United States Patent 7,960,612 (PLANT QUALITY WITH VARIOUS PROMOTERS) - sequence listing, part 3

SEQ ID NO: 6559 - DNA, 1426 bp, Zea mays
  Predicted polypeptide sequence is orthologous to G4
gcacgcgttccagttgtagggaagggccaagggaaacttcaagatagtatggcgaagaactatcgagagcgccgcttaaagagggcgatgaagatagatgagggagaggacgactttgaagctgattaccaagcattctctaagaagtacgatgagaaggatgagtgccactataagttcatggctttattaccattcaagaatggtcttcctaatgtctcaccgccaacaaaagagaaagttggacttcattttgccatgaaagatgttgtgattagtcaaaaaccaaccaccaccaatgaaggtatcattgtaaggccgaagtgcaagcgaaagaccccatataggggcatccgccgacgcccttggggaaaatgggctgctgaaatccgcgatcctacaaagggtgttcgtgtttggttaggcacgtataaaacaccagaagatgcagctagagcatatgacgctgaggcccgcaagattaggggcaataaagcaaaggtgaatttccctaatgaaccaccaaacatggtgagcaatgcaccaaaactaattgttactgcaatgactacaatggctatcccagcagacaagttgaatgccaatgaattgatgtgccataaaaactactcaaatgaggattttttctcaatggtgaactttagtggaaacaatggtaactttatttctactgcggcctttggcttacaatgtatcaaaaagcctcgtgttccttatgacatcccaaggatgggtgagtgttcaaatcaaaacagaatgacatatggtttaagtaatggattgggcaatgaagctagtaggaacctgaatggatgctctttcttaccacaagctggcatgccaattttcattcaacctacttttgatggtccttcaaggatgataggaagaaatgatggcgtgattgttcctactttgactaatgcaacacccatggctggtgttgatgctgcgaaaaagatgaatcaacaacctattttccaagagatggaaagtgaagatattccttctattttgcaaggtgatgtcagtgaggacgtggcagctgagattagtatgtgggagttttatgacaccctattagataataaggaaaattgatggatcttgacatcatgcatggtccatatggcttctgtcttgatgatactagcaagtggttcgaagcatgcatgatggggatgtagtcgcaaatgacatattcgttttataatgtcaagtaaaatgcagccatttgttatccatgtgtatcagtttggactgtttatttatgctttgttgtaagcttacaggcaacggaacctgattgacattgtgggtgttattgtaatgtattgataattttcaatccaaaaaaaaaaaaaaaaaaaaaaaaaaaaaaaactagagggggggcccggtaccc

SEQ ID NO: 6560 - DNA, 885 bp, Zea mays
  misc_feature (8)..(8): n is a, c, g, or t
  misc_feature (13)..(13): n is a, c, g, or t
  misc_feature (766)..(766): n is a, c, g, or t
  misc_feature (825)..(825): n is a, c, g, or t
  misc_feature (856)..(856): n is a, c, g, or t
  misc_feature (864)..(864): n is a, c, g, or t
  Predicted polypeptide sequence is orthologous to G4
tacctgtnccggnattcccgggccgacccagcgtccggtctctacccccatctgtagtgcggtctgcggccaagcagagcccggggaaacgatcgagacgatatgtgcgggggagcgatccttgccgaactcatcccagcacgggtgcaccggccgctgaccgccgccacgctctgggcggcggccctgagtgggaccactaccgtcggcaagtggaaggccgatgcagccgccgctaccgacgacgacgacgacgaagagttcgaggccgagttccagcttttcgacgacgatgacgagtgcgaggccgagttccagcttctcgacgaccaccaaccatctcccgcagcttcgcctgaggccagcggctgcaagcggaagcctgcccttgctcctcctgctggtgcccccgcttccacggatccggcgaccccgtgctccaggaagtacaggggcgtccggtaccgccggtcaggcaggtgggccgcggagatcagggacccgcggcaggggcgccgcgcctggctcggcacgtaccgcaccgccgaggaggccgccctggcgtacgaccgcgaggcccgccggatccgcgggaagagcgcgcggctcaacttcccgctgctcatcccgcacgaaggtcccggccgtcacgcgcgcacgccggtggccatcgacctcaacttgccgcccgtctccgacggtctcggcgtcccggctccggctggcgtcggcgacgacggcacggcgaatgccgacggagatgcanatatggccagtactaagactcagagcacgctagcgcgggtcaaggaactgatcgcgcangacctcacaacatcggctggcggcaagatcntgcctganctgatgatgcacgggagcagg

SEQ ID NO: 6561 - DNA, 889 bp, Zea mays
  misc_feature (654)..(654): n is a, c, g, or t
  misc_feature (741)..(741): n is a, c, g, or t
  Predicted polypeptide sequence is orthologous to G4
agccatagttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgngaagcacctgcttggcaccttggggtagcatatgctcgtgtctagctcagatgcagaagtcgcattctgaaactctttggttatcgnacctgtccctatttaactatctctgtatgagagccatttatgagactgaacccatttaccattttgttttcccccttcttttcgtgtacagtatatggttaacattatgaattatggatatgtgccaaacatgcctttaatatgcgcc

SEQ ID NO: 6562 - DNA, 866 bp, Zea mays
  Predicted polypeptide sequence is orthologous to G4
aaaacttgtcgaaaaatacacagggcacaatgtgcggaggcgccatcctcgcggagctgatcccgccgacgcggcgcgtggcgtcgaagccggtgacagaaggccacctctggtcggcgagctccaagaaagccggcagcggcagggacaagaggcaccagcacgaatacgccgacgatgacttcgaggccgccttcgaggacttcgacgacgactttgacgtgcatgaagacgacgaggacggccacttcgtattctcgtccaaatccgccttgtccccagccctgcacgacgggcgcgcggcgagccagaagaagcagcgcgggcgccagttccgcggcatccggcagcggccctggggcaagtgggcggcggagatccgcgacccgcacaagggcacccgcgtctggctcggcaccttcagcaccgccgaggacgccgcccgggcctacgacgtggaggcgcgccgcctccgcggcagcaaggccaaggtcaacttccccgcagccagcggtcgcgctcgcggtcgcgcgcgcccacgccgcggcgacgacggcaacccacgaaccgcgccggaaacgcagcacccagcacagcccgctctgctgcctcgaggagagagagagacgcagaggaaggaagggatcgccgccgtgaagccagaagctacggagtcgttcgacgtgggcggcggtctcttcttcgacatggccttccccaccttcccagcctcgccgccgccgcaggccgtggatacgtccttcgccggcagcaccgccacgtcggagaccgggagccccgcgaagaggccgagatgcgacgaagactcgtccgagggcggcagcggctcggcgctggagctcgct

SEQ ID NO: 6563 - DNA, 880 bp, Zea mays
  Predicted polypeptide sequence is orthologous to G4
cagccaaacacacgcgaagaaaaggagatagagtacaggttacagacaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgctttcgtcgtccgcgcctcgtccgcggcgacgcagcccagggcgcgccaggagcagcggagccggcgccgggcgcccgaccagcagtacaggggcgtccggcgccgcccgtggggcaagtgggccgccgagatccgcgaccccgtcaagggcgtccgcgtctggctcggcaccttcccttccgccgaggccgccgcgcgcgcctacgaccacgccgcgcgccacatccgcgggcccagggccaagctcaacttcccctcctcctcctccgcctccgctgccggggcccccgccagccgcaagcgcgcccgcgccgccgacgccgacgccgacgccgtcatcgacctcgaggaacaagagcagcgcccggccgcggcggccctgaagcacgaggccgccgagtgctccggatccggcgcgctcccggacttctcgtggcagggcgtgtcggcagcgtacgacgaggcctcggcgccgcgcccggccttcgacttcgaggcgcggccggagagcgccgcggacgaggcgtcgcccctggcctccgactccgagtcggacgcgctgttcgactcgctcctcttcggcgaccagttcgccttcttcgacgccggcgcgtaccagtcgctggacag

SEQ ID NO: 6564 - DNA, 2229 bp, Zea mays
  Predicted polypeptide sequence is orthologous to G409
atcccccgggctgcaggcaacgtttctctcctctcagcgcaaaaagatagatcctctgctctaccggcctaccacgttcgtctcccgcgccggccacccaccgctgccaccgagggtaaaaccgtcaacccgccttgccccggcgcctataagaagttccctctccatttcttcaaactttagttccagagccctccagagcaaaaaaaatatattatcgaatactaaagcattttcctcgtcgatagaatatagaattttaaaaagggagcgaaataggtttttcctttttgcagctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactagtctcggattaagcgataattaaggcaaagaatctccaagtttgcttcgctcttgcattgaaccatggagtctggacggctcatcttcaacgcgccgggctctggcgccgggcagatgctcttcctcgactgcggcgcaggcggcggtcccggcggcggcttgttccatcgaggcgggagaccgatgcttggccttgaagaagggcgcggcgtaaaacggcccttcttcacctcgcccgacgagctcctcgaggaagagtactacgacgagcagctgccggagaagaagcgccgcctcaccccagagcaggtgcttctgctggagaggagcttcgaggaggagaacaagctggagccggagcgcaagacggagctggcgcgcaagctgggcctgcagcctcgccaggtggccgtctggttccagaaccgccgcgcccggtggaagaccaagcagctcgagcgcgacttcgaccgcctcaaggcctccttcgacgctctccgagcggaccacgacgccctcctccaggacaacaaccgcctccgctcacaggttgtgtcgttgaccgagaagctgcaagagaaggaggatgcgacggagggcggcgccaccgctgacaccgccgcgccggcggtggacgtcgaggcttccctggccgacgacgtcgaggagccagcagagcctgcggcgacgttcgaggtgctgcaggaggtgaagtccgaggacaggctgagcaccggcagcggcgggagcgcggtggtggacgcggacgcgctgctgtacggcaggttcgccgcggcagttgatagcagcgtggagtcgtacttccccggcggcgaggaccactaccacgactgcgggacgatgggccccgtgaatcatggcgccggaggaggcatccagtcggacgacgacggcgccggcagcgacgaggggtgcagctactacgccgacgaagccgccgccgccgccgccgcgttcttcgccggacacgccacccaccaccacgcggacgaggacgaggacgccggccagatcagctggtggatgtggaactagacgttcgatcttcccacgccgatcgatcgaccgtcttcgaatcctgtgtcaacaagaagaaaaaagaatcgtgccgtgatttttctttgcgcaacgctgctgtaagcctgtaatggtgaatttctagctatggttatgccgttatgaaggaagaaagtgtatgcatgcatggtagggtaaagagtgggtaattaatatcgttgatcatcccagtcactcgtggtgttccagaagatcaatggagttgggggagaaataagtgcgcatagaggcaagtactactctttttatggcacagtgcctatgtcaaatcagggtgttattaccagttggttttttttttaaaaaaaatactgtactattacgcattttcgcatgatttagctgtgagttctgcacagtgaaactgaaacagctagtgtagtgtattaatgaatggaacagtgccccccaaaaaaaaaaaaaaaaaaaaaaaaaaaaaaaaaaaaaaaaaaaaaaaaaaaaaaaaaaaaaaaaaa

SEQ ID NO: 6565 - DNA, 1227 bp, Zea mays
  Predicted polypeptide sequence is orthologous to G409
gcacgaggagttttttttttttttttttccatgtctttgacttgctctctccgtattattaggagtaactgcaatgctcaagctcaacatcagggacaccgtgtcaattgtgggacacgattgttggtaaatacactctctacagttattacgcggtactgcactacactctgggtatccactcgtgcccctgtatgaagctggcgacgctgtacgcgtcgacgtggaccttgggaacctggctgctccacgccaccctctggcccgcggcgccgccggggccggcgctgtcgaaaaccaaaaaaataataatcccaaattaaagaaaaggagcagaagaaaaacaactttcatcgccgtccgccaccggagctcacttcgtcggtctatccctcagtgtcaacccccttctcagaagttctaattgcacctcagtccctggccggtctgcccggtcgccgcctcgccggaggaagcccctcgtctccttgccctgcggcgggttcatggggttctcgctgtaccccatgaagacgtccacgcggttgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcct

SEQ ID NO: 6566 - DNA, 737 bp, Zea mays
  Predicted polypeptide sequence is orthologous to G409
cttttttttttttttttttttttttttagggatgaaataaaacatcttctcgatgataatgaagacatggaacatccgtatctaacaaggaatcaagtacagaaccaacaggtaattaataaactttataagaaccatgttcgtttgatcaagggtgatatatatgacatttaaaaccagcaaatttagtcaactttgcactcctagccatatgcgtgcatcccctaatactgccgatcgttccatacccatgcccagttgttgagcagggcgtccggggggaagaagaaggcgcggtcgtcgtcctctggcgacgacggtggcgagcgcgccccggcgaagtacgactccgggctgtcgttggtccctgccgccgccggcgctgcagcgctgccggagcagagcttgtctccttccaagacagcgtaggctgtcgcttgggcggcaactgtctgctctccaggctctgccgccgccgccgccgactctttcgtttgcagtttctcagttaacgtgatcacctgtgagcggagacgatcgttatcggcgaggagcgcgtcgcggccggcgatgaggtcgtcgtgcgcggccctgaggcggtcgaagtcctgctccagctgcttgctcctccaccgcgcgcggcggttctggaaccacacggccacctggcgcggcgcgatcccgagcctccgcgccagctcgctcttccgctcgggctccagcttccgcttgggctc

SEQ ID NO: 6567 - DNA, 869 bp, Zea mays
  misc_feature (680)..(680): n is a, c, g, or t
  Predicted polypeptide sequence is orthologous to G409
caaagaaaaaacaaataccggatagatattaaagcattttcctcgtcgacttaaaaaatagaacaaaaaggttcttccttttcgcagctccatcgtccaccaacctcctccgattcggccgtcgtagcgtatagccgaattgccccactccaggactctcgccagcttctccggccgactagaggctgtttccggcgagtgctcggctgatctcctccgcgcggctgaggagatcacgcggtctcgctcgggggggctggggcgtgcatgatgggactttggttgattccgacgatggagactccggcgaggcttctgtggagcaccagcttcttccgccacaaaatcgccgacatgcttgcatcctcctcctgcttcttatagatcccacccctcgacgtcgtcgccggcagctagctcgctagcttctgtacatacgtcgacgccatatctagctagtctcttcatccagtcccgataagtgataactaataattaggagcttgcttcgacgaccttgcattggtccatggagtccggacggctcatcttcaacgcgcccggctccggcgccgggcagatgctcttcctggactgcggcgcaggcggtggtcccggcggcggcttgttgcatcgaggcgggagaccgatgcttggccttgaagaagggcgcggcgtanaacggcccttctacacctcgcccgacgagctcctcgaggaggagtactacgacgagcagctgccggagaagaagcgccgcctgacgccggagcaggtgcacctgctggagaggagcttcgaggaggagaacaagctggagccggagcgcaagacggagctggcgcgcaagctgggcctgcagccccggc

SEQ ID NO: 6568 - DNA, 1547 bp, Zea mays
  Predicted polypeptide sequence is orthologous to G428
catccccaacctctctctctcccccctaggagtgggagctcctggctccatctatccgcctgcagatatcacaagcttttcctgctgctgctgctgcagcagcacctgcagcttctccgtctgcagtgcgagcagctgctaaaaattcccccataagcctctggcttcctgcccccctcactttcttggaagcccagcacaacacgaggatcatattcactccctacagtggcgtactagaataccagttgtgcgcaaacagcggcagcagccgtgatgtacaggtgagctggctctgccgctccactccatggaggatctgtacagcatccacccggggatctcgcgggtcgtcggaggcgcggcgagcgaggcgtccgtcgccggcgccggcgccggcgggccctcgccgtcggatctgacggagctcatgaaggcgcagatcgccagccaccctcgctacccgtccctcctctccgcctacatcgagtgccgcaaggtgggagcgcatccgcatgtgacgtcgctgctggaggaggtcagccgggagaggcgccccgacgccggcgccggggagatcggcgtcgatcctgagctcgacgaattcatggacgcttactgccgggtgctggtgcgctacaaggaggagctgacccggccgttcgacgaggccgcgtcgttcctgagcagcattcaggcgcagctcagcgacctctgcagcggtggaagctcgccggcggctaccgccacgcactccgatgacatgatgggctcctctgaggatgagcaatgctcaggggacactgatgtgccagacatggggcaagaacatagctctcacttaggtgaccacgagctcaaggagatgcttcttaagaagtacagtggatgcctcagccgtcttcgttcagagttcctgaagaagcggaagaaagggaagctaccgaaggatgctcggacggtgttactagagtggtggaacacgcactaccgctggccttatcctacggaggaagacaaggtgaggctcgcagcaatgaccggtctcgacccgaagcagatcaacaactggttcatcaaccagaggaagaggcattggaagccatctgaggacatgcggttcgcgctcatggagggtgttgccggtgggtcttctgggacgacactctacttcgatacaggcacaattggaccctgaatcatacaccacttgggatgacaactggccagctcatattagtaataagatctggcatgtggagtgacgatctgctcggtgaaaattgaaaataaatctgctgagctgaggttgatcagactagtcagttgccctattattttacaagatcatgtgtatatggtgccgtcgtatcagaacaaactgtatgcatgtatgggcgaattgagacctgcaaaaggagtttaattagtagtttcaagtattggctcatggatttgtaatactcgctacccaatttaattgttagataggctgaagggcttataaaggtaaatttacttctgctaaaaaaaaaaaaaaaaaaaaa

SEQ ID NO: 6569 - DNA, 1447 bp, Zea mays
  Predicted polypeptide sequence is orthologous to G428
ggcacgagagagagcagccgagccggttcaaccccatgaataccgctgctgcagagatcacggcctgcttctgcgtctgcagctccagcagtagcaacagcaggggctgcagtgcaaacgactgctagttcccctttccccgcatgatctctgccccttcccctaccttctcttgttcttgcttgcacgacccttttccttgtgcgctagtgccgcttcttcttcgtcttcctggagctccccgcatccacacatgccccaagaaccagacaataaaacaacacggaaccatcggagtctttttctactactatttccagcgatttgattatatggatgtgtgcacaggtgcacgtagataggtagaatagaagggagattatagctagctagaggcagcgagcagctcggttgctgggacacgcgatcgagctacagcaaagaagactgcagggtggcgcggcgggcatggaggatctgtacagcatccacccggggatctcgcgccacggggcggcggcgactagcgaggcgtccggggtcgccggtggaccgggctcacccccgcccccgcccccgccggcggcggatctgacggagctggtcaaggcgcagatcgccgggcacccacgctacccgtccctcctctccgcctacatcgactgccgcaaggtgggcgcgccgtcggaggtggccacgctgctggaggagatcggccgggagaggtgcgccgccgcctccgccggcggggaggtcgtcggcatggaccccgagctcgacgagttcatggagacgtactgccggttgctggagcggtacaaggaggagctgtcgcggccgttcgacgaggcggcgtccttcctcagcagcgtcaggacgcagctcagctccctctgcggcggcgccgcctcgctctccgatgaaatggtggagtcctctgaggacgagccatgctcaggcgacacagacgcgacgacagacccagggcaggagcacagctcgcgcctggccgaccgcgagctcaaggagatgctgctgaagaagtacagcggctgcctgagccggctgcggtccgagttcctgaagaagaggaagaaagggaagctgcccaaggacgctcggtcggcgctgatggactggtggaacacgcactaccgctggccgtaccctacggaggaggataaggtgaggctggcggccatgactgggctggacccgaagcagatcaacaactggttcatcaaccagcggaagcggcattggaagccgtcggaggacatgcggttcgcgctcatggagggcggcgtctccggatcctcctccgggacgacgctctacttcgacacgggcaccatcgggccgtgatcgatgcgatagatacctctgacgaattgggggcaaattgttggttgatactgagattagttacatgaagcaatatccgctg

SEQ ID NO: 6570 - DNA, 1094 bp, Zea mays
  Predicted polypeptide sequence is orthologous to G428
cacgagagcagcttggttgctggggcacgcgatcgagctccaggcaagaagattattgcaggaaggcgcggcaggcatggaggatctgtacagcatccacccggggatctcacgcgccgggggcgccgccacggcggccagcgaggtgtccggggtcgccggcggaccaggctcgccccctcccccgccgtcgcagccccctccgccgccgccggcggatctgacggagctggtcaaggcgcagatcgccgggcacccgcgctacccttccctcctctccgcctacatcgagtgccgcaaggtgggcgcgccgccggaggtggccacgctgctggaggagatcggccgggagaggtgcgccgccgcctctgccggcggggaggtcggcctagaccccgagctcgacgagttcatggaggcgtactgccgggtgctggagcggtataaggaggagctgtcgcggccattcgacgaggcagcgtccttcctcagcagcgtccggacgcagctcagctccctctgcggcgccgccgcctcgctctcagatgaaatggtagggtcgtcggaggaggacgaagcatgctcgggaggagacacggaggcgacggagccggggcagcaggagcacagctcccgcctggcggaccgtgagctgaaggagatgctgctgaagaagtacagcgggtgcctgagccggctgcggtccgagttcctgaagaagaggaagaaagggaagctgcccaaggacgcgcggtcggcgctcatggactggtggaacacgcactaccgctggccgtaccctacggaggaggacaaggtgaggctggcggcggcgactgggctggacccgaagcagatcaacaactggttcatcaaccagcggaagcggcactggaagccgtccgaggacatgcggttcgcgctcatggagggcgtcaccggcggcgggccctcgtccgggacaacgctctacttcgacacgggcaccatcgggccgtgaccaccacactaccagcttgggcaacgcaaagtgcatacgtttttctttgtgtatatgggcgacaacgtgtcggtaggtacactcagcatactgg

SEQ ID NO: 6571 - DNA, 1116 bp, Zea mays
  Predicted polypeptide sequence is orthologous to G450
cgcttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtacccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagggggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtcctccacacggttgctttgccatctcggtggttttgtggtggtggtggtggtcgtgcttcctataggtgtgaggctgatggcgtggctgccatttatacaatctttaatcgtgttttgttgagctttt

SEQ ID NO: 6572 - DNA, 1519 bp, Zea mays
  Predicted polypeptide sequence is orthologous to G450
ccacgcgtccgtcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgtgctggctgaccccgccgagaagccgcgcgccgccaaggctcaggtggtgggatggccaccggtccggtcgttccggaagaacatcatgtccgtgcagtccgacaagggcgccggcaaagacgccgccgccgccaacggcgacaagtcctcggcggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcaccaagggccatggagaaatgcaagaacagaagctgaggagaagaccgacggacggaagcttgcatctcagcaccaccaggggtggatggatgcaagaagaacaaatctccatggcttttgaagctctgctcgtctctgtatcatactcgtcgtccctgccctccaggcctctgtatctccctgatcaatgaagtcgttttggtgtgtcaactgttctctccgtgcccagcttgtcagtgaaagagtcagtcagtgtctatcaagtctcatcttgtcctatacagaagagagaagccatgcatgaacatgtacctgtcctataacaatgtctttttttgctacctgttttttctctttctctctctttttttttggcacaagatgcaaaggcaccctgctcctgatcaaagggccttttgcatcataagctgtttgattataattaccatggtgtgtcagtggaacaaataactgttgcaaggtgttaaaaaaaagttgtattgtaatatgatcacctctcttccttgttgttttcaaaaaaaaaaaaaaaaaaaaaaaa

SEQ ID NO: 6573 - DNA, 642 bp, Zea mays
  Predicted polypeptide sequence is orthologous to G450
aatgaacatgtattgcattgtagttgcagcataaactgcgcaaagacacatcggcaaatctccaagataaacgttccagaaaacctgttcgtataagtattgtcacaagaggtaacccggcccaggtacaccaccaaactattgccttgtttcttaacaccaagtgctcttaaaaaacatcagcaaaaaagaagcttatactccgattaagaacatgtagcatcagtactcgaatcatcccagtagcttgagccgtttgacagaccttgcaaaatcatcccacggcacatctccgagcagcatccagtccccctctccgtcctcgtaggtgaccaccacgtccatatggctgctggtggtggtggcggtgatggcggtggacttgctgctgatttccttgtcgtcttggctgccggtggtggtcgggaacatgcgggcgagcgtggcgaggagctcgtcgtatgaggcgtggagcgacaggtccaccttcctgccgatggcgtcgccttccttcttcaccttcacgtacttggcggagccgccgccgcacgccctgctgcgcgcggagctcaagggcggccacccgaccagcggcctcttggcgccgccgcttctcccgccgcacgacgagccgtcgtcgaa

SEQ ID NO: 6574 - DNA, 850 bp, Zea mays
  Predicted polypeptide sequence is orthologous to G450
ctcctactccgctgcaaccccaaatctctccttcctcgcatacgcgcgcagcagaggagctgagaccaacgaagaagaagaacaaccgagcaagcacaagcttagctagcgtggaggtgcccaaggcgacgacggccgccgcgccaggctagccaaccagctgctcatcgctcctagctgcggagccgatggctggagccgacgtcgacgtcgggacggagctccgcctcggcctgccaggaggaggcgccgatgcggccaaggctgccaagaggggcttcgaggacaccatcgacctcaagctgaagctgcccaccgccggcatggaggaagctgccgctgccgccgccgccaagccggagccggccgccgagaaggccaagaggcccgccgaggcgccggccgctgatgccgagaagccacccgcacccaaggcacaagctgtgggttggccaccagtccggtcataccgcaggaacgtcatgaccgtccagtctgtgaagagcaagaaggaagaggagcctgagaagcagcagtccgctgccaacgccggcggcaacggctccgccttcgtgaaggtcagcatggacggcgcgccctacctgcgcaaggtggacctgaagatgtacaacagctacacggagctctccgttgctctgaagaagatgttcagcaccttcaccacatccggggaacacatgaatgagggaaaactagttgatccggtcagcggtgctgatgtggtcactacttacgaagacaaggatggcgactggatgctcgttggcgacgtcccgtgggagatgtttgtcgagtcatgcaggcgtcttgaggatcatgaagagctctg

SEQ ID NO: 6575 - DNA, 912 bp, Zea mays
  Predicted polypeptide sequence is orthologous to G450
caccgcacgcacgcactcgcctccgacagcgaccgcgcaacgtccttctcccgcgccgcccggccggccggtccctgttccctctcctcccctcggagcagcaggagcaggagcagccgcgttcgtcctctgcgctgcgcggcccgccggcctgaccaagcaaagcttatcggccggagccggacgaacgaacgatgcagcaggacctcagaaactcagagagaagaaacccggaacaggcgcatccagtgatgtcggcgagctcgaccaactccgcggcttccccggccgtgtccggcctcgactacgacgacacggcgctcaccctcgcgctcccgggctcctccgccgagcccgccgccgatcgcaagcgcgcccacgccgaccacgacaagccgccatccccaaaggcgcgggccgtgggctggccgccggtccgcgcgtaccggcgcaacgcgctgcgcgacgaggccaggctcgtgaaggtggccgtggacggcgcgccgtacctgcggaaggtggacctcgcggcgcacgacgggtacgcggccctgctccgcgcgctccacggcatgttcgcctcctgcctcgttgccggagccggagccgacggggcggggcggatcgacaccgccgccgagtacatgcccacctacgaggacaaggacggcgactggatgctcgtcggagacgtccccttcaagatgttcgtggactcgtgcaagaggatccgcctcatgaagagctccgaggccgtcaacctatctccgaggacatcatcccggcagtgattgttgttggtgtggacgccatatgccctacgcggcttatctctccgaattagttcacagagtgtgtgctggagaggcttggctgctcaggtcctccatgcacacgtcatacaccgtacgt

SEQ ID NO: 6576 - DNA, 696 bp, Zea mays
  Predicted polypeptide sequence is orthologous to G450
gattaacaaccctggaataaaatccccaagtaaattctgggaaacacgggaggggacatgacataacccccatccccctacccacggatatattattgcttctgggccatgaacgaattgaacaaaacaggtccccccccaactaataattaaaacgcgttatatttctagaaagaaaaaaaaaaacggcagcgcactggaaggggaccattcttctgaaacaatgggcaacatctttaacactgcatcttcttcagctcttgttcttgcacttatccttcgttcttggggcaaaacctatggcttcaaaactcttcatgatcctcaaacgcttgcatgaatcgacaaacatctcccccgggacgtcccccaccagcatccagtccccatccttgtcttcgtaagtagggaccacatcatcagcatccccggccggatcaaccaatcccccctccttcatgctgttcccagttgcggggacgaaggggcccaacatcttcttgagtgcagcggaaaggtccttgtagctgccctacctcttccggtccaccttgcgcagggagggcgcgccctccatgctgaccttcacgaaggcgttggcggcagcgggctgttgctgcttctcaggttcctcttccttcttgctcctcacggcctggacgacggtcatggcgttcctgcggtaccaccggactg

SEQ ID NO: 6577 - DNA, 1202 bp, Zea mays
  Predicted polypeptide sequence is orthologous to G451
cgcaagccaagcattctcacgctaagctgttctcttcttgcctcatccatcgtgcatctatattctcggcgcgagttacgtctttttcgtcgtccggccggcgagcattttgcttctgtgatcgatcggcgcgcgcgacgtacggccatggagatgatcgacgcagagctgcgtctgggtccgcccggcagcagcaacagagacgtcatcaacgtcgtgcagccttcgttggcggcggcgaaacggccgtcgtcgtcggtggtggagagcgaggcgtccgggacggacgaccatgaccatgacgacgccgcaccgacctccaaggtgcaggtggtggggtggccgccggtgagagtgtaccggaagaacgcgttccacgcggcggcggaggcgaggaggaccaggcggggcgagcagcagggaggaggaggcctgtacgtgaaggtgagcatggacggggcgccatacctccggaaggtggacctgcggacctacggcggctaccgtgagctgagggacgcgctggacgcgctcttcggctgcttctcctcctcggccgacggcggatgccagttcgccgtcgcctacgaggacaaggacggcgacctcatgctcgccggcgacgtgccatgggagatgttcatctgttcttgcaagaagctcaggatcatgagggggtccgaagcaagataaccaagcaacgaggatgcaaggacctgttgtatgcatatgcatggaggccggccggactcatgctgtcatgcatgagagtttgagagaggagaagaagacgacctactggaactgaaggcggttgggtatacctgcatggggagggagcccacgcatgcacgcgcgcgtcgtcgtgttctacggccagctagccaccagaccggctgccggcccatatgcacaccacggagatggaggtgatggttcaaggatcacggcggcgtacgcgcgcgtcatcagtcacgccgtcctgtcatcagatgagatggaggggtgatgcatgagggcagtgctagctgtggacggctggctggacgtgcagatcggagcgagattgtactgtgcacgcacataagctttgtacagtggcatgtgctggtcatctgtaattttgatttttttccccctccttttgtaagtgagcaagtttgaggaaaaaatgtatgaatgaagaaaaggagagggggatt

SEQ ID NO: 6578 - DNA, 1176 bp, Zea mays
  Predicted polypeptide sequence is orthologous to G451
cggctcatcatcacattcgcatacatctcttctagcacgcaaagatcgagctatagctagctctgcaacaagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcagcggccaaacaggaggcggcggcggcggcgcccggctgcacggcatcgtcagcagccgccacaaacaccaccagcagcagcagcgccgccgtcgtcgttggctccttcgtcaaagtgagcatggacggcgccccgtacctgaggaaggtggacctgaggatgtacaggggctacagggagctccgggaggccctggaggccttgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcaacaatgaagatctcatctgatctatcgagaggacctgcatgcccggcaacaacacgtcgatcgatcgtcatggccttattaattgtttctttctttcttttcttttctgtttaattatttttgttgttctggttggcgccgccgtggatcggagggatccccaagccgaaggatgagcttggctggcgcatcgaagcgcatgcaacggatgtgtgcggctttggttctgtaataagacaaccaggggtccttttttcgatctgttattagcggcacaaaaggagctagatgcatgctgaggttgtttcagttcactctccatgtgtgtctgtacaaacgaaacaatacagttatattttgatcgttgaa

SEQ ID NO: 6579 - DNA, 715 bp, Zea mays
  Predicted polypeptide sequence is orthologous to G451
acgtgggtgcggctgcacccctagaatgaactaatatacatgggcccaggtcacttacaaaagaggaactcaaagttacagacaggctagcaagcacaagctagctatgaaactacagcatatgagctagcgtgcacagtaccaaaaaaaatcctaggtagtagcttttcaccgatgctactacttggctgaataatctccgatctgccatgcatgcacgtccagtcagccgtccacagcagcacgtccgcctgactgatggcgggagacacggcgtgacgcgtactacgccgccgtgatccttgaaccatcacctccatgcagccatgctccatctgatcatgtgcatgtccatggtgtgtatggtcgtatgagccggccgggctggccgtagaacacgacgacgcgcgcatgaatgcattggggcctccctgctgtgcaggtactataccctacgcatgcgcctccaattccattggatgaccgatataaagacctccctttttctctctctctctctccccctctgtcccatactcgcatgcatgagttggacggaccgtagctagctggactggacctccatgcaagccatgcatccaacatgttctttgcatcctcgatgcgttggttatcttgcttcggaccccctcatgatcctcagcttcttgcaggaacagatgaacatcctgagagagagagaacccaacacaat

SEQ ID NO: 6580 - DNA, 990 bp, Zea mays
  Predicted polypeptide sequence is orthologous to G451
gaattccattgtgttggcaaggaccaagacagagcacagcgcagctcgtcggcctctcgacgccggttgctgcaaccaccgcctttattgcccacgcgggccgtgcggaagaagcaagaagacacgccaatggaggtcgccgcagcatcggcagcgagctacggattcaaggccgacgacgacgttgacagcctcagggcgacggagctcaggcttggcctgccgggcacggaggagaaggaggaggccgaggagccccagcacaaggcggccccgccgccgccgtccacgcccagaggcaagaagcgcgacgtcgtcgccagcagcgggcccgaggacgcgcccaagaagcgcgactgcgagaccgacgccgacgccgacgccgcgccgccgccggccgccaaggctcagctggtgggatggccgccggtgaggtcgtacaggaagagctgcttccagcagcaggcggcggccaagaacaagccggcgacagcgttggcggaggaggccccggccgccggcgggctgttcgtgaaggtgagcatggacggcgccccctacctcaggaaggtggacctcaagatgtacaagggctaccgcgagctgcgggaggcgctggaggccatgttcctctgcttctccggcgccgccgacgcgcccgccgtcaacccctccgacttcgccgtcacctacgaggacaaggacggcgacctcatgctcgtcggcgacgtgcccttcggcatgttcatcagcacctgcaagaggctgaggatcatgaaggggtcagaagcgagagggctcggctcggccaagaacgactgatgatgagacgtctatcgcagccttgtgctgtgcgtgcgtgcatgcgccagcaaattcttttggtcttttggggtcttatttcttctccaagcgtccctgcatgggtgtgggcgtgtggtgttgagtattatgtaccctctcccctaacattgtctgccaacaatggag

SEQ ID NO: 6581 - DNA, 865 bp, Zea mays
  Predicted polypeptide sequence is orthologous to G451
cgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgccagagacctcgacttcgaccacgaccacgacaccgccgcgcctcccaaggcgcaagtggtcgggtggccgccggtgagggcgtacaggaagaacaccttccaggcggcggcggcggccaagaaggtcgagcagaagcagaagcagcagcagcagggaggcctgtacgtgaaggtgagcatggacggcgcgccgtacctcaggaaggtggacctccggatgtacaaggggtacagggagctcagggaggctctggacgcgctcttcaccaactccttctccgcggcggcagagggcggcggcgaccaccaccagcacgccatcgcctacgaagacaaggacggcgacctcatgctcgccggagacgtgccctgggagtaagtacaccgtcgggttcggatcagcaagcatgctgctccgttctgtggatctgaggatacgtttggtgaacagaagcctgattaattgtgattcttaatttcaccccctttgcagtatgttcatctcttcgtgcaagaagctcaggataatgaagggctctgcctctgaggccaggtgatcgctgatccatacataaacagaggctacagacacgccacctgggaacgcggatccaagagcacacccggatcgtacttgacgagg

SEQ ID NO: 6582 - DNA, 881 bp, Zea mays
  Predicted polypeptide sequence is orthologous to G451
ccagctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgccccgccgccgaggaggaggaggcaaacaagcgcacgcggaggcagcacccccggcggccaaggcgcccgtggtcggatggccaccggtgaggtcgtaccggaagagctgcttccagcaggcaaagcagcaggccgtcagcagcagcagcaaggcggccgacaaagaggatgctgcggcgccggcgcccagctgcacggcgtccgcagccgcctcaaacgccaccgccagcgccggggccggctcattcgtcaaggtgagcatggacggcgccccgtacctgcggaagctcgacctgaggatgtacaaggggtaccgggagctccgggaggccctggaggccatgttcgtctcctccggcagcgccaacaacaacaacaacctgtcggagttcgccgtcacctaccaggacaaggacggcgacctcatgctcgtcggagacgtgccgttcgagatgttcgctagcacctgcaggaagctgaggatcatgaagagatctgaagccacaggcctgggatcggcgagacaatgaagaaggtctgacgacgaccgagggcccgacaacgttcatgtcgatctcttctttttttttctttttgccccattattttattttgttcttcttgtccgagagac

SEQ ID NO: 6583 - DNA, 713 bp, Zea mays
  Predicted polypeptide sequence is orthologous to G519
aggaagtgatagtgcacagctacgcatacacatctaccgtctgcgcaggaagtgaaactaaagaatgagccagcgccaagccaaagaccgggccggctcccatgtacgaaacaccgacacactcgacttgtaaccccgaccaggttcagtcaggttcgactcctagtcctatgctgtatttacagagttcgcaacgccgtccgtcttctctcctgacctccatcctcgcctgagctcactcagaaggggcccaagaccccgcggctccggtgggctggttccccctgaccctgggcgacgcgaagagcgaggagtagaagtcctcgccggccggcggcagcatgtcgaggccgctgtacatgccctggatgtcgtcgtagctgagatccacgaacaggtcgctgctcctggcgctgccgccggcgtccagcgcctccttcttkggcacatcatcgccggcggggcggyatcgttgtccacgatctccgactccggcgtgcgcgtctcgccccacgagtgggtctgcgagtgggagatgctcacgtccatggcctcctcctctttggctgcgcgagtgacgccggcggctgcccctttccccagccgcatcttctcccactcgttcttcttgttgtacagccggcacagcacccagtcatccaacctgagcgaccccytcttagcgcgtccgccggggtcagcgagcctgtact

SEQ ID NO: 6584 - DNA, 1022 bp, Zea mays
  misc_feature (484)..(504): n is a, c, g, or t
  misc_feature (565)..(589): n is a, c, g, or t
  misc_feature (796)..(836): n is a, c, g, or t
  misc_feature (880)..(919): n is a, c, g, or t
  Predicted polypeptide sequence is orthologous to G519
aagagccaacacagctacaatatatactgtaaaatatatattgtaggagtaagtacactcgaagcttggcgatgacgaatatggcctgcactacctaccaccagtacggagactgcaactacaagcccttacaaaattactagtacttattagtataataactaatcaatgaaggaacagaaaccctgcactgaaccaatcatgtacagtatgtatatgtacagccacacacacacatgccgcgcacgatccaccacacccgatgcactgcgccatccgtctccgtctccgtctcacttccgccggggccagacggtctcattgccgcctctccatgtaatccagctatagtttcatattatatcctccttgcaagtcaacaatggcggctcgcctgagtcaaagcccacaccgtgcggttgcattgcattgcgctgcccaagacagatcaatcaaccaaccaaccgcagccgaggatgcttcnnnnnnnnnnnnnnnnnnnnnaacatgatgggcggtgtcgtctagaacggcttgccccagtacatgaggatgtcctgcagcnnnnnnnnnnnnnnnnnnnnnnnnncgacggggtcgagcatggagcccgcggggttcacggggtcggaggcgaaggtccgctcccactcgctgatcttgggctggctctgcacctcccggtcgcacgccagctgctccggggacagcacctgctccgagcagctggagtagtccgcgtgcagccgcggcatcgagtccgacggccggtcgtagtacgccgccagctccgggnnnnnnnnnnnnnnnnnnnnnnnnnnnnnnnnnnnnnnnnnctgctccggcggggagctcaccgccgccgtggcgaacacaggcnnnnnnnnnnnnnnnnnnnnnnnnnnnnnnnnnnnnnnnngcccgccgcccttcttgttgtagatgcggcacaggacccagtcatccaacctgaggctgttcttcttgcgcgccgagcggtcgacgtcggcgaggcggctcgt

SEQ ID NO: 6585 - DNA, 1141 bp, Zea mays
  misc_feature (1084)..(1084): n is a, c, g, or t
  Predicted polypeptide sequence is orthologous to G519
gcacgaggaacccgcccacaggacaggacacacagagccgagccaccccacccaccatcggcgaccagcagccagccgcgggagcgagctgtttaaagacaccgagtcggagtcggacggaggactggcaggcacaaccgaagccaccgcttctagttctcgggttcatcgccagcaatccagaccacataatgggacagccggtgacgaggaggagggagagggacgcggaggcggagctggacctgccgccggggttccggttccaccccacagacgacgagctggtggagcactacctgtgccgcaaggcggcggggcagcgcctccccgtgcccatcatcgccgaggtggacctgtacaggttcgacccgtgggacctgccggagcgcgcgctcttcggggcccgggagtggtacttcttcacgcccagggaccgcaagtaccccaacggctcccgccccaaccgcgccgccggcgacgggtactggaaggccaccggcgccgacaagcccgtcgcgccgcgcgccgccgccgccgacgcccgcacgctcgggatcaagaaggcgctcgtcttctacgccggcaaggcgccgcgcggggtcaagacagactggatcatgcacgagtacaggctcgctgacgccggcggacgcgccaagaaggggtcgctcaggttggatgactgggtgctgtgccggctgtacaacaagaagaacgagtgggagaagatgcggctggggaagggggcagccgccggcgcagtcaaagaggaggaggccatggacatgagcacctcccactcgcagatcacccactcgtggggcgagacgcgcacgccggagtcggagatcgtggacaacgacctgccgttcccggatccggcgatgatggtgcccaagaaggagcgggtggacgacggcggcagcgccaggaccagcgacctgttcgtggatctcagctacgacgacatccaaggcatgtacagcggcctcgacatgctgccgccggccggcgaggacttgtactcctcgctcttcgcgtcgcccagggtcagggggaaccagcccaccggacccgcggngttgggccccttctgagtgagctcaggcgaagatggaggcatggagatcaggagaga

SEQ ID NO: 6586 - DNA, 815 bp, Zea mays
  Predicted polypeptide sequence is orthologous to G519
acgctcgggatcaagaaggcgctcgtcttctacgccggcaaggcgccgcgcggggtcaagacggactggatcatgcacgagtacaggctcgccgacgccggccgcgccgccgccgccaagaaggggtcgcttaggttggatgactgggtgctgtgccggctgtacaacaagaagaacgagtgggagaagatgcagctggggaagaccgccgtcgccggcgtcggcgccaccaaggaggaggcgatggacatggccacctcgcacacgcactcccactcccaatcacactcgcactcgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgccgcccggggaggacttctactcctcgctcttcgcgtctcccagggtcaaggggaaccagcccgccggagccgccgggttgggacagttctgagctgaggcgaggatggagccatggatcaggagatgaagacggttgcgaactctgtaaatacagcataggagtcgaacctgaccctgacccttgttggggttacaaggttttccgagtgtcggtgtagcgtacatggagccggcggcgcggccgggccggctcattctttagtttcacttccaaagcagacgggtagatatatgtgtagctgt

SEQ ID NO: 6587 - DNA, 771 bp, Zea mays
  Predicted polypeptide sequence is orthologous to G519
acaaaaatcccagtaccaaatcaatcgcatataaacagtttaattcaactcgtagcagcaataatcctgtagtccagctccatgatcattcacaagccgacatggcctcatcgccggcggctcggaccagtcatctttctcagtacggcttgccccagtatgtgaggatgtcctggagcagcgggtcgccggcgggcagccctacccccaccgccgcggagccgagctgatgcccgccaagccccagcatcgagccggccgggttgattcccgggccggcgccggcggcgaaagtgcgctcccactcggcgatcttgggctggctctgtacctcaggccgctcgccgccgccgccgccgcacgacgacgtggcggccagcgcgtggcccgagcagctcgagtccgcgccgtgcgcccggggcatcgagtcggacggccggacctcgtagtacgccgccagctccgagaacggcagcggcgcgtaccccgtcccggccgcggccgttgccgttgccgtggcagacggcagcacggacggcttctgctccggcggcgagcccatggacatggaccccagcgcgccctggctgctggcctcggccctgccgccggctccggtcggcttctccagcgcgcctttcttgttgtagattcggcacagcacccaatcatccaacctgaggctgttgttcttcttgcgggcggtgcggtcgacgtcggcgaggcggtactcatgcatgatccagttggtcttgtcgcccttgggcgcct

SEQ ID NO: 6588 - DNA, 755 bp, Zea mays
  Predicted polypeptide sequence is orthologous to G519
attgctcctgatttaaactcaggttgccagatccatttgatatgatatttcgggatcactcctgcgctggacatgcctaaacctgattatctcgtgcttaactcatcatcattgtatggtaccagaaaaaggttgggctacgggaccatgagagaggggggagggaacacttaaaatccccatcaggcctctctctgaggtgcaactcttgttatgctgccgctgctgacttcgtcttcttcgtctgacaagtcggtaacgccggtgacacagcttgaggacggcgactgtggcgccgggaacagcaacggctgccgtcctcccacaccttcccggagctgcggcggcgcagcggatgcgcggtgtctcagagctctgctgtggttaccatcccggcccggcctgcttcttcttgctcccttcttcagaaagacccggcacacgacccactctcccggctcagcatcgcaacaaccctgcagtcattggcacgccatgttttgttcgggggcaaatgtaagctacatgcggcaaaatatcgcggtcgaggttgcaaagcgaaccaagctacttccaaacggaggcatcatggtgggagttctgagttctcacgtggctcgcattcttcttcctctgctcggccacgccgcgggacgcggcggcgagccggtactcgtgcatgacccagcctgtccgcgacgacgacggcggcgacggctcactgcggtggaaggcgagcgccgtcttgccgccca

SEQ ID NO: 6589 - DNA, 910 bp, Zea mays
  Predicted polypeptide sequence is orthologous to G519
ctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagaccaacaacgcgctcaggctggatgactgggtgctgtgccggatctacaacaagaagggtgttattgagcggtacgacacagtggacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacacttccgtgccgtggacgacgcaccacacgcca

SEQ ID NO: 6590 - DNA, 820 bp, Zea mays
  Predicted polypeptide sequence is orthologous to G519
ggaggcaaggaaacaggcagctctccacggacaacgcgattctatttatttatctggctgccagccagccagccgcctttcgaaaccgagcacgagggagccgacgtggtggtctctggaacctggttcgagcgagcgagcgacccatctatccagccgcctgccgggaatttctgtgacgacgacgaggaggaggagggggtatggcaatggtggcggcgcagggaggcggccggagggacgccgaggcggagctcaacctgccgccggggttccggttccatcccaccgatgaggagctggtggtgcactacctctgcaggaaggtggcgtgtcagcagctgcccgtgcccatcatcgccgaggtcgacctttacaaattcgacccgtgggatcttccagagaaggcgctgtttggccgcaaggagtggtacttcttcacgccgcgggaccgcaagtacccaaacggctcgcgccccaaccgcgccgccgggagggggtattggaaggcaacgggcgcggacaagccgatcgcgcccaagggcggtggcggggcggcaggaatcaagaaggctctcgtcttctactccggcaaggcgcccaggggattcaagaccgactggatcatgcatgagtaccgcctcgcggacgcggaccgtgcgccgggcaagaagggctcacggaagttggatgagtgggtgttgtgccggctgtacaacaagaaaaacaattgggagaaggtgaaggctgaggagccggaggcggcggcgccgttccgtcaccagcagggcgcagcggaggatttcatgtctgacagctt

SEQ ID NO: 6591 - DNA, 667 bp, Zea mays
  misc_feature (571)..(571): n is a, c, g, or t
  Predicted polypeptide sequence is orthologous to G519
ggactggattatgcatgagtaccgcgtcgctcaagcggaccacaccctggggaagaagggctcacataagctggacgagtgggtgttgtgccggctgtataacaagagaaacaattgggacaaggtgaaggtcgaggagcaggagttggaggcggcgccgcgccgacaacatcaccgacaaagtgcggaggattccatgtctgacagtttccagacacacgacttagacatcgacaacgcctccgagctacataattgctacggtaacaacatggtgcaagggcaggccatgaccgccagaaacgacattggcgtcgtgacggtgaaggaggacaacgactggttcaccgacatgaatctggatgatctgcaggcgtcctacaacatggcccatacggtgaatccgatcccggcccaaaccgcgaacctggtgacggggcaaggccatggctacttgcaaggctatggctacttgcagtacatgaactcaccgtcgatgaagatgtggcagacaatcctgcctccgttctgagtgtccacgatgaagagatgctcttgtacgtaagggggncatagaagtgactaggactggaatagaaacaacatggtataggcttgtaaccgtttattcatttgctaaataatacctatgtgggttggtaatacc

SEQ ID NO: 6592 - DNA, 659 bp, Zea mays
  Predicted polypeptide sequence is orthologous to G522
ttttttttttttttttgccaaatcagtgctgaagctccttagcttcagctgttagctaaccttattattaacaccagacattatgccaacttatgcatggacgtgtgacctactcggttacactttgttatgcacataccattctactataccatgacacatgaatcagttggctactttatatactacgttacattacatccagcacgcctcaatgttattaactgtgtaatgagggaataatgcactagtccagtgatttagtgcgtatgtgaatatgtattaccattgacgctgttatttccacaaatcattgtcccctccacaggaggctgacgttgacacgtagtccaaggcctcttctttctcttcagactgctgaatcacctgcagtgccggattggagtagttattagctgaatccttattaggggtgatgtctccgtggctaagctgggacgccatgaacttgtcgagagctcgccaatctgtgtccccgccagtcgccagatagagaggctcggcctgaagctcctgcagggtgtagcgaggggcaccatgctcctgtgtaaggccgcatgctggctggagagtagtgtctacttggccaataaggtcagggagcttggggctctccagctgagggagctgctgcagga

SEQ ID NO: 6593 - DNA, 681 bp, Zea mays
  Predicted polypeptide sequence is orthologous to G522
gatgaaaattacaatcacatttgttggcaaacatacaaagggaaagtagtcaaggaaaaaaaataaaagagagaccaactttcagctataaccacataatatatgacacgcaccatcccatggacgcatgcatgcatgcatccctccgcgccacaccatgcacgcgggcggcgcgccggccgtccgcgcccgccactcatttgtcgaacacacacagtccaaagtcgccgtcctccccggcggccgggccgagcagccccgtccacctctccgcctcgtctctcccgtcgctgttgaggaacagcaatgccgccatgtcatcatcctcaacgtggtccagctgggagcccacgttgctggcggcggccgtcgacgacgctgccgccgcctccaagccgcactccgccgcggggctgagctgcgacgcgacgaacttgtcgagcgccctccagtccgtggccacttcatcagcccgcgccttcttgcccggccgccggccgctgtcggcggcgtccacaacctcatcagaggctgacgccgcctggctcttgttggccggcgccgacgggctctcgagctgcggcagctcgaccaggtggctggaggagtactgcagcagcgcggcggcggcgccgccgtccagctcgccctcctgcttgaagcgcgcgctcttgttggact

SEQ ID NO: 6594 - DNA, 1782 bp, Zea mays
  Predicted polypeptide sequence is orthologous to G525
ttcggtacgaggacaactcgctagctctgcatcatccgtcgttctggtgagcgagcgagcgagagacctagctagactgaccggcggccgccggcaggccgagaacgaagcgtttgtgcatgtatgaaagtttcgatttttatactgtcgtctacgaattgttccttgatatatgggtgttgttagtgcttcatcgatctgatctcagtgaaggagcaggagccatggcggaccagcagcagccacagcagcagccgcaggagatggacgttgaccgtaccggtggcctcgaactgcctccagggttccgcttccacccgagcgactttgagattgtcagccactacctcaagaataaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaaaggcagggctcccaggggtgacaaaaccaactgggtgatgcacgagtacaggctcgaaggcagcggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgtcatggacccggtggccccctactaccccaacccaaatgccggcgccgggatgatgccgcctatggcggccggtattggcggcgccggcgggctccagatcaacggcgccctgttcggcaatccgatgcccgcgccgctgccgatgaacttctaccaccaccagatgggcatgggggcagcagctggccaggtggacatgggggcagcggctggccagatggacatgggagcagctggcgctggcgctggcggcttcgacgttgcagcgccggagagtaggccgtcctcgatggtgtcacagaaggacgaacaggctaatgccgccgagatctcgtcgatgatgtctgtgaccggcccagggtccgcgaccaccaccatagagatggatggcatatggaagtacaagtactgaaaaagtggatatggagtttggagacaaatgcatgaattcgcatgaatatgcatgttatatctactatatctgcattgcattttgtgaaaatttgcatggttcctatatttctgcaataactagtcggtaagatatgtgtgtgcatgcatgtgctagtatatacatgcattgtatcattgcatgtgtggtatatgtgtgtgtcgtttggtcttagtaatccggggcatgatggtacccatacctggatttacatctgcttgggcgtgctgatgttgtgttgtaatttgtaaaaagcagattgaagttcggtacagtatattatcgtgaacctatatatattatacttgtgtgaaaaaaaaaaaaaaaaaaccgagactagttctcc

SEQ ID NO: 6595 - DNA, 894 bp, Zea mays
  Predicted polypeptide sequence is orthologous to G525
actccactcccgcggaaaaaaaacccatatccctccggcataaacccaaaaagctgcaagcagtgtgaccaaaagcaggcctgacggcgatcctcggctctctagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacggggctgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaaggacgagtgggtgctgtgcagggtgttcaagaagagcatcgagccgccgccgtcagtgggcaagaggtcgtcggtcgcgtgcacggggacgatggtggtggaggacgtcgtgggaccgccgtccatgtccatggaggacgacctcaccgcgtgcgcgctgcctccgctgatggacgtgtccggcggtggcggcgccaacatggcggcggcgtccatcgagctgctggcgccaccggcaccacacgtgacctgctttctcaacgcgctggagggccagttcttcctgaacccac

SEQ ID NO: 6596 - DNA, 853 bp, Zea mays
  Predicted polypeptide sequence is orthologous to G525
cacttgaatccgtgcctgctctaatagaggctctgcaatggagcaggagccgcaccggcccatggagctgcccccgggcttccgcttccacccgaccgacgaggagctcatcacgcactacctggcccgcaaggccgccgacgcccgcttcgccgcgctcgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggctccaagaagacgctcgtcttctacacggggagggcgcccaggggagagaagtccggatgggtcatgcacgagtaccgcctccacgccaagctccacggccacggccacggccacggccaaggcgcagccgtcgtcgtcgtccccaaggccgccgggaccaagaacgagtgggtgctgtgcagggtgttcaagaagagcctcgtcgtaggtggtgcagctgcagcagcagcaccaaccgcaggcaagaggggcggcacggagacgtcgtccaactccaagacgggcgacgtagcggccatctcccacctccctccgctgatggacgtgtccggctccggctccggcgccgccgccgcggcggcggcacacgtgacctgcttctccgacgcgctggagggccagttcttggaccagacgacgaccacgccgccgccagaagccgccgcccgcgccacggacgacgacggccacctcggcgccctcgccgcc

SEQ ID NO: 6597 - DNA, 270 bp, Zea mays
  Predicted polypeptide sequence is orthologous to G559
ggtaccgagctcgaattccgttgctgtcgcgcccttccggcttgattctcccaaattgccactgtgtgggattaatgttgcagtgtcatcttgtgacctccttgaactgcccgtgaccgtgtctgccatattcttctttaccgctgaggttcaagttcttcttactctctgcaacgacacgccaggagcaaggaggtggcaagtcgtgcagaaatatcctgtcgcccttcgtcgagcagagggcggttcatgatgctgccgacagcaacg

SEQ ID NO: 6598 - DNA, 884 bp, Zea mays
  misc_feature (665)..(665): n is a, c, g, or t
  misc_feature (780)..(780): n is a, c, g, or t
  Predicted polypeptide sequence is orthologous to G559
gcacgacgtactccaaatactcttctcatttcctctcggttctgctcggtggcaacccagcgcgtagatcttattcttggacgagaattctcctcaagttctcggatttctgtttttgtgccgcttagcaattcaaccccgaaattcttttgcggcgcagtcttcacccgaatcttgggtcgtagccaagaagatgaacaaggataaggctccgatgccgggagacggcgaccccagcgatggcttgccgccgcagaccacgcgccgtgccggggcgccgccctcgtcgtcgaccccgccgcgggagtacgacatcagccgcatgccggacttccctacccggagcaccggccaccggcgtgcgcactccgagatcctgggcctccccgacgacctcgacctcagcgcccctggaggcggcgacggaccgtcgctgtcggacgagaacgacgaggagctcttctctatgttccttgatgtggacaagctgaactcatcgtgcggggcgtcgtcggaggccgaggctgagtcctcgtccgttgcggatggcgtcggtgagggggctgagctgggccacgcgcccaggccaaggcatcagcacagccagtccatggatgagtccatgtcgatcaaggcggaacagctggtgggggagcaggggatgnaggggatgtcgtctgcagaggccaagaaagcagtctctgcggcgaaactggctgagcttgctcttgttgacccaaagagggctaaaaggatttgggctaatagacaatctgctgncagatcaaaggaaaggaagatgcgatatattgctgaactcgagcgcaaggtgcaaaccctccaaacagaaagcacaacattgtcagctcagctaacattgctgc

SEQ ID NO: 6599 - DNA, 915 bp, Zea mays
  Predicted polypeptide sequence is orthologous to G559
gcaaccctccaacagaagccacaacattgtcagctcagctaacattgctgcagagagacaccactgggctaacaaccgagaacagtgagctgaagattcgcctgcagaccatggaacagcaagtccacttacaagatgctttgaacgacacactgaaagctgaggtccagcggctgaaggtggcaacagggcaggggccggccaatggtggtggaggcatgatgatgaactttggcgccgtgccacgcgcgtttggaggaggcaaccagcagatgttccacagcagccagagccaagcgatgcaatccatgctggcgacgcaccagctgcagcagctccagctccactcccagcctcagcagcagctgcaggcgcagcatctccagcagggggcgagagacctcaagatgaaagggcatctgggcgcccaagcccagtggggcggtgggaagtctgggagcagcggcagctgaggctactggcacgggagttttggtgtatgtggttactggttagctaggaggggagatccccttgttctcgggcgggtgctcccgtgcatgggtagttaccgttagctcgggctatctatctacaggctcagttcagcttcagttttactgttaactcgggggctcagctctcctgcagcgtactgtgtccggaaactcggatggtaacaggtgttttatccgttggaatctgtctgtatctctttgctagtttaagggtaaaaatggtcgggatttcagggcttcaaatgaaatctcccgtcttgagtaaggtccgggatccattgctattccattgggatatgtacccctccctgggggctccagggggggtgtaccaaaaaaaaaaaaaaaaaaaaaaaaaaaaaaaaaaaaaaaactcgaggggggcccccgccccccc

SEQ ID NO: 6600 - DNA, 831 bp, Zea mays
  Predicted polypeptide sequence is orthologous to G559
acgatacagcccttccctcttcaatcctctcgtcatttcctctcgcttctgctcagctgcaacccagcgcttagatcttattcttggacgagaactctcctcaagctctccgatttctgttctcgcgccgcttagcaattcaaccccgaaattcttttgcggcgcagtcttcacctgaatcttgggtcgtagccaagaagatgaacaaagacaaagctccgatgccgggagacggcggccccagcgacggcttgccgccgcagtccacgcgccgtgccggggcgccgccctcgtcgtctaccccgccgctggagtgcgacatcagccgcatgccggacttccctacccggagcaccggccaccggcgtgcgcactccgagatcctgggcctacccgacgacctcgacctcagtgctcccggaggcggcgaaggaccgtcgctgtcggacgagaacgatgaggagctcttctccatgttccttgacgtcgacaagctgaactcatcgtgcggggcgtcgtcggaggccgaggctgagtcctcctcggccgcgggtggcggcggtgagggggctgagctggccgacgcgcccaggccaaggcatcagcacagccagtccatggatgggtccatgtcgatcaaggcggaacagctggtgggtgcgccggggatggaggggatgtcatctgcagaggccaagaaagcagtgtctgcggcgaaactggctgagcttgctcttgttgacccaaagagggctaaaaggattttggctaatagacaatctgctgcaagatcaaggaaaagaagatgcaatatattggcgaactcgagct

SEQ ID NO: 6601 - DNA, 931 bp, Zea mays
  misc_feature (802)..(802): n is a, c, g, or t
  Predicted polypeptide sequence is orthologous to G559
tccctcctggcttctgcccctttgtctgcgctcctcacgccgccccccgccccagcctcacacccgcattccccagatctccatggactcgacccctcccacggacccggcggcctcctgcttggcctccgcctctgcggcggtggcatcgggggacgtcgccgcgatgctgccggactcgccgccgcggcgtggggcgggccaccgccgcgcacagtcggagatcctcctcggcggcgccgcgctccccgacgacctcaccttcgacgcggacctcggcgttgtcggggaggcctgcgtggccggcgacgaggatgaggaggatgacgacgacgacgaggaaggggtcggcggcgctggcggcagccggatgttcgagatgttcctcgagaacggtggcaagctcccaggaccgccggagccgtcggcgcatccgcattcgacgccgccgcggccacggcaccatcacagcatgtctatggatgggtccacgtctttgtttggttccgccgccgccgggacgcctgggaggtcgggcgctgatgccaagaaggctatttccgacgctaagctcgccgagctcgcgcttgttgaccccaaacgtgccaagaggattttggcaaaccgccagtcagctgctaggtcgaaagaaagaaagatgcgctacattgcggagcttgaaaggaaagtacagactctccaattagaagcaactacactatcagctcagctggccatgttgcagcgagatacgactggtatgacaagtgagaatagtgatctgaagatacgtgtgcagacnatggagcagcaggttcagctgcaggacgctctgaacgacaggctaagagacgagattcagcagctgaagggtgcaacaggacaggtaaacgccagcattggaaaaacaggaaactctggtatgtcatca

SEQ ID NO: 6602 - DNA, 647 bp, Zea mays
  Predicted polypeptide sequence is orthologous to G559
aaatcttgccgagcttgccctaatcgatccaaagaaagcaaagaggattataaataatagacagtcggcggcaagatcaaaagaaaggaagatgaggtacattgctgagcttgagcggaaggtgcagttcatgcagagagaagccacagcactggcaacccagctggcattgctacagagagacacggctgggctgactgttgagaacggcgacctgaagatacgtctggagagcacagagcagcagatccacctacaagacgcactgaacggggccctgaaatcggagatgcagcggctgaagatggcgacagggcaggcgggcaaccagatgatgaacttcgccgaaccgccgcacacgttcggcggtgcgaaccagcaggtcttccaccacccgggccaagcagtgccgccattcctggtggcgatgcaacagcagcagcagttgctgctgccgcacatgaaccagccgttgcaccctctgcagagccagcagctgcatcaggcggcgacgctcagcatcgacatggaagggctgccggcggctccacctggccagtggcaatggggtggtgacacgtggtcggagagcagcagtagctgattcggcggcgacgacgacgtgggttgtggatgtatgccatgtt

SEQ ID NO: 6603 - DNA, 2356 bp, Zea mays
  misc_feature (34)..(46): n is a, c, g, or t
  misc_feature (254)..(278): n is a, c, g, or t
  misc_feature (375)..(414): n is a, c, g, or t
  misc_feature (533)..(557): n is a, c, g, or t
  misc_feature (711)..(740): n is a, c, g, or t
  misc_feature (749)..(785): n is a, c, g, or t
  misc_feature (795)..(800): n is a, c, g, or t
  misc_feature (838)..(880): n is a, c, g, or t
  misc_feature (1068)..(1072): n is a, c, g, or t
  misc_feature (1124)..(1128): n is a, c, g, or t
  misc_feature (1191)..(1195): n is a, c, g, or t
  misc_feature (1833)..(1855): n is a, c, g, or t
  misc_feature (2278)..(2284): n is a, c, g, or t
  Predicted polypeptide sequence is orthologous to G562
tttcaattctgcgggcaatgcgttgatttctccnnnnnnnnnnnnnggattcatgcagcatccagctgcatccagttatttggcttagcctcgtcgtttatattagagtagttcgtgggcgatgattattattacggtggctaaattcgagttatgcacatattcatcacggagaccccgagagttggtgcatgatgcactgaatcccagctgcacatgtttaaaacagcgacacagttatatcccagtaggannnnnnnnnnnnnnnnnnnnnnnnnagtgcagcatcgtcgcgtcagcagcggcgaagctctatactggtcagacccattaggtgtattccattcccacctacagtcggtgaatcactcgtcnnnnnnnnnnnnnnnnnnnnnnnnnnnnnnnnnnnnnnnnccttagcttattaactggtgaagtggtttctttcgccctgtaactctttgggtgtaacttatggagagcgattagcaaattattaccgttttagatagttctgcgtcaagattttaaannnnnnnnnnnnnnnnnnnnnnnnntgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgnnnnnnnnnnnnnnnnnnnnnnnnnnnnnntattatttnnnnnnnnnnnnnnnnnnnnnnnnnnnnnnnnnnnnnatactattgnnnnnntgagtaaattgtatgttgtgataatctgaacttttacnnnnnnnnnnnnnnnnnnnnnnnnnnnnnnnnnnnnnnnnnnnggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccannnnntttcgggacaccatatgctgcagtatacccacatggtggagcttacccacannnnnttgtgcccatgatgtcaacttcaatgagcgtggagccagccaaatctgcgaatagcaaggagnnnnnttccaataagaaacttaaggaaatagatcggactgcagtgtctgctggcagtggtaacagtaaaagaacagtgtcatccattgaagattacagtgcagaagcctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggttaacagagagctcagagaagctcagactagagaactcagctctaatggtgaagctgaaggacaccgcagaaccgtctcccagcaaagcannnnnnnnnnnnnnnnnnnnnnntgcctcggcggagaacttcctttccatgatcgacagcgccaacgcgccgagcgtcagcaggcacacggagcacggcggtcccaggctccggcagctcctggactccagttccgcgacagacgtcgccgccgtaagctgatgatgaagccggtccggcaaatacgccacagcacatgcatgtggcctggggattccgcaggctcatgcggctcgagtgctcgtcagcgttacggactcggactctgtactccagtttaggcactgattccaccgagggtaccggtaattttatctgctctcgcgccagagtgccgggctgccgcctgcgaccactcctgtcctgtgtacccagagttgtaacgtagtagggtgttgtgctgcatgccgaccttttgaaactttcgagaccgtcatttgcaccannnnnnncgtcgcaataagacaatacagatcggagtttgtacaggacggatgctgcctggtgtgcgcaattctctactg

SEQ ID NO: 6604 - DNA, 1507 bp, Zea mays
  misc_feature (1073)..(1073): n is a, c, g, or t
  misc_feature (1355)..(1355): n is a, c, g, or t
  Predicted polypeptide sequence is orthologous to G562
gaattccgactcccgcctccccggggtgcgtgtttccccatccggctcgtccgccgatcctcgcgaggcctcctcgaccccgaccccgacccggcgcggccaccggttcaagtcattcacaaaaaaacatgggtcatgatgaagctgtagttactcagaattcagtaaaagcaccatcaccacccaaggatcagccagctatttatccatgctttgattggtcgactatgcaggcatattatggcccaggggtcttgccaccagctttctttaaccctggagtagcgcctggtcatgcccctccaccatatgtgtggggtccgcagactatgccaccggctgcctttggaaaatcatatgctgcaatatacccaccatgctggtacggtggtttcctgcatccactcatgcccctagtggtaaacccattgagtgcagagccagctaagtctgggaacagcaaggataatagtttaaagaagaaactaaaggaaattgatggatctgctgtgcaagtggcaacagtgagaaaacaagtgggatcacagctagaaggatccagcgatggaaacaacccaaaggtgagcggaactccaaagaagaggagcttagatgataggactacatcagaaacatgtggggaatcaggaagattgccagctttgtccagtgtgcgcattccagacacaatgatgaaaccatgtgtgagcaccggtagtgacttcaaagttagtggtgcgacatcaaccgaatggccagctaaggacgacaaggaatccaagcgtgaaaggaggaagcagtcaaacagggagtctgcccggcgctcaaggctgaggaagcaggctgagactgaagaactggctagaaaagtagagctactgaccgcggagaacacgtccctccgaagcgagatcagcaggctaacggaaagctcccagaaactaaggatggagaactcggctctgatggagaaactagcggacggtacatcagaccaagcacaagaagcttccgccggccaccagacgacaccaacggcgccatcgtcggctcgcgtcgtcaagaacttcctntggatgatggatggcgaaggcgcgtcaagaggcggcagcggcagcagcagccggcgcagggatcacggtgcgcccatgctccgccagctcctgagctcgggtcctctggcggctgacgccgtggccgctagctgatcagtgccgtgcttcccttgtgccgagcgcgtgtggactggcgatttttttaaaagagcgcacaagccgccacgcacggacgacctgtaaattacagtagctatgcctatgtatggggcatcgttccggccgctctgctgagagccnatatacggatcccatcactgagctttggtaactctctgtcgactgtcgttagagtggttgtgccaaactgaatcaactgacacgattcaacagtactaataataaccatcaggaggtttgcctctgaactccaaaaaaaaaaaaaaaaaaaa

SEQ ID NO: 6605 - DNA, 657 bp, Zea mays
  Predicted polypeptide sequence is orthologous to G568
acaacttatccttaatcacaaaaggttgttcaaagtcaaatgtaaagctttcagtgaacaataagaatttgtcaagatcgttattgtcttctatccaacaacaaagtcccgtgctggagaagccatacaaaacccaagttaataacagtgcagtaaaagcaacaagatctctcaatgccaataagagatctgaaacaagcacacattcagcaaaaaagactgtaaacttagtctctgcttcgattaatttgaaacactctggtgctaagtctattctaagggaaaggaacttgtttattccaactactaattcatcaaaggaagataagaaaacttttgtgacaactgcggtaaggaaacatgaggtttgtatacttagcatcttatatctacacttgccattgaccattagtgaacatatttatattagagttttctatatcatttcataggcggtagatacatcaatttgcatggaaatttgagccctcccaccaattgagacactaactttttttattgccactacaagcatatgctagtattacaactaactattgcaatatattagagcgatatgcaggagaatcacaatggcacaaaaaatattgtagtatcatctgaaatgcaagtagtacctcggccgcgaccacgctt

SEQ ID NO: 6606 - DNA, 1054 bp, Zea mays
  Predicted polypeptide sequence is orthologous to G591, G793
cgaatgttcttatcaagagtgtggatccatatataaataaagtattcaacgcagatagcagatccactagcaacgctgaaacgcacgctcagcctccattgaccaaagcctgcctcggacctccactttggaaaaatggagaaggaagaacatcgctatcaacatcatcttccatttcatcctgtatctaaactttgtcaaccatttgcgcaggccgcagacacactcatacatcagtcccttttgattagtccatatacacccactaccagaaaagcagcagcccccccaccacaaagtgtatggctagctagtgcactacagacccggaaagaaacattatgagagcatgccagactcttttagcagctccctctctccatcactcacactcatagggggcattgaaagatggaggagcatgagcaggttattgcttaccatatccttgcaattaaagcacctttgaacaaaagatcggaaagggaaaggggatatcatataccatttggtacaacttcaagtggagaggatcttttaggtcttttttccctgcctcctccttgttagtgaatcgaagccggcatttctatcttacgctttgattggtaggttaacgcctgctaacagccccgaaaggatgcaagttacgcttgctgccactatactaggaaggagtgttgggttctggttttactggttgtccgtcctgcgaatgttgcgtgtcatagattgccatggcgagcgagatgggcatcatgcagagtgctttggactggaggaattgcatcgctgccccaatgtcttcttccatcagctttgcgatctgtctttctgtgccgtccgttgaccacttctcccaaatctgctgtttgctcccactatcacttgcttcccccttaactgaaagtgggatatcagcgaccagctgtgccacagcaccagcaccacccagcctgctcatgcttagaaccttgacttgaagcctcagaaacttcacataatcgaggatctcatctagcataactgctctattcctcttgtttctcgtgcc

SEQ ID NO: 6607 - DNA, 922 bp, Zea mays
  Predicted polypeptide sequence is orthologous to G591, G793
cagcagagcaggcaaaccgctcccagtcccagtctctcacctgaggtgactggcgtctcttgtcgcaagccgccagaagcttcggcccctgacgcgtgggggccccgtccgcccccgcccccgtccccacgttgccggccatggcggggcagccaccgccgtccggggcctccgaggacgacttcctcgagcacttcttcgccttcccctccgcggcctccgccggcgctgccgggggccacgcgggcgccggtattggcggggaccaccccttccccctcgccctcagcctcgacgccgccgccgaggccaagccggaccgtgatcccgtgcagctcgccggcctcttcccgccggtgttcgctggcgccggcggcgtgcaccagccgcacctccgcggcccaccgcctccgcagatgttccaggcgcagccgaagccgggcgagggaggcatggcgccgcagccgccagccccgcggcccaaggtgcgcgcgcggcgggggcaggccaccgatccccacagtattgcggagaggctaaggagagagagaattgcagaaaggatgagggcattgcaggaattagtccccaacacaaacaagacagatagggcagccatgctagatgagatccttgattatgtgaagtttcttaggcttcaagtaaaggttctgagtatgagcagactgggcggtgctggcgcggttgcgcagctggttgctgatattccactctcagttaagggcgaggcaggcgacggcgggggggcgccgcagcagcagcagcagcagcacgtgtgggagaagtggtcgacggacggcacggagaagcaggtggcgaagctgatggaggaggacatcggggcggcaatgcagttcctccagtccaaagcgctgtgcatgatgcccgtctcgctcgcgat

SEQ ID NO: 6608 - DNA, 906 bp, Zea mays
  Predicted polypeptide sequence is orthologous to G598
gcggccgcgatgtcgaggtcaccacgttccgcgacatccaccctctgacgcccgacgcgccgccgcccgcctccgcgtcctgggacaccgccagccaccgctccttgtcgtcgtccgacgaccagcagtacatgacgatgagccgcgagttcacggccatggtcgccgccggggcgaccatgcagcccggcggctacgacggcgccgccgaccagctcaccagcatcggcgaggacgagctggaggagaccaacccgctggccatcgtccccgacagccaccccatcgccacgcccgccaggtccagggcgtccgccgccgggctggaggtcgtgcccgcgggcccggcgccggcgccgcagccgcagccgcagccgcccgcgcacctggaggccagccaggtcaagaaggaggaggtggagaccaaggtcacggcctggcagacggccgaggtcgccaagatcaacaaccgcttcaagagggaggatgtggtcatcaacggctgggagaccgagcaggtggagaaggcctccgcgtggctcaagaagatcgagaggaagctggacgagcaacgcgccaaggcgctggagaagacgcagaacgacatcgccaaggcgcggcgcaaggcggaggagaagcgggcgtcggcggaggccaagcggggcctcaagctggccaaggtgctggagctcgccaacttcatgaaggccgtcggcagggtgcccaccaagcgctccttcttctagccagccgactaccgctaccacctccgtctctccctgcctgcgtgtgatcgatgtacgctcgctgctgcatccgagaacctaactgtaaagaaaaaaattgtaagctgtatacgtactactgcctgctatggtcccctgtgatgtctgtcatccatcacag

SEQ ID NO: 6609 - DNA, 834 bp, Zea mays
  Predicted polypeptide sequence is orthologous to G598
ggtctctcccggccgctactagaggcttagcgttgagagccacatgttgagtgaacagacggcggctagcactagcagcggcgagcatcaggagaggagcgtcgtcgaggacaggcggctacagccggtgggggagaacgaggaggcggagttcagggacatccacgcgctgagcccgccgccgagccagccttcgtcgtaccgccggagcaggcacgcgtccgtcgggagcgacaccgcgtccagcgagcccttcccgaccatgagcagggagttctcggccatggtcgccgccgcagcagccatcgccaacggtgccgccgccgacaggctcggggaggccgaggacgaggagaccaacccgctggccatcgtgccggacagcaaccccatcccgtcgccgcgccgggcccggggcccgcccaccccaggcgccggcgccgcccacgccaacggcgacggtggggtgtccgtggggcaggtcaggaaggaggaggtggagtccaagatcgccgcgtggcagatcgccgaggtggccaaggtcaacaaccggttcaagcgcgaggaggtcgtcatcaacggctgggagggcgaccaggtggagaaggccggcgcctggctcaacaagtacgagaggaagctcgaggagaagcgcgccaaggcgatggagaaggcgcagaacgaggtggccagggcgcggcacaaggcggaggcgaagcgcgcgtcggcggaggccaagcggggcaccaaggtcgcgcgggtgctggagctcgccaacttcatgaggggcgtggggagggcgccctccgccaagcgctccttcttctgaaccct

SEQ ID NO: 6610 - DNA, 880 bp, Zea mays
  Predicted polypeptide sequence is orthologous to G634
gtggcgccgaggcgacggaggggcgcagtccggcataggcggcgggggcacgacgccggcgccgtgcggagggagccgcgcgggctcgccctgccccccgccgacacgctggaggaacgcgatcagcgcggcgtcgcgggaggccgcggcggcgcgctccctggcgagctgctcgcgctcgcggttcatgcgggcgacctcctggcgccgccacgcctcctcgcgcgccgtgcgctctgcctcgcaccgctccagcgtctccaggaacacgcgctgcatggcgtcttgcttctccgtgaactgcttcatcatcctctcgaaggtggccatcatctccctgtcgcactcgcccccgctgaggccctcctcccccgcaccagagtcgtcgtcgtcgtcgtccgagtcgtactctgagtcggactcggacatcgacgagaagctgaggtccggcaggccggcgacggcggcagggcccagcaccgtagggcccgccgtccatgccatttccatcggctgatgagggccagcttgcaccgtggtcatgcccgagggcgggggcggcagaggcggcgccgaggcgtgcagcgcctcgagctgcgagaagaagcggtagctcttgccgtcctggcgcccggcgcgggcgtccttggtgcgcctgtagtacttgtccacgttctcgaacttctccttgcacttcttggcgctccggtggtaacccagccctgcaagcttccttgcgacgttctcccagagcggcgctttgagcggggagctccggaagtcggcgtccatctccgtccggatcctgatgagcgccagcgtctcctcgcgcggccaccggttgccggacgctcccgcgccgctggcgcccagtcggcct

SEQ ID NO: 6611 - DNA, 899 bp, Zea mays
  Predicted polypeptide sequence is orthologous to G634
caagtactacaagcgcacaaaggaaggccgcgccggcaggcaggacggcaagagctaccgcttcttcgaggagctggaggcgttgcacgcagccgcgccgcagccgccaccacagcacttgccggcagccagcaccgccccgcagttgcacgccctcgccgcgccagtatccccgacgccccagcagcagttgccggcatccagcgccgccccgccgttgcacgccttccccgcgccagtatccgcgccgccgccgttgagttcaatgccactgctgacagggccgatgcagccagcgcccatatcatcggcggccccagccccggcaccggtggatctgctcgtggcccaccagcccctcaacctgcaaggcttcagcttctcttccatgtcggactcggagtccgacgacgagtccgaggacgacgacatgacggcggagacaggcggaaaccaggaccgcctcggcaagcggaagcgcggcgacggcggcggcagcagcagcaacaagatgatgtctttcttcgaggggctcatgcagcaggtcgtcgacaggcaggaggaaatgcagcggcggttcctggagaccatggagaagcgggaggccgagcgcacggctcgggaggaggcgtggcgcaggcaggaggtcgcccgcctcaaccgcgagcaggagcagctcgctcaggagcgcgccgccgcggcctccagggacgccgccatcatcgccttcctccagcgcatcggcgggcagtccgtgcagccccctgctaccgccgttgttgtcccaatgccagcaccggtgtcagtccataccacgccgccgaaacaaccttctcgccagcagcagcaaccgccgccgccgtcgccccagggccggccggcgacaccgcagtcgaagc

SEQ ID NO: 6612 - DNA, 1931 bp, Zea mays
  misc_feature (95)..(99): n is a, c, g, or t
  misc_feature (285)..(289): n is a, c, g, or t
  misc_feature (301)..(342): n is a, c, g, or t
  misc_feature (404)..(408): n is a, c, g, or t
  misc_feature (587)..(592): n is a, c, g, or t
  misc_feature (713)..(809): n is a, c, g, or t
  misc_feature (1154)..(1179): n is a, c, g, or t
  misc_feature (1353)..(1358): n is a, c, g, or t
  misc_feature (1439)..(1444): n is a, c, g, or t
  Predicted polypeptide sequence is orthologous to G635
ccacgcgtccgaaaggaagagtaattacgacacagtttgcctcaaacatacatcgaattgggagcatcaaagctgctgcagatttaactggtcgnnnnntggtatttgttggaatgtcactcaggacataccttgaagctgctttcaaggatggaaaggcaccactggatccatcaaccttgatcaaggtagaggatatggatgcgtatgcccctaaagatcttttggttgtcactacaggttcacaaggagagccacgtgcagctctgaatcttgcatcttatnnnnnaagtcacgctcnnnnnnnnnnnnnnnnnnnnnnnnnnnnnnnnnnnnnnnnnnttattcctggaaatgagacacgggtaatgaagatgatgaatcgtctcactgatcttggcccnnnnnttatcatgggtaaagattctggcctgcatacctctgggcatgcctaccgagaggagctggaggaagttcttcggattgttaaaccacaacatttcttgcctgttcatggagaactcctatttctcaaagaacatgaatcacttggaagatcaactggcatacggcacacaactgtaatnnnnnntggagaaatgcttggtgtatcgcatctaagaaacagaagagttttgtccaatgggtttgtttcattagggaaggaggatcttcagctcatgtatagtgatggtgataaagcttttggtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcgcagtctggtttgaaaggaaaatttaagattacgacaagatgtctatggcttgataatggaagattgttagacgcactctacaaagcagctcatgctgcattgtcaagctgtcctgtgaattgtccacttagtcacatggagaggatggtagctgaaatcttgaggaaaatggtacggaagtatagtgggaagaggcctgacgtcattgcggttgctatggagaacaccacagcaagtatctcagaacacctcgatgctaaatcatctggaaattttggaccttcctcagctactagccatctgagcaggagtccagctatgactcttgaaggcagttannnnnnnnnnnnnnnnnnnnnnnnnntggatgctgaagaaacccttcctgaggccgcgagaacagcaccagatgatgcaaccacaagttccaatggtgaagcattcttctcttcagatttacatcagcctaaaacattggagcacttctgggagtcattcaaatctcctacagctgttaaaattgcacggattgtcaatnnnnnnaagaagcaaaatctcggcaagattggcataatgggtaaggactcatcaatccagtcagctccggctccagctaaatcttcnnnnnngaacaagtggaaacctgaggaaatcaagagcttaatacagatgcgtggcgagatgaatgagagatttcagagcgtgaaaggaagaatggtcctgtgggaggagatttccgacaacatgttgaagcaaggaataagtcgtactccggcacagtgcaaatcgctttggacatcgttagttcagaaatacgaggaaagcaagaaggacgcggagagcatgaagacgtggccgtatttctcggccatagataggatcctttcgcagcaaggggaaatggcaaccaaaggatagagaaggctgtagcttagtggtagaagtttagaacatttgatatgttgtagcagagcccagtcagtgtagtgaggatataagatgaaatgtactgtgtacaggtactgaggtacagcacctggcaatttattgggaccggattcccttgttctaagtaaggtcgacgatcggtagcacgagatctagatggcaatttat

SEQ ID NO: 6613 - DNA, 1458 bp, Zea mays
  Predicted polypeptide sequence is orthologous to G635
ggtttgtttcattagggaaggaggatctccttctcatgtatagtgatggtgataaggcttttggtacatccactgatctctgcgttgatgagagactaagaattgcatctgatggcattatttttgtaagtatggagatcttccgacctcagaaggaacatgggttagcgcagtcaggtttgaaaggaaaatttaagattaccacaagatgtctatggcttgataatggaagattattggacgcgctctacaaagcagctcatgctgcattgtcaagctgtcctgtgaattgtccacatagtcacatggagaggatggtagctgaaatcttgaggaaaatggtacggaagtatagtggaaagaggcctgacgtcattgctgttgctacagagaacaccacagcaggtttctcagaacacctcgacactaaagcatctggaaattttggaccgtcctcagctactagccacctgagcaggagtccagctacgagtcttgaaggcagttataaaacacacccagacaacccagaggtggatgctgaagaaatccttcccgagactgtgagaacaacacccgacgatgcaaccacaagctccaatggcgaagcattattctcttcagatttacatcagcctaaaacattggagcacttttgggagtcattcaaatcccctacagctgtcaaaattgcacggatcgtcaatgggggggacaaacaaaatttcggcaagattggcataatgggtcaggactcattaatccagtcagctcctgctccagttaaatcctcaaaacggaacaagtggaaacctgaggaaattaagagcttaatacagatgcgtggcgaaatgaatgagaaatttcagagcgtgaaaggaagaatggtactgtggaaggagatttctgataccatgttgaaccaaggagtaagtcgtactccggcacagtgcaaatctctatggacatcgctagttcagaaatatgaggaaagcaaggatacggaaagcatgaagacttggccgtatttctcggccatggataagattctatcgcagcaaggggagatggcaaccaaaggatagaaaaaggcttgtagcttagtggtagaaatttagaatattgattggtatgttgcagcagagcccagtcagtctagtaatataaagatgaaatgtctgtctacagtgcctggtgatctattgggatcggattcttttgttttgtgtaagacatgcagtagcacaagatcgagatgcatcgactggcttgaaattaagcttcagggcccgtggactcagagcggggtagccaggagcgctctattcttagcaacaggcagacatgtgtggttttatctgccagataacgtttgtaactcctataatgtaataggctacacggtaggcgaacggcgaacccctaaaaggcaactgatgtatcatatgttttgaggag

SEQ ID NO: 6614 - DNA, 1188 bp, Zea mays
  Predicted polypeptide sequence is orthologous to G653
ccacgcgtccgccgcggcaaaagtgaggagcgcgcgggcgagctgggggagacgaacccgtcataactccctcgcttaatcgcgtctcgtgctcctgcctcctgcgtatataaacgcggcaatcgggacgcccggggaggcgttcgttctccttctccatcccacgcgcgcgcaggccaaggccggatcggcggcctctcagatctcgccggccgccgtgagacagagaccgaagggggggttgaccggtgctcgggaggaagatgtttagcgggacgcagcagaagtgcaaggtgtgcaccaagacggtgtacccgatggaccagctctccaccgacggcgtcgtcttccaccgctcctgcttcaagtgccagcactgcaagtctaccctctcactgagcaactattcctcgttcgaaggagtgccgtactgcaagacccatttcgagcagctgttcaaggagaccgggagttacaacaagagcttccaatcacagtcacctgcaaagattactccggaaaagttggcccctgagctgaccagatcaccaagcaaagctgcaaggatgttttcaggaacacaagacaagtgtgcgacttgtggtaaaactgcgtatcctcttgagaaggtaacagtcgaagagaagtcctaccataagtcatgcttcaaatgctcccacgggggctgcgcgattacaccttccaactatgcagccttggagggcatcctctactgcaaacaccatttctcccaacttttcaaggagaagggaagctacaaccacttgatcaagtgcgcgtccgtcaagcgcgctgctgaagcacagccagaacaaccggcctctgattcctcctcctgaccacgccatttaaacagtgggggtttggaggcgagagagttgggaagcctcctgtttctacttaaaaccgcgtgatgtatgttattccatctatgccccgaggatactagactactactctattttggtatcctctgctgtgctagctggatcatatcagcgaaccatggaattgctgtcattttcaatgaaactgttgtgcatcaagtagtgaaatcttcactgaaatcgggtatcttgcctttattgatcaatatattatctatgttgttttgttgtttttaaaaaaaaaaaaaaaaaaaaacctcgcgactagttctcctcgtgc

SEQ ID NO: 6615 - DNA, 1369 bp, Zea mays; identical to SEQ ID NO: 1997
  Predicted polypeptide sequence is orthologous to G666

SEQ ID NO: 6616 - DNA, 129 bp, Zea mays
  Predicted polypeptide sequence is orthologous to G666
accaactacctccgcccgggcatccggcgcggcaacttcacgccgcgcgaggagcgcgtcatcgtccacctccactccctgctgggcaaccggtgggcggccatcgcgtcgcatctcccgcagcgcacc

SEQ ID NO: 6617 - DNA, 129 bp, Zea mays
  Predicted polypeptide sequence is orthologous to G666
accaactacctccgcccgggcatccgccgcggcggcttctccgaccaggaggacaggctcatcgtccacctccaggcgctcctcggcaaccgctgggccgccatcgcctcctacctccccgaccgcacc

SEQ ID NO: 6618 - DNA, 879 bp, Zea mays
  misc_feature (853)..(853): n is a, c, g, or t
  Predicted polypeptide sequence is orthologous to G666
cccgattcacctcctgggaaagtggaagggagggagaagcaaggcaaagcggagccgagggtcaaaggccctcgtcctgcttggccaagcaagcgtcgcgcacgtacgtagaggccgaccggccggccaggttgaagaaggcatggggaggccgccgtgctgtgagaaggccgggttgaagaaggggccctggtcgccggaggaggacctcttgctcgtctcctacgtgcaggagcacggtcctgggaattggcgcgccgtgccatgcagcaccggtctgatgcgctgcagcaagagctgccggctccggtggaccaactacctccgcccgggcatcaagcgcggcagcttcagcgaccaggaggagaagctcatcatccacctccaggagctgctcgggaacaagtggtccgcgattgcgtcgtacctgccggagcggacggacaatgacatcaagaactactggaacacgcacctcaagaagaagctcgccaagacgggcgccagggaaagcggtgccagcgccaagacgacgaagaagagcgatagggccgcggcgcccaaggggcagtgggagcggcggctgcagacgaacatccacaccgcacgccaggcgctccgggaggcgctgtccatggacgacactgcgccgccggcaatcaagccggagccgctgccgctgccgctggggcagctgccggcgccagccagccaggcgatgtacgcttccagcatcgataacatagcgcgtctgctggagggctggatgcgtcccagcgtcagtgggaatgcgtcggctgagtccatgtcctctttctcggcgttctccggtggtggcgacggcgcgtcggcnagccacatcggcacggcgcacacgcc

SEQ ID NO: 6619 - DNA, 821 bp, Zea mays
  Predicted polypeptide sequence is orthologous to G666
ctgtcctcaacctcaagccgccacgctccaccaacacgcgcgcgctggcttcttcaacctcggttgcttgctcgcaacaagacacggatcgtcagagcaagagctctggtgacctgacgattctgctcttgttctcgtacggcgccggtgcctagcgtctgtagcctttttgtgtgtgttttttcgcccatatctccccaccaccaccaccaccaacctcagccgcagttcacccgcgtcaccgcacgagtacacgagcaatccgcaagcgataacctgcaagctgaggggaaaggaaggtgaaggccagctgttttgctcacggagaaagaggttcgtcgttgatcaacacggacacaccatggtgaggccgccgtgctgcgacaaggagggcgtcaagaaggggccatggacgccggaggaggacctcgtcctcgtctcctacatccaggagcacggccccggcaactggcgcgccgtcccggccagaaccgggctgatgcggtgcagcaagagctgccgtctgcggtggaccaactacctccggccgggcatcaagcgcggcaacttcaccgagcaggaggagaagctcatcgtgcacctccaggccctcctcggcaacaggtgggcggccatcgcgtcgtacctgccggagcggacggacaacgacatcaagaactactggaacacgcacctcaagcgcaagctgcagagcggcggcgacggggcggccaagccgccggcgcacaggccgccgtcgtcgtcccaggccagtgggagaggagggtgcagacggacatcaacttggcgcgccgcgcgct

SEQ ID NO: 6620 - DNA, 129 bp, Zea mays
  Predicted polypeptide sequence is orthologous to G675
accaactacctgcggcccgacatcaagcggggcaagttctcgcaggaggaggagcagaccatcctccacctccactccgtcctcggcaacaagtggtccgccatcgccacgcacctccccggccgcacc

SEQ ID NO: 6621 - DNA, 2660 bp, Zea mays
  Predicted polypeptide sequence is orthologous to G707
tcgcttgttctccctagttccgacccgaagcagggaatgagcttcggcgatctcgacggcggcgggtccaagcgcaagaagccgtacaaccgccacgcgccgcggcagatcgaacagctcgaagcgatgttcaaggaattccaccacccggacgagaagcagcgcgcgcagctgagcaggcagctgggcctggacccgcggcaggtcaagttctggttccagaaccggcgcacgcatttgaagaaccaactggagcggcaggagaacgcgaggctgaaacaggagaacgacaaactgcgcgtcgagaacctgtccatccgggaggccataagggacctggtgtgcagctgctgtggcggtccagcggtgctcggggagctgtcgcccgaagagcaccagctgcgcctcgagaatgcgaggctcagggacgagctcgctcgagtctgcaccgtcacttccaagttcattggcaagcccatgtctcacatggaactgctgctcgcgaaggagccgcatcctattacaggctcgtcactggaacttgcagttgctgttggtgttggttccggcgtgccatcgagcaaaatgcccgtctcgacgatctccgagttggccggcagcacatccagctcaacgggaacagtgaccacgcccatggtgactgcatccttgccgatggttagcattgtcattgacaagtccaagttcgcccagcttgcagtgagtgcgatgaatgagcttgtcaagatggcgcggatgaatgaaccgctgtggattccaaccattccctcacctggctcaccaatcatggagactctaaactttaaagagtacttgaaggcattctcaccatgtgttggagtgaagcctactgggtttgtgtctgaggcctctagggaatccggcattgtcaccattgacagtagcgctgctcttatggaggtcttcatggatgagagacgatggtcagacatattctactgcattgttgccaaggcatcaatcgttgaggagatcttacctggtgttgcaggaagcagaaatggtgcattgctgcttatgcaggcagaactacaaatgctttcacctcgtgtccctataagggaggttacatttctcaggttctgcaaacagcttgctgagggtgcatgggctgtagtggatgtttccattgatggactgcagacggatcagtgcctagatacaaacacgaaatgccggaggctgccttcaggttgcgtgttgcaagatacccccaatggctgcaaggtcacatgggttgagcatgcagaatatcctgaggcgtccgtgcaccagctctaccagcctcttatgcgctctggcctcgcccttggcgcagggcggtggcttgcaacactgcaacgccagtgtgagtgcttggccatcctcatgtcatcgcttgcagcgccagagcatgactcagcagcggtttctctggaaggaaaatggagcctgttgaagctggcacggaggatgatggagaacttctgcgcagggatgggcgcgtcatcttcccgcgaatggagtatgctggatggcttaacaggtagcacggggaaagacgtgcgggtcatggtgcagaacagtgtggatgaacctggggtgccaccgggtgtggtgcttagcgtcgccacagcagtatggctgcctgtgaccactgagcggctcctcaacttccttcgcgacgaggagctccgtgctgagtgggacatcctcagcaatggtggccctatgcagcaggtgctacgcgttaccaagggccaactggatggcaactctgtggctctgctgagatccgatcatacagactcccacctgaacagcatcttgattctgcaagagacgtgcactgacagatctggcgcaatggtcgtgtacgccccggtggacttcccggcaatgcagcttgtgcttggtggaggggactcgaagaacgtggcgctcttgccatctggtttcgtcattctgcctgctgggtctagcgccggtggggttgggcacaaggcacgcggatcgctgctcacagtcgcattccagatccttgtgaacagccagcccacagcaaagctgacggtggagtcagtggacaccgtgtacagcctcatctcatgtaccatcgagaagatcaaggcggcacttcactgtgacgtctgttaacttgggaacaggaagcttcaggcatggaggcaaggcaacagccggtgatcagcctgagtcaagaacgaaccgcgcaaaacagtagtgacctttgctaggtggtacgggtccatagggctggcccgtagcacacagcaatggcggtggttcgggtattgactcagcctccaattgttctgggttaaattttgcattttggacctacgcctgggcaatgccatggttggttttggtggttttagggagtctggagtcatctatgctttttgttggctggctcgtggtttttggtatcaggtttgcttttgtaaccatagatgtaggagagccccccttgatgttgatgatacagtcaatatcagacaaatgcagcattgtatcgtgagattcagtctcagatcactgtggatttaccttgtatggaacagtaggaggaggagcggcagtttatgtaaaaaaaaaaaaaaaaaaaaaaaaaaaaa

SEQ ID NO: 6622 - DNA, 860 bp, Zea mays
  Predicted polypeptide sequence is orthologous to G707
tacaaagacggcgcgtccggtgcagattcccatctgtttcgtttgattgatgagttgacgacgcatcggctcgaagcgagactaggctgcatggtttttgtgcctggaggtttctgatccgcgtggttaaggaaactgggtgctacaatttgttgctacaagtgcccgatccgtcgaattgatgtctgccgaccttcagagctgcgacgttccgggaatctggggggatctggatcttggcggactggacaattgggaggcgtctaaagcatggctggacaattgttttatgtgacatcttgaaggcctttgccatgttgggtgcgctcgcatggcaggcatcataataaagatgttggttttgtgtgctgggtgggagatcgcacggggaattgttttttcatccctgggttctcccgccctttgtgtccccgtgccctgcttcgtgttgtttggcttctcgttctatgcttcatcaccggtgctgctgcaaattgaacggatcttctcgtctcgcggcgtgctgcaaattgaacggggctacatcgcaacgcaacacaacacgcaaggtacaaatcggatctaaacattttcaatttacagcaaagttagcaagttactgaaatcaccatcaatcgttcaaaacttcgcgcaccacaaacttatacgcctatgctaggtcatccatatgcacttcattcacccaacgcttatcccgtaaggctataaagcacatgcgaaaggcgttcagtcactctgtaaggcgttcttcacccaacgcttctcgcacgggggtcttctattgaccattgaagataaacttttgaatatatgaatcagctgtgtatatttgctgtagc

SEQ ID NO: 6623 - DNA, 658 bp, Zea mays
  Predicted polypeptide sequence is orthologous to G730
atgacctaataactctaccccagcccactactacctcttcctgctgcaggttctcctttccatcctttcctctaactttggaaccaccaagaagctcagctcaccgtctgcaaacccgttgggagctaccatgagccgaggctgctgctggggcgtttccaccggcggcggcgtgggtgtgcagacgacggcggcggcggttcctgatctctcactccacataagccctccgtcgccaccggccggcggcgtcgaggtgctgccggagccgaggctgctgctggggctggggctggggccggggccggggctggagctcgacgacgacgacgccgccgtggcgacgaagaaggtggacgacgacgacgacgcggccgcggcggcgcgggagcacaaccttcacgcgcagcggctccggctgcagttgcaccagccgagccagacggcccacgggttcaagaagagctcgtcgggcaccgctgccggcggcgggaggagaagctccagggcgccgcggatgaggtggaccaccgcgctgcacgcgcacttcgtgcacgccgtcgagctcctgggcggccacgagagagcaacaccgaagtcagtactggaactgatgaacgtgaaggatcttacactagcgcacgtcaagagccacctg

SEQ ID NO: 6624 - DNA, 751 bp, Zea mays
  Predicted polypeptide sequence is orthologous to G730
gcaccatcagatcataattaaatatggctggtcgttacaatgcaagcaaatcaatctatatatgcagctagctagctcgatctagcctgtcgatctcttatccgcatgcatggtccagcttcatcgatcaactcatccatatgtagatggcgcgcgcgcggcggattattatatccgtcctagggtgaagtcgaggttcggtttgttgcctccgccaaacatcgtcgcagcagctacttggaacggcgccgacaagttcaggtcagaaacatcgtcatcaaggctctcgaaggatttgatgtcgcccggagtggcatctcttgatttgtcacggacgaaccagcaggcggcccctcttatcgaggcgttgcaccagaaagcacacgtgctggcgccattatgctcgctgccgtcaggcggattggagtgctgggcggacgactcggacccgctggtggtggtggtggtattggtgaggtcgaacaggctgctgtcgtcgtcggggatgtcgatgatcgtcttcgcaccacccgcttgcccgtaggatgaagcagaggctggcctgtggtcagtagtcttgatggtccgatacatctgcaagtgcgacttgacatgggccaacgtcagatccttcacgtccattagctcaagaaccgacttgggtgtagctctctcgtggcccccgagcagctcgacggcgtggacgaagcgcgcgtgcagcgacgtggtccaccgcatccggggggcgcgc

SEQ ID NO: 6625 - DNA, 898 bp, Zea mays
  Predicted polypeptide sequence is orthologous to G732
gtccatggcgccgttgcgggcgcgcagcgcggccacctgcgccgtgaggtcgtccagctgccgctgcttgcgcgcgcgggaccgctgcgcggacagccggttcgactccttgcgcttgcgcttcctctcggcggccagctgcgggtcgggccccagctcggacccgccggtcgacgacggcgacgtggtcacggtcgtagacaccgtgctgggagtgggaggagaggccatcatatgcacacactgttcttttttcttttcccttctttttatgcgtctcgacgacgattaattacctggttaacgatcgatcgagatggagcagctagtttgttgctgtgttttactactaagccggactatagctatagctacaagctaagttgccgacagggattcagaacttggatctggaagagcgcgcgagcagtcgatggacacgggggtgtggtttaattaattatgagaagacgtagaaccagtagaggaagacgacggagaaggactggacgagcacagtggatgttatcataaacacgacagcagcggcaccatcaaataaagcctagaggctgttgcttggttgcacaaaacgcatgcaaagcaaatcacggaagcaacgctgtgtgtgccgcgaaagaaagaacaaaaatccagcagagttttcccttgaacaggcaaggtgaaatcttttgacagggtgccgcgcgccctggacgtacaagcaggttttggagcgccggaaatttcggcagagtgacgccctagacagcagtgtttctggcgaaaaatttcggcagagtgacggtcctgaaagctagctaggttcttcttgtaaaaaaatccggcagaggcttgccctgatcagcaaagctaagctggtttgtgacggcaaaag

SEQ ID NO: 6626 - DNA, 969 bp, Zea mays
  Predicted polypeptide sequence is orthologous to G732
cggtggggcctcgtctgggtctagtcatgggacccgtagcttggggtcagagggtgacatggtgcaccggatggagctcatgcgcaagagaaggatggagtcaaaccgggagtccgcgaagcgatcgaggcagcggaagcagcaacatctcgacgacctcaactcgcaggttcgtacgttgtttgtgaacagctcttgtttacctctgtgtctctttctgcatgcatgtttgatctgaacatattttaatcgaaatggtgaatttgctgctgtgctctgtatatatataggccacttttgctttttatgtattgaagcttgcactcatgtgcaggtgaatttgacacaaagcaaaagtcagatgaaaaaaacgagacttgtgcttcaggatatgctgaagcaagcaaactccgataatgcgcggtgccccttaatttctcagggtccaccacccaataaaattgattcaaagtaggccattccaacctaagcaaagaacgatgcacgacgtgccaccgtcgaaatctttctcaaaaaaagggaaaaaagggaaaaaaattccacaccaattcattggctgtctcggcaaaatcaacacggtcatatatatatcaatcattttttttcttcttcttctacccgacgtcgcgtttatatcggaataattgaatcgtcttctgtataaaataaaacaaaacaaaacaaacaggtggacaagttgaggacgacgaaacagcaactcatggtagcactgaacatgaccagccagaactacgcggcagcagcagctcagaactcggtgctgcgcacccagatgatggagctgcagagcaggctctgcgcactgcgtgagatcatatgccatatgtacgcaacacaacgaatgtccatccagcaactgtcatggggcgtgctgctacctaccatacttttggcgaaactgcgtggaactctggcagctgcagcatg

SEQ ID NO: 6627 - DNA, 725 bp, Zea mays
  Predicted polypeptide sequence is orthologous to G732
gacatcttaatgagcattttatcatcatcattacgcatataatttcccttatacatatatatgaagagctttcaaatcacctacctctctttcactatctggcccaatattattatttcctatatatatactcctcaactacaaaaaaacaactgcgctgcattcacgtcacagaaagccaagggaaagttgccattgtccgtcctttaggctcctccgctctaccaacaaaacgtcgccgtcgcctccaaaacaaacgatggggaagcaacaagcctcctttcctcctggccctaccaccgccttctctctagctagcttggagagctagctaataatagcaccggtacgcgtctatgggctgctgctgctgggggttccatgcgctggcgccaagaatatcaccagaggcgtcgctccagctccatgtcgtcgtgacgccgccgttcaccatggctgggtttgtaggaggagcagcagtgccggtgcttgagctgatgcaccagaggatctcggtcagggcgcccagcctgctggccagctccatcctctgggtctgcaggacagagttctgcgcttgcactgccacgaggttttggctggtcgtgctcagcgccaagttgagctgcttgttctggcccttcagctggtctacctgtgacgtgaggtcgtcgtggtgttgctgcttccttagcctagacctccgagccgactctcggttggac

SEQ ID NO: 6628 - DNA, 900 bp, Zea mays
  Predicted polypeptide sequence is orthologous to G732
cgtccacgcccgcccgcccgccttgccaccagccagcacccccctcaacccccggcctcgccgccgccgccgcaccccccaccccccgctgccgcgcaggccggttgctccgattgggctggagtgccaatcggagccaacatcagggggaagcacatgctgccgttcgcgcgccctagagttcctcattgatgtcgcctgtgatcagtgagatcctcctctcggggtttatgatcaactccacactccggcgccgcacccacctcgtccagtccttctccgtcgtcttcctctactggttctatgtcttctcataaactactcgcccccgtcaccgccacgcccctctcctcctccccgtccctgccttcttctcctccttcttcccgttccatctagtagcatccaccgtcaccctcttctcgtttcttctgcccagtctctgccttcttcttcgtcgtcgtcgtctcggtttcagtcgtttcctaaaactttaccttgcatgcacttccctactactgctgctgctagcgaagacctttattagttattagtagtgttaagttattaccaacaagaagcagaaagaaagaaagaaaaaagggatcaagaagcagagagctgttctgttcttttttccccctctcttgcaagaaagggcggttcttgcgcggacggaacgcaggaacaatggcttcctccagcgggagcgggagcgggagctcgggcttcctctcggcggcgctggacttggcggcggcgggaacggaggaggagctgcgcgcgctcatggcgcagcgccgcgccaagcggatgctgtcgaaccgcgagtcggcgcggcggtcgcggatgcgcaagcagcgccacctggacgagctcacggcgcagggcgcgcacctg

SEQ ID NO: 6629 - DNA, 861 bp, Zea mays
  Predicted polypeptide sequence is orthologous to G748
gaggaagggagctagagatgggggagggcagagcaggagacggcctcatcaagctgttcgggaagaccatccccgtgccggagacggccgccgtcggcgaggctgccaaggacatgcaacaaagcggcggcagcggcagcggtacgactgatccgaaagggcaagagaacaacgttcaggactccacaggctcgcctccgcagcaggaggtcgcggacaccgaagactcgtcggcagacaaacagcagggcgaggcgggcaacccaaaggagaagctcaagaagcccgacaagatcctgccgtgcccgcggtgcaacagcatggacaccaagttctgctactacaacaactacaacatcaaccagccgcgccacttctgcaagaactgccagaggtactggactgccggcggtgccatgcgcaacgtgcccgtgggcgcaggccggcgcaagagcaagagcgcgtcggccacttcccacttcctccagagggtcagggccggtctgcccgtcgacccgctcgtctgcgcggcagccaagactaacggcacggtgctcagcttcggctctgccatgtccagcttagacctcacggagcagatgaaacagctcaaggaaaagctcgtcccgatagcgggggacgagcgctcagttgggtctcgcactcaaggaccttctgccaaggcagaagacccggaccggaaggagaatgttacagcagataaatctgcgagagttgttcagcatccatgcatgacgaacggggtggccatgtggccatttagctgtgcgccacccagtaccggcctctgcctgttacggcccaggcagcatcgcaatcccgttcttaccggcagcagct

SEQ ID NO: 6630 - DNA, 1141 bp, Zea mays
  Predicted polypeptide sequence is orthologous to G783
gcacgaggccacacgctcgctgcgcctgcgtgcgtgtgctcgcctcccaccctccccgcactagctctgcactttccctggcagtcgtcccttgttcctgacttcctgcctgagcgcatccggccaccttctatccgcccgccagtccccgccggcctccgcggatcatctgcctgggatcaagatccgtcgaggccgaggcacccgcgcgccaaagatcgtttcttgatctaaatttgggtggtcgtagggatcaaagctcggttctctgcggtgcagttgagagggcaccaatattcttggcatggtggctgacacggaaagctcagattcactgcctggcagttcaaatgctgcttctgagatgcctgctaatgggtctattcaccgaaagtctcaggaaaagccccccaaaaaaacacataaagctgaacgagagaagcttaaacgtgatcagttgaatgacctttttgttgagctcggcagtatgctagatcttgatcgacaaaacactggaaaggctacagtgctaggtgatgctgcgcgagtactgcgagatctaatcactcaagtggaatctctcaggcaggaacaatctgctcttgtatcggagcgccaatatgtcagttccgagaagaatgagctgcaagaggagaacagttcgctcaagtcccaaatatcggaactacaaaccgagctctgcgcaaggatgaggagcagcagcctgagccaaaccagcatcgggatgtcggatccggcaactcaccagcagatgcagatgtggagcagcattccccacttaagctccgtggccatggcggcgcgcccagcaagtgcagcgtccccgttgcacggccaggagggctactctgctgacgccggtcaagcgggctacgcgccgcagccgcaacctcgggagctgcagctctttccggggtcatcggcatcgtcttcaccggagcgtgaacgttcttcccggctcggaagcggccaggccacgccgccgagcctgacagattccttgccgggtcagctctgcctgagcctcctacagccatctcaggaagcaagcggcggcggcggcggcggcgtcatgtcgcgcagcagagaggaacggcgggacgggtagccaacctcgtgc

SEQ ID NO: 6631 - DNA, 911 bp, Zea mays
  Predicted polypeptide sequence is orthologous to G783
gcacgaggtagctctctccgtctccctcatcctgacctcgattcgagctagtttcgggaagcaaaggtatcggatcaacccccttgatcacccatggtgcccagggatagggcgcacagcgccgccgctgccaccgcgcccccgacggagaagcccgttcaagggcctatccagaacaacaagtgcgaaaagaaggctccaaagaaggtgcataaatctgagagagagaaacgtaagcgggacaagcagaatgatctctttggtgagctgggaaacatgctagaacctgatagacagaacaatggaaaggcatgcatattaagtgacactacacgaatacttaaagatctactttcacaagtagaatctcttcgaaaggagaacaacacgctgaagaatgagtctcattatgtcgctttggagagaaatgaactactggatgaaaccaatatgatccgtggcgaaatatcagaccttcaaaacgagatgaggatgcggctagaagacaactctatctggagtcatgacacttctagaccaaatcttacagcaccccatccagcgaccacagtatttacattgcagcattcaccacatccacaagtcattgcaacaatgacacttcctctgcaacagccagcagtcgttgagcaatcttacgctgccccacggcgggagctacagctattccctgaagctgcacccactgaagatactgagccaccacaaaacgaggggacctctaatcatgtgatgcggccgcaggcgaggtacccaccagcaatgaccactttgcctgggcatgtatatccagtccttccaagagtggaagatgagcaacgcagcagcggcactactggtagcagagaggaaggcggggtaggcaaccgttaacagctcgagggggggcc

SEQ ID NO: 6632 - DNA, 837 bp, Zea mays
  misc_feature (646)..(646): n is a, c, g, or t
  Predicted polypeptide sequence is orthologous to G783
cgcgcttgcaccgttacgcagtgcgacctctgcgtcttcgaatccaggaaggtagagaggaggaggaggtttgtggcaggatttgaccagcccaatggttccatccgagatggggagcgtcgccaccgccgtcagcacgcctgctgcggacaagctgctccatgggcctatctctggcaagaagtgcaagaaaccaggcccgaggaagattcataaggctgagagggagaagcttaaacgagaccacctaaatgatctctttgttgagctgggtaatatgctagaagcagatagacagaacaatgggaaagcatgcatactgactgacactactcggatactaagagacctgcttgttcaagtagactctcttcgaaaggaacatagcgacctacaaaacgaatctcattatgtaacaatggagagggatgagatgcaggatgaaaacggcgtgctccgcaaagaaatttcagagcttcaaaacgagttgacaatgcgggtttcaggcagtccagcaggttggggccatggcaccgccagatcacatccccctcttcctcactcaaccgcagtgttctcgtcggagcaggcgatgcaaccacccaccattgcaagcgttgtattcccgttgcagcagccactggcnaccatcagcatgaccaaaccacctcatgctgcaccaccactcgaactgaagctctttccagaagtggcatctgccgaaggccatgagccgtgtgaagaccacaaagctcccaaccatgtggcacgaccacaggcaaggtacccaacgcaatcagcctcatggcccgtaaacctgttctctggccttcccga

SEQ ID NO: 6633 - DNA, 795 bp, Zea mays
  Predicted polypeptide sequence is orthologous to G783
aatgggttaaaaaatctgtacattgcacaactgtcatgacaaggctatcgcaacagcattacgctacaggcgtacagcactggttaaaaatcagatgggctcgcgttggttaagttcagcatcatcaccttgtaaactggcaacacagcaggcggagtccctcattaccgggagcaccctgtgcacaatcaccaggctggaaaaccaggtgatatttcgggtgctacctcatgaaacatcatttcccatcaagtacatacaatgagtgctggcgaaggggaaaaaatccttcctttctttgggtgagaagttaaggcagacaatatcaggcctgccaactaccagtgcagtaggtgtaccattgttatttgcagctctgcagccaatgtgaagctaccaacacattagtagaacatccattatgtcattttgcatgcctaaaaagacttggtcagcaaataaaaaaaactaaatagcttgtaccaaaaggacaggtgagtaatgagtaaatgatgcagccatggttttattgtaaaacattaaaaatgacacatattgttgttcatggcgagacagaaatactttgttctgtactgcagtaccatcctaacagtaggtaccagtcagcggtaatccaatgtgccagcacccaatgtgaatggaaatgttagagagccatcagtggagccactaagaaaattagtatgactttgaatgccttcagcgacaatattgtcaactggattttgtgttcgatcacaattagcaccaataagatcagctatgtcagggggg

SEQ ID NO: 6634 - DNA, 718 bp, Zea mays
  Predicted polypeptide sequence is orthologous to G793
tttttttttttttttttcgacatattgcggttggagttataagacaacatcacgacgtccagagaggggggtgtgtggaaacatcggcatacatgtggagaacaaaatattcgagcccgaacagggaaatacagtgtaagaaatgggatgcaaaggagaacttgctaggagaacacgagcctagcctcggcagggcacaggagctggtgacaatcatgcataatgtccaagcacctgttccagctcagctgtagctgtcgccgacagggccaccgtgccagcgagcgcccttagatcagcagcattcaaagtacggttgcgcagcagaccacggcgcttaacctgaaccttgagttccttggagcagtttgctagttcatccttcagagatttcagccgcgatgctttggtggacatatcgacatagtgagcaggctccttcgcgcgcaagcgctcgctgtggcgagaagcaaggagttggccagcacccttgtatttggctgcatgatcagccgaacgcttggcgcggacacggatcttccgagcagaggcctcgtgaatagggtcaggttcaagggaggacatggggataggcgatttacactccgcgacaggggagttttgcgcagcggccatgtcaggaagaggggggagggcggcatcaagggggtctgcaacagcaagcatggggagatgacatagctttatgataatgggg

SEQ ID NO: 6635 - DNA, 646 bp, Zea mays
  Predicted polypeptide sequence is orthologous to G8
agggttgattctgtagagcgtatgatagggcagccattcgcttcaatggaccggatgctgttaggaactttgattctgtttcctatgatggagatgtcccacttccacctgcaattgagaaagatgtggttgatggagacatccttgatctgaatttgaggatttcacaacctaacgtgcatgatctcagaagtgatggtaccctgactggttttggattaagttgtaattctcctgaagcttcaagctccattgtttctcagccaatgggcccccagtggcctgtccatcctcacagcagatcgatgcggccccagcatccacatctgtatgcatctccttgtccaggcttctttgtgaacctcagggaggcgcctatgcaggaagaggagaaccggtccgagccggcgtgtccccagccgttcccctcctgggcatggcaaacgcagggctcccgtgccccagttctccctgccaccactgcagcatcatcaggattctctaccgccgctgccaccggcgtggacgcggccacagccggccacagcgtgccgccgccgtctggtagcctccggcagttctcgggctaccaccagctccgcttccccccaaccgcctgacggagacagaccacctcctgttgagt

SEQ ID NO: 6636 - DNA, 883 bp, Zea mays
  Predicted polypeptide sequence is orthologous to G8
acttgtgcagggtgacgcctctgtacctggagctgcctctcgagaagccggtgctctgacggcgcaggacgtgcacgaactcctccttggacaggctccccatctgcttcatgtcgtcctcgtagtcgctgaggttgaagttgatgtcggcgtcgacgccgcggaacttgatcgccgcccggtcgtacgcccttgcagcggcgtgagcggtgtcgaatccacctgcgtatatcggccagcagccggaccaccactaggtacacctgcttgccgcaatcccagatgtgggactcccagcggcctgtgcggcggtagaaggtgacgccgcggtactgcgagctgcgggagcgcgggccgcggcggctcttcttggccggcggcggcgcggcgtgtgggtgcggcacgatcctggggcccggcgcctgttgctgctgcaggtcggcgcggaagaagccgagctcggcccaatgccgcggcgtcggggccggcggaccggcgccggccgggaacagctcgcgggtcacgagctgctgctggtgctggtggcggtggcgaggaggaggcgatggcgtggcgtcctcgtcctcgtccgcgccggccgcgtcgctatcgctccggatgaggatgctgaactccagcacggccggcgttgagctagatccctcctccgccggcgcgggcgcgccgcccgccgacgccgcttccgacgcgttcagcaccgacgaccccgagtcgctcgcctccatctccaccggcggcggcgcctcggccacgttcagatccaactgcatctcctgctcctgctcccctcccctccaaagctacaactcgcaagcggcagcccgccaccgatccccagtcgcaactgggctgctaactacct

SEQ ID NO: 6637 - DNA, 594 bp, Zea mays
  Predicted polypeptide sequence is orthologous to G811
tttttttttttttaatagcaagcaaaactgaataaaccgtctaagccaaagcatattcgtacatagcgtgcctatagacactatacgcgtcgtcttgaacatcatctcatggtgatcttctcttttacccatacaactataatgctcgtctttcaaatacaatgccattccaaactcaaatcaataaagattcttattacgccaggttccgtgtcgtgctctgctcgccgatcggtagtattgttacagagcgatcgcgcctcgacggctttctcgagtatggaggaatccttggaagccacaaaagacgaagaaagcgacgtagacgaggacagcaacgaagatggtgtctgaaactgccttgccatcttcgggatcatccacgccacccgtgaattcttcatggttgcttcggtagagacctgcgagggcgctgaggatgacaatggcgaaaacggagagaacggtgcatgaccacgcgttaaaggcgctgacgacgggcttcattatgggcgtatgtgggaagagttcgagtatggttgaccaaccgatgtatcacgatgtgtgtggtggtaatggattattacttgcgac

SEQ ID NO: 6638 - DNA, 781 bp, Zea mays
  misc_feature (661)..(661): n is a, c, g, or t
  misc_feature (752)..(752): n is a, c, g, or t
  Predicted polypeptide sequence is orthologous to G811
tgtttcctcagtggactagtgtgaagctgtgcttagcgtagcggaagggaggaaggacaaggcaaggcaactgatggcggcgggcggcggaggcggctcgccggcgccgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttctccagcttcgtccgccagctcaacacctatgtcagttaaatcacacactccagctagctaaattgattgccgtctctcttctacgagctgaaccctgctcttgggagagcgctggatctgtataaactttggcgtgtgtaccgaatgctcttgctgtgctgtaccaacacaaatttgtaaattggtttttgttggagaaaaaaaaggaaatatgtaagcttgctacctgcagcgacgaaattcttcaaaacatctttggagatcgaccattcaaaattcgtagacaaacatatggacagagatggagccgcgtatatatatgcaacgaaattctgcagacagttcggtgaatatatgcacggagaaaaattggtttttttgcgcaatttacctatggatttctgncagaaccgaacacaccgccgtgagaactttataaatcgcgagagccaagagctgcacagctagtactagtacttcccttgtcctgacttgntattttcagggcttccgcaaggttgatcc

SEQ ID NO: 6639 - DNA, 876 bp, Zea mays
  Predicted polypeptide sequence is orthologous to G811
cgatgttgccgtcgacaccctgccaccaacgacaggttaccttcttcgggcccttctcaccatttcctcatttaagccccgtgtgccttgctcctcggtgtttcctccagatagtagtgtttcctcagtggactagtgtgaagctgtgcttagcgtagcggaagggaggaaggacaaggcaaggcaactgatggcggcgggcggcggaggcggctcgccggcgccgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttctccagcttcgtccgccagctcaacacctatggcttccgcaaggttgatccggaccggtgggagttcgcccacgcgtcgttcctgcgcggccagacgcacctcctgcgcaacatcgtccgccgcggcagcagcgccgccggtgccggaggcggaaagaggaaggacgccagccccacggagctggcctccggggacgacatgaccatggtggccacggaggtggtgcgcctcaagcaagagcagcgcgccatcgacgaccgcgtcgcctccatgtggcgccgcgtgcaggagacggagcgcaggcccaagcagatgctcgcgttcctcctcaaggtcgtcggcgaccgcgacaggctgcaccgcctcgtcggcgacgcccccgtgccagataacgggttcgcctcccggcgtgccgccgagccgcccgccgcggaggtcggcgagaagcgggccaggctgctgctcgacggtgacagcatggtggcgctcggtcccgaggccgt

SEQ ID NO: 6640 - DNA, 995 bp, Zea mays
  Predicted polypeptide sequence is orthologous to G896
tgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgtcataatgtgtgccttaattgtcttgcggccaataatgtgtgtccatgtgtcgatcggttaccggccctgagccaagcttatagcctgtggaccgacgactttgttgaccattataaatacaatgttgataatgtttaaaaaaaaaaaaaaaaaaaaaaa

SEQ ID NO: 6641 - DNA, 836 bp, Zea mays
  Predicted polypeptide sequence is orthologous to G896
ggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgtgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgaggggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgaggtcatcgtgcgcccgctggtgcacggcgccaggctgcacgccgtggtggacgcctgctacagcgccacggtcctggacctcccctaccagtgccgcatgtccaggaacgggttctggcagtgggaggacgagagcccgccgtcgggcgcctggaagggcaccagcggaggccacgccgtgctcatcagcggatacagcgagggca

SEQ ID NO: 6642 - DNA, 881 bp, Zea mays
  Predicted polypeptide sequence is orthologous to G896
caacgtcaaacgaccgcaccaaccaatccacttcgccggcgatccgtctcatctcgtcgcgtctccggcgccggcagacacgggtaacgcggctccgagatcggcgggcaggatgatgatgctgatcgattgctcggggtgccgtaccccgttgcagctgccgcacggggcgccctgcatccgatgcgccatctgtggggccgtcacgcacatcgcccccgcccctcccgccgagcccaaccgcggcgccgtacaaccggcgccggggtgggcgccgccgccgccgccggtgcacggacggaagcgcgccgtggtgtgcgggatttcgtatcggtactcgcggcatgagctgaagggctgcatcaacgacgccaagtgcatgcgccacctgctcatgacgcgcttcaacttccccgacgactccatcatcatgctcaacgaagaacaaacggacccctacaaaatcccaacaaagcataacataaggatggccatgtattggcttgtgcaaggttgtcaacctggagattcattggtgttccattattctgggcatggatcacaacaaagaaattacagtggagatgaggttgatgggttcgatgaaaccctctgcccgttggattttgagacacaagggatgattttggatgatgagataaatacagcattagttcgaccacttcctcatggagttaaacttcatgcactcattgatgcttgtcatagtgggactgcacttgatttgccttatctctgcagaatgaacaggagtgggcaatatgtatgggaagatcaccgaccgcgatctggtgtctggaaaggcactagtggtggggaagctatttcctttagtggttgtgatgatgatcagacctctg

SEQ ID NO: 6643 - DNA, 465 bp, Zea mays
  Predicted polypeptide sequence is orthologous to G905
ttttttttttttttacttcttttttttttttttttggcccctcctgaattttcgtcctgcgtccgccactgtatacgaaacatttagctgccgtgtatactcaatcctatagaaacatttaactgcttatttagctgtcataatatcgactgtcagacaccaagccaatccgctgctaattaagcccgctggttgattatgcggttggcaagtggcagagcagatttaagaccactccggcggcccggtcgccgtcgctaacgtgtccgcgccgttccggcaccaccgggatgggctgcgaccgcggcctggccaccgaaaaggtaaaagtggcctccgagacggtcctcaccaaacgcgaacgcgcgtgagacggctggcgagccggcccagcccgagcagcccggcccggccccgggggcttggcaggaggtcggagcggcacagcgggcacgtcgtccggcc

SEQ ID NO: 6644 - DNA, 594 bp, Zea mays
  Predicted polypeptide sequence is orthologous to G921
tttttttttttttttttttttggatgataatggcgtacgtgctagagctagcttgaataattgacagcttcaatggcactggccaacagagcagggtgaaataaaaatgtctgtatcaattaatcgtcgtgttcgtctattattaggctataatccctggtcaaggatccggccggagagcgcgctgactttctccgccttgaacccgggatcccgcgtgagcgtgaccgccatgtgctccgcgaggttcttcctcgcgacctccgacgacggcccggcctcttgcttctgcagcggcagtggcgccggcggtcgcgcggcctcgcccgccggcggcgcggacgacctcttggcgccgccgtcgtgctgcggcgggcgggcgtggttgtgctcgccctcgtacgtggccaccaggacggcgctgtcgtccgcgctgcgctgcaccttcttcttcaccgggcacgacggcgcgagcgagcaccggaagtaggcgcgcgggcacgggttgtccttggtcaccttctgcccgtacttgcgccactggtacccgtccttcaccacctgtttcgtcgaacgcgagcgggacgacgaatt

SEQ ID NO: 6645 - DNA, 818 bp, Zea mays
  Predicted polypeptide sequence is orthologous to G921
tccgagagtcctgcagagcccatcctgttcctgtccccctcgagcaatcgagctctacagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgtcccgccactggctgctgggggccacggacatcgtccctcgctgacgggaaggacgaggccaagaccctggaggccaggctcacccaggtcagcgaggagaaccggcgtctcaccgagatcatcgcctacatgtacgccagccaggtcgccgcgcggcggagtcccgacggcaggaagaggagcagggacagcctggagccgtcgaattcgggcgacgccaacgctgccgtcgagagcgccgccctcagcgacgagggcacgtgcaggcggatcaagctcaccagggtctgcaccaagatcgacccctccgacaccacgctcaccgtcaaagacggctaccagtggcgcaagtacggccagaaggtgacgcgcgacaacccgtccccgagagcctacttccgctgcgcatacgcaccatcctgccccgtcaagaagaaggtgcagaggagcgcggaggacagcgccatgctggtggccacgtacgagggcgagcacaaccactcgagcccgacgcgcgccggcgagctccccagctccacctccatcaactccctccgcccggccatcacgctggacc

SEQ ID NO: 6646 - DNA, 889 bp, Zea mays
  Predicted polypeptide sequence is orthologous to G921
cgtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggttaccaaggacaacccctgcccgcgggcctacttccgctgctccttcgccccggcctgcccagtcaagaagaaagtgcagcgcagcgccgacgaccccaccatcctggtcgccacgtacgagggcgaccacaaccacggccagcccccgccacaggcgcaggcgccgcacgacggctccagccctg

SEQ ID NO: 6647 - DNA, 820 bp, Zea mays
  Predicted polypeptide sequence is orthologous to G921
gggtttttagtcgagatggtaaataatgtatgacgcgcgtgtggaccaagagtcatggcttgctgtacttgtggtttctgagctgcaacactcaatcgactactaaactaaggtaataactaggttagtgcccgtgcgttgcaacggaaacatataatatcatgataatttaaagagaacccagagaacaatcctgattgtactattgtatatattggcaaccttggacatgaggtagaaccaaattactgcataaccatgttcatcgttccaatttgttctagctctccgtggagcacattgtcccttcgtatcggaggacggagaaccggctgattctcagagaacgccggtggggcagaggaaaaaggacggagggagaactcacctcgacgaaaaccaatgtgacgagggcggacgcgaggtgacggtggagtagatgaacagtcagggtgcgagcacgcctcatttacaaatctctcattaccgatttgggatcctacaggcctcaaattctctcccggcaggtagattcccgtactttggtatttttgtttgatagatacatgccagctgcatgctggcgctatatgacaaccatacaatgtttctggtatcaacctgttagtgttttaggcaacgacaaaagcaacggtgctagcgttcataaatattcttcagtacatggctcttctccaattcttaactctttgatcccaagcctaaacccaacaataacggtttgcgtccctatcaacagttcgtgcaaaattttggatccaatgcccacatgtcatcggttctactcttaatgagacat

SEQ ID NO: 6648 - DNA, 922 bp, Zea mays
  Predicted polypeptide sequence is orthologous to G927
cgccttcttcatatcatatcctccctcctgctctgctctgctcgggctctttgccaccccggccgaatcttgagttcctgacgcagggtagggagccccgtgttcctcgattgcttccaccccgtgctgctgcctggattccgagcggctggtgcctggtggttcggttaggtgcttccctcgtcaacgtcagacgcccccacttccgccagcaacaacaccagcagcagcacgatgatgagcttcaggagcagcagccacgagggcttcggcttcggccacgccgccgccgcggccagcggagcgccgctgccgtggtgggcagggccggccccgatgctgagcggcgagccgctggccctgtcgccggaggcccactgccgggacggccgcatccaggccccccagggacctcccgtgccgtcggtcaaggctcctgtactggcaccccagcagccgcctccgctgccggagagggggatccctgagctcctcaacctctccgtggatcctcaaggtaaagggaagaaaggatctgatcactctgccactattgctttgcaatcaccatttgcaatatacaatgctcattttgagctgggccttggtcaatcaatgatttccgctgataattcttatgctgatcaacactatggcctgctttctccttatccagtgggtgcaacgcctggaggtcgtctgcttataccactgaataggccaacagaagcaccaatttatgtgaacgctaagcaatatgacgccatcatgcgtcggcgctgtgcccgtgccaaagcagagagggaaaataggctggtcaaaggcagggagccatatctccatgagtcacgccatcagcatgcactgcgtcgcccgcgaggctctggcggacgcttcttgaacacaaaaaaagaatccagcg

SEQ ID NO: 6649 - DNA, 925 bp, Zea mays
  misc_feature (808)..(808): n is a, c, g, or t
  Predicted polypeptide sequence is orthologous to G927
cccatgctgatctcggcgcgcttctcttcctcctcccccagagccgggcactgatttcccttggctgctgctgctggattctttggtgttccatcaggccaaggatcccgcaaagagctccggagccaagcctgctgcagccgtcgcgtcgggtgaggcaggcttcagcttcagtctcctactcgacgaggcaagcggatcggagcgggcctccgctccgccatgatgagcttcaagggccacgaggggtttggccaggtggccgccgccggtgccgggagccaggctgcctcccatggtggagcaggcccgctgccatggtgggcggggccccagctgctgttcggcgagccggcgcccccgtcaccggaggagacgcgccgggacgcccagttccaggtcgtgccgggggttcagggcacgccggatccagcgccgcccaagacagggacacctgaggtcctcaaattctctgtctttcaagggaatttggagtcgggtggtaaaggagagaaaaccccaaagaactctaccactattgctcttcagtcaccgttcccagaatacaatggccgtttcgagattggtcttggtcaatctatgctggccccttccaattatccttgtgctgaccagtgctatggcatgcttgcggcttatggaatgagatcgatgtctggtgggagaatgctgttgccactaaatgcgacagctgatgcacccatctatgtgaatccgaagcagtacgaaggcatcctccgccgtcgccgtgctcgcgccaaggcggagagcgagaacaggctcgccnaaggcagaaagccctatctccacgagtcgcgccacctccacgcgatgcgtcgggtaagaggcaccggcgggcgcttcgtcaacacgaagaaagaagggcgtggcacgggcgttgctt

SEQ ID NO: 6650 - DNA, 620 bp, Zea mays
  Predicted polypeptide sequence is orthologous to G937
ttttttttttttttttctggcccctgctgagaaatcaggctgcacacgcggcgcgcgtcgtcggacggcggcgaccagcacgcgggcgggctgtggtcgtcggcgccggagcagcagtacacgacgtcgcagcacagcacgtcgcagtcgcagtcgcagtccgggtcgccgcaggggccgctgcagctggcggtgtcgagcagggccatgtcggccaccgccggggacagctgcgacgccggcgacgaggcccacggcggccggtcggagagctacggctgggagatgccgcagcacgggacgaaggcgtcgtcgtcttgatgatccttgtccttggacgggatcacaattcacaacagtatagaagacggtgcggcgtggggcatggtactgaggacaactgcggaagaggcggcattttttgtacaggcgttgagatgatttcatttttcccccttccttttttttctggtagagggaggaggatgtgatggtgaagatgaactgatctggtgttgttgatcgagagtgaggcatatgagatgagatgttattttttacatcccattgtacaatctggaggctggatcgcgttgttttaacggggatggatcggtttt

SEQ ID NO: 6651 - DNA, 602 bp, Zea mays
  Predicted polypeptide sequence is orthologous to G937
ggtatgtatgtatgttatctatataatatctcattctcagggcgaaaattttgggacctgcccagaaattaaaagtcaggaagccatcagctttccatgtacgtacatgacaaacaaacaatccaacccatgatcagttgagctcttgggcgcacgcactacaacctctctcaagactgatgaatctgttattgccacagacgggcaagcagaagccgcgacgctatctctacactctcatccgtcgaacgcggcctttacacgtatttccggctgtagccttcggacttgtcgtcctcgtcgctgctgctgctatcgccgccgacggtggccgctacaccggatccagagaactgaagcgggccctggggagacccggactgcgagctgctttgctcctgatgaggaggagcccagaggccgcccgccagcatgaccgactggctcaccggagccacgacgccgggggatcttctgttgtgcagccggtacttctgaaatacgaacacgacacgccgatcgaatcagtttccaaaacaagatgctatatcatcgccttcgtctgaaataggcaccggcgcggcgctactagaaggaaataa

SEQ ID NO: 6652 - DNA, 760 bp, Zea mays
  misc_feature (643)..(643): n is a, c, g, or t
  misc_feature (691)..(691): n is a, c, g, or t
  Predicted polypeptide sequence is orthologous to G937
tctaaaacggcgcgtccgacgtcgccgtttccaagttgctcggtggcgcacccatgcccataagggccgttgcggcggtgccatccctgccgccgagcggcagattctgtgccactatgccaccgtctggctctggggccaacttgcactctcaggctcagcagcaagccaggaaggcgaggcggtgctggtcgccggagcttcaccggctctttgttgccgccttgcatcaactcggcggccctcaagttgctactccgaagcagatcagggaggtgatgaaggtggacgggcttacaaacgatgaagtgaaaagccatctccagaagtaccggctgcacaacagaagatcccccggcgtcgtggctccggtgagccagtcggtcatgctggcgggcgggctctgggctcctcgtcaggagcaaagcagctcgcagtccgggtctccccagggcccgcttcagttctctggatccggtgtggcggccaccgtctgtggcgacagcagcagcagcgacgaggacgacgacaagtccgaaggctacagccggaaatgcgtgtaaggccgcgttcgacggatgagagtgtagagatagcgtcgcggcttctgcttgcccgtctgtggcaacaacagattcatcantcttgagagaggttggttgtagtgcgtgcgcccaagcccaaggagctncactgatcatgggttggattgtttgtttgtcatgtacgtacatggaaagctgatggcttcctgactttt

SEQ ID NO: 6653 - DNA, 1619 bp, Zea mays
  Predicted polypeptide sequence is orthologous to G938
ccacgcgtctgcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatgggggagggtgatcttgtggacccaccgccagacagcttcccggacgccgtggaggacgacagcgatgacgacgttgaggacatcgaggagctggagcgccgcatgtggcgcgaccgcatgaagctgaagcggctcagggagctgcagcagagccgcggcaaggatcccatggctagcggtgggggcctggccgacggctcatccaagccaaggcagtcgcaggagcaggcccggcgcaagaagatgtcgcgcgcgcaggacggcatcctcaagtacatgctcaagatgatggaggtgtgccgcgcgcaggggtttgtgtatgggatcattccggagaagggcaagccagtgagtggtgcctccgacaacctccgtgcgtggtggaaggagaaggtccgcttcgaccgcaacggaccggccgccattgccaagtaccaggccgacaacgccgtccctggcgccgagaacgagctcgcctcgggcgctgccagcccccattccttgcaggagctgcaggacactacgctgggctcactgctctcagcgcttatgcagcactgcgagcccccacagcggcgctacccgctcgagaagggcgttcctccaccgtggtggcctaccggcgacgaggagtggtggccggaactcggcattcccaaggaccagggcccacccccgtacaagaagcctcatgaccttaagaaggcctggaaggtgagcgtgctcaccgctgtcatcaagcacatgtcaccggacatagagaagatccgtcgcctggttcgccagtccaagtgcctccaggacaagatgactgccaaggagatctcaacctggctggcggtcgtcaagcaggaagaggagctgtaccagaagctgaacccgggcgcacgcccaccggcgtctactggtggcatcgcaagtgccatatccttcaacaccagctcgagcgagtatgatgtggacatcatcgatgagtgcaagggggacgaggccggtaaccagaggacggcagtcactgacccaaccgcgttcaaccttggtgccgctatcctaagcgacaagttcctcgtgccgacgccgatgaaggaggagaccgccgacgtggagttcatccagaagaggacacccccgctgcagccgagccagagctgatgctaaacaaccgattgtacacctg

SEQ ID NO: 6654 - DNA, 706 bp, Zea mays
  Predicted polypeptide sequence is orthologous to G938
tttttttttttttttagtattttatgagactttttatttagttctaataggttgagcaagatggaagctcccattacgattttgtggttcatggctgggtctggacggcggcatcagccattgcccattatatttgcaggcttatacaaatacttaaatacgagactggagaaaactcacgacgatctcgtcgtctactcgtgaattctaatatccaacctccattgtccattccatccatgattctgccgcatgcgcagtcagtagaaccaactgccgttggatcccgtggacttgtgcggctgctgcaacccgccgcctcccgccacgtccaggcctgagccgaacctcagccccggtgacgcggcggcgatgtcgcctccgaactgcgcgtcgtcgtcacggacgtagaccgccgccgctgcgctctgctgtatcacattgctgatgatgtcgccaaatcggcacggcgtcgggaacggaccgggcagctgcacttcggggccgggggcggccgtgtccacgttgcccacgttggcctcgtacatgtccatcagctccccgagcgacctctggccgtccaggggcaaatccaagtccaagccgccaagcgccgccgtctggccgacgctgttgttgaacatgcacgagtactggtgcgcgttgcgcgtgttgcggtccaggaacccatgcgcgctgctgctgt

SEQ ID NO: 6655 - DNA, 808 bp, Zea mays
  misc_feature (760)..(760): n is a, c, g, or t
  Predicted polypeptide sequence is orthologous to G938
tccaaataaaaaccagccgcagcgggaggtggcgcgacgcgaacccacccaccctgcgaacccggccgcgaaattctcctctcggattccgccgccgcgaaccgtcccctcgacgaggctgctgccgtagaattttcttatcattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcaacggattttgaggttgatggcatcgacaacctcagcgagaacgatgtcagcgacgaggagatcgatgccgacgagctcgcccgacgaatgtggaaggacaaggtcaagctcaagaggatcagggagaggcagcagaagcttgccctgcagcggctggagctggagaagaccaagacaaagaagatttcagaccaagccctccggaagaagatgacgagggcccaggacgggatcctcaagtacatgctcaagctgatggaggtgtgcaatgcccgagggttcgtgtacgggatcattcctgagaaaggtaagcctgtcagtggtgcgtccgataacatcagggcctggtggaaggacaaggtgaagtttgacaagaatgggccagcagcgatcgtgaaatacgagcttgagaactcgatgctgagcaaccctaagggcggcggagccatggaccagcatagcttgatggacctccnagacggcactctgggctcattgctttcagcgctgatgcaacactgcag

SEQ ID NO: 6656 - DNA, 888 bp, Zea mays
  misc_feature (884)..(884): n is a, c, g, or t
  Predicted polypeptide sequence is orthologous to G938
caagcacatgtctcccaattttgataagataaggaatcatgtacggaaatcaaagtgtttgcaggataaaatgactgcaaaagaaagcctgatttggctgggagttctacagagagaagaaagccttgttcacagaatcgacaatggcgtatcggagattactcagcgcagtatgccagaggagaggattgcagacacaaatagcagcagtaatgagtatgatgtgtatggttttgaggatgctcctgtttctacatcatctaaagatgatgaacaagatctgtctccagttgcacaatctgctgtggagcatgttccgaaaagaggaagggaaagagcttacaataaacgccctaatcaaatcgttcctggtaaggcaaaagaaccaccaaagagaaaaagaacacgccacagctccactgttaccgagccagatgcacacagagttgttgatgcaccagaaaactcaagaaatttgatccctgatatgaatagattggatcaagtagaaatcccaggcacgtcaaaccagattgtcacctttgaccatgggggcaccacaactgaagctttacaacacagaggagatgctcaagtacaggtccatcctcctggtgctgaggttaatagcttctatagtgctccaactgcaaaccctactcctataagcatatatatgggtgaccagcctataccttatcaaaataatgacagcacaaggccgagatctgaaaatagttttcctgtagatgctcatactggtttaaataatcttcccagcagttatcagaacttacctcccgaaacatcactacccacttccatgatggatcatcatgtggttcccatgggtatcagggcacctactgatagcattccctacngtga

SEQ ID NO: 6657 - DNA, 965 bp, Zea mays
  Predicted polypeptide sequence is orthologous to G962
ggagtggtayttctacgtgccgagagaccgcaagtacsgcmacggcgaccgccccaaaccgggtaacgccgtccggctactggaaggcaacgggcgccgcccgcacggtctacgtcgaggtcaagcggccgatcgggctcaagaagavgctggtgttctacgtggggaaggcacccaagggactcaggagcrgctggatcatgaacgagtaccgccttccttcaggcgaggccgaccgctaccaaaaggctgcagcaaccatggaaaagaagcaccaccggacatcggcgtcgccccgcatggcgccagtgttcgacggtgacmactcatcaggttacatgaacaagccatacagtggagcaaacaccaccatgctgggcatggcatcwtcagccgcagctcgrgcagcaaaactggcacwacagacgtcaatgttcctatcaaccccctaacttagctccaccacgtcgacggaggaggacggtacatmactctacmacatgaagggtgttaacccaccaatgctgccttcttcaacacacgccctgcttaatgcaaactccgctacaatggcaacaattccaatagatgagctgagtagggcaattggatgccaaggagaccctaaccagaccttgccaamacamgctccattgcttccttttcctaacttggaaaagatttgggattggaatccactcctagamtctcccaaggtttgcacaagcttcaagtgactttcaagtggctcgaagcatatatgtgcatgcttgcatgcgtgcacctattatttatgaatacaagtgtgtatatgtgcagacacataatttttatttgggctagaatgtggttgagatgtaatggaatatataggatgagatagttctagtcctatctaatgctccactatattaatcaattcaccrtcacaaatatgtactatgttgcagtgatcatttgaactt

SEQ ID NO: 6658 - DNA, 1897 bp, Zea mays
  Predicted polypeptide sequence is orthologous to G979
gtgaggcgccacgcaacaacaatggcagttggcacagaggcgcaacgcaaaaaccccccaccgccaccgctctataaaaaccccgtcctcctcctcctcctcctcctcccccgcctcgccgccagtcagattcaccaccggctcccctgcacaaccgcgtccgcgctgcaccaccaccgttcatcgaggaggaggggggacggagaccacggacatggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcaccacagtcgacgacagcatcgaagagggcttgtggagcccttgcatggattacgagctagacaccatgtcgagaccaaactttggcagctcaatcaatctgagcgagtggttcgctgacgcagacttcgactgcaacatcggatgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactaattctggaacccgaggaggttttcgctttccaggtgtcctgtcttgggtaatccttgatctgtctaatgccacagtgccactgcaccagagcagctgagaaccttcttgtagaaagcccatggcagtttggcgttagacaagtgtgtcgatgttctttaattctttgaatttgcccctaggctgcttggctaacgttaagggtttgtcattgtctcacttagcctagattcaactaatcacatcctgaatctgaagtggttgtgcttgtgcagtttatcactgagtttacatggcatgatcatggtaacgcagccagtgcagcatagatttgttcgtttgaacagtttaccaaggctgtaaccctagtaagctccagattaaggaacctttgttttcaccattctatatttactagatgaatgcccgtatgttgcaacgggaatatataatattagtatactacaataacttatatacaaaaaaaaaaaaaaaaaa

SEQ ID NO: 6659 - DNA, 1441 bp, Zea mays
  Predicted polypeptide sequence is orthologous to G979
gcacgaggctcaattagcacatgcactgaccatggaacaccacctggcattctggcgctgattgtgaaatgggggtcccaggcttcacactgactcggaccaatgtcctctagttgggtgacacggtgcaagatgaggcccacctgtaacgtcagatcaggcatgcatcacctgggcctgtgacacgtcacacacgccacgccagccattgtgctgttgcatgactcatcaccaggcattgtgcttgtgcacctagaaaatgccagctctgaactgcaagcaccacagagtacttacatcatctttgaaaatgaaaccagtgcatcattttcagctcatttcggtctgaaaccagctaaaaaggatgaaacttttgatgttcttgttgcttccatggtctaggcatcaccacaacgggaggtgggaggcacggatcgggcgagttttagggaacaagtacctctacttgggaacattcgacactcaagaagaggcagccaaggcctatgatcttgcggccattgaataccgaggtgccaatgctgtaaccaacttcgacatcagctgctacctggaccacccactgttcctggcgcagctccagcaggagcggccacaggtggtgccagcgctcgaccaagaacctcagcctgatcagagagaacctgaaaccacagcccaagagcctgtgtcaagccaagccaagacaccggcggatgacaatgcagcgcctgatgacatcgcggagcccctcgtcacggtcgacaacagcatcgaggagagcttatgggagcccttgcatggattatgagctagacaccatgtcgagatctaactttggcagctcgatcaacctgaacgagtggttcactgacgcagacttcgacagcgacatgggatgcctgttcgacgggcgctctgcagttgatggaggaagcaagggtggcgtaggtgtggcggatttcagtttgtttgaagcaggtgatggtcagctgaaggatgttctttcggatatggaagaggggatacaacctccaacgataatcagtgtgtgcaattgattctgagacctatgcgtggcgtgcgacaagtgtcctgtctttgggtatacttggtttgtccaatgccacggtgccactgctgcgagtcagctgaacttcttgtagaaagcacatggcagcttggcattagacaagtgtgttggtgttccttaattctttggatatgctttaggcattgactaaccttaagggttcgtcactgtctcgcttagcttagattagactaatcacatccttgaatctgaagtagttgtgcagtatcacagtttcacatggcaattctgccaatgcagcatagatttgttcgtttgaacagctgtaactgtaaccctatagctccagattaaggaacagtttgtttttcatcaaaaaaaaaaaaa

SEQ ID NO: 6660 - DNA, 858 bp, Zea mays
  Predicted polypeptide sequence is orthologous to G979
gctctccggtagaggaagggtgggtggacacgacggcggtgtgcttcaactgtcgcaacactggaatgcggttgcacggcgtccaaaatcctccacacgccgtgttccgggcagtcacttttggatggaacgagggggaaaaattagcaattttacctgcagaattttcatataagatatatatacgtagttcctatcggggaaaaagaaaatcattccatgcaaagaaaaattcaaattcctgcgaaagatggcgtgtttttttggtgctgatcagcctgttgcgtttgcgtgtggaccgtgctgtgcgcgccagggacgcaggaggaggcggcgatggcgtacgacatggcggcgatcgagtaccggggcctgaacgccgtcactaacttcgacctcagccgctacatcaagtggctccgcccgggcgccggcgccgcgcagaacccgcacccgatgctggacggcctggcgcagcagctgctgctgtcgccggagggcaccatcgacggcgccgcgttccaccagcagcagcacgaccaccgccagcagggcgccgccgagctcccgctgccgcccagggcgtcgctgggccacacgcccaccacgtcggcgctcggcctgctgctgcagtcgtccaagttcaaggagatgatccagcgggcgtcggcggccgagagcggcaccaccaccgtcaccaccacgtcgtcgtcgtcgtcgcagccgcccacgccgacgccgacgccgtcgccatcgccacctccgacgcccgcagtgcagccggccagggacgcctcgccacagtgcagcttccccgaggacatacagaacttcttcggctgcaaggacgtcgcgggc

SEQ ID NO: 6661 - DNA, 836 bp, Zea mays
  Predicted polypeptide sequence is orthologous to G979
cccacctctccctcctcctttcttctgtcgtctctctctccgcacgcgcaatggcgaggcctcgcaagaacagcgccgccgccgccaacaacaacaacagcaacaccaccaacgccggcaacgccgccgtcgacctcgcggcgcgcgtcaagccgaagcgcacgcggaagagcgtgccccgggagtccccctcgcagcgcagctccgtctaccgcggcgtcacacggcaccggtggacggggaggttcgaggctcacctgtgggacaagaacagctggaacgagtcccagaacaagaagggcaagcaagtttacctcggcgcgtacgacgacgaggacgcagcggcgcgcgcgtatgacttggcggcattgaagtactggggccccgacaccatcctcaacttcccggcgtctgcatatgaagcagagttgaaagaaatggaggggcagtccagggaagagtatattgggtccttaaggaggaaaagcagtgggttctccagaggtgtttccaaataccgaggtgtcgcaaggcatcaccacaacgggagatgggaggcgaggattggtcgcgtcttcggaaacaagtatctctacctcgggacttacgggacgcaggaggaggcggcgatggcgtacgacatggcggcgatcgagtaccggggcctgaacgccgtcactaacttcgacctcagccgctacatcaagtggctctgcccgggcgccggcgttgcgcagaacccgcacccgatgctggacggcctggcgcagcagctgctgctgtcgccggagggcattatcgacggcgcctgcgtccatcagcagcagcacgaccac

SEQ ID NO: 6662 - DNA, 838 bp, Zea mays
  Predicted polypeptide sequence is orthologous to G988
gtctgccacccgagaaagcacgcgccgcgcgcctcctgcacgaggtagccctccgacgggtagtgcagccgcagcagcagccgcgcctgcgacacggcgaaagcgctgagaggccgcgccgcaaatccggcgccgcgcgccgcggctccccaccgctcgagtccgcgccaccacctcccaccggagggacccagcgcggcgtcgatctccctgccgagcacctcgtgctccaccgccagccgctcccggctccccggcggcacagtcgcctcgagcgcctcgaacacggccgagtagtgatccatggctaccgcggaccgctggggcaggtcgtcgatgcggtcgaaacccccgccgattgtctccctctccgcgatggtcaccacggcgggggccatggccttgacccacttcaagaaggcggcaagctcgtcgtgcccgcctagcttgtgcaaaaacatgacgcagttgacggctagcgtctcgtccgggtgcagctccagctggctcgtcgtggccgcgctcgaagtggtggtgttggtcgtggtgctcgcgctggtgacgacctgctgctgatgggtagcggcgcaggagagcaggagcggcgtgaagtggaaggggagctggatggagcgggcgaaggcgcggaggcggctgccggtgcggaggagggtgtcgcggtcggcgccggcgccggtgatgcgcacctccggcggtcccgcggccgggtcggcgcgctcggcgatcgcctgcagcagtggcggccactgcaccccgtgcgcggcgtccaggtcgaggatgtggatccggcgcgcgccctcgacggcgtcgaggatgg

SEQ ID NO: 6663 - DNA, 1115 bp, Zea mays
  Predicted polypeptide sequence is orthologous to G993
gcacgagggcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgcggccgccgagctccggttcctggcgtcccgctccaaggccgaggtcgtcgacatgctccgcaagcacacctacttcgacgagctcgcgcagaacaagcgcgccttcgccgccgcgtccgcggccaccgcctcgtcgctggccaacaacccttcttcctacgcgtcgctctcccccgcgaccgcgacggccgccgccgccgccgccgcgcgggagcacctcttcgacaagacggtcacccccagcgacgtgggcaagctgaaccggctggtgatcccgaagcagcacgccgagaagcacttcccgctgcagctcccgtccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgcaggcgccgacaccaagctcttcatcgactgcaagctgcggcccaacagcgtcgtcgccgcctcgaccgcaggcccgtcgcctccggcgccggtggcgaaggccgtgcgtctcttcggcgtcgacctgctgacggcaccggccgccgccgcggcgccggcggaggccgtggccgggtgcaagagagccagggacttgggttcgcccccgcaggcggcgttcaagaaccagctcgtggagctggcactagtgtagatttaatgctacggagcgatcgatctttccctagctagctagtcttttttatttttttgctcgatcgctcaactcagatggtagcatcaccgagctgaatttagttccctctcggcatctcacttagttggttcgtttgttaatttccagtttcaaaaaaaaaaaaaaaaaaactcgagact

SEQ ID NO: 6664 - DNA, 818 bp, Triticum aestivum
  misc_feature (15)..(15): n is a, c, g, or t
  misc_feature (704)..(704): n is a, c, g, or t
  misc_feature (711)..(711): n is a, c, g, or t
  misc_feature (770)..(770): n is a, c, g, or t
  Predicted polypeptide sequence is orthologous to G1006, G22, G28
accccgctattcganttaggcctatccaggtgacattatataacaagtttgtacaaaaaagcaggctggtaccggtccggaattcccgggatatcgtcgacccacgcgtccggacaaacgctccgcgaatcccaagagcgaactcagatcatctttggaccagacgcgcccacacaggacaagatgctgctgcttaatccggcgtccgaggcggcggcggcggcggcgctggacagcatccggcagcagctcctggaggagccggcgcggccggcgtactgccggagcgcgagcttcggcagcctggtggcggaccagtggagcgagtcgctcccgttccggcccaacgacgccgacgacatggtcgtctacggcgccctccgcgacgccttctcctgcggctggctccccgacggctccttcgcagccgtcaagcccgagcccctgccctcccccggttcctacgacggctcctgcctcggcagcttcctcgcgtcgccgcccgagctggacgcgccgtggacggaggaggaggccgaggtcgcggcgacggcgtcgagggggaagcacttcagaggcgtgaggcagcggccgtggggcaagttcgcggcggagatccgggacccggccaagaacggcgcgcgcgtgtggctcggcacgttcgacagcgccgaggacgccgcggtggcctacgaccgcgccgnctaccgnatgcgcgggtcccgcgcgctcctcaacttcccgctccgcatcggctcccgagatcgcgncgcagccgcagccgcgggccagaagcgtccgtctccgcagccggcgag

SEQ ID NO: 6665 - DNA, 683 bp, Triticum aestivum
  misc_feature (424)..(424): n is a, c, g, or t
  misc_feature (426)..(426): n is a, c, g, or t
  Predicted polypeptide sequence is orthologous to G1006, G22, G28
cccgggagacaacagagcacggcgaggatgctgctgaacccggcctcggaggcgatggtgctggacagcatcaggcagcacctcatggaggacacggcggctccggcgccggaggcgaggaggcagaggccggcctactgccgcagcgccagcttcgggagcctggtggccgaccagtggagcgagtcgctcccgttccgcgcggacgactccgacgacatggtcgtctacggcgcgctccgcgacgccttctcctgcggctggctccccgacggctccttcgccgccgtcaagccggagcccctcctgccttccccggactcctgctatgtcggcttcctcgagccggagacgcctccggccacgtccccgggcgggagcgaggaggaggccgccgcggcgttcatgggccaggaggcggccncngccgtggcgagggggaagcactaccgcggggtgaggcagcggccgtggggcaagttcgcggcggagatccgggacccggccaagaacggcgcccgcgtgtggctcggcacctacgacaccgccgaggacgccgccgtggcctacgaccgcgccgcgtaccgcatgcgcggctcccgcgcgctcctcaacttcccgctccgcatcggctccgagatcgccgccgcgcacgccgcggccgcggccgccggcgacaagcg

SEQ ID NO: 6666 - DNA, 630 bp, Triticum aestivum
  Predicted polypeptide sequence is orthologous to G1033
tgagttcaggccgcagtacatgggagaagcacccaaacaccaagggcgtcgcagcggtgaccaaggctgccggggagaagtggcgcgctatgtcggacgaggagaaagcgcaatatgggggcaagaagccagatggcgagagcaagcccgcggccgctagcaagaagaaggagagcactagctctaagaaggctaaaactgatggtgcggaacaggagggagaaggttctgacaagtcgaagtctgatgttgaggatgatgagaatgatggcagtggcgaggacgagtagtagtaaatagcttagagagctgcagctatgcaaatcggtgttcactgcttagggctttagctttgctatgttactgttatccttgttatgtcctgttgtaaggaaaacgtgcgaatgaaggtactcctgggccgtggcatgctggaggtgtctctgtttaactagtagcgaagaaaatgccgaatactgttgactgcttttcttttgcgaacctccgcagcatgtgtaaactattttgcttattcactgatctgatgactagtccgcgattggctttctgttaatcgcgtctgctgtattcatattctgttgtgtaaaaaaaaaaaaaaaaaaaaaaaaa

SEQ ID NO: 6667 - DNA, 441 bp, Triticum aestivum
  misc_feature (215)..(215): n is a, c, g, or t
  misc_feature (236)..(236): n is a, c, g, or t
  misc_feature (239)..(239): n is a, c, g, or t
  misc_feature (300)..(300): n is a, c, g, or t
  misc_feature (311)..(311): n is a, c, g, or t
  misc_feature (322)..(323): n is a, c, g, or t
  misc_feature (328)..(328): n is a, c, g, or t
  misc_feature (333)..(333): n is a, c, g, or t
  misc_feature (359)..(359): n is a, c, g, or t
  misc_feature (378)..(378): n is a, c, g, or t
  misc_feature (401)..(401): n is a, c, g, or t
  misc_feature (404)..(404): n is a, c, g, or t
  misc_feature (414)..(414): n is a, c, g, or t
  Predicted polypeptide sequence is orthologous to G1033
cgcattatcagtaccatgagaacaatatggcagactctgcagctgccagcgacggtgagcagagcgatgaggaggaggaggaagaggacgatgacaatgaagaagagagccagtaatgagagactgaataacaggtccaggcattggtgattcaaacagtttctattgggtatgtgttagggttacattgcaacaacttaacttatatttgaatncaagcaggaactatatgtccnagnaattattttattggaatccttttatcaaagtaatttcccaagggtttaatttattacttanttatgataagnccccgcccttnntcaanttgcnaccacatatttcatgccccttaaccnaatttcaagacacatctgncccgattcctttgtgccaagatntgnctgttttgcnaaccctgttgcccctaaaaaaaaaaaa

SEQ ID NO: 6668 - DNA, 609 bp, Triticum aestivum
  Predicted polypeptide sequence is orthologous to G1033
ccacgcgtccgcgacggcgaggcgctgaagctattttgcaggctgcatagtcaagggggagggggtcgctactacaatcgctctcgcaagaccacgggttgccgcgtggggagggcaggaaaaggccagacacgacgggcggggagcggaggctgccggacctgctagcccgccggaccaactccctgcaacactaattagtcagatcctttgttcgccaagcgatttgaaaagatgaagcctatggtgaggtccaacagtggcggcggcagcgaccgaaggggttggctagcgtggaggaagacaaagtgtggcaagaactccaacatgcccaagcagcctcccagtgccttctttttgtttctagaggattttagtctggagtacaagttggaacacccgaacgtcaaggtgtcctcagtgatcaacaaagcaggtggtgatcgatggcgagctatgtctgatgcagataaggcgtcgtattgcgtcatggctgagcaccgtagagcagagtacgccaaggcgatggaagcgtacaataacccaggggaacccggccagcatgaggtggcccacaaggtggagccggctgatgtgatgtacaaccaa

SEQ ID NO: 6669 - DNA, 1032 bp, Triticum aestivum
  Predicted polypeptide sequence is orthologous to G1033
gagacgccagaccggccgccctttttttttttttttatcaagatgattttctccctttcaacatcatatatattgagatcgggggcaggattcttaaaacagccacgggcacgacactaggtacatacgacagagactgaattaaaacataaagcacgaagcaacagagggcggtccgagcagaggaccctgcagaaaggaaactaggctagcaatttcaccactccgatccaggacaacgactacatgggactagagctaccatttctatcatcgccatcagcagcagcaacctgaaagagagggagggactaccaaggggctaaactaacagcgaacatccatcatcgatcggtgacaccagcaatgagcggcagcggccacgttccagagaccccctccccctgctgcagctgcttggcgtgccgcttcactcgtcgccctcgctgtcctcgtcgttcacctcggacttggacttgtcagagtcgccggacgcctctcctgcctgtgggttgttgtaggcgttgatcttcttggtgtactcggccttgagcttctcggccttggcagtgtagggagccttctcagcatcgctcagggacttccacttctcaccaccggccttgccaaccacggacacctgcttaacgtcggggtgcttctccttgtactccttcctgaaggtgtccatgaagacgaagaaggcgctcggggggcgcttgggcttgttggggtccttctcggccctgctcttcttcaccgtgagcctggagtcgccggcgcgggagcccgccttgggccttatcctgccgccggcggccaactttggatccgaccaagggggtggtggggtggggaggggggcgggccctcttctgcttggggcttgcgtggggtgggtccgccgggtgggagggagattttctaccccttcagtccaatgtaaggggtcccgtggcccaaatcgcgggacccctggggtcgaaaaatatcccgggaaattcgggaccggttccaagccgggttttatga

SEQ ID NO: 6670 - DNA, 855 bp, Triticum aestivum
  Predicted polypeptide sequence is orthologous to G1033
tgaccttaggcctatttaggtgacactatagaacaagtttgtacaaaaaagcaggctggtaccggtccggaattcccgggatatcgtcgacccacgcgtccgccggaacccctcaactcgggcgctcgattcctggcttcccctggcgccgatctcatctgttgctcagacatgactgcttgcaagcagaccgcatccacgggcgccgccgccacgtacgaggccgacagcaagtcggcagcgaagagcgatggagcggaggagcggaagccctcgaccaagtgcaggaaggggaagaaggccaagggcaagttggcggtgaagagcaatgttgcggagaagcccaagacccatgacctttccgatgttacacgcgggttggcggtaatgagcattgcaacagagaagccgttggatgaacagctcgcccagcacgccctgttcacctaccagaactacttctggatggacaacttcaaaggcgtctatgacaagccgtccgtagatgctattaaaaggaaagctgctgaaaactggaaatcctttagcgattcggacaaagccccttatgtggccattgcacgtgtgaacagaatactcattgccgaggcatatgagttcaagaggacactgaagttgaccctcctgatgacggacaagatgatgaatctgaaaatgtgaacagcccagatctctaaaaatgtgtttgaatagaaatgtctttgtaaaatggcggaaatactggcaccaactccaaaaaaccgattctgtctgggcggcatttggaggtttgaaattcaggtgccattccagcctgccctatggacaatttccttagttcaaaaatagtttggg

SEQ ID NO: 6671 - DNA, 703 bp, Triticum aestivum
  Predicted polypeptide sequence is orthologous to G1062
ccacgcgtccgcggacgcgtgggcggccaagaacctgatggcggagcggcggcgcaggaagaagctcaacgaccgcctctacatgctgcgctccgtggtgcccaagatcagcaagatggacagggcttcaatccttggtgacgcaattgactacctgaaggagctcctgcagaggatcagtgatctccactccgagctcgagtctgctcccagctctgctgcactgggtggaccatcgacagctaatagcttcctcccgtcgacgcccaccctgcagccgttccccggccgcatcaaggaggagcggtgcccgccggccccgttccctagccccagcggccagcaggcgacggttgaggtgaggatgagggaagggcaggcggtgaacatccacatgttctgcgcgcgcaggccgggcatcctgctgtccaccatgagggcgctggacagcctcggcctcgacatcgagcaggccgtcatcagctgcttcgacggcttcgccatggacgtcttccgcgccgagcaatgcagggacggccctgggctcctgccggaggaaattaaggccgtgctcctgcactgcgccggtctccagaacgcgatgtaggcgagtgaacccgggagacagaccgtcaggacggtgatgatgatgatcgtggccgttggatggtctctatctcctctctgcctcgccaggatgatg

SEQ ID NO: 6672 - DNA, 425 bp, Triticum aestivum
  misc_feature (413)..(413): n is a, c, g, or t
  Predicted polypeptide sequence is orthologous to G1076
ggccggcggtggcatgccgttcggtgttgatccgtcggggggctcgacaggagctgggctccagttcttcaacctgccgatgggcatgccgccaatgcccgtggacgggcacaacggctggccgggcgctgccggtggcgtcgagaggccgccgttctcgtgacggatcttggccggcggtgaggacagcaggtgcgtccgaggacacggacatgtacaacaacagttagcctctacttcttatcacggtcgatcgattatctctttttcattgtgatgaaggaaatctcctgatattttttgcgttaacctggataaatttgggttggtgttagtttgctgggtccctgtttgtttaattggaatatatgttgcgagaacgtgcactcataaattcaccaatttaaattaanaaaaaaaaaaaa

SEQ ID NO: 6673 - DNA, 720 bp, Triticum aestivum
  Predicted polypeptide sequence is orthologous to G1084
atttaaaacagaggggggaagcagaactgagtatatacacataaaagtgttgttatagccctggtattaacaggcgcatgcaagcctgatgagtggcagtcttagagattacatgcaacagggtaacttgtaggtgctcaaaagcaagcgatggcagcattcatcatgtcataaagcacagctagacgcttgtagagtcggtcgccggcgttgacggaggcaagggagatgttgaacttggtccagatgtccctgatggcagccctggtcctctcaatggcgaacagctccgcactgttggcgtcctgaatcctcagttgcgcgaccttcttctcgtaggagcgcaaatgtgttccattttcatatctttggcttgactcattctttggacttctaatgattatacaaattcttggagaagcaagtgtactcgattgaacgtaccctgactttaggctctccttgtgcctctggaagagctggaatggctctgatgaagcttcgcaaatgccgacttgctcgttgccattgttatcctcaacaaattcttggagaatcaagtgtcctcgattgaacgtaccctgactttaggctctccttgtgcctctggaagagctggaatggctcaggcgaagcttcacaaacaccgacttgctcgtcattgtcgttatcctcaacatcccctctcggagcagctggtttaaccttaatttgaggcca

SEQ ID NO: 6674 - DNA, 700 bp, Triticum aestivum
  Predicted polypeptide sequence is orthologous to G1084
cgaaattcttgataaacttattatatttatacatcacgtgagaaagaaaataatattccatcacagacaacacacaacaattataataccatcgacagaagcatcttgctgcatggcaactaataagatacaacaatagaaattgcgcatgtgtaggccccaacggcggtggtgtgcctctgatgcctccgaccgtgtggtgactatgggagaagctcgctcacctcatccactatgcgcttcatcacccggtgcacgtcgccaatgactcgccacatccttgccagcatttggaggagtcgcagatgacaactaccctccgggacacgtctttgacaaaggcgacggtgatgttgagcttggtccggagattcctgatggtagccctggtcctctcgatggtgaacggctctgcaccgttggcatcctaggtcctcagttgcgtgcactttttctcatacagcagcggaacgcactccccttccttcgtcgggaggctcctgtagtgcaagcagtcatcgcagagcatatagagcactcccaactcctacaacaattactcagggtaaaccaaactccaaaaagttgtcctcacaataatccaaactcctcaacatgaaccaaagactaaatccaatttctaaatgtgagaacgatcattgtagcacatgcaaggaggcacaaaaattgatcttcctcc

SEQ ID NO: 6675 - DNA, 574 bp, Triticum aestivum
  Predicted polypeptide sequence is orthologous to G1084
cggcacgaggcctagtatgatttgtcagagcgacatctaccctccctgccacaaatgattgatccttttaaccagattcagaatccgaactttcgtttcattaaaaaagaaaaccgaggttggtcatccatgatgcatttatagatccatttgatgatgaatcccatcccatcttgaatacccctcccttcatttcaaagccaagttatgaactggaatgcatttgcaagcagaggagcgtgtccggctgttgtcgtacgagaagaagctagtgtgtgcagctgaggacccaggatgctaacggtgtagagtcgttcaccatcgagaggaccagggcttccatcatggtcctccggaccaagctcaacatatctgccgccttcatcgacaacttgtcctggaggatcattgccgtctgcaacgactcacctgaatgtacgcctgtgatggcattttagtttcttccccacgtgatgcatcaatacaataagtttatcaagaattgcatgaatgtgctatccagatccaaaaagaaaatgaaggtgtcgttccccaaaaaaaaaaaaaaaaaaaa

SEQ ID NO: 6676 - DNA, 666 bp, Triticum aestivum
  misc_feature (11)..(11): n is a, c, g, or t
  Predicted polypeptide sequence is orthologous to G1089
atgcagtttcnaatttgcaaaggtgctataacaacaaaatagaagggaaaatgacatcaaagggaagtacactatatacgccctagtttagaaaatagagctagtctggggtactgggttgttaaactaatctggcacggggcagaactttagtttccacttttatctataccaaaagaacatcgattgtttcataaatgttaattgctttcttgtttccaaaactaacgatctgtggcacggtgattgtctggcacaaagggtgcggactgattgctcaggattcaaaaccaaggattactgtggggacctcccctacagtttccattcaaaagaaacaagacacacttgcctcgactgtcagcatggttggagtggtaatgcatccgtgtggcctcaagcttttttgacacatcatgtgcactctccgaagacctgagaaagttatcatcaagctgagcaataatctgcagtaggctggcagacaccatcataatcttccctttccgggtctcaactgagcccatggacgaggcatgctggtggtgtacttctggttgcaggccaggtgccttgggtggcttcctaacaatcggcttcgacgggggaaggtttgccccaagctcatcgatggccttcgccttctccagtgctgtcttgtggtgg

SEQ ID NO: 6677 - DNA, 720 bp, Triticum aestivum
  Predicted polypeptide sequence is orthologous to G1113
attcggcacgaggctccctccagcgagaacgtctctgtagttctagttcagttgatttcatctgcggcacaggtcagcatgcagaacaacgcgacagaggttcctgcccaaggccatggccttgggcaggtgagcaacaacgacatcaggctgtccggctccgtcattgggggcactttcgtcgttgtcgttgttttggtgggcggcgctattcttctgcaccgattcttcaggttctacaagctggagaaagcactgcgagcgctgaagatccccccctccaggttccaaccggagggggcaatcaactcagtgtgcaccatctgcattgcagatttccgcccccgcgcgcgcgtggcagtgctccccacgtgcgggcacgtcttccaccgccactgcctccgggaggtggtggcggggcagagcccacgctgcccgctctgttgggcagctctgctgtgaaggtttgatgaaggaggaggatcgacaggtgatgaggaagggggcgctgatgctcaaagacaatgccagcaacacgatgcgcacctgcgcagcgatccaggatgacaacagcggctgatgaagttggcagctgggtcattaaagcatggcagcgtttccccttttcgttgcttgtctgataactttgacccctgcgtgggtagacttcctgtgtcttgtttggttggcacctgttttgagctgatagttcccttggat

SEQ ID NO: 6678 - DNA, 1141 bp, Triticum aestivum
  Predicted polypeptide sequence is orthologous to G1140
ggcatgcatccaacgcgtccccgagctcacgcctctggtcgacctgcaggcggccgcactcgtgcttcgcgtggtcgcggccgaggtctcactctcattccaagctccttcagcaagcagacgcgccatctcagctggatttgcatgaggacagcaattgtgcaagactaagggacgagcttgcagaagcaagcctctggctccagcagatgagaggagaggagctccagagcttgaacgtccagcagcttcaggccctagagaagagcctcgagtccgggctcggctccgttctgaaaaccaagagccaaaagatcatggaccagatcagcgagctagaaagaaagagggtgcaactgatagaggaaaacgcaaggctaaaggagcaagcgtccaagatggagatgcaagtcgccgctgattcaccggcggtgtatgaggaaggacagtcatctgagtccgtcacgaacacgtcgtatccacgccctcctctcgacaccgaggacagctccgatacctctctcaggctcggattaccattctacaactcgaagtgattggctggaaattatccgaagcaaagtgatgcttggtcacgacaagctcctgaatcgaaccgcgcgctgcatcgaataaacagtttgagtgcgctggatgatgtgtgtaatctaaaagaagactggcttctgttatatatagtatagtgtggcacaataagagaacaggttcttttgatattacctgctactggtttttcccgtccttgtcctgtgctgtaaggttttagtagacccctgagtgtccatcagaactctgaattgcttcaacccctgcaagtaaaatcaccactggcacagtggcatattgatttgaacataagaaaaaaaaaagttgttatgatgttcttgaagaggcaaattttgttttcgaacctcgggcgggaacacgctaatcccgcggccatggcggccgggagcatgcgacgtcgggcccattcggcctatagtgagtcgtattaaaatcactgggcgtcgttttacacgtcctgactggaaaaaccctgggttccccaattaaatgccttgaagaaaatccccttttgccagttgggttaaaacaaaaagccccacccaatcccctg

SEQ ID NO: 6679 - DNA, 1099 bp, Triticum aestivum
  misc_feature (17)..(17): n is a, c, g, or t
  misc_feature (19)..(19): n is a, c, g, or t
  misc_feature (801)..(801): n is a, c, g, or t
  Predicted polypeptide sequence is orthologous to G1140
acccacgtcttccgatncnagccagccggtgctctttgtttgtttgtttgtttgttcgtgcggctgagcaggaggagggaggaggacggcggcgccggagcagctgggagcggttcaggcagggcggatcgagatggcgcgggagaggcgggcgatacggcggatagagagcgcggcggcgcggcaggtgaccttctccaagcggaggcgcgggctgttcaagaaggccgaggagctcgccgtgctctgcgacgccgacgtcgcgctcgtcgtcttctcctccaccggcaagctctcccagttcgccagctccagtatgaacgagatcattgacaagtatagtactcattcaaagaacctggggaaatctgatcagcagccggctattgatttaaatttagagcactgcaagtatgacagtttgaatgaacaactcgcagaagcaagtcttcgacttagacacatgagaggtgaggaacttgacggactgagtgtcggtgagttgcagcagatggaaaagaatctcgaaacaggattgcagagggtgctttgtacaaaggaccggcaattcatgcaacaaattagtgacctccaacaaaagggaacacagctggcagaggaaaatatgcgcttgaaaaaccaaatgcatgaggtgccaactgctagcacggtggccgttgccgaagccgaaaatgttgtccctgaagatgctcattcatctgactctgtgatgacggcagtacattcgggaagctcacaggacaatgatgacggttctgatatatccctgaaactagcgtnaccttggaaagtagggacgtggggagggcaccatgagttgccttggtagagagaagatgtgaaatgctatggggaatcactccaagataggctggctgggatgatcccatagtagaaggcagatcagtttaacccgatcgagttgtcgttttatgtctccgtttgcacggcgcagttgtcccccttgttgctggggaatcagtcactgaaactgtaccgtatcttcctgtcttcccctgtaacggcctgtatcattcgtgcaaccattgtatttccctgcccggcttttggtcttttt

SEQ ID NO: 6680 - DNA, 1170 bp, Triticum aestivum
  misc_feature (31)..(31): n is a, c, g, or t
  misc_feature (865)..(866): n is a, c, g, or t
  Predicted polypeptide sequence is orthologous to G1140
atgcttccaacgcgttcgggagcgtacccanatggtcgacctgcaggcggccgcactagtgattagcgtggtcgcggccgaggtttttaacatgcccttcaacttcccgccaaaggaaaaaaacttctgattgttgttcaactttctttttcatcaaaatgttacttcctccgtcccaaaatataagatcacttgagcttatataatttgagacggaaggagtagaacgctgaccaagacatgtatttatagagcataatctaagataccgtcatggtacatacataacatggatagtgtcaacaacgatgaacatcaggtagctctaaaagtttagtcaaggtcctagcaaacaccaacagttaaaacgggggcatcacatcatgcagccacaaggatgataaatcaggttaactgatctcgcttccgccgcaggattattgcagcccaggtttatccataaccccaagagcttcttcactgatgctgcagctccatgaggaaccgaacggacgacaaccgttgttacttccacgggaggcagggcaatcctaatttcagggaaacatcagaaccatcatcattatcctgtgagcttccggagtgtaatgcagtcatgacggattccgaggactgtccatcttcagcaacaatattttcagtatcagcaaccactagcttgccagctgttggaatctggcctacttggttccttagtttcatgttctcctctgccagctgtgaactctttcgatgcagttcatttatctgttccaagaattgttgatcttttgtctgaagcaccctgtgcagaccagtttctaggtttttctccaactgctggagttcatcaacactcaacccnnttcagctcctcactctcatctgtcttagtcgaagactagcttctgcaagctgatcgttcaaatttgcatacttgctatgctctaagttcaagtcaagagcaggctggtctgttttccccaagttcctagaatgcgtgctgtacttgtcgatgatctcattcatactggacctgccgaactgggaagcttgccggtgaggagaagagatgaccgccacttcgggttcaaaagacaggaaagtccctggccttcttaaaaggccgggcgggctttgaaaaaggtacctgccggcccccggaactcg

SEQ ID NO: 6681 - DNA, 539 bp, Triticum aestivum
  Predicted polypeptide sequence is orthologous to G1146
gtacattcatgagccacatcacaagttcccagcaaatgtaccaccaaatcagcaaatgtaccgcctaattaagcagcaagccaacaaaacacacgactcccatgaacttgtcaatgggccgattcaacaatagaacatcacgtccttgacgttatccctgatcctggggaggcgacggtatgtcccaggaggaccagcagctcctgcgccggtggcagctgactcccgggtgccaccgctgacgatcgaggcgctgtccgagccctccgatggctcgtcgtaataccgtgcgcggaacgcagccaggtgagcgtagtaggcaggaggaacaacagagacagagcgagtacatcgagcgtatgtgtagcacaggttgttggtgagcagctgcagcccatcggcagtgaaacggttttcatcgaagaggacatggtagtgagttggtctgcttgtgccctgaatcccggcatggctacacaggtagaaatcaaactcggtgggatggcatatgttggtgtcgaccacggttccaggaagga

SEQ ID NO: 6682 - DNA, 614 bp, Triticum aestivum
  misc_feature (7)..(7): n is a, c, g, or t
  misc_feature (48)..(48): n is a, c, g, or t
  Predicted polypeptide sequence is orthologous to G1146
tgcaggnaattcggcacgaggcacattatcatgttctgtgggacgagnaacaatttcacggcggacgaaatgcagacattgacaaacaacctttgctacacgtatgcgcgttgcacacggtctgtttctgtcggtaatttcttcttccttctcgcgcccctgctgaatacattttcctctttcgacgtaacaatggtgacaaatctgaagtttggcctttggtctgttgtgttgtttgagcagtgccgcctgtttactatgctcatctagccgcattccgggcacgtttctacatggaccaagatagcctctcggtgaagaatgccaaccggacgaatggaagtgccatgaagactatgccagcggtgaaagagagggtgaagagggtgatgttctactgctgacaggcactcggacatgctatatagctaacactaggaattagaggtttatattagattttagatatgtaggacgggaagagtgaagaactaggtatcttgtcctatataaacttggactatgttttgttaagattgggcacaacatcctccgtaatatagctaatagattggcaatgtcagtccggaaaatgtgcacacataaaaaaaaaa

SEQ ID NO: 6683 - DNA, 711 bp, Triticum aestivum
  misc_feature (17)..(18): n is a, c, g, or t
  misc_feature (684)..(684): n is a, c, g, or t
  Predicted polypeptide sequence is orthologous to G1146
tgtactctctctgatcnntattgattatcgcagattaatgtagtacaatggataggagggagtaattaggatctactcagaaacatgattagtattaaactaaagctcaagctcaatgtaaattgttctgggctcctattcacccatatcaacactttcaaaactgctttagcagaaaaacataacacctttcacattttcactgagaacgggaaaggatccctcatgccctcgtttgatataaagtcgtccccgcgaagccaaaagatgtgcatagtagacaggaggcacaactgaaacagaagaggtgcatctcgcatacgtgtagcataggtggtttgtgagcgtttgcaaagcgttagccgtaaacttgttttcatcccacagaacatgataacgcacaggtcggctcactcccttagtgacagcatggctacacaaataaaaatcaaagtcagtgggatggcatacttctttatcaatcactgtaccaggcagtacatttccacttccataaattgtactcacaacatcatagttatcagaaaacagacgggtatgatgacgtttctgaacgacaacaaaggtaactcgtgggcttttttatggcagaaagttcaacatccaaaacctgattaagctgtccattgctgacaccatccctgtaaaatatgattcttccangtatgcattcagttgcccttctgaaag

SEQ ID NO: 6684 - DNA, 334 bp, Triticum aestivum
  Predicted polypeptide sequence is orthologous to G1146
ttttttttttaaacgcaaggcgtggcttgaatgctctggttttcaagctccaaacctcaaaagtactcgaggttcaacgtttacagcatgacaaagtacacacatagatggtacttaagcaagcatagaccagcatagtagggcgcactgcgacagccgctggcaaattattactactttcttcacataattacaatgacaaggggcgacatgctgacttaaggagcattttaatctccgccttcacgggcttcaacagtaaaacatgacgttcttcacattgtccttgagggctggaaggggcttaacagctgcaccgccgggggcccgggta

SEQ ID NO: 6685 - DNA, 630 bp, Triticum aestivum
  Predicted polypeptide sequence is orthologous to G1146
caattattgaagggcagaggytcaccaggaagcttaacgagaaacaagtgactggcatacygagagcyacgtgcgaacgyccccgtgatagggagaagagcayacttaagayggtggagcacaacaacyattcagctgataagctggcacaggagtttggaatcgatgttacggataaaatggtcaatgtgcaggctcgcgtgctacctccccccatgctcaaatatcatgaatctggaaaggacaaagcttgtgcaccaagtgttggccagtggaacatgattggcaagaaaatgataaatggagggaatgttcagagatggacttgcttgaacttyycacgtttgcayattgatggagtcaaaaggttttgtggcgacttagtcaaaatgtgcacgccatcggcatggttttcaatcctatgccagtggtagaaattctctcagcgtctgccaataacatagaaggtgctttgaagcatgctcaccagagtgcccataacctccagttgcttattgtgattctcccggatgttactggccattacgggaaagttaagaaggtgtgcgagactgaccttggtatagtatctcaatgtctcaagccagacaaggtcgaaagagcacacaa

SEQ ID NO: 6686 - DNA, 584 bp, Triticum aestivum
  Predicted polypeptide sequence is orthologous to G1146
ccacgcgtccgcgctgccgacaaatttccttatcccgtctgccgttccttcacctcgatccccttctctggtccttttctcatctgatccgcttcgcctctactgcttcgcctctcctcgtctccgtgtgattcgccatcaccacctcgccgcttccctactggttgtgacggcggcgctcgctggatggcatggtggaggtggtagagggtggcggaggcggagcagtcgaggtcctcggcgtcgcgcgtgtggtggggcagaaagtggaaggggaagaatgacgccatccagagaaggaggcataggatctaaaagatcgagcctgcccctcacgcaagctcaagaaggagttttccgggtgtgtggatgatagtttgttcagcagcatggaccatgccatgaaattggtgacggcaagactcccagactcatatgacaaaaaggaaggagttacaggagatggaaccactggtggggcggtagaatttttttctgttgagggcgatagtgtgtaagagcaacctttcctttttaagataatgtgtggacatgtatttacttttttggggtgtgtgctccag

SEQ ID NO: 6687 - DNA, 635 bp, Triticum aestivum
  misc_feature (389)..(389): n is a, c, g, or t
  misc_feature (405)..(405): n is a, c, g, or t
  misc_feature (410)..(410): n is a, c, g, or t
  misc_feature (435)..(435): n is a, c, g, or t
  misc_feature (467)..(467): n is a, c, g, or t
  misc_feature (469)..(469): n is a, c, g, or t
  misc_feature (487)..(487): n is a, c, g, or t
  misc_feature (537)..(537): n is a, c, g, or t
  misc_feature (567)..(568): n is a, c, g, or t
  misc_feature (571)..(571): n is a, c, g, or t
  misc_feature (580)..(580): n is a, c, g, or t
  misc_feature (589)..(589): n is a, c, g, or t
  misc_feature (621)..(621): n is a, c, g, or t
  misc_feature (635)..(635): n is a, c, g, or t
  Predicted polypeptide sequence is orthologous to G1146
ttttttttttttttttttgacccttaaaagtactcaaaattcaatgtttatacagcatataaagtacacacatagatggtacttaagcaagcatagaccagcatagtacggcgcacgagacagcggctggcggattattactaccctcttcacataattacaatgacaagaggcgacacgccgacttaaggacatattaagctcggccttcatgggcttcagcagtagaacatgacgttcttcacattgtccttcagggctggaagaggcttaacagctgcaccgccgggggcccgagtaccacgtgacgccgacgagccggacgtcggtccacgcccaccgggcccacttgccatagagccgctgtcggagctctctggctccatgtngaaacgggcgcggaangcggncagatgagcatagtatgcaggtggnacaatcgacactgaccgagtgcactcgcgtangngtacagaggttgttggtnagactctgcaaccatcactgtgactttttcgtccacaagactgataagancggacggtggtcctgatcagatatgacaanngantcaataccngatacagtntctgtcaaacgtctggatatttcacccgtcanggtctacatggatn

SEQ ID NO: 6688 - DNA, 629 bp, Triticum aestivum
  misc_feature (315)..(315): n is a, c, g, or t
  misc_feature (319)..(319): n is a, c, g, or t
  misc_feature (333)..(333): n is a, c, g, or t
  misc_feature (350)..(350): n is a, c, g, or t
  misc_feature (353)..(353): n is a, c, g, or t
  misc_feature (360)..(360): n is a, c, g, or t
  misc_feature (382)..(383): n is a, c, g, or t
  misc_feature (393)..(393): n is a, c, g, or t
  misc_feature (411)..(411): n is a, c, g, or t
  misc_feature (425)..(425): n is a, c, g, or t
  misc_feature (457)..(457): n is a, c, g, or t
  misc_feature (463)..(463): n is a, c, g, or t
  misc_feature (467)..(467): n is a, c, g, or t
  misc_feature (484)..(484): n is a, c, g, or t
  misc_feature (515)..(515): n is a, c, g, or t
  misc_feature (518)..(518): n is a, c, g, or t
  misc_feature (521)..(521): n is a, c, g, or t
  misc_feature (526)..(526): n is a, c, g, or t
  misc_feature (542)..(542): n is a, c, g, or t
  misc_feature (557)..(557): n is a, c, g, or t
  misc_feature (563)..(563): n is a, c, g, or t
  misc_feature (572)..(572): n is a, c, g, or t
  misc_feature (580)..(580): n is a, c, g, or t
  misc_feature (583)..(583): n is a, c, g, or t
  misc_feature (586)..(586): n is a, c, g, or t
  misc_feature (596)..(596): n is a, c, g, or t
  misc_feature (600)..(600): n is a, c, g, or t
  misc_feature (615)..(615): n is a, c, g, or t
  misc_feature (618)..(619): n is a, c, g, or t
  Predicted polypeptide sequence is orthologous to G1146
ccgtcttcctctctccctcctcctggtccactctttcccgagatacgtacgagcccaggacagccatgaagttcttcggttcctccacgtccaagaaggagaacaaggggaagaagagatccaaaaggagcggcaacggcggctccttcgcctcgaccgcgtcgtccgtcggcatcagatgaccagtctgttacaacgctgagatccgtcctgccgtcgtcttcgggggccggcggtaccgtccggtcccgggacgaccaaagaaaccggcctgggcgccgtgacgcggctggactggaggttggcgctgcgtanatcntgtcgaccgaggangactggccgcgatgtcnccnaggggangccgctccccctttagggattnntggcgccgangcgcggacaaggcaactnaaggacaatttccngtgtttgaccttacgggacgaagtttccgccnaaggancctncctgttggctcctggcnacaacggtgtcgttgagaatgcgcccatatnggnggngtcanacgacgggacggttcncgcttacagttaccnatatangcttccctnatattatnaantgnctacaattanaaanccacactttctatanagnnaatagttttt

SEQ ID NO: 6689 - DNA, 2511 bp, Triticum aestivum
  Predicted polypeptide sequence is orthologous to G1146
gcacgaggctagacatccggatgagttaaaacgagaccctaacaagtggatgattgacatcgagtactatttgtcacagcagattcatcctgtcgtttctcgtctgtgtgcttcaattgagggtactagccctgcccgactggctgaatgtcttggacttgactcatcaaagttccaatcaagatcaattgggtctagcaatgaggatacgtctaccatgctcttatctgtaattgatgatgaagatgagagatatcgtggctgtgagccactgcgtttatcatgcccaagctgtaccaataccttcgagtgcccccctgtgtccagtctgattgctagtttatcagatccaaatgaaggaaaagatgctactgtgaatttctggcgtcggatgcggtgcccaagatgtccagatgatactgatgagtgcagagtttctcctgctgtgcttgccaaccagataaaaagacaggctgataatttcatcaatcggtattacaaaggtttactgatgtgcgatgacgagggttgcaaatattcaactcacattgtgaaccttagagtgatgggggattctgagagaggaaccatctgcccgaactatccacaatgcaacggccgtctagtaagacagtacacagaggcagatctatacaggcaattgtcctacttttgctatgtacttgatgcaacccggtgtcttgataagttggaccagaagatgcggcttccttttgagaaagagtttgcagtattaaaccaaacaataagctccgcatttctggagattcagaaaatccgagacagatgtgctttcggatgggttcaattgacagatctagcagtgtcaatctgatgagctactgtttgccgtaatctcaagcagtgctgatctgagcatgggccgtgggatattgtgttgttgaaactagatctgttgttgaaggtgaaaggaactggaaaccagatgatggccttggccactagctgctgacgggtttcctggcctgcaaaggatggagttgcccacatcatgttgcatttaaatacaaatgttctaaccagttgtttcagagaccctccttggtgccatccctaattttcgaagtgtatattgtactactgttgtaaatatgttgcatccatcagtcccatggttttgtagtgacatactttgaatactaaatttgtcatcagtcagtttttatcatcttaaaattatcacaatccagatgcttaaaaaaaaaaaaaaagaaatactgtacttgttgatgctttgtcaaggagaattccccttgttagtgacagaccaaccattatatttggtgctgatgttacccatcctcatcctggagaagattctagcccttccatcgcagctgttgttgcttctcaagattggcctgaggtcaccaaatatgctggattggtgagtgcacaaacccgtcgtcaggagttgatacaagatctttttaaagtatggcaagatcctcagagagggactgtaaatggtggaatggttagagaacttctcctttcctttcatagatcaactggacagaaaccccaaaggatcatattctatagggatggtgttagcgaaggacagttctatcaggttctgttgtatgagcttgatgcgattagaaaggcgtgcgcatccttggagtccaattatcagccacccgttacctttgtggtggtccagaagcgccatcatacacggctatttgctaataaccacaacgatcagcgaagtgttgatccaaaaagtggaaacatactgcctggtaccgtggttgattcaaagatatgccatcctaccgagtttgatttctacctttgtagccatgctggtattcagggaacaagccgccctgcgcattaccatgtcctttgggatgagaacaattttaccgcggatggtttgcagactctcacgaacaacttgtgctacacctacgcaaggtgcacccgttctgtatcgattgtgcctccggcatactatgctcacctcgccgcttttcgagctcggttctacatggaaccggatacctccgacggtggctcggtcgcgagcggtgccacgacaagccgtgcccctgctggtgcacgctgcggtagagctgcagggaatgctgctgttaagcctctgcctgacctcaaggaaaacgtgaaacgtgtcatgttttactgctgagtttaggatcccaactgaattacatgttgatttgccaatcctttctttgcggcagaaaagcaatcctcattcatcacatgagtgtatcagtgctgccatgtttcctgtgcaacctgaacatctcaattcctcttcgccccctacagattttcaaatgacattgccctgtttgtcttgaccacattattggcctgcacattcaaacatccgtccagatttgtaactttggaggttccatgtaatgctacgacgaagaccctatataatatttccccacctttttttttaaaaaaaaaaaaaaaaaaaaccac

SEQ ID NO: 6690 - DNA, 791 bp, Triticum aestivum
  Predicted polypeptide sequence is orthologous to G1146
ctcgtgccgaattcggcacgagaacttcctcaaatacgcaacgcatgccgcctgaaatatcctgcaaccgacaccaaacgagggctccccaggatcacaattgttgtctgtggtaaacgccaccacactcgattctaccctaaaaacagcggtgacgctgataaatcatcgaatttgatggctggaactgttgtcgatcgtggcgttacagagactcgaaactgggacttttacctacaagcccatgcatgtcttcagggaacagcccgtgcctgtcattactatgtgataatagacgaaattttccggtccaataaggttaagggtggtcacaaaaatcacgctgatgcccttgaggaattgacaaacaatatgagtcatctgtttggacgagcaacaaaagccgtcagtctttgtcctcctgcttactatgctgatttactctgcacaagggtacgctgctacttatctgaagttttcgacccaagtgaggcccagagtgtgatgagtggcggcaccaaccaaacgatcgaggacattgttattccgccgagtatgagggattccatgtactacatctaagctcattgcatgagaatgagaatcattaaaccataaccttcggtgttagttacagaattagctgtgtcaagtcattatagacgaaataccatttctgtattgtagactttgcgttccgaaatattttatgcacacgcaaatgtatagccaaaaaaaaaaaaaaaaaaaaaaaaaaaaaaaaaaaaaaaaaaaaaaaaaaaaaaaaaaaa

SEQ ID NO: 6691 - DNA, 690 bp, Triticum aestivum
  Predicted polypeptide sequence is orthologous to G1146
ccacgcgtccggtaacgttcctccaggtccaccaagaacagttcccgagctgcaccaagccccgtatgtccaatatcaagccccggtggtttcaccatccgcatcaggagctggctcatcctctcagcctgtgtcagaggtgagcagtggacaagtccagcaacagtttcagaaacttgcgattgttgatcaaagttcaacaagccaatccagtcaactggcaccagcatcaagcaaatcagttagatttccattgcgccctggaaagggtacacatggagataggtgtgtcgtgaaggcaaaccatttctttgctgagctccctgataaagaccttcaccaatatgatgtctccataactccagagattacatcacgtggtgtcaatcgtgctgtgatggcagaacttgttaggctctatagacattctcaattggatggacgcctacctgcgtatgatggaaggaagagcctatatacagctgggccattgccatttccttcaaagacatttgaaattactctgcatgacgaaaaagaaagccttgttggtggtcaagtcgcaccaaggcgtgagagacaattcaggttggtgatcaaatttgctgctcgtgctgatctccaccatttggatatgttcctaaatggaaggcaaactgatgaaactcaagaaactcttcaggtgcttga

SEQ ID NO: 6692 - DNA, 706 bp, Triticum aestivum
  Predicted polypeptide sequence is orthologous to G1146
agatcccaacatgatcatatagactttcaaactaacaggtagaagtccttcccaaaccagaaatgatttcaggggtagttcaaatacgaccacagataggtagatggttacacagagtttcacacggtacaacaatgaaagtttgcatggcggtgttctcccagcgccaccaatgcagtgcaaatacttttaacacacccaaactcagtcgaatatcttcaggtttgcatattagggtgaacaataaccaccacgaccttaacagtaaaacatgacccgcttcacgttttccttcagggcggggaggggcctgacagcaacattcccaaacggcctggtattgcgtccaccctgtggagggccacgggcaccgcttgccatggacccactgtcagaggtatccggctccatgtaaaacctagcccggaaggctgccaaatgtgcataatatgctggaggcacaattgatacagagcgggtgcacctagcatacgtgtaccacaagttgtttgttagagtttgcaactcatcagcagtgaatttgttctcgtcccatagaacgtgataatgagcaggacggttagttccctgaatgccagcgtggctacacaagtagaaatcgaactcagtcggatggtaaatctttgaatcaacaaccgtgccaggcattatgtttccacttctatcaacagtacgctgatcattg

SEQ ID NO: 6693 - DNA, 1152 bp, Triticum aestivum
  misc_feature (859)..(859): n is a, c, g, or t
  misc_feature (882)..(882): n is a, c, g, or t
  Predicted polypeptide sequence is orthologous to G1146
agctccaacgcttcccgagctctagcaatggtcgacctgcaggcggccgcactagtgattaagcgtggtcgcggccgaggttttcctttttttttttttttttttttttaatttattcaagcataacaaaaaaaactaatatccagcacatttcagaaacacgttgaaaaaatggcacatgataattgttgtggctaattcaaaacagaaatggatacatttgaaatggaacttcaattttcaaatgtaaatacaatttttcaaattaaaacaagtacgtttagacaaagctcggcaataatttttcatttcttcaactccaccacaaccacttgaaggccctgcgctttagcagaagaacatgccacgttttttcacattgtccttgatatcaggtagaggattgatgaatggtttacaggatatatcgatatttaatgaaattcccatctgtgtgttttgtattgtctgataaaaaccacagcagtttttcaagccctcgtcaggttgagatttataaaatgaccggccaactaggcaataccttccaaggaacaattcatgtagaatagtattaaatgcttgatagaattcttcaccatcaattcgtccgaacaaaactttatccaatgttatctggaccctaaaatgtctcttaccccttgggaggccacaaagaatattttcctggtcaggtagtgttactttaaaagcctcacaagtaaatggaaatggacgagatgtatataagcttttctttccatcatatgcaggaagacgaccacccaaacgtgattgcccatacagctttgcaagttgtatcatgacatcaccagctgaagtaggcttaggatctatnaatacatgatatcggcaaagagnttcattataagttagtttaaaatggttggccttcacatatagctttcaccagcagaaacgaatccagggcgcttttagcttcggcggggacaaattttggagttaaggattgaccatggactgtactgatggcccaaaactatctgcctcgggaccacattgaatgaacggttattcttctcacatgggacaaacctcgccacaacacacggtgatcgccccttccaccgctaccttccggaggaaaatcaaaacggtcgccaatttaca

SEQ ID NO: 6694 - DNA, 917 bp, Triticum aestivum
  misc_feature (14)..(14): n is a, c, g, or t
  Predicted polypeptide sequence is orthologous to G1146
aaccgccacttgantgatgacgccacgctattcggtggactactatagaatactcaagctatgcatccaacgcgttgggagctctcccatatggtcgacctgcaggcggccggactagtgattagcgtggtcgcggccgaggttgcggggcgtcaaagtcgaagttactcaccgggaaaatgtaaggcggaagtaccgcatttcgggggtgacagcacaaccaactcatgaactcatcttcccaatcgacgatcaaatgaatatgaagtctgtcgtagagtatttcaaggaaatgtatgggtttactattcagcaatcacatcttccttgccttatggttggcaaccaaaagaaggcaaactatctaccaatggaggtctgcaagattgttgagggtcagagatacacaaagaggttgaacgaaaagcagatcacatcactgctaaaggttacatgccaaaggcctagagaaaaggaaatggatattctacagacagttcatcaaaacggatatgaccaagatccttacgcaaaggaatttgggatcaacataagtgtgaagctaacatccgttggagcgcgcgtccttcctgcaccttggctgaaatatcatgatgctggaaaggaaaaggagtgcctgccacaggttggtcaatggaacatggtgaacaagaaagtgatcaacgggggcaaggtaagccactgggctttgtataacttctcgaggagtgttcaagaaacaactgcacgcggattctgcccagagttggcacaaatgtgtcaaatttcgggcatgggatttcacagtgaacctgtgctccaaatatattcagctagaccagatcaagtagcgaaggcactaaagcatgtgtataatgtagcactacacaaactcaggggtaaggacttgagcttct

SEQ ID NO: 6695 - DNA, 1049 bp, Triticum aestivum
  misc_feature (13)..(13): n is a, c, g, or t
  misc_feature (849)..(849): n is a, c, g, or t
  Predicted polypeptide sequence is orthologous to G1146
cgacccacgcttnccgctgggcctgtgtgatttttcacgcatgcgtcctgaggcggtacacaggttctgttgtgatctgattcagatgtgcaatatgactggaatgtctgtcaattcaaggccacttgtagacaaccgatcagcgagccccaaccacattgagaatgctttgagagatgtctacaggaggacaacggaaatgctttccaagcagggacacgaaaaacagctacaactgttaattgtaatcctacctgaaatcagtggttcttatgggaaaatcaagaaggtttgcgagactgaccttgggattgtgtctcagtgttacctgccaagatatgctgccagaccgaacaagcaatatctggagaatgttgcactcaaaatcaatgtgaaggtcggactgccaccttccattgagaaggcctttgctcgatttggtgttcctgctgttacaaaagtcccaacaatcatctttggtgctgatgttacacaccccccacctggagaggactccacatcatctattgctgtggtggtggcatcaatggactggccagagatcaccaagtacagaggtcttgtctctgctcaaccacacaggcaggagataatcgaagacctcttcagtgtcagcaaagatccgcagaggggcaatgtcaatggtggcatgatcagggagttactgattgccttccgctggaagacaggccggaggcctgagaggatactcttctacagggatagtgtgagtgaaggccagttgagcactgtacgttttcatgaaatgaatgcaatcaggaaggcctgtgctgctttggaggaggggtatatgcccaaattatatantatggctctgataaatgacactatactcatgctcggttgcaccggtggggtctctgttgtcccaccgggggtacaacgcggattttgcggaattccgtccgggctattagttggaaggggacagctcggacggcgggtaacccccaggaacagcaggaagaaggcgaacctgggagagggccctgtgaaggtgcaattaa

SEQ ID NO: 6696 - DNA, 709 bp, Triticum aestivum
  Predicted polypeptide sequence is orthologous to G1146
gatggagtgagtgaaggccagttctaccaagttctactgcatgagcttgatgccatcagaaaggcatgcgcatcgctggaagcaaactaccagccgctggttacgtttgtcgtggtccagaagcgccaccacacgaggctgtttgcgcacaaccacaatgaccagagcaccgtcgacaagagcggcaacatccttcccggcactgtgattgactccaagatctgccaccctacagagtttgatttcttcctgtgcagccatgccggcatcaagggcacgagccgccccgcgcattaccatgtcctgtgggatgagaacaacttcactgctgatggactgcagaccctcaccaacaacctttgctatacttacgctaggtgcacgcgctcggtgtctatcgtccctccagcatactacgctcacctggccgccttccgcgcccgcttctacatggagccggacagctccgacagcggctccatcttgagcgcgcgcaagtccggctcgtcgacgtcccgcagcacccgcgccgccggcgccggggtcgtcaggcccctccctgcgctcaaggacagcgtgaagaaggtcatgttctactgctgatgatgctccacaatctactgctgccctaataaaaaggctccacgcctgctcacctgcaccttaagtgatgaattcactgaaggtgttgttgcaccgatacttaagt

SEQ ID NO: 6697 - DNA, 881 bp, Triticum aestivum
  Predicted polypeptide sequence is orthologous to G1146
acgcttgaccttaggcctatttaggtgacactatagaacaagtttgtacaaaaaagcaggctggtaccggtccggaattcccgggatatcgtcgacccacgcgtccgctgggcatgtattaacttctctcggaatgttcaagataatgctgccaaggttttctgtcatgagttggctataatgtgccaaatatctggaatgaactttgcacctgaacctgtgctgcccgtacttagtgcgaggcctgaacacgtggaaagagcactgaaggcacgttatcatgatgccatgaacgcaagcaaacccccgggcaaagaacttgacctgctaattgttatactgccagataataatggttctctttatggcgaccttaaaagaatttgtgagactgaacttggattggtatcccagtgttgtcttacaaaacatgtttttaagatgagcaagcagtatcttgcaaatgtagctctcaaaatcaatgttaaggtggggggaaggaatactgttcttgtggatgctttggcaggaggattcgccttgttaccgacagaccgaccataatatttggtgctgatgttacacatcccccaccctgaaagaagattctagccccttccaattgccagctgtggttgctttctcaagaactggccctgagataacccagtaccgcaggattagtgagttgcccaaaccccttaaggcaaagagctgaatacgggatcctttttaaaagtattggcaaagatcccccaaagaagggaacctgtttactgggttggcaatgaatccaagggaagcttcctcattattcttttcaaagaagggccaacttggaacaaaaaccctcccgaaagtattctttatttttaacgggg

SEQ ID NO: 6698 - DNA, 851 bp, Triticum aestivum
  misc_feature (757)..(757): n is a, c, g, or t
  Predicted polypeptide sequence is orthologous to G1146
acgcatgacattaggcctatttaggtgactctatagaacaagtttgtacaaaaaagcaggctggtaccggtccggaattcccgggatatcctcgacccacgcgtccgcagatcttgggctagtctctcaatgttgtcttgcaaagcatgttttaaagatgaaaccacaatatcttacaaatattgcccttaaaatcaacatgaaggtggggggaagaaatactgtacttcttgatgctgtggtagggaatctcccacgtgttagtaacacaccaactattatatttggtgccgatgtcagtcatcctcatcatggagaaggacgttctagtccttctattgcagctgttgtagcttctcaagactggccggaggttaccaactatgctggattagtccggcggcaagcccgtcatgaagagattatacaaggcctttttaacgaaaatgattgtggaagtggacgtatatctggtggaatgatcaaagagcacctcatttctttcatgaggtcgactggacatataccccggaggatcatattttacagggatgttgtcagcaaaggacggctcaatatggttattgagcatgaactttctgccattaaaaaggcatgtgcgtcgctggatcctatttataatccacaagttaccattattatggttcagaaacagcaccacacacgtttgttcgctggtaactatggtggtgggagcacatttttgaaatggaaatgtattgccaggtactgtggntgataaaagaatatgccatcccactgactttgatttttacttgtgtaaccatgcctgcactaaggaagtcgcccggcctgttcgtatcatgttc

SEQ ID NO: 6699 - DNA, 1062 bp, Triticum aestivum
  misc_feature (792)..(792): n is a, c, g, or t
  Predicted polypeptide sequence is orthologous to G1146
gcgacccacgcttccgcgaccgggagcgtgatataacccagatggtcaaacacaatgcttatcaagaggatccttatgcgaaagagttcggcattaagattagcgattgtctggcatcggtagatgcacggattttaccggccccacggcttaagtacaacgagactggtagagaaaaggattgtatacctagagttggtcagtggaatatgatgaacaagaaaatggtaaatggtggcaaagtcagaagctggatgtgcgtcaattttgcccgcaatgtgccggacaagcttgctcgtgatttctgccatcaacttgctcagatgtgccaagactcgggaatggacttcgctctggagcctgttctcccacctatgagtgcacgtccggatcaagtggagcgagctctcaaagctcggtaccatgaggcaatgaacattcttggaccccagcgccgggagctcgatctgcttattggaatccttcctgataacaacggctcgctttatggtgatttgaagcgcgtgtgcgaaatagatcttggaatagtttcacaatgctgttgcacaaagcaggtgttcaaattgaacaagcaaatttatgcaaatattgcactgaagataaatgtcaaggtggggggcaggaacactgtgctggtggatgcattgtcgaggcgtattcccctggtcaccgatagacctacaatcatatttggtgctgatgtgacccatccacatcctggcgaggacagcagtccctcaattgctgctgttgtagcctcccaagattggnccgaggttacgaggtacgcggggttagtttctgctcaggcgcaccggcaagagctgatagaggatttgtacaaggtccgggcagatccacagaaaggaccagtcagtagtggcatgatttaggagctacttatatccttttagaaatcaactggtgagagccctcagcggatattattttaccagggatggcgttagcgagggcccattttaccaagttctgtggtttggaaccaaggcgaaccgaaaagccgtgtgttcccttggggga

SEQ ID NO: 6700 - DNA, 533 bp, Triticum aestivum
  misc_feature (374)..(374): n is a, c, g, or t
  Predicted polypeptide sequence is orthologous to G1150
gtgcaacatagggaaaaaaagagtgaagaagttgcagcatagttttagtttcagcagcccccccttttttaccttctttcccttcacctctcctcaagctgatggcaccgcaccagctgattcagaccacaagaggcgaaggacaaaaaatactaccactactagcaaccccaaggcttcaaaaacagtgtcagatacttagggcccctcctattattaccattaccatatgcattagttactgttagtcgattactcctgctgctactactagtagtaccaccaccaacaaccaccaatactaccaccgccaccaaccccccattgatgtgccaccaagctcctggcaaggccaccgccaatataatagccanctactagtagtagtagttctcatgtaatagtagcacattagggtgcgatgtttagccaaaaagtacagaggaatactaccacaatgtatgacatacactagtggctctgctcgctgtgttgcaagacagtgcaacaagatacggatgcatagctagcta

SEQ ID NO: 6701 - DNA, 380 bp, Triticum aestivum
  Predicted polypeptide sequence is orthologous to G1150
ttttttttttttttttttttaacataaaacaccacaaatccataataataacaataatcctctcagagccggtgagcagtaggtacaggaacgcacacaataaataatactataatagtaataataaactcacaccaatcacactagatcaaatccaccatcaaaaaacctctccaaaccctcagatccatccatccatccgccacgcggaccaaaacaaatgcctcctcttcataaaactatcaccaccgctaacgacacactgctactaccactactactagactgcaggactcccactaccactgtaccactagatctgaagacgcgcgcgcacgcagacgggggcggcgagcccaccaccaccaccacatctcctc

SEQ ID NO: 6702 - DNA, 2204 bp, Triticum aestivum
  Predicted polypeptide sequence is orthologous to G1198, G1806, G558
gaattccggcgacggcggcagtctactaccccgtagttcggatagaggcccctcttcctatcgagtgtttaggcatatatctgcagctttgtcacaacaaaggaatctctctgggagttacattgagcactatgaataatctgcaatggcagaggccagccctagaacagaaacgtcaacagatgatactgatgaaaatcttatgcttgaaccagggaatgctgctcttgctgttgtttctgactctagtgacagatccagagacaaaaacggagatcaaaagacaatgcgtcggcttgctcaaaatcgcgaggctgctaggaaaagtcgtttgaggaaaaaggcatatgttcaacaattggagaacagcaggctaaagcttacccagctagagcaggagttgcaacgagctcgtcaacaaggcatttttatatctagttcagcagaccagtcccattccatgagtggaaatggggcgttggcttttgacacggagtacgcacggtggttggaagaacacaatcgacaagttaatgagctgagagctgcagttaatgctcatgcaggcgatactgagctgcgtagtgttgttgagaagatcatgtcacactatgatgagatttttaagcaaaaaggaaatgcagccaaagcagatgtctttcatgtgttatcaggcatgtggaagacaccagctgagaggtgtttcctatggcttggaggtttccgaccttctgagcttttaaagcttctttcgacccagcttgaacccctaactgagcagcagctgtcagggatatgcaaccttcagcaatcatcacaacaagctgaggatgctctttcacaaggaatggaggctcttcagcagtctttggcagaaacgttggctgggtctatcggctcttctggatctggatcaacaggaaatgtggcaaactacatggggcaaatggccatggccatgggaaagcttggaacccttgaaaatttccttagtcaggctgacaacctgcggcagcagactcttcagcagatgcaaaggatcctgaccacaaggcagtctgcccgtgcacttcttgtgataagtgattactcatcccggcttcgtgccctaagttctctttggcttgctcgaccgaaggaataacaagcgcgtgtgatttgactgcaatacattttcgcaatttgggggtgatggtggtggcagtcatgcaacagacttgattcagagaaacttgcacatactataatccaaagagatgctgtgttcaggtagcttagccatatagtgaagttgagtgcattagggaagggtccttgttgtaccgttaaccgctgtaaaattggcatctaatggttgccaagtaatctttaagatactaatttgcagagagccatccctttagatgtgcatttataactcttttgttgctaatcggaaaaaaaaaaggaggaagagcgagctaggcaagaggctatcgcgaaaaaggctgcagaagacaacaaggatcagccctcaagctctaccgatgctattatggctgaagcggaacttaccttaaatgctcctgctgatcttgacgcagatctactcaaggatgatgatgatgctcagctactacagcaagcacttgctatgtcaatggatgagggtgcttcaggagctgcagccgtggctgatgctgctatggcagaagctgctgcagatgaccaggatttggcattggctcttcaaatgtctgtccaggacgctgaggcggctggtcaatctgatatgagcaaagtgtttgaagacagatcatttgtgacatccatccttaattcgcttcctggtgttgaccccaatgacccatctgtgaaagatctactggcatctttgcatggccaaggagagcaggaggagaagaaagataaggaggacaagccagacatttctgaagatgggaagaactgaaggcaatgaacatctattttctcggaaaagtgcaggcgcatgaagtgaagaagattgcctgcattagctgcttttacactcgggctctatgaatttacttaatcctcttgtaactgcgttgatgataactgccgagagaacttgtattatgtctgctctcacgaatgctccttcatgtttgtcttaagtgattacatgttgcaaattcatttgtacactttatgtctgttgaaggtgaaattgaacggaattc

SEQ ID NO: 6703 - DNA, 1505 bp, Triticum aestivum
  Predicted polypeptide sequence is orthologous to G1198, G1806, G558
tggagagtaggcgaggaggaggagggccggcagcggccgcagcggcggcgggcgacccgcgcgggccgatgccgggtttcggggctcctcagcacaccatcccaacaaatgtgaacgtcatgcagccttctcgagttgctgatttgggggcgctcgcccactctgctggattcagaatagaagatctcgctaatttcagtacaaataatttattcaatctgaagccaaatacacatgcatataccagtgacccccttcagtttggaaattacggaaagtccatttctccgactgatctagctactacggcggcggcagcagcagcggtaacagcagttgatcctcaggccctactacagcaaaagggagtgcaaccaaatctagtagctttaagaactcataacaatgataactggggagagtcaagtatggctgatacaagtcctaggactgatacatcaacggatccggatatagacattgatgaacgcaaccaaatgtttgaacaaggacagcttgctgcccccacagcttctgattctagcgacaaatcaagggacaaattagatcataagtcacttcgccgtcttgcccaaaaccgtgaagctgctaggaaaagccgtttgagaaagaaggcatatatccaaaacctggagagtagtagattgaaacttactcaactagagcaagagcttcagcgtgctcgtcaacagggcatcttcatttcatcttcaggggatcagtctcagtcagcgagtggaaatggagctgtggcatttgacatggagtatgcccgatggttggaggaacataacaagcatataaatgagttgagggctgcagccaatgcacatgctggcgatgatgatcttcggaaaattgttgatagcatcatgtcgcagtatgatgaatttttcaggctcaagggtgtagcagccaaagcagatgttttccatgtgctgtcgggaatgtggaagacccctgctgagaggtgcttcatgtggttaggtggcttcagatcatccgagctccttaagttactggcaggtcaactagaacctcttactgagcagcagcttactggcatatgcaacctgcaacagtcttctcaacaagctgaggatgctctttctcaagggatggaggcattacaacagtcacttgcagaaaccctagcatctggatccctgggccccgcaggatcttccggtaatgttgcaagctacatggggcagatggcaatggccatgggaaaacttggcaccctagaaaacttcctccgacaggctgataatctgcggctccaaacccttcagcagatgcaacgcatattaaccactcgccagtctgcacgagctctgcttgcgataagcgactacttctctcggctacgcgctttgagttcactttggcttgcccgtccacgggaataaattgaatcgattcataaatagcataataatattaggtactgcatcttgagtgttgcattagccagccccata

SEQ ID NO: 6704 - DNA, 596 bp, Triticum aestivum
  misc_feature (13)..(13): n is a, c, g, or t
  misc_feature (47)..(47): n is a, c, g, or t
  misc_feature (52)..(52): n is a, c, g, or t
  misc_feature (68)..(69): n is a, c, g, or t
  misc_feature (89)..(89): n is a, c, g, or t
  Predicted polypeptide sequence is orthologous to G1198, G1806, G558
atacaatacgatnaacactaatgacaaacaattacacatgatatatnccggntcaccagcgctacaanntctccctgttttcttatagnaatttcatcgctacaccatcatcatcatcacaccaaaacatgtatttacacatccttgatcccttgacccggccacctgatcgaccttaattaccctgttttactctgtcatcgtccggaaaacatgcaagcacgcacgcacctacggcgcggctctgaatgcctacctcttctcccttggacccagcgagatggatctcttcgtcctccgctggccagcagatggatggattactacgtacgtacgtactaacttcttctgcgccatcatcgatctctctctgcttccgccattgctacgtgatcgagcacagtttagcttatggcggactcgcgcgggcgggccgcccagagcgtgctgagcgcgcgaaggcgctggaagtagtcccccagcacgagcaggcccttggccgcctgccgcgtcgtcaggatcctgtgcatgttctgcagcgtctccagccggagatggtccgcctgctgcacgaagccgacgaggcccttgagctt

SEQ ID NO: 6705 - DNA, 607 bp, Triticum aestivum
  Predicted polypeptide sequence is orthologous to G1198, G1806, G558
tttttttttttttttttttttttttccaaattctgtcagatagctcacctattcaattcaagatattttggtagtggtgcatggtagaaggtgttcttacaaaatgcagccagaagtaatgaaaataacacaaattgacaataatgaactctgggtgtcctccatttgttctcactccaggatacattaaaccatttgactcaagaaaatctgatgacagttgtacgcattctgacaagttctcccatttctggagcttcctttgtttcccagctctctgtttctcacatatctgctacattacatccaaaaaatttcttcccagttgttttgcttatgctcctactttgaaggttagttccaagatacatttgaatcagtaggctgaatattggctttcagctggatgtgctgcaatgcttagctctccacaattgccttcatctgtcatcagtatctctcgagggcgagaacccagagggagcttagggcacggaggcggttatggtactcgccaatagccaagaaacatcgagctgcctgcctaactgtcagaatcctgtgcatctggtgaagagtctgctgcctcaagttatcagcctgtatg

SEQ ID NO: 6706 - DNA, 758 bp, Triticum aestivum
  Predicted polypeptide sequence is orthologous to G1198, G1806, G558
ccacgcgtccgttctcgaagcttccccgattcgccgccgctccccccaccaaatccccgacgccgcgagccggagctgctacaggaggaggagtcgccggcctccgggcagaagccgcgcgtgaggccaggccgtaccggattcggtgctgcggctctgaggctctcccccatccatccccggcgggggcccgagggccgaccacctaccatggccgcggcccgccggcgccacgccgagccccgctcaggacgaccgcgccgaccgcaccccaccatacggttgtagtaaatcctcggcagctactgacttgggctcttggagagaaattctggcaacgatcgatctcgcgcagcaaagggctgggctcaccgctttgctgttaggaaggggggagcaaagtgatttgctgtctccttgtgattgtggtccgctgagtgatggcagatgctagctcaaggactgacaactcaactgttctagacaacgacggcaagatctataggttagaacaaggacaaagtggtggggcaatcatggcttctaattcttcggataggtctgacaggtccgacaaacccttggaccaaaagacattgcgtcgtcttgctcaaaatcgtgaggctgcaaggaaaagtcgattgaggaagaagtcatatgtgcaacagctagaaagcagcaagctgaagcttgcacaactagagcaggagctccagaaagctcgtcagcagggaatcttcatttctagctccggagac

SEQ ID NO: 6707 - DNA, 865 bp, Triticum aestivum
  misc_feature (22)..(22): n is a, c, g, or t
  misc_feature (521)..(521): n is a, c, g, or t
  Predicted polypeptide sequence is orthologous to G1198, G1806, G558
caaccccccctgcggtagtggnctttcatacgacgttagattgggaccactttgtacaagaaagctgggtacgcgtaagcttgggcccctcgagggatactctagagcggccgccctttttttttttttttttcaaaaatggtacgaacttgttcgatagttgataatctgatgtcatctacaggcagcaatatccactgaacatttgctgtaaacattcatcacatgattctgatccaaacttctcgccaatacaagaacattgtgaagaatctagggagtagggaatacctgaattcctatggggctggctaatgcaacactcgagatgcagtacctaatattattatgctatttatgaatcgattcaatttattcccgtggacgggcaagccaaagtgaactcaaagcgcgtagccgagagaagtagtcgcttattgcaagcagagctcgtgcagactggcgagtggttaatatgcgtttcgcatctgctgaagggtttgtagccgcagatatcagcnctgtcggaggaagtttctagggtgccaagtttccccatggccattgccatctgccccatgtagcttgcaacattaccggaagatcctgtagggcccagggatccagatgacagggtttctgcaagcgactgttgtagtgcctccataccttgagaaagagcatcctcagcttgttgagaagattttcggaggttgcatatgccagtaagctgctgctcagtaagaggtctagtttacctgcccagtaacttaaggagctccgattattctgagaccacttaaccaattgaagcactcttcagaggggttttccccattccccggaaggcaatggaaaactctgc

SEQ ID NO: 6708 - DNA, 850 bp, Triticum aestivum
  misc_feature (19)..(19): n is a, c, g, or t
  misc_feature (39)..(39): n is a, c, g, or t
  Predicted polypeptide sequence is orthologous to G1198, G1806, G558
ttaaccgccgttcgttagntagcttccatacgagttagnatagggaccactttgtacaagaaagctgggtacgcctaagcttgggcctctcgagggatactctagagcggccgcccttttttttttttttttttttttttttttttttttttttttttttttttttgaatcttaaaacatttcacctcgtcaggcggtatgatttatttaggcgattatacaccacaagaacatcacatcataggatctcaaattattctgcaagtttttacatccccattttttcaaaaatgctacgaacttgttcaatagttggtaatttgatgtcatctacaggcagcaatatccactgaacattcaccgtaaattttcctgacatgattctgatccaaactgctcgccgatacaagaacattatgaagaatctagggagtagggaatacctgaattcctatggggctggctagtacaacactcaagatacagcacctaatattattaattatcctatttatgaatggattcaatttattcccgtgggcgggccagccaaagtgaactcaaatggcgtagccgagagaagtagtcgcttattgcaagcagagctcgtgcagattggcgagtggttaatatgcgttgcatctgctgaagggtttgcagacgaaaatatcaccctgtcgtaggaagtttttttgttgggtgtccaagttttcccatggccattgccatctgccccatgtactttgcaacatttccggaagaattcttagggccccggggttccaaatttccgggttttcttcaaccaaattgttgtagtgcttccatccctttaaggaaggacattctt

SEQ ID NO: 6709 - DNA, 365 bp, Triticum aestivum
  Predicted polypeptide sequence is orthologous to G1198, G1806, G558
caatctgaggcagcaaacgttgcatcagacgcgccggattctaacaacccggcaggcggcccggtgtttcctctccattggggagtactaccgccggctccgagcactcagcagtctctgggcttcccgtcctcgcgagaacttcatcgggactgagagccttagcccaacaggaacggagctacaaggaatgcagcaccaccaccaaccgcaacagaatcagttctccggattttgaggcttctcctggagggtgtaacgtaggggtcagtgatgttagaaagagaggagaagacaacgagggactgtaatgttctatcattgattaaagtatttgagaaagcaacaaaaaaaaaaaaaaaaaa

SEQ ID NO: 6710 - DNA, 849 bp, Triticum aestivum
  misc_feature (653)..(653): n is a, c, g, or t
  Predicted polypeptide sequence is orthologous to G1198, G1806, G558
acgcttgaccttaggcctatttaggtgacactacagaacaagtttgtacaaaaaagcaggctggtaccggtccggaattcccgggatatcgtcgacccacgcgtccgatgccatgagtggaaatggagcaatgactttcgatctggaatacactagatggcttgaggaccaaaacaagcaaatcaatgagttgaggactgcagttaatgctcatgcaagtgacagtgacctgcgccttatcgtagatgggataatggcacattatgatgaaatatttaaggtcaaaggtgtcgctgccaaggctgacgtgttccatatactgtcaggcatgtggaagacgcctgccgaaaggtgcttcctgtggcttgggggtttccgtccatccgagctcttaaagctcctggtgaatcatctggagccgctaaccgagcagcagatgttgggattgaccaacctccagcaatcttcccagcaggcagaggatgcactgtcacaaggaatggaagcattgcagcaatcactggcagagactctggctggatctctgggttcctccgctggctcttcggggaatgttgcaaactacatgggtcagatggccatggccatgggcaagcttggaacgctcgagaactttcttcgccaggctgacnacctgcgacagcagaccttgcatcagatgcagcgaatcctgactatccgtcaggcctcccgcgccctcctagccatacacgactacttctcgcgtttgcgcgcgctgagctctctgtgccttgctaggcccagggaataaccaaggatcatcgctcgccggattcccccctaactgatgtgacaccgctgggggtg

SEQ ID NO: 6711 - DNA, 1109 bp, Triticum aestivum
  misc_feature (675)..(675): n is a, c, g, or t
  misc_feature (803)..(803): n is a, c, g, or t
  Predicted polypeptide sequence is orthologous to G1198, G1806, G558
aagcaggctggtaccggtcccgaattccctagatatcgtcgacccacgcgtccgcgaaaaagtcgtctgaggaaaaaggcgtatgtacaacaacttgagagcagtaagctgaaacttgcaagcctggaacaagaactccagaaagctcgacagcaaggaatcttcatttctagctctggggatcaaactcatgctatgagtggaaatggagcgatgacatttgatttagaatatactcgatggctagaggagcaaaataagcagataaatgagctgaggactgcagtaaatgctcatgcaagtgatagtgacctccgtcttattgtagatggaataatggcacattatgacgaaatattcaagctgaagggcgctgctgcaaaggctgatgtgtttcatatactttcaggcatgtggaaaacacctgctgaaaggtgttttttgtggcttgggggttttcgttcgtctgagcttctaaagctccttgtaaatcagctcgagcctctaacagagcagcagttgatggggttatccagcctcgagcaatcctcacaccaggccgaggatgcactatcacaaggaatggaggcattgcagcaatctttggctgaaacgttggctggttcccttggtccatcaggatcttcaggaaacgtggcaaactacatgggtcanatggctatggctatgggaaaacttggaacccttgagaatttccttcgccaggctgacaatctacggcaacaaactttgcatcaaatgcaaagaattctgacaatacggcaagctgctcgagctctccnttgcatacatgactatttttcacgtttgcgtgccctgagctctctctggctttgcaggccacgggagtaaaacatgtgcgccatcttttggcgcctcatgagctgatccaggaaatgtggacaaaatgcgacgcatttgcagaagattggggttcagttccctctgaaaataatttgacaccttgtgttctcatattgtacctcgacgttgtacaagtagccagggagggggtaaggcttgtacttgtaatttacatgaattttatgattggaaatttggtaaaaaaaaaaaaaaaaaaaaaaagg

SEQ ID NO: 6712 - DNA, 1117 bp, Triticum aestivum
  Predicted polypeptide sequence is orthologous to G1198, G1806, G558
cgtgcgacccacgcttccgcccttctgaccaacccggccgcccccagtttcttctcctcttctctctccgcgctgccgtcccgaccccgtcttctgctcctccgcttcacgcggcgccggccgccggccgccggccggcctccctccaaatccgtacgccgagcgggccctccctccctttcgacctcctcccctgccgcagacactgccccccgtgatcccgtgcctacagataatttgactctgaaaaggtgacggctctggcctcggagtgatctgacacataaaggatacaggcgcccttattaccctgcttgaactaaaggggcaacaaagcgatttgttgtcctgttgttttgagctggaaaacccccggtatggctgatgctagttcgaggactgacacatccatagttgtggacactgacgataagaatcaaaggattgttgtacacatttgctccagtgcctaaagaaacaacacacttcttaaattagatatcaacttgcaaaagtgaacaggactactgctgctgcactatcagtttcatcagatggaaaacggacaaaatggagctatcgtgccttctaattcatctgaaccatctgacaggtccgacaggcctatggaccaaaaggtattgcggaggcttgcccaaaatcgcgaggcagcacgaaaaagtcgtctgaggaaaaaggcgtatgtacaccaacttgagagcagtaagctgaaacttgcaagcctggaacaagaactccagaaagctcgacagcagggaatcttcatttctagctctggggatcaaactcatgctatgagtggaaatggagcgatgacatttgatttagaatatccccgatggctagaaggaccaaataagcagataaatgacctgaggactggggtaaatggtcatgcaagttaatgtgacccccgtcttattgtaaatgggatatgggccattattaccaaatatttagccttaggggcctctgcaaaagcggagtgtttcaaatacttcagggctgtgaaaaaccctcttgaaagggtttttggggctgtggggtttccgtcgccttaacctttaaaccctctttaaataaggcgagcccttaa

SEQ ID NO: 6713 - DNA, 579 bp, Triticum aestivum
  Predicted polypeptide sequence is orthologous to G1246
atcgctgcttatctactcgataacagagagagagagaagaaaaagaagatggtggcgattgttttatcaactgttacagctgtcttttttgacatttggaaagaccgccacttgtggcgtcccccgcttcccctccctcccttgttcttatccagaacgacgtattgaaaaatccggccaccgacccaccgaccaccggcacctcgccgccctcaccgacgcggcggagctcgctagggggacaggtggacacgattgagttggttgtgctgaatctgattgatcatacgccggctggccgctctccggagactagctgcatggtcgacgggttgtggatgactggaagcagccgctgcttcttctcgctgcttggctgcttcactcggcgtcggaggtgtccgggctcggcgcctggttgagatccgggttcttggcgcgcccgttccacgccgtccgctgctgcttcacgtggcggtgcagctcctcagcgtgcggctccgcgtggtggtggtgttggtggagccgctgccgctcccggtggtgcgcgggcgcggcgaccatggtggtcatgccggc

SEQ ID NO: 6714 - DNA, 533 bp, Triticum aestivum
  misc_feature (32)..(32): n is a, c, g, or t
  misc_feature (246)..(246): n is a, c, g, or t
  Predicted polypeptide sequence is orthologous to G1272
agtgtaccgtaacgcatctcttgcctcatatnaccggcccctcgtatctccccatacatattttgctttctacaaaaattcgtctggcaaagcaaattccccttcctttgccggctgccatgtttttctactaccttacctgccctgcatatctagctagatggatagatagataaatgttacaagtaaaaaaaaaaggttactgggatgtcgtctgtcttttggcacaaaccacagcaaggcagngccatatgtagtatatcatcttcgttcgcctgtccctcaactggcgaaaccccgcaggaaaccaaaccggctcgaactcgaaacaggtctcttgagggttgctgctgtgcttgaagtgtcctttggcgcctcaggggtaggcactccttccttcatcgaagttgcccggttgatcacagcccttttaggtattgatgtagttccagctagcatactcagtcctgatgctgatatggctgtagacgaacgcaaaaccttaggtggatctgctctaggtgattgagcta

SEQ ID NO: 6715 - DNA, 610 bp, Triticum aestivum
  Predicted polypeptide sequence is orthologous to G1272
agggaggggccacccccgccggagaagaccgccgcgacggaactcgcatcgccggtaggatggacccgcatgatggagagcctgctgctgacgagttgccaccaccaccccctctgcctcccaacgtggtgcccatcatcgcagaagatgctgctgctgctagtgagagcgaaccgcccccaccgccacctccaagcaagccagcaaagcctaggaggcacataatggccaggcctcccaatggcttgggaaagaagggccagcccatccagctgcttgccaaccactacaaagtctctgtcaagccttcagaggagttcttcaaccactactatgttaatctcaagtatgaggatgatacgccagtcgacagcaagggcattggcagaaaggtccttgataagctgcagcacacctaccattctgagctcgcagacaaggactttgcatatgatggcgaaaagagcctctttaccatcggggctcttccacagatcaacaatgaattcattgtggtattggaagacatcggtagtggaaagactgctgctgggagccctggtggtaataacggtagtcctggaggtggtgaccagaagagggtgaggag

SEQ ID NO: 6716 - DNA, 781 bp, Triticum aestivum
  Predicted polypeptide sequence is orthologous to G1272
accggtccggaatttccgggtcgacccacgcgtccgtgtttgtcaatgacgcggtgcaggcagaacagtttgatttgagcatccgcaaagtgttcaccttcagtcaccagattacaggtcttcatattgcagacttgcatttcaatgaagttagctcaatgttgtcccatgccatccctgttcgccttttgaaggtatttggagaagacagttgaaagttgggtggtattagagaacttgtcttctacattcacatcagggagacgtggggtttgaagatagacccattcccattcccattcccattcccatttcttcccaaatcccagcccccgccgtctggcgtcctccgccccgccttcctttttcacctctccccttccatccacctccctaagggcgcggaggcggagagggcggaggcgagagggttccgcatctccgggcgagctctggaaggtacctgattatggcggctaaaacgggtggagctgtacaagtgcataagaatgacactgttaaacgcacagcaatggcacggactggcttgggccgtgaaggaaagcccattaggttgctgtcaaaccactttgctgtgaagcttagtgggattgattcggttttctaccaatacagtgtgtccatcaaatctgatgacgatcaggtggttgaaggcaagggcattggccggaaggtcatcgataaaatgttgcaaacatacagttctgagcttgctggaaaggattttgcatacgatggcgagaaatgcctatttactgtt

SEQ ID NO: 6717 - DNA, 1565 bp, Triticum aestivum
  Predicted polypeptide sequence is orthologous to G1272
actcgaatatgaggaccctcacactgtaattgaagagagcccgtcactgagacgagctccggtggcacgaagagtggaggagatgtttgcccagataaaggccaagctacctggagcacccttgtttcttttgtgcctcctccctgagaggaagaactgcgaagtttacggtccttggaagaagaagtgtcttgctgatttcggcatagtcacccaatgtctagctccgcaaagagtcaatgaccagtacttgagtaatctgctactcaagataaatgctaagctcggtggactcaacacactgcttcaaattgaagcagcccgtgcaatacccattgtggggaaggtgcctactatcatcctgggcatggatgtctcgcatggtcaacctggccaatccgacaggccttccattgctgcggtggtgagttctcgtgagtggcctctcatctctaaatacagagcaacagtgcacactcagtcacccaaacaggaggtgatggcttccctgtttaagccacggggagctgaagatgatggccttattcgggaatctcttattgacttgtacactagctctgggaagcgaaagccagaccaagttattattttcagggatggagttagcgaaagccagtttactcaggtgataaacattgagcttgagcagatcattgaggcatgcaagtgccttgacgacaagtgggagcccaagttcacggtcattgttgctcagaaaaaccatcataccaggtttttccagacaaactcgccagaaaatgttcctcctggcactgtggtggataaacaagtgtgccatcccaagaactttgacttctacatgtgcgcgcatgctgggatgattggcacgtcgaggccaacgcattaccatgttctgcatgatgagatcggcttcagtggggatgagctccaggagtttgtgcactcgctctcctatgtgtaccagaggagcacgacggcgatatcagtagctgctccgatagcgtacgcgcatctggcggcggcgcaggtgggcaccttcatgaagtttgaggacatgtcggacacgtcgtcgagccagggagggggccacacgtctgcgggcagcgccccggtgccggagctgcctcggctgcacgagaaagtgaggagctccatgttcttctgctgatctgatgctgctcttgaacttgatcgatgccgctttctgtcagtggaggttgaaccgtgcgtctgtataaataaaacctactagtacctatctatctatgtactatctagatggcacctggaactttagctgttatccagggtgcccgtaagtcggtccgttgtgtcgggtgccgctgggaacgttcccatggatgttaccgtttgtggtgttggcgttgttgaaccaaccaacctgaccctagcttaaccttgcttggattggatgatgtgctagctagctagagctagagctagagttagaccatgcatggctgatggtatgtattgtgggatcatatctatctatctccatcctgacttggtgataaaaaaaaaaaaaaaaaaaaaaaaaa

SEQ ID NO: 6718 - DNA, 2815 bp, Triticum aestivum
  Predicted polypeptide sequence is orthologous to G1272
aagaggggaaatcctatacagcttgtgacaaatcatttcaaagtctcgttgaagacgacagacgagttcttccatcattactatgtaaatctgaagtatgaagatgacaggcctgttgatggaaaaggtgttggtagaaaagtcattgataagcttgctcagacttatccatcggaactagcccataaagactttgcctatgatggtgaaaagagtctttttaccattggtgccctcccacaaattaacaatgagtttgttgtggttcttgaagatgtttccagtggaaagactcctgcaaatggcagccctggaaacgacagtccagacaagaagagagtgaaaaggccatatcaaactaaaaccttcaaggtggagttgagctttgctgctagaatccccatgagtgctattgcaatggcactcaaaggccaggaatcagagcacacgcaagaagccattcgggttattgatatcatattaagacagcactctgccaaacagggctgcctgttagtccgccagtcattttttcacaacaatccttcaaactttgtggacttgggtgggggtgtgatgggctgccgaggtttccactcaagctttcgagccacacagagcgggctttctcttaatattgatgtttctacaacaatgattgtgaaacctggccctgttgtcgattttctgctggccaaccagaaggttgaccaccctaataaaattgattgggctaaggccaagcgtgcacttaagaatttaaggataaaaacaagcccagcaaatacagaatacaagattgttggtttgagtgagaggaattgttatgaacaaatgttttccctcaagcaaaggaatggtgggaatggtgaccctgaagcaatagaaatatctgtttatgattactttgtgaagaaccgtggcattgagctgaggtactctggtgatttcccttgtataaatgttgggaaacctaggcggccaacatattttcccattgagctctgccagctggtccctttacaaaggtataccaaatctttgagtaccctacaaagatcatctcttgttgagaagtccaggcagaagcctcaagagaggatgtcagttttgtctgatgtactgaaacgcagcagctatgatacagaacccatgttgaaggcatgtggaatttcgatagctcagggctttacacaggtggctggtagggtactgcaggcccccaagctcaaagctggaaatggtgaagatattttcacaaggaatggacgttggaatttcaacaacaagaggcttgctagagcttgtgtggtggacagatgggcagttgtaaacttttcggctaggtgtaacaccatgaaccttgtcaatgacctcatcaagtgtgggggcatgaagggcattacagtagaaaaacctcatattgtaattgaagagaatggttcaatgagacgtgcacctgctccaaaaagggttgaggatatgtttgagcaagtgaagtctaagcttcctggggctccgaagtttctcttgtgtattcttgctgagaggaagaactcagatgtttatggtccatggaagcgaaaatgccttgctgactttgggattgtcactcaatgtgtggccccaacaagggtcaatgaccaatatctgacaaatgttctgctgaagatcaatgcaaaacttggtggaatgaactcactactacaaattgaaatgtccccaagtatacctcttgtatcaaaggtcccaactctcatcttgggaatggatgtgtcccatggatcccctggacagtctgatataccgtccattgcagcagttgttggttctcgggaatggcctcttgtctcgaaatatagggcttcagtgcgctcgcagtcaccaaagctcgaaatgatagattcattgttcaagccacaaggaactgatgatgatggccttgttcgggagtgtctcattgacttctacaccagttctggaaaaaggaaaccagatcagatcatcatcttcagggatggtgttagtgagagccagtttaatcaggtgctgaacattgaattggatcaaataattgaggcctgcaagttcttggatgaaaattggaaccccaagttcacgctgattgttgcccagaaaaatcaccacaccaaattcttcatacctggatctcctgacaatgtccctccaggcactgttgtagataatgcagtctgccatccaaggaattatgacttctacatgtgcgctcatgctggaatgattgggactacaaggccaacacactaccatatcctgcatgatgagatacactttgctgcggatgacctgcaggatcttgtgcactcgctctcatatgtgtaccaaaggagcacgacagccatatcagttgtttctccaatctgctatgcacatcttgcggctgctcaggtggcgcagttcataaagtttgatgagatgtctgagacgtcgtcgagccagggcggtggccacacctctgccggcagcgctccagtgcaggagctgcctcgcctccatgagaaagtccgcagcagcatgttcttctgctgagccagccagccagccgcacttgcgcgttccaacttttggtgatgcgcttggttatctagtactagtagtatgtagtagtggcctgtgatggcctgttggactcctgggatgttgtgttcctaagctggttgctgcacttggtgcctcagaacctttgaatcctgtcagggtgctgcagttgaacctttactatcgaaccatctaatttgttgctttcaaaaaaaaaaaaaaaaaaaaaaaaaaa

SEQ ID NO: 6719 - DNA, 857 bp, Triticum aestivum
  misc_feature (22)..(23): n is a, c, g, or t
  misc_feature (666)..(666): n is a, c, g, or t
  Predicted polypeptide sequence is orthologous to G1272
cactcacccgtgccttagtggnnttaccatacgagttagtatagggaccactttgtacaagaaagctgggtacgcctaagcttgggcccctcgagggatactctagagcggccgccctttttttttttttttttttttgttttttttttaccaaattcacaactgcaagcaaattatcaccaagtcaggatggagatagatagatatgatcccacaatacataccatcagccatgcatggtctaactctagctctagctctagctagctagcacatcatccaatccaagcaaggttaagctagggtcaggttggttggttcaacaacgccaacaccacaaacggtaacatccatgggaacgttcccagcggcacccgacacaacggaccgacttacgggcaccctggataacagctaaagttccaggtgccatctagattgtacatagatagataggtactagtaggttttatttatacagatgcacggttcaacctccactgacagaaagcggcatcgatcaagttagagcagctcagatcgagaaactgactctcttgtctgctcctcactttctcgtgcagccgaggcagctccggacccggggcgctgcccgcagacgtgtggccccctccctggctcgacgacgtgtccgacatgtcctcnaatctcatgaaggtgcccacctgcgccgctcccagatgctcgtacgttatcggaatcacttattgatattgcccgtcgtgctccttttggtcctcattggagaagcatgtgcccaaattcctggaggctcatccccctttgaagccctttttcttcattcaaaaaattgttattggctttgcctcccacct

SEQ ID NO: 6720 - DNA, 741 bp, Triticum aestivum
  Predicted polypeptide sequence is orthologous to G1274, G1275
tcggcacgagggtagcacgctagtgcgtagtccgtagctcgtctgtgcagtgcacttatggcggcttcgctaggacttaccagccatgaagcctgctgcacggtccaccccaccggctcctccttgtacaacttccaagccgatgaccccttcgtggcagcagcggacggtgccgcggagctgagcttcccggagctcgtggaagccgctcgggcctccgactactcgccgcttccggcgttcggcgtcgctggaggcgagacgatgaacatgtacgggcggagcgtcgtcttccctatgacgacctcgtactactgcgacggcgccgggatgttcgacggcgacgcttcggcgagggggagatggggagggatcggtgctatgaccgggcggccgtcggggaggatcgggttccggactcggtcggaggtggaggtgatggacgacgggttccggtggaggaagtacggcaagaaggcggtgaagagcagccccaacctgcggaactactaccggtgctccgccgaggggtgcggggtgaagaagcggatcgagcgcgaccgcgacgacccgcgctacgtcctcaccacctacgacggcgtccacaaccacgtcacccccggcagcacgtcgtcgagggcagcgccggcgtactcggcgccgacggcgcccgcttggacctggagcgagctgcatgcggcggcgcactcctcggagtcctactgaacggagctactgatc

SEQ ID NO: 6721 - DNA, 396 bp, Triticum aestivum
  Predicted polypeptide sequence is orthologous to G1274, G1275
ttttttttttttttataaatatatttcttcgattaaatggggtcaaaagcaatatacatttgccttgacatcatatcatagtacaaaagaatgtgatatcacagtactagtagcacaaaagaatagcaacagcaataacaccaaatcgacctcgtgccgaattcggcacgagcccaaacccaaggaactactaccggtgctccacggaggggtgcagcgtgaagaagcgggtggagcgggaccgggacgacccggcgtacgtggtgaccacgtacgagggcacgcacagcacgtcagccccagcaccgtctactacgccagcaggacgccgcctccggcgcttcttcgtcgccggacgcacccgccgccaggctcatcaactgagttacctaacca

SEQ ID NO: 6722 - DNA, 734 bp, Triticum aestivum
  misc_feature (255)..(255): n is a, c, g, or t
  Predicted polypeptide sequence is orthologous to G1309, G237
ggatttcgctggtgaccgcgcgccctcgacgcgcttcttgaggtacgagttccagtagttcttcacctcgttgtccgtccggcccggcaggtgctgcgctatctgagaccacttgttgccgagggcggcgtggaggcccatgacggtctcttcttcctcccgggagaacatgccgtgcttcagccccggcctcaggtagttgatccatcgcagcctgcagctcttgccgttccgctgaagcccggccttgacggngacggtgctccagcagctgtggccgtggcggacgatgaaatcgcggagcttctggtcctcctccggcgaccacagccccttgcggtgctgcgccttgggcttctggcacgacttgcaccccatcagttcccacgaaatgccggaggtgcaggaggacgggccggcgatgctgtgcactccaagcaggaacggcgaaggggggttatgatttgataaataaatcagctttgagaggcgtgggaggggctgcggtttgctgtgctgtgatgtgtgcactgttgtgctcgaggtcgacccgggaattccggaccggtacctgcaggcgtaccagctttccctatagtgagtcgtattagagcttggcgtattcatggtcataactgtttcctgtgtgaaaatgttatccggtcaaaattccacacaacatacgagccggaaagaataaagtgtaaaggcctggggtggctaatgaatgaagt

SEQ ID NO: 6723 - DNA, 655 bp, Triticum aestivum
  Predicted polypeptide sequence is orthologous to G1309, G237
tcggcacgaggagtgcacgcagcacagcaatcgcagcccctcccacgcctctcaaagctgatttattaagccttaacctcctccttggagcacacagcttcgctggtcctgcacctccgcggcggccggcatttcgcaagaatcgatggggtgcaagtcgtgccagaagcccaaggcgcagcaccgcaaggggctgtggtcgccggaggaggaccagaagctccgcgactacatcgtccgctacgtccacagctgctggagcaccgtccccgtcaaggccgggcttcagaggaacgggaagagctgcaggctgcgatggatcaactacctgaggccggggctgaagcacggcatgttctcccgggaggaagaggagaccgtcatgagcctccatgccacactcggcaacaagtggtctcagatagcgcagcacctgccgggccggacggacaacgaggtgaagaactactggaactcgtacctgaagaaccgcgtcgagggcgcgcgggcaccagccaagtccgccggctccgacgcgccccggagcccgatgcccagcgacagcggccgcgaacgcagcaccgttaaccagccgtccaacttccggctcgtcgggcccgcctgagtcctcgtcgacggccgacgactcgagcag

SEQ ID NO: 6724 - DNA, 644 bp, Triticum aestivum
  misc_feature (483)..(484): n is a, c, g, or t
  misc_feature (531)..(534): n is a, c, g, or t
  misc_feature (609)..(609): n is a, c, g, or t
  misc_feature (613)..(613): n is a, c, g, or t
  misc_feature (616)..(617): n is a, c, g, or t
  misc_feature (623)..(623): n is a, c, g, or t
  Predicted polypeptide sequence is orthologous to G1313
ccacgcgtccgggagcataaggcagagcttccagatgtttctttcagcaatttacctggtctgtactttgagtcaaaaaaccatggcttcatggatcaagtaaaccaagcagaagttctgaaagaatctgagatctcatttccttggttgaacgcggccattaatggtaccttcgatggcggccatgccttttcaaatggcaacttctctacttccaggcccatgactggtccctggaagatggagctcccttcactccaatttgctggatctgatccaaacaactggtccacatactcaaggacctgcgccgcgcagggtgccaactttgctgatccctgcatgcgctcatcagcggcaatggcatcagctaagtttgagcacatgtgcatgataccagggaacagcggtcagttggaagagccgcttccagaagctcatgcagtaagctctgcagagaaccagcagctgtccgtggggagnncgagtgcctctactggctcaccctgcgatgctatggtggaaacatcnnnncttcatttcttggaacgggatcccaacctgtacgcccttgtcaacagctgttcgcccgcctcgcctctttgccangcancgnntgatgngttaccgtgctccgatttttc

SEQ ID NO: 6725 - DNA, 1527 bp, Triticum aestivum
  Predicted polypeptide sequence is orthologous to G1313
ccagggcacgacggagagatgtaccgggtgaagagcgagagcgactgcgagatgatgcatcaggaggaccagatggactcgccggtgggcgacgacggcagcagcggagggtcgccccacaggggcggcgggccgcctctgaagaagggcccctggacgtcggcggaggacgccatcctggtggactacgtgaagaagcacggcgaggggaactggaacgcggtgcagaagaacaccgggttgttccggtgcggcaagagctgccgcctccggtgggcgaaccacctcaggcccaacctcaagaagggggccttcacccccgaggaggagaggctcatcatccagctccactccaagatgggcaacaagtgggctcggatggccgctcatttgccagggcgtactgacgatgaaataaagaattactggaacactcgaataaagagatgtcagcgagctggcttgccaatatatcctgctagcgtatgcaaccaatcttcaaatgaagatcagcagggctccagcgatttcaactgcggcgagaatctttccagtgaccttctgaatggaaatggtctttatctgccagattttacctgtgacaatttcattgctaattcagaggctctatcttatgcaccacagctttcagctgtttcaataagcagtttgcttggtcagagctttgcatccaaaaactgcggcttcatggatcaagtaaaccaagcagggatgctaaaacagtctgaccctttactccctggattgagcgacaccatcaatggcgcgctctcctcggtcgatcagttctcaaatgactctgagaatctcaagaaggctctgggttttgactatctccatgaagccaactctagcagcaagatgattgcaccatttgggggtacacttactggcagccatgcctttttaaatggcaccttctctacttctaggaccatcaatggccctttgaagatggagctcccttcactccaagataccgaatctgatccgaatagctggctcaagtataccgtggctcctgcgatgcagcctacggagttggttgatccctaccttcagtctccgacagcaactccgtcagtgaagtcggagtgtgtgtcgccaaggaacagcggtctcttggaagagctgcttcatgaagctcagggactaaaatctgggaagaatcagcagctttccgtgagaagttcaagttcctctgtcagtacgccgtgtgatactacggtggttagcccagagtttgatatctgtcaggactattgggaagaacctctgaatgaatatgctcctttcagtggcaattcactcactggatctacggctcctgttagcgctgcgccgcctgatgtttttcagctctccaaaattcctcctgcacaaagcccttcgctgggatctggtgagcaggcaatggagcctgcatatgagcctggggctggggacacttcgtctcatcctgaaaacttcaggccagacgcactcttctccgggaacacaactgac

SEQ ID NO: 6726 - DNA, 545 bp, Triticum aestivum
  Predicted polypeptide sequence is orthologous to G1335
aaagactacagatacataccgagagaaaatgcagattactggtgtggtcaagtggttcaacgaaaccaaggggttcggcttcatcacccccgacgacggcagcaaggacgtcttcgtccacttcaccgcaatccaatcccatggcttcaagaccctcgccgagggccagcgtgtcgaattcgaaattcaagacggccaaaaaggcccgtccgccgtcaatgtcaagcccctagaggtagaggaggataagaggatttcgagcaaattgtaagaggatgctccacccatccacccgcgtcgatgtgtaatatcctatgctgcgttcggaaagattgctattgtttgtcttctcttctcacatgtacactgaaatctgcactgtttctcttttcttttttattagtacatcaagtctacaggggttaactgctgctccgttcgggtttgcaaggaatgtggattttgtttgagtcaattcttttttacttttttaaaaagtttatactacaaagaatatcgatgtttaaagtaccaaaaaaaaaaaa

SEQ ID NO: 6727 - DNA, 1124 bp, Triticum aestivum
  misc_feature (11)..(11): n is a, c, g, or t
  misc_feature (33)..(33): n is a, c, g, or t
  misc_feature (654)..(654): n is a, c, g, or t
  misc_feature (729)..(729): n is a, c, g, or t
  misc_feature (811)..(811): n is a, c, g, or t
  misc_feature (912)..(912): n is a, c, g, or t
  misc_feature (917)..(917): n is a, c, g, or t
  misc_feature (919)..(919): n is a, c, g, or t
  Predicted polypeptide sequence is orthologous to G1335
acgcttccgtnagggttttggtccttcgttttncggcggcgcaagacgggggagaggttcaagggaaccgtgaggtggttcaacgtcaccaaggggttcggcttcatctccccggacgacggcggcgaggaccttttcgtccaccagtccgccatcaagtccgacggctaccgcagcctcaacgagaacgacgccgtcgagttcgagataatcaccggcgacgacggacgcaccaaggcctccgacgtcaccgcaccaggaggaggggcgctctccggcggctcccgccctggcgaaggcggtggtgaccgcgggggccgcggcggctatggaggcggcggcggtggctacggcggtggcggtggtggctacggaggcggtggtggcggctacggcggcggtggtggcggctacggtggcggtggctatggaggcggcggtggcggcggccgtgggtgctacaagtgcggcgaagatggccacatctccagggactgcccccagggcggcggtggcggcggcggctacggcggtggtggctacggaggtggtggcggcggcggccgtgagtgctacaagtgcggcgaggagggccacatctccagggactgcccccagggcggcggcggcggcggctacggaggcggtggcggncgtggcggtggcggcggcggtggcggctgcttctcctgcggcgagtccggccacttctcccgcgagtgccccaancaggcccactaggcggcacagctcttcagatctgagtgccccgtttacccttgctcctttacctacctcctgattctgcagncagtcataccctatacctatcagtactagtattagtcgccgtagcgtttccccctgctgctcgatgcgagcttgggttcagaagaattgctggtggtgtgntcgtnangatccaagttattttgctgtctctctgtgatgaggacacagatctatctatgtgttggatggacttagtaatcgaagttcaaaaaaaaaaaaaggccggccggtctaaagattcttcgaggggcccaagtttaccgttccccgctttcttgtcaaaggggtccctaaagggggtcgatttataaccaggcccgggccgcctttta

SEQ ID NO: 6728 - DNA, 1111 bp, Triticum aestivum
  misc_feature (649)..(649): n is a, c, g, or t
  misc_feature (726)..(726): n is a, c, g, or t
  Predicted polypeptide sequence is orthologous to G1335
gacccacgcttccgagggtttcccgtcagggttttggtccttcggtttcgccggcgcaaaatgggggagagggtcaagggaaccgtgaagtggttcaacgtcaccaaggggttcggcttcatctccccggaggacggcagcgaggacctcttcgtccaccagtccgccatcaagtccgacggctaccgcagcctcaacgagaacgacaccgtcgagttcgaggtcatcaccggcgacgacggtcgcaccaaggcctccgacgtcaccgcaccaggaggaggagcgctcgccggcggctcccgccctggcgatggcggtggtgaccgtgggggccgcggcggctacggtggcggtggctacggcggtggcggtggcggtggcggctacggaggcggtggtggcggttacggcggtggcggtggcggctacggtggtggcggcggcggccgtggatgctacaagtgcggcgaggagggccacatctccagggactgcccccagggcggcggcggtggcggcggatacggcggtggtggctatggaggaggcggcggcggcggccgcgagtgctacaagtgcggcgaggagggccacatctccagggactgcccccagggcggtggtggtggcggcggcggcggcggctacngaggcggtggtggccgtggcggcggcggcggcggtggcggctgcttctcctgcggcgagtccggccacttctcccgngagtgcccccaacaggcccactaggcggcacagctcttcagatctgagtgccccgtttaccctcgctcctttacctacctcctgattctgcagcaagtcatacccttatactatcagtactagtattagtcggcgtagcgtttccccctgctgctcgatcccgagcttggttccagagaaatggctggtggggtgttcgccgttagatcccaattattttggtggttctctgggatgaggaccaaatttttttttttgtgggggggccaatttttcaaatgaagttggggtttaaaaaaaaaaaaaaaaaggggggcggcccaaaaaatccctccggggccccggttagccgccccccctttttgttaaaaggccccctgctgaa

SEQ ID NO: 6729 - DNA, 1180 bp, Triticum aestivum
  misc_feature (18)..(18): n is a, c, g, or t
  misc_feature (969)..(969): n is a, c, g, or t
  misc_feature (1151)..(1151): n is a, c, g, or t
  misc_feature (1154)..(1154): n is a, c, g, or t
  misc_feature (1156)..(1161): n is a, c, g, or t
  misc_feature (1163)..(1167): n is a, c, g, or t
  misc_feature (1169)..(1170): n is a, c, g, or t
  misc_feature (1172)..(1173): n is a, c, g, or t
  misc_feature (1175)..(1175): n is a, c, g, or t
  misc_feature (1180)..(1180): n is a, c, g, or t
  Predicted polypeptide sequence is orthologous to G1335
tccgaccaccacaccganctagggtttcctgctagggttttagcccttcgtaactggcggcggcgcaagatgggtgagagagtgaagggaaccgtgaagtggttcaacggcaccaaggggttcggcttcatctccccggaggacggcagcgaggacctcttcgtccaccagtccgccatcaaggccgacggctaccgcagcctcaacgagaacgacgtcgtcgagttcgaggtcatcaccggcgacgacggccgcaccaaggccgccgacgtcaccgcaccaggaggaggtgcgctcgccggcggctcccgccctggcgacggcggtggtgaccgcgggggtcgcggcgggggtggctacggtggaggcggctacggcggcggtggctccggctacggcggcggtggcggcggctatggcggcggtggcggcagctatggcggcggtggcggctacggaggtggtggtggcggcggccgctacggcggcggcggcggcggcggccgtgagtgctacaagtgcggcgaggagggccacatctccagggactgcccccagggcggtggtggcggcggcggtggctaccgaggtggtggcggccgtggcggtggcggcggcggtggcggctgcttctcctgcggcgagtctggccacttctcgcgcgagtgccccaacaagaccatcgtagcggcgctgcccgtcagatctgagttgcccgttccccttcggtcctttttcctaccgcctaactcctgaggaagtcataccctattcctatcagtattagtataagtccccgtaatgtttcccggtgctctcgtaggaggaaaaatcaaaatgccacctggttcgaaaagtattgtggggggcgtgttcgttcgtagaagctatcttgttggcgcctccggtgggcacaaactatctatcttatttattggataaacggaccaaattgggcaccacctttanctttctggtttggaaaaaaaaaaaaatggggcgccgtgtttaattcccccccgggaccaagtttcccttcccccctattggcaaaaggggccccatagagggcatattaacgaacgcgggcgcttttccaaagccgcgcgcggaactgggcgttggcgattgctccgcaactctcctttggnggngnnnnnngnnnnngnngnngnttttn

SEQ ID NO: 6730 - DNA, 1123 bp, Triticum aestivum
  misc_feature (295)..(295): n is a, c, g, or t
  misc_feature (298)..(298): n is a, c, g, or t
  misc_feature (1046)..(1046): n is a, c, g, or t
  Predicted polypeptide sequence is orthologous to G1335
cataccggccgcccttttttttttttttggttgcaatctcctcattcgcaccgaaaatttatcaccaataagccaggatcatcacgaccttagacatcaactgagagtacgggtacgggtaccagaggaccaattcatagcaaaattaaccatcacacggactgactgactgactgactttcccctaggattgattccgagaacggaaggggggaggaagataaaataagcgaggcggctgcggctgggcgctcaggcccagatcgatcgagcggggggggtttttttttgaggnatncaggcgccacctatagagggggaggggcagagatatcccctcacttggtgcagtcgcgggagatgtggccggtctcgccgcagtggtagcaggtgcggtcgccgccggcgccgcctcctccgccgaacctcccgccggcgaccccgccaaagccgctgctggtggggcagtccctcgggatgtggtccgggtcgacgcaggtgtagcagttaccgtcgcctccggcggcgtagccggcggctcctcccgcgggcgccgccggtggaccagtcccttgagcatgggggcttgttcggcggcacttgtaccaggcgcagccgtcggcggccacgagccggggccctggcagggagccgcccccggtcgggtgggcgcggtccccgcactttcactcgggcccgctgttctgctccccccggcgtgatccgtctgggcccgccacacagggccggtggccgaaccggcgaaccggtccccgcctcgtcgagacgggtccccacgcccacccccgccgcacgcgcgaccgcggcgcatccgcccggggggagcgccgcatgtgcgggtacgggggcagcgcgtcgcccttcgcgccgggcggtggcgatccgcccccgtcgcgggcgccctccacactatccggtggggcggtgcctgtgcccgccaccggccgagcgtcggtcgcggccgtgtcgcccgccgggggtgtgcgctcgcacgtgcccggcctcgtccggggtcttggcgcccngcggtccccgcggcgcccgcagtccggcccgtcggccggtggtaggccctcgtcgcgtcttctcactggcttcgtgt

SEQ ID NO: 6731 - DNA, 861 bp, Triticum aestivum
  misc_feature (683)..(683): n is a, c, g, or t
  Predicted polypeptide sequence is orthologous to G1335
agcttgacattaggcctatttaggtgacactatagaacaagtttgtacaaaaaagcaggctggtaccggtccggaattcccgggatatcgtcgacccacgcgtccggcgcggatgaaggggacggtcaagtggttcaacgacaccaaggggttcggcttcatctcccccgacgacggcagcgaggacctcttcgtgcaccagtcctccatcaaggccgacggcttccgctcgctggccgagggcgaggtggtcgagttcgccgtctcggagggcgacgacggccgcaccaaggccgtcgacgtcaccggccccgacggatccttcgtgcagggcggcgcgggcggcggcgggggcggcttcggatcccgcggcggcggcggatctcgcggcggcgggggcttcggcggccgctctagagtatccctcgaggggcccaagcttacgcgtacccagctttcttgtacaaagtggtccctatagtgagtcgtattataagctaggcactggccgtcgtttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgnctgagagttttgcttactgagtatgatttatgaaatattatacacaggagctagggattctaaattgtttgtgtattttagattcacagtcccaaggctcatttcaggcccctcagtcctcaagtctggtcatgatcataatcagcccttacacattttgtagaggttttacttggct

SEQ ID NO: 6732 - DNA, 683 bp, Triticum aestivum
  Predicted polypeptide sequence is orthologous to G1341
cacgatacattcacaagatgatctgccgcaacgacacacgcaaacacctacaggttcgacattgagcgtacaaagcaacgtggaatcttgaaaaaacagctactacaggttcctcttatctcacgacacgcaagggttttgctcttaaaccaagttcatagcacgaacgaatacaatggacacaaagaaccacgagagaccacagcgcaggtgcacgtgcacgtgcacgccctgcacctgccgctcacacccgtcaatcgcatcgaggcatcgggatggagatcgagagctgggtcgtcgagaaggaggtgccgttggagcgctcgtcgtccatctccgaccacgagtcccgcctccccggccactcgtcgaagaagggcctcagcggctggttctcctgcttgacatttcccatgagccctccacctccacctccacctcctccacctccaccacccaaagagcggcagtcctgctcctgggagtgggacagcgaggcgatggttacctgcccaagctcctgcgacggctcatagtgggaatacgagaagccgccttgcatgaggccggaatctctaggtttcgacagttggtacgggggcaggctggaccccatcgagtgccacgagctgtccgttggggaatcgatggtgaagcccctgttgttgtttcctgatgctcca

SEQ ID NO: 6733 - DNA, 1143 bp, Triticum aestivum
  misc_feature (21)..(21): n is a, c, g, or t
  misc_feature (24)..(24): n is a, c, g, or t
  misc_feature (766)..(766): n is a, c, g, or t
  misc_feature (823)..(823): n is a, c, g, or t
  misc_feature (980)..(980): n is a, c, g, or t
  Predicted polypeptide sequence is orthologous to G1341
tccgcccagagagatttgttnatncgctgaccggctggcttcccctctccctgttccaatgccttcacaacccactcatgaaagacatccagaactccgacatctatagcctgtgcgaggagtggcagctggccatcgaccggatccccgacaaggtggcctcagaagggatcaaaaccctcctgtcggtgatccacgctgtggtagtccagcaggcggaggagcagaaacagaagaagaggtcagatgctgcattcaaagacttcgagaagaagacagaggaactgcggtctctggagtccaaatacgggccatactctgccgcaggctatggagagatgacgcggaagacaccagtagcagagaagcgggcgaaggtggaggccctgaggagcagggcggacgacgagaagagcaagcacgagaagagcgtcggggtgacgagggcgatgaccctgaacaacctccagacaggcttccccaacgtcttccaggcgatgacaggcttctccagtgtctgcatggaggcgttcgagtcggtgtacaacttcaagcggagcttggaccgggcgctcgacatgaagaggctactgacctgatgagagtggcattgcctgtggtcactgtataaaatgtatacagtttgtaggcttgtagtgtgatggtagtagggctggaagagagtttgattttacagagccaacttcattggtctggtacctggtgactagtctaggcatagaaatgcctggagctcgtttacttngctgtaatgaactcgaggccttgccttcctttctttttgcctggcttctactagctngtaatcattcaaaatctggctgttttgaagagctgcggtttttgaaaaaaaaaaaaaaaaaggcgggcgctctagagtatcctcgaggggcccaggttacgcgtaccagctttctgtacaaagtgtccttataggaatcgtattatagctaggactnccgtcgtttacacgtcgggactggaaactgctactgggatcttgtgaaggacctattctgggggggattattgccaactcctacgagatttaagccaggtaaattaaatttaaggttaagggtaacaaccgatatctgccgttaaatttggttcgaattaata

SEQ ID NO: 6734 - DNA, 722 bp, Triticum aestivum
  misc_feature (234)..(234): n is a, c, g, or t
  misc_feature (665)..(665): n is a, c, g, or t
  Predicted polypeptide sequence is orthologous to G1361
aatttgagagtacgttaagacgtaagttacgtatacatatatgtgtatataatgaacaatgtaacaaagattgatccctacgcttcatcacctgtgcagccactcaacacttttattgtccagtagtactgtttcgaaactgcttcgcgcgcactgccagtgccattttatctgcctgccatcctctcagtacgtgtctcctggcctctaacctagtagtagagtatatatcangtcaacgaatagaactgctttgctttagttggctttgcaattcttggtcagggaccaaagcccgtccctcccgtgtgcacctcgaagttaggcatcaaatgagcagaagcagcagcagccgcggccgccgccctgttgttaggaggagccgcctggctgctgtacccgattagtgctgcagcagttgggctgtagaaatctaccattcctgcagcttccttcagcatattgttgttgtggccatcctcgtggtgatgacggtgatgatcactagttgcacctgcaccgccacccttgatgatattgcccgctgtgatggcggcgtccctgacagcggcagccgtcgagccgccgcactgccgtggctgcgtctgatagaacaccttggagacgacgagctcgccatccttctcctcctcatcggagcctangtggtattgatgcatcacccagttggtcttctctggcttgcgctgcttgccgtagtt

SEQ ID NO: 6735 - DNA, 1130 bp, Triticum aestivum
  misc_feature (630)..(630): n is a, c, g, or t
  misc_feature (762)..(762): n is a, c, g, or t
  Predicted polypeptide sequence is orthologous to G1361
ccacgcgtccgatgcatcaatccacctctacttggtagtacaactagctccctcgtggcgtatcgatctccttggcaagcaacaacccaaaagttggtgagaattctattcctctgtaccagatagagagagaaacccagcacccagcagcagcaacaagcgcaggcaatggtagctagcttgtaacagggacaagcttcctctctaacctctttttctctttgttctcttcgcaggccgctttgttccctcgcccgccctctttagccagccaccagccccgatctccctcgatctcctctcctctttttaccctgtcactcattccctcccagccggcagggccggccttgatcctgccacatatggggacgggctagcaaagcggaactgcggacaccgagaggctttccatatcttcatccatccatcatcattaagtacgtggtggtggggcgcgggagtgccgtgtcggccggccatgacatggtgcaatagcttcaacgacgtgcgcgccgtggagaacaacctggcctccgccgcggccgtcgcggcggcggccgccaagaagcagcagcaccaccagcagcaggcctcctcccacgtcagcctcgttaggacgtgccccgnctgcggccaccacgcgcagtatgaacagttgcaggcggcgtcgacgatacaggatctgcctgggctgccggccggcgtcaagttcgaccccacggaccaggagctgctggagcacctggaggggaatggcangccggacacgcgcaagctccacccgctcatcgacgagttcataccggcgattgagggagagaacggcatttgctacacccatccggagaggcttccaggagttggcaggacgggcttgatccgcatttttccaccgtccatcaaagggctttacgaaggggactagtcagcggggcaggtggacaccgaaaaacagggcggcgaaacaaaatgcacaaacggggcaaaccccccccgttttctggaggggaagctcagggggtaaaaaaatctggtctcttatcaactacggaaagcggcaaccccaaaaaaccaaggggtttgttcaaaacccctaagcccctaaggagaaaagggggtgcccctca

SEQ ID NO: 6736 - DNA, 651 bp, Triticum aestivum
  misc_feature (581)..(581): n is a, c, g, or t
  Predicted polypeptide sequence is orthologous to G1361
cggcacgagggtcgagccatatcgctgttctcagtcagtactcggtagagacagatcggcaagtccttgcaagcgcttcgctgaacctcctctagtcctcttcctcccagaactgccgcattaggtttcgatccactggtcgcgatggtcgttgatccagttctcaagggatttgacctcaacatcgcggcagtagatgagtcaagccctttggaaggaatcggccttggcctgtatgcgactgagttcatccacaagtacctcagattcaatcccacggaccaggagctgatggagtggctcgaggccaaggtgagggatggaggcgcgagatctgaccctctgattgataaattcatacccaccatagaggtcgagtacggctacccccatcctcagcaacttccaggtgtgacgatggacggcacgatcaagcattttttctgccgtccgagggcgttcgagagtggacggaggaaacatcggaagataaaggcggagcgcaacgatcgtaccgcatggcacaagaccggcaaaagcatggcattgaaggccaacggccggctgacgggctggagaancatcctggtgctctacaccaacaccaggaagaccaactgggtgatgcacgagtatcgcctcagcgacgtc

SEQ ID NO: 6737 - DNA, 1097 bp, Triticum aestivum
  Predicted polypeptide sequence is orthologous to G1364, G481, G482, G485
gcacgaggcgccgccttctcttctccagcgtcggatcttcccccactcgccgccctcaccgcacctccattcccctccaccaccttccctccctccacgcgctcctctatataagggggagggccggatgtcggacgaggcggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggccacgctgggcttcgaggagtacatcgagcccctcaaggtttatctgcagaagtacagagagacggagggtgatagtaagctagctgggaagtctggtgatgtctctgttaaaaaggatgcactgggtcctcatggaggagcaagtggcacaagtgcgcaagggatgggccaacaagtagcatacaatccaggaatggtttatatgcaacctcagtaccataatggggacatctcaaactgaagatatggaccatctccgagactgctgctactctgctaggcgggttttcgtcatgtggagagcactaagcagttaaagaaaactcttagtacccccattagtctcgtgttgttgggtctgccagaactgatgctcaaaggctgcttcccagatgtaaattgctttttcctgagaatagattcagttgtggtttagcatggttgttgttgttgtctgtatatttatgatgattagcctcgtcgtggctgtcattcggttccatataatctgggtatttgggggagacataactcctccaggtgtagtttgtcctgaactagctgtatcagactcttgagaagagttgctattagccctccaaaaaaaaaaaaaaaaaaaaaaaaaaaaaaaaaaaaaaaaaaaaaaaaaaaaaaaaaaaaaa

SEQ ID NO: 6738 - DNA, 779 bp, Triticum aestivum
  Predicted polypeptide sequence is orthologous to G1364, G481, G482, G485
ggtcaaaagcatacatcagcagctgcattatcttcttcagtcaataccttacacgagcgaaagactgcggtttttcaaacctgttcatcatcttattacagtcactaacccctaaaagttgacgtggaaaaggcgtatctctgaatttaccataaggttagacagacccatacaacacacggactgaactagagagagggaaagaacagctaacatctacagaagacatagcatggtatttcaagtatcccgcatgcacagaactaagcagagtgctggggactttccccggccacaaaggcgcagtactgctaggatcacactgccaacgaattgtatgtgtatgtttgtcatacgccgatcagtatcatcctccaccctacatgccgttgaacgatgatccaggctgcccattcagtgcacccactttctttgcagcctgctcagatttcgaaccctttgacgtgtcaccctccatctcccggtagagcttgagatagagcttgaggggctcgacgtagtcctcgaagccgagcgtgcccatggaccagatcaggtcgtcgccgttgatggtcttgcgcttctccttcatgcacttgtcgctcgcctcgctggtgatgaagctgatgaactcggagacgcactcctggatggactccttagcgtccttggggatcttgccgttctccggcacgccgcgccgcatgatgcgcccgatgttggcgatcgggaggaaccggtcctggtccttcggcccggtgctcctccgggtgcccacc

SEQ ID NO: 6739 - DNA, 639 bp, Triticum aestivum
  Predicted polypeptide sequence is orthologous to G1364, G481, G482, G485
ccacgcgtccgcactgagtaagtgtgtaagtaagtgacagattgaacaatgggagggcgcggcaagaagcgtggtggtgcgaagggggccggccgtgagggcaacggggagaagccggcgtcggacgggagcagcgcggtgccgacggccaacgtcgtgcccgtgacaaggcgggtgcagccgtcgaacgtcaagatcgccgagtccgcgaagcagctcacccacgactgcgcggccgagttcgttttcagccgcagggcgcgccctcctgcgcggccggcgatgacggcggccgtgtcgcctggcgcaccagtgttcaccgacgaggagctggagttcctccagtcggtaattcctccgccgccgggcggatattagcggtgcggcgggcaagctggtcggccacaggcgcaggcgctaccacctgcggggcatggctataaatgttgtgttgttttgcttgaagaaaaatcccgatgtatccaataagacaataatacatacatcggtcccaaattacttgtcttaaatttttctagatacggatgtatcgaacattaaaacatgtctatatatatccgtatctagataaatgtaagacaactaatttaggacgaagtgagggagtactaatgacat

SEQ ID NO: 6740 - DNA, 1055 bp, Triticum aestivum
  misc_feature (747)..(747): n is a, c, g, or t
  misc_feature (966)..(966): n is a, c, g, or t
  Predicted polypeptide sequence is orthologous to G1364, G481, G482, G485
caacccagacgtgccgggactggagcacgaggacactgacatggactgaaggagtagaaatcttgtagctccaaacattttccaccttttcgtacaagtgtccttccttctagtgaagtagttcatgcttgatcaggctagagtggtttgatgtcaccacttgcttgtggatttgaggcagacagatcgaggaggagagccatgccggactcggacaacgaggactcgggcaacgcgggcggggagctgtcgtcgccgcgggagcaggaccgcttcctgcccatcgccaacgtcagccgcatcatgaagaaggcgctcccggccaacgccaagatcagcaaggacgccaaggagacggtgcaggagtgcgtctccgagttcatctccttcatcaccggtgaggcctccgacaagtgccagcgcgagaagcgcaagaccatcaacggggacgacctgctctgggccatgaccaccctcgggttcgaggactacgtcgacccgctcaagcactacctccacaagttccgtgagatcgagggcgagagggccgccgccacatcgacatcaaccacgcccgacatgccaagaaacaacaacaatgccaccggttacgccgacgccccgggaggcatgatgatgatggggcagcccgtgtacggctcgccgacgtcgccacaggagcagcagcagcaccaacatcagattgcaatgggagggagagcgggcttaccctatcacggacgcggnggtagcaggggcgggtcctcgtcatcgtcgaggttcggacggaaagaggggtgacatctcttctcttcttattgagctgaccaaagtgagtgattacaagatatgttcctctcttggatgaagcgtacatgacttgtagcttagggaaatccatcagtacaaggagaaatgattgtcttttcctccaaacaaaatatctatcccttaacccaagttcangaaaagggggcccgtcctaaatatccttgggggggcaaatccttggctttcccggttttttgaaaaagggggtccttaaagaagcgtat

SEQ ID NO: 6741 - DNA, 1100 bp, Triticum aestivum
  Predicted polypeptide sequence is orthologous to G1364, G481, G482, G485
gaacccacgtcggtccggcccattccccacccctcctcgcagcgccaaccaccgctcctcctaattcccccttccttctgggccctccgctcctccccgcgcgcgcgcgcgcgtttatataagggtttcggggccccggatggtttttaaagacagggggagcccccggggcggcggcggggtcagggagcaggaccgtttcccccccatcgccaacatcagccgcatcatgacccaggccgtgttggccaacggcaagatcgccaaggacgccaaggagaggggcggggagtgtttctccgagggcgtctcccccgccatcagcgaggcggggggggaagggccataacgataagcgcaagaccatcaacggggacgatctgcactgggccatggccacgctcggatacgaggagtacgtaaaccccctcaagatctacctgcaaaagtacagagatatggagggtgatagtaaattgacctcaaaatctggtgaaggatccgtgaagaaagatataataggcgctcatagtggtgcgactagctcaaacgcccaagcgacgggtcagcgatggaggtaacgcccaagggatgggtaataatgcaccccaggaccataatggggacacctgaaactgaacatcaggcaagctacgggaatgggtatagcgccaggaatggcgaactaccagtaagggaagccgccccaccattagggtccagaggaccatggactggaaacaggggggcgtgcatggctgcctccaagaggaaggtggtgccgagagaagagagtccgccatcatggccaggggagggcgggcaccggccacgcggagagatccacgcggcgggcaacaggggacccagggggggcagatagggggtataggaaaccaaagcacaatggctccgggggggggaccgtatcagggggggcgcggccccggggcccgccacgagggggcaagggccccgggcggcgcggaacagaaaaacacgaaaagaggggcggcggtgtcaaaggccgccccccgggcgcaaggctgaggcgggtacccggagctcccgcggagaggggcgcccagaatcaaacaccg

SEQ ID NO: 6742 - DNA, 910 bp, Triticum aestivum
  misc_feature (600)..(600): n is a, c, g, or t
  misc_feature (614)..(614): n is a, c, g, or t
  misc_feature (638)..(638): n is a, c, g, or t
  misc_feature (649)..(649): n is a, c, g, or t
  misc_feature (663)..(663): n is a, c, g, or t
  misc_feature (678)..(680): n is a, c, g, or t
  misc_feature (697)..(697): n is a, c, g, or t
  misc_feature (711)..(711): n is a, c, g, or t
  misc_feature (727)..(727): n is a, c, g, or t
  misc_feature (739)..(741): n is a, c, g, or t
  misc_feature (743)..(743): n is a, c, g, or t
  misc_feature (751)..(751): n is a, c, g, or t
  misc_feature (764)..(764): n is a, c, g, or t
  misc_feature (776)..(776): n is a, c, g, or t
  misc_feature (778)..(778): n is a, c, g, or t
  misc_feature (783)..(783): n is a, c, g, or t
  misc_feature (800)..(800): n is a, c, g, or t
  misc_feature (802)..(802): n is a, c, g, or t
  misc_feature (806)..(806): n is a, c, g, or t
  misc_feature (815)..(815): n is a, c, g, or t
  misc_feature (817)..(817): n is a, c, g, or t
  misc_feature (829)..(829): n is a, c, g, or t
  misc_feature (840)..(840): n is a, c, g, or t
  misc_feature (843)..(843): n is a, c, g, or t
  misc_feature (853)..(853): n is a, c, g, or t
  misc_feature (859)..(859): n is a, c, g, or t
  misc_feature (862)..(862): n is a, c, g, or t
  misc_feature (874)..(874): n is a, c, g, or t
  misc_feature (885)..(887): n is a, c, g, or t
  misc_feature (892)..(892): n is a, c, g, or t
  misc_feature (903)..(903): n is a, c, g, or t
  Predicted polypeptide sequence is orthologous to G137, G145
taacttggtcgaagcaacgaatcgagccagatttcatgccttcctagctcgccctagcagacacacatcgtgcgcagtggtgctgaatttgtcagctttcacgttgctggttgggagggtgagaggttcagggggaagagatcacaggtctcggagatgggtcgcggcaaggtagtgctgcagcggatcgagaacaagatcagccgccaggtgacgttcgccaagcgccgcaacggcctgctcaagaaggcttacgagctctccctcctctgcgacgccgaggtcgcgctcgtcctcttctcccacgccggccgcctctaccagttctcctcctcctccaacatgtttaagaccctcgagaggtaccagaggtacatttttgcttcccaagatgctgtcgcgccgaccagcgatgagatgcagaacaactatctggagtatatggagctgaaggcaagagttgaggttttgcaacactcacaaaggaatctcctaggtgaggatttggctccactgagcacaaccgagcttgaccagcttgagagtcaagtagggaagaccttgaggcaaataaggtcagaaagactcaagtactggtanatgaattgtgcganctgaagaaaggagcaaaattgttnaccaggatgcnaaacatggaacccntgaaaaagaaaaagnnntgggcgaagatccaaangtgggagggcgaancctggatccaccaagnaagagagcagcnnnangttggccnggcgcaccgcggngtgggcccacanantctcngtaaacattctttcatngncgcnaaaaagtgncnctctctcgaggncaaattctggncgnattaacaacncgcgtngtngttgatcacccncggtgggcagnnnccgcncacagaacacnggggaaa

SEQ ID NO: 6743 - DNA, 590 bp, Triticum aestivum
  misc_feature (19)..(19): n is a, c, g, or t
  misc_feature (26)..(26): n is a, c, g, or t
  Predicted polypeptide sequence is orthologous to G137, G145
ttcggcacgaggatcgagnaacaagnacaacccggcaggtgacattcaccaagtcgccggaacgggctgctcaagaaagcctacgagctctcgctgctctgcgacgccgaggtcgccctcgtcatcttctccggcggcggccgcctcttcgagttctctagctcctcatgcatgtacaaaatacttgagagataccgcacctgcaactacaactcaacagaagcaacccctccagcagaaaatgaaataaattaccaagaatatctgaagttgaagaccagacttgaatatcttcaaagttcacaaagaaatattctcggtgaggatctgggcccacttagcatgagggagcttgagcaaattgagaaccaaatagacatatctctcaagcatatcaggacaagaaagaataaagtattacttgatgagttatatgaccagaaaagtaaggagcaagagttgctggatcaaaacaaagacctgaggaggaagttgcaagacatcagctgtgccgagaatgcgctccatatgtcatggcaagatggagggcatgccatcgagactacttatccgggactgctgcaacgccc

SEQ ID NO: 6744 - DNA, 704 bp, Triticum aestivum
  misc_feature (7)..(7): n is a, c, g, or t
  Predicted polypeptide sequence is orthologous to G137, G145
tgcaggnaattcggcacgagggcaaggtggagctgaagcggatcgacaacaagatcagccggcaggtgacgttcgccaagcgccgcaacggcctgctcaagaaggcgtacgagctgtcgctgctctgcgacgctgaggtcgcgctcatcatcttctccgcccgcggccgcctcttcgagttctccacatcctcacgcatgtacaagactctagaacggtaccgcagctgtaacttcaactccgaggcaactgcaactccggagaccgaactaagcaactaccaggagtatttaaagctaaagacaagagttgagttcctacagacaactcagagaaatcttcttggcgaggacttgggcccacttaacatgaaggaacttgagcaactggagaaccaaattgagatctctctcaaacatatcagggcgacaaagagccagcagtcacttgatcagctctttgagctcaagcgcaaggaaaaacaactgcaagatgttaataaagacttacgaaaaaagatacaagaaactggtgcggatagtgttctacagatgttttgccaggatgttggaccaagtgggtctagtggccatgctaatcaagctaatcaacaggagtattttcatcctgattgtgacccttccctgcgtatggggtatgatcatgcttacctggatcacttgaacaaggaatgaatagatgga

SEQ ID NO: 6745 - DNA, 646 bp, Triticum aestivum
  Predicted polypeptide sequence is orthologous to G137, G145
tttttttttttttttttttgtatgcgtatgccacgtttgtattggacgtatcaatcctgtttctatacggtcacatttaatacaagctgaaacacgtcgctgtcccgttggtatgcctaccaggagcaggcgagctcgtccataccatcgccgctctcgtacaacacccaggaacataaaactagctacaaagatgaagcgttcccttcttttaacttcaacctagagctctcttcttcaaaggcacttattcgcttcacacatcatttgttccttcctttggaggtcagtgagctggtcaagcatacgctatgtctgcaagatttaatttcatcagcattcttttgtgtaacaaaatatgctagctagcataaactgagaaacaatatccaagttgcagcgccaaattatttcaggttttataaaacatatgaatgttgcagtgcattacagaataaaaaatttctgaatgtatcgttgttccattcctagaaaaatgatgatgaatcaaagagatccagctgaaaactgagtgtagttgaatgaacaggaactatacaaagctgctcactaatcagagattatttttttctgaaacaggatttttgtaaacatagactagcttgagatgtgctttgtcatttga

SEQ ID NO: 6746 - DNA, 786 bp, Triticum aestivum
  Predicted polypeptide sequence is orthologous to G137, G145
gcagttatgcaggacctgaaactactgtgcagaacagagaaaatgagcaactgaaaaacagtcgcaatgagtacctgaaactaaaggcacgggttgataatttacagcgaacacaaaggaatttgcttggtgaagatcttgattcattaggcataaaagagctcgagagccttgagaagcaacttgattcgtccttgaagcacattcgaacaacaaggacacaacatatggttgaccaattgacagaactccagagaagggaacaaatgttttcggaggcgaataaatgtcttcgtataaaattggaggagagcaaccaagttcatgggcagcagctctgggagcacaacaacaatgtactgagctatgaacgtcagccggaagtgcagccgccgatgcacggcggcaatggattcttccacccccttgatgctgctggtgaacccacacttcacatagggtaccctcccgagtccctgagtaactcatgcatgactactttcatgcccccgtggttgccttgagtgaagatggcgaagaaagtgtgaaaaataagtatatacgtggcacccggctggccgcatatatacatgtatactacttcgagtgatggattattccagtcaagatcctcagttattttgcgtgcaacttttgtgtgatgaaaacttcgctgtattgatgctcaacattattatgttactgcgtgtaaaagatcatacactgtattactagagtgactatgtgatgattttccccccttacctctattggaaatattggcat

SEQ ID NO: 6747 - DNA, 961 bp, Triticum aestivum
  Predicted polypeptide sequence is orthologous to G137, G145
atggggagagggagggtggagctcaagcggatcgagaacaagatcaaccgccaggtcaccttcgccaagcgccgcaacggcctgctcaagaaggcctacgagctctccgtcctctgcgatgccgaggtcgcgctcatcatcttctccaaccgcggcaagctctacgagttctgcagcggccagagcatgcccaaaacacttgagagataccagaaatgcagttatggtgggccagatacagcaatacaaaataaggagaatgagttagtgcagagcagtcgaaacgagtacctcaaactgaaagcacgagtcgagaatttgcagagaacccaacgaaatttgcttggtgaagatctcgggtcacttggcatcaaagatctggagcagctcgagaaacaacttgattcatccttaaggcacataagatccacaaggacacagcatatgcttgaccagctcactgatctgcaaaggaaggaacaaatgctgtgtgaagcgaataagtgccttcgaagaaaactggaggagagcagccagcagatgcagggccaaatgtgggagcagcacgccgccaacttgctcggctacgaccagctgcggcagtccccgcatcagcagcaggcgccacaccacggcggcaacggcttcttccaccccctggaccctaccactgagcctacacttcagatagggtatactcaggagcagataaacaacgcatgcgtggcggcgtcgttcatgccgacatggctgccctgaagatccacgatccaaccagctaataaatgtgcgacggtgcttgctcagccgtcgcatgcattctaccctacgtacgtacgtatattccggggccgggagcgactactatcgcgttcgcgtacgtcccatagttctgtgtctctgttgcgtccttgtgtgaaaaacttttgtgatcgataatgatcgacgtgtatgtcaagac

SEQ ID NO: 6748 - DNA, 750 bp, Triticum aestivum
  Predicted polypeptide sequence is orthologous to G137, G145
cggcacgaggcgcagctgcaacttcaactccgaggcaactgcagctccggagattgaactaagcaattaccaggagtatttaaagctgaagacaagagttgagttcctacagacaactcagagaaatcttcttggcgaggacttgggcccacttaacatgaaggaacttgaacagcttgagaaccaaattgagatatctctcaaacatatcagggcgacaaagagccagcagtcacttgatcagctctttgatctcaagcgcaaggaacaacaactgcaagatgttaataaagacttacggaagaagatacaagaaactactgcgcaaaatgtgctgcaaatgtcttgccaggatgttggacctagtgggtctagtggccatgctaatcaagctaatcaacaggagcattttcatcctgcttgtgacccttccctgcgtatagggtatcaacgaaatttcctggatcaattgaacaaagaatgaatggttgtattagctgagcctgagcgcagatgtcctatgttgggtctatgtgatataaatttaatgcaatgctttcttttatccatgggttctagcttaaaacaacctattatgtactattcaatcatattgtgtgctattttaaacttgagaggagaattatctgaatgttggatgctgaattgaccacacaatctctcagtttgaactgagggtactgaaaataagtgcaccgtgtcagtgcatagctacaaaaaaaaaaaaaa

SEQ ID NO: 6749 - DNA, 777 bp, Triticum aestivum
  Predicted polypeptide sequence is orthologous to G137, G145
cggcacgagggaaagagaggaggaggaggagatgggtcgggggaaggtggagatgaggcggatcgagaacaagataagccggcaggtgacgttcgccaagcgccggaatgggctgctcaagaaggcctacgagctctcgctgctctgcgacgccgaggtcgccctcatcatcttctccggccgcggccgcctcttcgagttctcaagctcctcatgcatgtacagaacacttgagagataccgtacctgcaactccaactcacaggaagcaacacctccgctagaaaatgaaattaattaccaggaatatttgaagctcaagaccagagttgaatttcttcaaagttcacaaagaaatattctcggtgaggatctgggcccacttagcatgaaggagcttgaccagatagagaaccaaatagatgcatccctcaagcatatcaggtcaaaaaagaatcaagtattactcgatcagctatttgaactgaaaagtaaggagcaagaattgcaggatgaaaacaatgacttgaggaagaagttgcaagataccaccagttgctgcggagacaatgcggtccatatgtcctggcaagacggagggcagtgtagctccagagtactacacccggagcatgatacctccatgcaaattgggtatcctcaggcctacatggaccagctgaacaaacagagatcacgtggcttctgagcgccctggtggaggatcgtctgcaggttggatatgattaactgatgtggcgctgcgtcatgtgtact

SEQ ID NO: 6750 - DNA, 757 bp, Triticum aestivum
  misc_feature (635)..(635): n is a, c, g, or t
  Predicted polypeptide sequence is orthologous to G138
ttttttttttttttttggctacaatttcgcaggtaccacattgcacctgtgtcttgctttgtcaggatttggataacgtgcgtttgtgggacaagcagttaaccgatcaaacttgacagttatatgtatgaatgtgtgaacaacaacaaatcaaacctatgatcatctatcgaacatttgcaggtttggggctgcaaatttaatgcagctccttctccagtgtaaattaagagctcactcctgatcttggctctgaaatcgagcaactcttcctcttcttctcgctttgggggagcacactagccaccttcatcatcagtttgttcttaacaactgtcaaagcattagtcatcgcttcctccaaacctcttagctcagcgatgttcagctcgttgacatttgattccaacacacattgagtaatgtggtttatcttaggcaccgggtcatctgaacgctctttctgacgaagctgtatattgcaatcaacccgagattcccttgcttcaatattgagatcaattgttgtgtccagaaggtcccaataccgaccaaaaattgtatcaatgctggaggtggaagaggcgaactcgtagaggcggccggcgggggagaagactaggagggcgacctgngcgtcgcagagcacggacagctcgtacgccttcttgaacagcccgctccgccgcttcgagaatcgcacctgccggctcgtccggtcctctatccgccgcagctccagcttccccctcttcct

SEQ ID NO: 6751 - DNA, 695 bp, Triticum aestivum
  Predicted polypeptide sequence is orthologous to G138
agtagggaagaccttgaggcaaataaggtcaagaaagactcaagtactgctagatgaattgtgcgacctgaagagaaaggagcaaatgttacaggatgcaaacatgaccctgaaaagaaagctgggcgagatccaggtggaggcgacgcctgatccacagcagcagcagcagcagatgtggcagggtgaccggggcgtgccgccccacacgcctccgcagccagagcacttcttccaggccctagaatgctatccttctctgcagccagtatttcgtggcacggatgtgaaccagccgccgcctgcatggatggcatagctacgcacccgcattggtctgtctaccgttccagtcgatcaacaagatgcaccgcttggcatgagcgattatccatctcaaaaacaatcaacaagaaatgcgttgcctgccaatgtgtcctgcatctccaataggctcctatatatatcaactcggctgcttttgtgtttccttttcaagtgcttgccggacttctttacgtaatatgtacagggcttgtcttattgttattagcaagtgttatattgctcattttgcttagagaaggcgagaacggttttccttttgggatttgatttacagtagcgtaataaaccttcctttcccgatacatgtatggcaggctcacgctctctcaacatcttctctcgtaaac

SEQ ID NO: 6752 - DNA, 371 bp, Triticum aestivum
  Predicted polypeptide sequence is orthologous to G1382
tggacgcctgcggtaccggtccggaatttccgggtcgacccacgcgtccgggggcaggccggcctcaacgggctcgccgtcggcggcggcgggagcgcgttcgcgtccaacacctccgtgccgatgcccatggcctaccacggagccggcgggtactactactagctcctcctcctcctcctcctcgagccgagcagcctctgctcgttcctgattgatcgttgagcttttatctgtgaataataatactctgatcgtgatttgccaccagaaaaactgtaatccgaattgatttgatcctgctcggacgctgaggtaaccatggcgattgagaatttgagattaatggtaaaaaaaaaaaaaaaaaaaaa

SEQ ID NO: 6753 - DNA, 2158 bp, Triticum aestivum
  Predicted polypeptide sequence is orthologous to G1382
gcacgagccgcaccgcgccgatggccgattcgccaaaccctagctccggggacctcccctcagccgccgggagctcgcccgagaagccgtaccccgcggatcgacgcgtcgcggcgctcgccggcgcgggcgcgaggtacaaggccatgtccccggcgcggctgccgatctcgcgcgagccctgcctcaccatccccgccggcttcagcccctccgccctcctcgactcccccgtgctcctcaccaacttcaaggttgaaccttcaccaacaactggtagtctgagcatggctgcaattatgcacaagagtgctcatccagacatactgccttcgccacgggataagtctattcgagcccatgaagatgggggttctagggattttgaattcaagcctcatctgaattcgtcttctcaatcactggctcctgctatgagtgatctaaaaaaacacgagcattctatgcaaaatcagagtatgaatcccagctcatcatctagcaatatggtgaatgaaaacagacctccctgttcacgcgagtcaagtcttacagtgaatgtaagtgctccgaaccaacctgttggaatggttggtttgactgacaacatgcctgctgaagttggtacatctgagccgcagcagatgaatagttctgacaatgccatgcaagagccgcagtctgaaaatgttgctgacaagtcagcagatgatggctacaactggcgcaaatatgggcagaagcatgtcaagggaagtgaaaaccctagaagttattacaagtgcacacatcctaattgtgaagtaaaaaagctattggagcgtgcggttgatggtctgatcacggaagttgtctataaggggcgccataatcatcctaagccccagcctaataggaggttagctggtggtgcagttccttcgaaccagggtgaagaacgatatgatggtgcggcagctgctgatgataaatcttccaatgctcttagcaaccttgctaatccggtaaattcgcctggcatggttgagcctgttccagtttcagttagtgatgatgacatagatgctggaggtggaagaccctaccctggggatgatgctacagaggaggatttagagtcgaaacgcaggaaaatggagtctgcaggtattgatgctgctctgatgggtaaacctaaccgtgagccccgtgttgtcgttcagactgtaagtgaggttgacatcttggatgatgggtatcgttggcggaaatatggacagaaagttgtcaaaggaaaccccaatccacggagttactacaaatgcacaagcacaggatgccctgtgaggaagcatgttgagagagcatcgcacgatcctaaatcagtgataacaacgtatgaaggaaaacataaccatgaagtccctgctgcgaggaatgcaacccatgagatgtccgcgcctcccatgaagaatgtcgtgcatcagattaacagcagtatgcccagcagcattggcggcatgatgagagcatgtgaagccaggaacttcagcaaccaatattctcaagccgctgaaaccgacaatgtcagtcttgaccttggtgttgggatcagcccgaaccacagcgatgccacaaaccaaatgcagtcttcaggtcctgatcagatgcagtaccagatgcaatccatggcttcgatgtacggcaacatgagacatccatcatcaatggcagtgccaacggtacaaggaaactctgctggccgcatgtatggttccagagaagagaaaggtaacgaagggtttactttcagagccacaccgatggaccattcagctaacctatgctatagcggtgctgggaacttggtcatgggtccatgagaggaatgatgagagtgtcagcaaatgcttatagctccatgaatcatatattacaaacaatgcttttgtaacgacaatctcttcagcaagattcttaattgtgtatcggttacaagtcagttcagccagaggcaagtaagctataagctatacctggaggactgcagcaaatgcgcatgtgtctttttaggcgcggaaaaggcccctgctgtatgtagcgctgcagacctacattcgttgtacagcgaacctaatatgattaattaattagattatgagaatttggtttaaaaaaa

SEQ ID NO: 6754 - DNA, 1225 bp, Triticum aestivum
  Predicted polypeptide sequence is orthologous to G140, G146
ccgctcctagcctcctaccgttctcctttaaacacactcttctccctcatttgccttcctcatctctcactctatccatcccatctctctccgcccacgaaacacaaacatgcagatactcaacgagcagctggctgcaccatccacaggcctaatggtgaaggagtctgcgtccccggggtcggggtcgggatcggcagggggggctgctgagaagatggggagagggaggatcgagatcaagcgcatcgagaacaccacgaaccggcaggtcaccttctgcaagcgccgcaacggcctcctgaagaaggcgtacgagctctcggtgctctgcgacgccgaggtggcgctcatcgtcttctccggccgcgggcgcctctacgagtactccaacaacagcgtgaaagcaaccattgagagatacaagaaggcaacaagtgacacctccagcgctggtacagtcgcagagatcaatgcccagcactaccagcaggaatctgcgaagctgaagcagcagataaccaccttgcagaactccaacaggactctaataggcgatacaatggccaccatgagccacagagacctgaagcagctggagggaaggctggacaaaggcctaggaaagattagagcaagaaagaacgaattactatgcgctgaaattgagtacatgcagagaagggaaatggagctgcagaataacaacttcttcttgagggaaaaagtagctgagactgaaagggggcaacagcagacgttgaacatgatgggggcggcttcgacatcgaatgagtacgagcaaaatatgatccattgtgatccgagaaccttcctgcagttcaacttcatgcagcagcaccctcagtactgctcccagcaggaggaccgaaaaagtttcaactcagttggaaggtgatggatgcatccatgcatagctgtgtcgtctctcatttaccttcaagtgagattgaagctacatatatccgtgatatataactagaacttgcatgaatgtgtgtatttctatacgcgcacaatcgactttatcctataattaaggcttggccacaccagtgcaatgtatccatatgtattgtgatggtactacttaattttctcagtgcaactcaggtactccttcgcatatatctatatatgtaccttttctaaatgcaatagtactgttggcgatttcatataaaaaaaaaaaaaaaaaaaaaaa

SEQ ID NO: 6755 - DNA, 1053 bp, Triticum aestivum
  misc_feature (802)..(802): n is a, c, g, or t
  misc_feature (902)..(902): n is a, c, g, or t
  Predicted polypeptide sequence is orthologous to G1419, G43
ggtcccggattcctcgggattcgtcgacccacgcgtccgctcacaaacaaactcgcagatatctgccactgccatcgagtagttctctaccgtgaggccgtgccatccctctgtgccggcatggatttcgccggagaagttgacgacttcgctctcgacctcatccgcgagcacctcctcggcggcgacggcggtgtcctgccgacggcgaaccatgatccggcgggccccttttgcgacgacgtcaccttccccgtgctgccaccttccgcggcggaaccacaagcgtaccagcagcagcccatgttcttcccgcagcaggagcagcagcagaatcagcagatgcaagcttacatggacctggcacaccagtacctgaactcctgcccgtctgccgacgtccctgaggctgtgatcagggcgccggagccggtgatgatacagttcggcggccagccgtctcctgtggctgcaccgtcgtccacgctgaccatctccgtgccggccaagggctcgttcgggtgggcggcgactgctgccgccccggcaccgccggcgccagcaccgctggaggacttgcgcaagtaccgcggcgtgcggcagcggccctggggcaagtacgcggcggagatccgcgatccgaagcgccggggctcccgggtgtggctgggcacctacgacacgtccgtggaggccgcacgcgcctacgaacgcgccgccttccggatgcgcggcgccaaggcgattctaaacttcccaaacgaggtcggcacccgcggcgccgagctgtgggcgcctccgnctcccgctaccgcgtcccagaccgccggcgcgacgaacaaacgcaagcgatcacacgaggaggaccgcgacgtcgaggtgaccggagtggtcataaacanggcccccaagaacgaggcgccgtcgccgtcgtccgcccaggtgtctggggacagccctcgtccgtgtcgcggggagacggcctcctcgaaggtgacgttgggggccaggcggccggaaggaggggtttctccggagccgtcaagctcggga

SEQ ID NO: 6756 - DNA, 868 bp, Triticum aestivum
  misc_feature (5)..(5): n is a, c, g, or t
  misc_feature (30)..(30): n is a, c, g, or t
  misc_feature (663)..(663): n is a, c, g, or t
  misc_feature (671)..(671): n is a, c, g, or t
  misc_feature (685)..(685): n is a, c, g, or t
  misc_feature (693)..(693): n is a, c, g, or t
  misc_feature (737)..(737): n is a, c, g, or t
  misc_feature (749)..(749): n is a, c, g, or t
  misc_feature (769)..(769): n is a, c, g, or t
  misc_feature (783)..(783): n is a, c, g, or t
  Predicted polypeptide sequence is orthologous to G1435
cacangctatttcgatataggcctatccangtgactatgtagaacaagtttgtacaaaaaagcaggctggtaccggtccggaattcccgggatatcgtcgacccacgcgtccgatcccatgttatcccctcgcgtcgtccggccccagcctcacgacggcacggcctccgccggctcatcctcgtcgcggcgccacatggtggaccgcgtgtccgagtgggagctcggcctcccctcggccgccgagctgacgcccgtctcgcagccgctcatcccgccggcgctcgccgcggccttcgggatcggccccgcggacgcgctctcctcccccgtcgacaccggcttcctccacgactcgcccacctcccatctcacatccaggttcgacgagtacgacgaggaggacgaggaggagggggagggcgagaccgacgacgccgccgccggggcgcggaggggcggcggcggcgggaagaaggcgaggatggtgtggacgccggagctgcaccaccggttcgtcgaggccgtggagcacctcggcgagaagggcgccgtgcccaaggccatcgtgcgcctcatgaacgtcgacggcctcacgcgggagaactcgccagccactccagaagtacgactctatctaactcgaggcgctccagccccggngctggcgngccctcgccaccgncaccgccnttcttttcccgcttcgacgtccaacgaccgcatcaagactccgncaccggagcggntactgcgcgtacccgtatgnttctaccagaagcntcgatgcgataagcgcatagtcacatgttgtcgcgttccgactgatcgtgattgtctaaacatgcaccacggtagtcatgtcctt

SEQ ID NO: 6757 - DNA, 533 bp, Triticum aestivum
  Predicted polypeptide sequence is orthologous to G1451
agccaaggtgtcactttgggagattgaacccctgacaactttcccgatgtaccctactccttttccactcagactgaagcgaccatggccaacaggcttgccttctctgcatggtggtaaggatgatgacttgacttcctcgctcatgtggcttcgagatagtgcaagccctggtttccagtcgctgaatttcggtggtgctggtatgaatccctggatgcagccaaggctggatgcatcgttacttggtctacagcctgacatttaccaaacgatggctgcggctgcgttccaggacccaacaaagatgtcacccacgatgttgcagttccagcagccacaaaacatggttggtagagctacgccgcttctgcaaagtcagattttacagcaaatgcaacctcagtttcagcagcagtcataccttcaaaacatcaatggggccacgatccagggccaggctcagtctgagttccttcaacagcagctccaacggtgccagtccttcaatgagcagaagccacagcttctcc

SEQ ID NO: 6758 - DNA, 684 bp, Triticum aestivum
  misc_feature (26)..(26): n is a, c, g, or t
  Predicted polypeptide sequence is orthologous to G1451
aatctttgactccaacacggcggatnacccacacttaattcacagcgaaaagtctaggctccagccgggataatcagttttaggtccccagtcggaatactcggttttaggtcattcatattgctacataataaggtggtcacttccacggtaccatactgcctcacattcataagagcggttcttgtctgccattccgagactaggctatcatagagccgaagcagcgatcacacaacatatccatgatcggaatgatgttggtagatcgtctaactatattattgactaaagttcatggcgaggagagggctagctaggttggtgaaccgaacacgtcgcaataccgtgatgatgatgcgatcctggagtgctggtttagttctggactccgatctccgtttcagtagtccagtggcggtacggaggccatgttgccggtgagattctgcaggtcgtggcccccagaataaccgtcgcagacattgccctgcgccatcctcgctccaggtgcagaagacagaaggccctcgccgccgccgcggaccatctgctgcacctcctgctgcgagagtatcttgatgcaccctacgctattcacaaactcctgccatgggtcgtcgccgacgagaagaatatcattttctcggtcgacgaatacaagctgccagcctgatcttacgg

SEQ ID NO: 6759 - DNA, 702 bp, Triticum aestivum
  Predicted polypeptide sequence is orthologous to G1451
ttttttttttttttttttgatgactagagagcctacattcacaggattagtatgtaggagtattccacagaagagagttttggcaggcttaccaaaaggggggggtttacggatcacggtacaggttcctactacttcttaacatgagatcacatggcatgattattagacggtagtacatgacttaaaagagctagtaggaatggtctgtgtgcttgctttccagttccgggtctcgaaaactagggagagagaaaaaaaggctgcagaaacatacgcggcgagctagcttaagccgaggccttcgcctcagaacgccctctcttcagaactctacttcgaccgagccgaccgacgcgatcccggtgctcaggctcctcgactcctgcctgctcgcgtagtcgtcgcagctgctaccgccgccgccgccgcctagcctcttcccgggggccgagctcaggagctccaggccctgcttgcccatctgctgcacctcctgcggggacaggatctttatgcaggacacgctgttcacgaattcctgccaagggtcgtcaccgaccagaaggacgtcctcctcccggtcgacgaatacaagctgccagcctgatctcatagggtcttccaactggccctcaaggccgaataggcgcccagttccctacgtagttcatggtagttgctaaacttggtgatatcaag

SEQ ID NO: 6760 - DNA, 671 bp, Triticum aestivum
  Predicted polypeptide sequence is orthologous to G1451
tttttttttttttttttttttggacggggtacaactgagtaaattacatcccgagtacaagatatgcaggcacatgtgccgggcacatgttgtataataccagatgatggaatgaacggatgtgggtgatggtcgtgtataataccaagataaggaagtggcgtctgcctcacgccatccctctcgacatccacaaaaaaccgtccatttcttagggagaggcatatatataccatgtcgccaggccgcactacatacgcatcaataaacatacgccagccaacagcgtgaatcctggtcttcttagctccatgatcaagcttgacttcgtactccagtagttctctggttacaaagattgtcttacacatgggcttattctctctggcggcaatggactgcagatgctcaatacatgcaccaaacactcgcctgttgcagcatgggataatcttttcttccagccaggcacgactataacgcttccagaatcatcggcaggtacatctgggttgacatctgggccgtaggcacaggtatttgcgcccctcaatgtggccggaggcgttactagtcccatatgttcattggattgtgtcgtctcgcctgggacatgtacaaattcctgtatgcttggctgccgcgataaatcggccgccgcccccctccgt

SEQ ID NO: 6761 - DNA, 724 bp, Triticum aestivum
  misc_feature (651)..(651): n is a, c, g, or t
  Predicted polypeptide sequence is orthologous to G1451
gcacgagggggaatacgtcgagcaaatagatcgcaaacggttatgccatcatcagtattgtctagtgacagcatgcatattggtcttcttgctgcagctgctcatgctgcatcaacaaatagccggttcactattttctataatccaagagcaagcccttcagagtttgtcataccgttggctaagtatgtaaaggctgtgtaccatacccgtatatctgtgggcatgcgtttccggatgcttttcgagacagaagaatccagtgtcaggcgatacatgggaacaattacaggaataagtgaccttgatcctgctcgttggccgaactcacactggcgttctgttaaggttggatgggatgagtcaactgctggagagaggcaaccaagggtgtctctctgggagattgagcctctgacgacttacccaatgtattcatctcctttccctatgcgactgaagcggccttggccaacaggattgccctccttatatggtggaaaggaggatgacttgacctcttctctcatgtggcttcgagatggagcaaacccaggtttccagtcattcaattttggtggacttggtatgagtccttggatgcagccaaggatggatagttccctacttggtctgcaacctgacatgtanccaagcatgtcagcagcagcttttcagaacacgacgaagcaagtatcgcctacactgctgcagttccagcagc

SEQ ID NO: 6762 - DNA, 1034 bp, Triticum aestivum
  misc_feature (613)..(613): n is a, c, g, or t
  Predicted polypeptide sequence is orthologous to G1451
tgcgacccacgcgtcccgatattcacgacgtggagtggaagttcaggcacatcttcccaggccagacctaacgacacttgctagctactggctggagtgtgttcgttagcgccaaaagacgagttgctggagactcggtgctcttcatatggaacgagaaaaaccagctttggctaggaatcaggcgtgccaaccggacacagactgtgatgccttcctctgttctttcgagtgacagcatgcacatagggctccttgcagctgcggctcatgctgcttctacaaacagccgcttcacaattttctacaatccgagggcatgtccatcagaatttgtcataccactctcaaagtacatcaaggctgtttttcacacccggatatcggtcggcatgcggttcaggatgctctttgagaccgaggaatctagtgttcgcaggtacatggggacaataacagaagtaagtgatgctgatccagtgcgttgggctagttcctactggagatcggttaaggttggttgggatgaatcaactgctggggaaagaccgcctagagtttctttatgggagattgaaccattgacaaccttccctatgtatccgtcattgtntccgctgagggttaagcatccctggtattctggtgtagcaggccttcaagatgacagcaatgctttgatgtggctgagaggagttgctggagatggaggttatcagtctatgaactttcagtcacctggtattggctcctggggacaacagaggctccatccttctttgatgagtacggagcatgatcagtacccagcagtagttgctgctgctgccgccggcttccagtctggtgggtatatgaaacaacaatccctaaaccttcagcagcctatgcagccgcctcaagaacactgcaactccaaccggtgttgcagcaacagattttggagcaagcaagccaacagcaacttgtagggctgatatccagaatattcgaccatggttgaaccaggtgcaatcagcaccaatttcaaaggt

SEQ ID NO: 6763 - DNA, 1127 bp, Triticum aestivum
  misc_feature (17)..(17): n is a, c, g, or t
  Predicted polypeptide sequence is orthologous to G1451
ggtttgcgtggttacgncgacccacgcgtccgcttgaggcgactgcataggctgctgaaggtttaggacttgttgtttcaagaacactgcaacctcaacccgctcttgcagcaacagatcttgcagcaagcaagccaacaacaaaccgttagtgctgatagtcagaatattcaggcaatgctgaactcaagtgctatgcagcaccaacttcaacagctccagcaactgcagcaggtgcaccaggtgcagcaggcgcagcaggctcacattgatcagaagcagaagattcaatcagatcaaacatatcatgttcctactagtgcgtctctcccaagtccaacatcactaccaagccatctgcgtgaaaaatttggcttctctgatcctaatgctaattcgtcaagcttcaccacttctagcagcagcgacaacatgctggaatcgaacttccttcaggggaattcgaaagctgtagacttgtctagattcaatcagccagtagctagcgatcagcagcagcagcagcaacaacagcaacagcaggcttggaagcaaaagtttatgggttcacaatcactgtcttttgggggctcgggtttgcttagctcacccacaagtaaagacggttctcttgagagcaaaattggttctgatgtgcaaaatcagtccctttttagtcctcaagttgattcttcctccctactgtacaacatggtgcctaacatgacttcaaatgttgcggataacaacatgtctacgattccttctggatcaacatatcctgcaagtcccatgtatggttgtttggacgactcttctggtatatttcagaatacaggagagaatgacccaaacagcagaccattcgtgaagggttataagtcaggatcagtggggaggtccctggacatcacccggttctccaattatgctgaacttcgggaagaactgggtcagatgtccggcattgggggtcagttggaattactccgaatagaataaggttggcaccttgtaattcgtcgaaaggggaaaatgatgtgcttcccccttggagacgacccctggggagtcatttggccaaaagggttatgggacatcaaggaactttcaccgagaggagtgta

SEQ ID NO: 6764 - DNA, 1016 bp, Triticum aestivum
  misc_feature (937)..(937): n is a, c, g, or t
  Predicted polypeptide sequence is orthologous to G1471
ctacgacccacgctaccgccaaatcagacgcggagaggtcaatattgggcgtgcctcttgtactgaaagtaactggttggacggtgcttgtctaatggttgtgcttatgagctggtacgtgaaagttcttctgaaaggcagttgatgcaaatgggctgacacgatcctgagtttgaactagatcttccaagcacaaggatcctttctaggcgaagtcatacatgaaacaggtggtccttgaagtatattgatacatatggtttgggtgcgatggaagctggcttgagaagagagacaccatttagcgtctgttctatttcgccattgtagctgtgtaaatgttttcttgccttggggaatcgagagactcctttgtacatgatttgtaacttgccgctggtaggtcttgtggtgcatagaaagctcatgttttggtgtggggtttgttgaaccaaaaacttgaaagcaaatgtgacaatcatctatagttcaactgacaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaagggtaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctggtcatgatcatantcagccataccacatttgtagagggtttacttgctttaaaaaaacctccacacctcccccttgaacctgaaacataaaa

SEQ ID NO: 6765 - DNA, 1176 bp, Triticum aestivum
  Predicted polypeptide sequence is orthologous to G148
ggcacgagatcccaagccctatgcgctagtaggttgcgcatcagaaccgccgcaggaggaagagcgcagagctagcttgctgatcggtagagctttgcttgcttgcttgcttggaaggaggaggaggaggagatcatggggaggggaagggttgagctgaagcgtatcgagaacaagatcaaccggcaggtcaccttctccaagcgccgcaacggcctgctcaagaaggcctacgagctctccgtgctctgcgacgccgaggtggcgctcatcatcttctccagccgcggcaagctctacgagttcggcagcgccggcacaacaaaaacattggaaagataccaacactgctgctataatgctcaagattccaatggcgcactatctgaaactcagagctggtaccaggaaatgtcaaagctaaaggcaaaattcgaagcgttgcagcgaactcagagacacttgcttggggaggaccttggaccgctcagcgtgaaagaactgcagcagctggagaaacagctagaatgttctctgtcactggccagacagcgaaagacacaacttatgatggagcaggtggaggaacttcgcaggaaggagcgtcagctgggagacatcaacaggcaactcaagcacaagctcgatgctgaaggcagcaacagcaacaactacagggccatgcagcagatctcctgggctgccggcaccgtcgtggacgagggcgccgccgcatatcacatgcagcagcagcagcaacaccctaatcattccgctgctatggactgtgaacccactctgcaaattgggtaccatcatcagttcgcggctcctgatcaggcagccaataatattccacggagcagcgcccccggaggggagaacaacttcatgctggggtgggttctctgagcgagcgagctgctagcgcagctggttagcttgtctgtccatcagccaagaaaccaaataaaatgcgtgtgctgctccttcatgctctacacgagaagtatcctgcgtcgcgcgtgcctctttctttatttttactcgttgtttgtgtgtgtaagaagtaagaaccaagaaccacttctatattttgagtattttaactgcatggatcttgtaaaacacttgcaagttccaagctgtccatgcatgcatgccaagttatccagt

SEQ ID NO: 6766 - DNA, 701 bp, Triticum aestivum
  Predicted polypeptide sequence is orthologous to G1480
gccacagcactgtctcctcggtggatgttgggtcggtgccggagcggagcgacagccccatcgcggcggcgacgccggcgacgggggaggggagggaggcgcgtctgatgcggtaccgcgagaagcgcaagaaccggcggttcgagaagaccatccggtacgcgtcccggaaggcctacgccgagagccggccgcgcgtcaagggccgcttcgccaagcgcgccgacgacgccgacgcggactccaacgccgtcgcggtgggcacgatcaccacgccccggccatgcgtgctcgacttcggcagctacggcgtcgtgcccaccttctgaggcggcgcctaatttcgtgtccatttcctctggcgagcgtgccggctgggtgcctaattaaatccggcacggcatggccggcacgcacgagcgcgccgacgtgcatgcgtcgcacgtcgtgttccctcttgtatgattgcatgtaatgtttctcgagctggctgatcgctggctcgagtgtagtatactactctactcgacagacacgcacgcacgcacgcatgttttgctagaactagaataatacagatagttctagttgactagtctactacctgtacccttttctgggctagcttgatggcaaattaggctagggcaatgtaacgtgttttgctggaacagcttaattctagtttcggatcccaggat

SEQ ID NO: 6767 - DNA, 601 bp, Triticum aestivum
  Predicted polypeptide sequence is orthologous to G1480
cgcgtctcggcgtacgcctgcgggacgcgtagcggatggtcttctgaaaccgccggttcttgcgcttctcccggtaccgcatcagccgggcctgccgctccttccccttgctcgccaccaccgccaccgacggcgccggcgccagggccccgccgactgacagcgcgtccggcaccactgcgacctcagacgttgacatgctctggttcatggagtgttcggggtagaagagagcgccgccggcgaggtcgagctcggaaggggcgacgggcaccccgatggccttgatcccgtccatggaccggacgaagtccagatcgaggtacgcgtccgaatcggcgaagaacgtggcggcgctgtcctcggggctgtcgccaggctcgggaagaagccacgaggccgcctcggcctcgttgctcccgtcgtcgtctgcgtcctcctgcatcgcggcggcggaggacggggaggggttgggctggggcggatcggcgagcgcgccgaagaaaggcgtgaccgggagccgatcgtgccggctggcgagcgggttggcggagtggatgtcgggagtcgcacgttgcgcaggagcgggaggtgtcggacg

SEQ ID NO: 6768 - DNA, 1061 bp, Triticum aestivum
  misc_feature (34)..(34): n is a, c, g, or t
  misc_feature (300)..(300): n is a, c, g, or t
  Predicted polypeptide sequence is orthologous to G1480
gtcacccagaccggtcgccctttttttttttttntagatgataataatgattgccgatccaaatttgtttgggctacgggtggcggccatccaaaaataaacgagcatattggccaaagtactactactgttacagtttacagtattactagtacatcactagcgcgatcgaactagctcaggaggagtacatggatggattgctagtcccctactactgtacatgcatcaatggtacaagtacaagcggccggccggggcgccgggccggcgggtcggaaggacgggacgactccgtanccaaagtcgagcaagtaggaggtggaagacggcacggcatgggcctccgcgtccaagtcctcgccgtcggcgtcctggtcggtgcgcttggcgaagcggcccttgacgcgcggccgcgactcggcgtaggccttcctggacgcgtaccggatggtcttctcgaaccggcggttcttcctcttctcccggtaccgcatcagcctcgccaccctgccctccccggtcaccgccaccggacgctccggcacagtcaagtaccccatgtccaccggcgaagcctgctgcatagtcacgccgtggctcggcggcgccgcggtgtacgcgggcatgtacgcctgcggcttgggccgggtgaagtcgatctcgaagctgcccgcgccgccgaagatggcctccgggcccaccccgacctccgattaagagccgctgtgcgcgccggaggcgttggccgtgtattaggagctgtaggtctgcggcggcttggcgccgatccccgcaggcgaagtccaggtccacgaagggggggttacggccacggtccggaggcccgttgggcacgcaggctttccagcgtgggccgaagcgccgtcaagccgacgggcgaggttaggggctcacacagggccggaaaaacagggtgctcctctcttcccggccctctcttggccgcggtctcccccgtgtgagagggtccggcttccccccccagcctgggtgccagctcgtgccgggccacctatcgccttagtctcgcgcccctc

SEQ ID NO: 6769 - DNA, 1177 bp, Triticum aestivum
  misc_feature (12)..(12): n is a, c, g, or t
  Predicted polypeptide sequence is orthologous to G1480
aagcaggctggnaccggcccggaatgctcgggatatcgtcgacccacgcgtccgccaccgcgtgcacccgccattgcctgtcggagctaagaggacgtgcaggggtgctagctagttatgatggagctgcgcaagtaccggggtgtggggggcaggcggtgcggggcgtgcgaaggggcggcgccggcggcggtacactgccgggactgcgccgggtacctgtgcacggggtgcgacgcgcgcccggcgcacgcgcgggcgggacacgagcgcgtctgggtgtgcgaggtctgcgaggtcagccccgcggccgtcacgtgcaaggccgacgccgccgtgctctgcgccgcgtgcgacgccgacatccaccacgccaacccgctcgccgagcgccacgtgcgcgtgcccatcgcgcccatcggctcccccgaggccgccgcggtggcggccgaggccatgatgttctgcggcgccggtgacggggaggccagggcggatcaggacgaggtgcccgagcagctgcgccagcacgggggcatgctgaacctcaacgtgcaggccggcaaggagggcgggaagatggactacctcttctccgacctcgtcgacccctacctcgccgtcgactttacgcgcttcgcccacgctgacagcgtcgtgcccagcggggtcgccaccgccgcggtacccgccgtcgtggacctggacttcgcgtgcgggatccccgccaagccgccgccgacctacagctcctcgtacacgggcaacgcctccggcgcgcacagcggctcttcatcggaggtcggcgtggtgccggagggcatctgcgggggcgtcgggaccttagagatcgacttcaccagggccaagccggaaggcgtacatgcccggcgtaaccgcggggccgccggaacacggggtgggcatgcagaaggcgtccccggtggacatgggatacttgacggtcccggaccgtccggtggcggtaacccgggagggcccggtggcaaagctaatccggtaccgcgaaaaaaagaaaaaccccccggtccaagaaaaccatcccgtacccgtccagggaacggcctacccaattccggggccggccgtaaagggccgttccccatcgccacccgaccaggaagccgaacggaaagaattggaccccggaggccaa

SEQ ID NO: 6770 - DNA, 1070 bp, Triticum aestivum
  misc_feature (12)..(12): n is a, c, g, or t
  misc_feature (788)..(788): n is a, c, g, or t
  misc_feature (1049)..(1049): n is a, c, g, or t
  Predicted polypeptide sequence is orthologous to G1480
ttttttatttangtgtcttcctaaaacaagtttgtacaaaaaagcattttcctaccggtccggaattcccgggatatcgtcgacccacgcgtccgggtggtggcgctggtgctagctgggctcgtcggactgtgagcgagcagtgagcgcgtacgtgccatggagggggaggagaagccggtggtgggcggggcctactggggcgtgggcgcgagggcctgcgactcgtgcgccaccgaggcggacaggctcttctgccgcgccgacgccgcgttcctctgcgccggatgcgacgcgcgcgcgcacttctccggttctcgccacgtccggttctgggtcttctaggtttgttagcacgcgaccgcggacggttcgtgtaaggtccaatcccctcatgctcatgcataccctgcttctcttatcatccacaccgttaaagcctttcagtgtcctcccacccatatcgtgatccccgcggtattaccttttctgtctaaccctgcgcgcgtccttctgagtctttgttacctttgtcgcgcctctgcgtcgatgctatggctgccgcgtcggctgcagagacacgcagagagggacgcttcgccagcgcgcttgttcgcggcaatggaacaccgatctttatttcggccttgtggttatctcttgttgtctctctctatttgattggtccgataacaagtattcacgctcattcttctttagatttcttcccgttagtatcgcgccatcgcgtctcactaagctatcggctcgcctgcgcgatctacacnaccactctgctccacccacttctgtcgcaccaatcacccccgccgcgacgtcccgtccctacatatgtctgctccgacagtcaactcgcgtcgctacgtcctcctctgccttttatgttttgcttgcgcaaatatgatacaaatcctgtgtatagagctagatcagtcgcacctatgaattataccacgcgtcctacttaaagtctgctgatgtcgcacctctcctccacttgtgcgtccgtaccacatcacccacacttntattcatattcctctgcatag

SEQ ID NO: 6771 - DNA, 929 bp, Triticum aestivum
  misc_feature (619)..(619): n is a, c, g, or t
  misc_feature (690)..(690): n is a, c, g, or t
  misc_feature (692)..(692): n is a, c, g, or t
  misc_feature (715)..(715): n is a, c, g, or t
  misc_feature (748)..(748): n is a, c, g, or t
  misc_feature (764)..(764): n is a, c, g, or t
  misc_feature (766)..(766): n is a, c, g, or t
  misc_feature (773)..(773): n is a, c, g, or t
  misc_feature (796)..(796): n is a, c, g, or t
  misc_feature (803)..(803): n is a, c, g, or t
  misc_feature (812)..(812): n is a, c, g, or t
  misc_feature (819)..(819): n is a, c, g, or t
  misc_feature (821)..(821): n is a, c, g, or t
  misc_feature (879)..(879): n is a, c, g, or t
  misc_feature (887)..(887): n is a, c, g, or t
  misc_feature (918)..(918): n is a, c, g, or t
  Predicted polypeptide sequence is orthologous to G1488
ccggagtaccggccggcggcgagcccgacgttcgtgccgtccaagcattccaactcgcaccgcaaggtggtggagctgcggcgccagaaggacaccccgcagcagcagctcctgcaccattctcagcacaagccgccgcagcagcagctcctgcaccattctcagcaccagccgccgcagcagcagcaccagctggggccgggcctggggttccaggtgccgagcccgctgctgttcgacgggccgcacctgggcggcggcgcggacgagttcctcatccgcaaccgcataggccccgaccaccggcagctcatctagcctagcttagctagccagcgccgcccagctcgcctaggaggaggatcgttccgttagccccagcagcaataattcagcaagaagaacagccagcccagcccagctaaaacttttttcctaggagttgttgtttctccggattttaatttacctttttccagagacctgtatgcttgcttgcttgctacactctccgtgtttctcagtcagctctcgagttccttagaaactaatcctagggtgcatttgtcgttttccttccttctcttcttttttcatagactttttctttgcttttccnctagatttttccttcattttcttgtaatgccaggcccacgctgccaggggtatccaaagcccctagaaatncntatgaaccaacgaagggaacacnaccaacacggaagggcaaacaggcaacggagcnagcagggggtttgccntnggacaanacacagacacaccagcacaccanaacacantacaacgancacgcanangcaggaataaaaaaccccgctcgcgaatatgagagagagaagtgacagccaccaccanacaacagnaacacagacgagcaacgagacaccgcactangcgacacgaag

SEQ ID NO: 6772 - DNA, 458 bp, Triticum aestivum
  misc_feature (28)..(28): n is a, c, g, or t
  Predicted polypeptide sequence is orthologous to G1488
ggcaaggtgctcgagctccgccgccagnaggagatgcaccaccaccaccagccgtcgcagctccagcagcacgcggtcgccggcggcgtcgggaggataatgcacatggagagccacctgctgttcgatgggccggcggcgccgcccatcctcggcggcggcgacgacttcttgatccaccaccgcctagggacggcagactaccggcagcagctcatctagacgagtcgtcagtctgttagaactgatcagtttagcccagaaataataattaaaagcagctaaaaccccaagagccggaaatatcggaagaactgcaaatgtttgcttattaggagttatattttcccagttttctctctgcttccgtttggttagcccgtgtgctttttgttgagctcgaaattttcgtgtccatttagttcatgatcctccccagtttcccgctaaaaaaaaaa

SEQ ID NO: 6773 - DNA, 634 bp, Triticum aestivum
  Predicted polypeptide sequence is orthologous to G1488
ggtcgacccacgcgtccgcggtcgataagcgaagccccttcggcgccatggccggcaaataaggggaagaggtgccagcactgtgggtcgtcagagacgccgcagtggagggaggggccaaaggggcgagccacgctgtgcaacgcgtgcggcgtgcggtacaggcaggggaggctactgccggagtaccggcccatggcgagccctacatttgtgccaacaaagcatgccaattcccaccgcaaggtgctccagttgcatcggaccaggcaaagcaacgacgagcatccatcaccgctgcctgccgacagcgtcaccaacctgcccccaatccgcgacgagctcccgaccaccagcacggcaggtcttgccagtgaggatccgaccgacgcaccgggctacaccgacaacccaatcaacgtgccgagctcactggactcgctgctgctcgacgggccgtcggcaccactcatcgtagagagtgaagattttgcgattagctagcctatgaagaataattcagctgagatgagatactgatcctttttacttcgtttgttcagatactgatgcttggaaattttaaactttcaatcactgaaggccactgcacaggccctagcagtgatcaaac

SEQ ID NO: 6774 - DNA, 863 bp, Triticum aestivum
  Predicted polypeptide sequence is orthologous to G1488
acgcttgaccttaggcctatttaggtgacactatagaacaagtttgtacaaaaaagcaggctggtaccggtccggaattcccgggatatcgtcgacccacgcgtccgcaaaaaagcgccgagtaacgcactgccccgccgcagatagagaattgcggtgcctaccgctctcgcggcggccatggaggcgacggtgcccgactactacggccgcgacaagaagggctccgacctcttcgtcgtcgacgacctcctcgcgctgccgtgcgacgacgacgaggaggaggaggaaggggttggcgaggcgccgttcctgccggccaactccgcctccgccgccgccatcgtcgtcaagcaggaggccgggttcgggaacgcgtcggccgactcgtccacggtcacggccctcgacagctgcagcaactccttctccggcctcgccgatggcgacttctccggcggcctctgcgagccgtacgatcagctggcggagctggaatggctgtccaactacatgggcgagggcgaggagagcttcgccaccgaggacctacacaagctgcagctcatctccggcatcccctccgggggcttcccctcggcgaacggacccactgctccggcgggccacgctgccacggcgcagcccggcatggtcctgcccggagggccccgtccccgccaggcccgtagaaagcgctccccgcttgccccgggcaactggccgtccggcctgttcgtttctccgccggccccggtctcccggcctccccgggggtcctggccctctcgcccggggagtcccggctctcccaccggggtttccttggcaagaacccctccagccggaataaaaataggggt

SEQ ID NO: 6775 - DNA, 1026 bp, Triticum aestivum
  misc_feature (18)..(18): n is a, c, g, or t
  misc_feature (762)..(762): n is a, c, g, or t
  misc_feature (795)..(795): n is a, c, g, or t
  misc_feature (867)..(867): n is a, c, g, or t
  misc_feature (876)..(1025): n is a, c, g, or t
  Predicted polypeptide sequence is orthologous to G1494, G789
tcgacccacgcttccgtncgatgagcctggccgactgcggcgacaacgccggcggcgtcctgtcggacctcgtccaggctcgcgccgggaaggcggcgatggaggagggcgcgtcgtcgacgctgagcgcgatgggggcgagcttctgcgggagcaaccaggtgcaggtgcagggcgcggtgagcgagcaggggcgcgccggccacaccactgcctatggcggcggcggagcgggcagcgctctgccttcggcggtagggagcggaaatgcaaacgccagaggcaggggccacgaggccaccgtggcctcctcgtcgggccggtccaactacagcttcggcgtgaccaccaccactggcaccgagccgacgagcacgagccaccggagcagcaagcgcaagcgggggctggacacggaggactcggagagccccagcgaggacgccgagtcggagtcgttggcgcttgagcgcaagccgccgcagaagctcacgacggcgaggaggagccgcgccgccgaggtgcacaacctctccgagaggaggagacgagacaggatcaacgagaagatgcgagcgctgcaagagctcataccccactgcaacaagactgacaaggcgtcgatgctggacgaggcgatcgagtacctgaagacgctgcagatgcaggtgcagatgatgtggatgggcggcggtatggcgccgccggcggtgatgttcccgggcatgcagatgcaccagtacctgccgcagatggggccgncgtccatggcgcggatgcccttcatggcgccgncgcagcagggccacggcgtgagcctgccggagcagtacgcgcacttcctcggcgtcaacccccacacggggnaggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 6776 - DNA, 595 bp, Triticum aestivum
  Predicted polypeptide sequence is orthologous to G1506
ctccatttctggcaattgtgactccatctgcattcggtcaagcattatagttcgcacagtatggcctttgttacatgcctggcacgtaatggctgctatcagtctgctgagctcatctgtttccctgaagagttacgatgggagtatcaaatagacatgtatcagcaacgtcatcagtctgttgagctaatctgtttccctgactgaagagttagtatgggagtatcaaataaaagtgtatcggcaacgtcagaatggttaggaaccttcatacaacagttactagaggcagcaccagagcaattcattcttcgaaagcctgaatatcgctgttgatatttttatatattgtccggttgttggctttctcaatatttcccttcctggaagcatgtttctcagtgtacgtttgtaagctctgttgagatgtatcgcatgatgctagtgcccttgatagactttctgctttgctctggttcttgggcaatgggagtacgcaccctctttggcatgcatcgtccgggaaagacgccggttctgctctgctccctccacaagagcaactgcgtccgcatgttgggcctgccatcgttcg

SEQ ID NO: 6777 - DNA, 662 bp, Triticum aestivum
  Predicted polypeptide sequence is orthologous to G1506
gcagatatacaggttacaatttctccgccatatatatatgctacaccaaacaaaagaaaacaagcgcagacaaattcagcatatgcatgtctggacgatcatcggtgagcggtatcgtatgatgatgatccaggaaccaaaatgtaaacaaaactaccactgatgcctgttcctgagctgatcgctagcggaaccgggactatggttgctcgggggagaggctgcggttacggtcacagagctgagctgagatggtggggggcagcagagaagaagctctgcttcagggtgccgcgcgttgcgagggacctccagcagcagcgagtcttggtcagaatccttgtccgaggggttcagcatagatgataatttgtctggggctaacatgaacaggttgagtggtgctgctgctgctccggtggcattgccagatttcggcaaaaatgcgcttcttctcaactgacaagaagccatagccctggatctcgaagaagctaatctcatggttcctcctctcacttctgcatctgtgaagctttgctgctggctttcataaggtcttttgagagacctcatgctggacttggtaaggcctccaacttccttgctgcaattgtcctctaaagctgaatctgcgctctccaggatatgctggttcgaac

SEQ ID NO: 6778 - DNA, 662 bp, Triticum aestivum
  misc_feature (30)..(30): n is a, c, g, or t
  misc_feature (80)..(80): n is a, c, g, or t
  Predicted polypeptide sequence is orthologous to G1506
ttcccccatgaaagagttcttctattttcncggtgatatgagttatactttctccaaaagcccacgtgctatggaaaccnacacaagcctagtccaaaagcaccgctacaaatgttagctgaacgggcaattttgcctccgcggcagacgcacattgtcaatgtaaattggggcgataacgacggcacaagcatgaacaaaccgcagaaagccctaccggtgatcggtaaataaaggtaccgtgatgatccaggaaactaagggaaactaccgctaccgcctgttcctaagttggtctctggtctacggttgcttgaggcgcccctcgccatcagcaaccacgtctgctgaggtggagctgcgggttactgagctaagttgaaatggttggcaaagaagttctgcctctggttcccgcgcattgagaggaacctccagcagcaagtcttgatcagaattatccatgtactgcggaggggccagcatggatattttatctgggggtaacatgagtaagttaaatggtgctcctccagatttgggcaaaaatgaacctttgaactgaggagccatagccacagatttgcaaacttttttggcaatcctcatggttccttctgggcagctttgcaactggctttcatgaggccttttgagaggct

SEQ ID NO: 6779 - DNA, 655 bp, Triticum aestivum
  Predicted polypeptide sequence is orthologous to G1506
ccacgcgtccggattcatacaccacccaagaaccgccccttgattcccccctccccctttttctgctcgcgaattacttggtagtagtatttccacaggagaactgctccttttccgctctgttttccgtgtttctctgcttggaaattcctccggttcttcctcgtttgttcgtggggggcgaggggaggaggaggcatgggaaaggaaggtccttgctgccattgcggcgtcacgagcaccccactttggcgaaatgggccaacacataagccagtgctctgcaatgcatgtggctcgagatggagaacaaagggttcattggagaattacacaccaatgcattctcgtgatgatatcgatgctgatcaacctagagttagcaagctgaagccgccgacattgaggctaaaggaacagaggcagctaaagaaaaggccaagccacagcataagggagaatggagcattttctgatcaaaacttctggaagatgggggatgccgacccaagtcgatctagttctggatcggcactatcatattcagagagttgtgccccatatggttctgctgatgctagtgaaatgactggttcagcgcaatcgcatgcttgggagtcattggtaccatcaaaaaagagaagctgtgtcactc

SEQ ID NO: 6780 - DNA, 882 bp, Triticum aestivum
  misc_feature (14)..(14): n is a, c, g, or t
  misc_feature (832)..(832): n is a, c, g, or t
  Predicted polypeptide sequence is orthologous to G1506
aaccgccactgagntagggcctattcaggtgacacaatataacaagtttgtacaaaaaagcaggctggtaccggtccggaatcccgggatatcgtcgacccacgcgtccgcggaggaagattaatttaccacagtgcaactcctgtggattcctttgagattggttatggaagtatgcttctgagaagttcaaactcaaaatcagcggaggaagattcagaagcaaactctgttcctgcagataataaatcataccttacaagtgaatcctattcagggactgcctcgtttgttgtgcatagtgaaagcaagggggcaagtaattcaaatgcttctcctgagaagccaaagtggtttccggtgcatacacacgaaattgctaaaaggggtaaacttcattactcaaagcagcataccctggaaaatgtaggttcaactttagtttcagtagctttagagggagaaggcactaaggaaacaggaggaaatgaaaataccagtgctttgaaagaccttaccaaatccaccatgaagcctctcaaaaggcctcatgaaagccagttgcaaagctgcccagaaggaaccatgaggattgccaaaaaagtttgcaaatctgtggctatggctcctcagttcaaaggttcatttttgcccaaatctggaggagcaccatttaacttactcatgtaccccaataatatcatgctgcctcgcatcatgatatctgtcagatgtgtgagtcctcagcggaaccagcaattgccgaaaacagagcaacttcttgcaacattcacttactcataccgcactcactcacaacgtgtgctatgcnagggcgctcaacacgtaacagaacacttagacaggggtcggtatcccttt

SEQ ID NO: 6781 - DNA, 641 bp, Triticum aestivum
  Predicted polypeptide sequence is orthologous to G1510
ctcctcccctccccatctcatcctgatctccaattatctgcgctccctagctcgctagatctcctctagatctcatcatgtctaccatctacatgagccagctctctactgctttccctctaatggaggaagatcatcaccaggatcaccatcaggggcacttccaggccttcaccctgcccaaggatccccccatattgttcccttttgtgatcagcaacagcggccctagcgacaacagcagtactctcagctacggatcagaccagcacttgatgcagcaccatgccatgctagatcagccccaacatatgatcggtgaatcatccagtgtgttctcgacgccgttcccgaccgtcgagagcatccgcgacgacatgatcgagcgatcctactcgtacgatccatatgatatggagaagctgcaggccaccagcggatcgctcaagatcggcaagtggacggcgcctgctcccgcagccaagatgaggatcacgaggaagacgagcgatcctggtgtcaagaagccgaggaagagggcgcaggcatacgaggatcatggccacatgggcggcatgaaccaagctctgggtgttattaggacatgctctgattgcaacaccaccaagacccccttgtgg

SEQ ID NO: 6782 - DNA, 683 bp, Triticum aestivum
  Predicted polypeptide sequence is orthologous to G1510
attcggacgaggaacccctccctctctccctccattcgaaccaaacccgagggagccgccgcccgcggaatccaaactttttccctccatccccttccccgcgcgatcaatcgatcgcttgatcaagcgcttgatcgagcgatcggagccgatcggggagcagcggcgatcaggaatcgatccgtgctccgcatacaagatgtcgccggcggagatggagtccgacaaggtcgttgaggcggcggcggatcctgaggagcgaggcgctggcgaccccaaggcctgcgacgactgcaacaccaccaagacgccgctctggcgcggcggacccaacggaccaaagtcgctgtgcaacgcgtgcgggatccggtaccggaagaggcggcgggtggccatggggctcgacccggaggccaagaggaagcccaagagggacgacgccatcctatccaaggcggaggcttctagtaccaaggaggaggaggaggaggacaacaaggccagcaccaacaagatcaagaccaagacgactactcacaccgtggagctccacatggttgggttcgccaaggacgcggtgctgaagcagcagcagcggcggcggcggcagatgcgacggaggaagccgtcgtgcctggggcgaggaggagcgcgccgccatcctcctcatgtcactctcctca

SEQ ID NO: 6783 - DNA, 1041 bp, Triticum aestivum
  Predicted polypeptide sequence is orthologous to G1538
aagccaaaccggccgcccttttttttttttttatacttacaaagattaccccttcataatgttcatggcttagcagatagtacgtactactactgagattctccgttagggcatccacccattgaaactaccaccaatactacccagttctgacttgctgctactactgctagtacgtgcatacgattgccccgcaatcccggttgattaattaattaattaacattgattgagcatagtaaactaccactagcactgttctttcaccccctctatccgggtgagctgaactgatcgtacacccctccgaggtagccgccggccgccaggtccatcatgtagttggtgtaggcgtactcgctcatgtaggtcaggtcggtctccacctcctccatcccgaactgctgcccccctaccattgccgtcaccgtcgagaacgacgaagagctcgggctgctgccacccccgccgcccgttgccgccgccgacgccgccatggccttgtttttctcctcctccgtctccgccaacctctccttgagcctcagcagctcggcctcgaggcggcagttgtggacgacgacggcgtcgtgggccgcgcggagcttggagaactcctcctcgatgagtttgctcttgtagcgggcgcggcggttctggaaccacacggcgacctgcttggtgtccagtcccagctccgcggcgagctgcaccttgcgcggcgtctccagcttccgctccttcctgaagttcatctccaggaactgcgcctgctcgtcgctcacccttcgcttctttcgcggggtgtcccctccgccgttgccggccggccttcttctggtctccgccggagacgacgggtgttgggtcctccgcccggaagctgtccggggaagacaaaggagggaacaggaacccttttccctcctcggagcttatttttcccagcaaattaaagttaccggcaccccaaaaatacttccctctttaacctgggcccggatccacaaaaactaagttttttggatcgggtcttgacca

SEQ ID NO: 6784 - DNA, 596 bp, Triticum aestivum
  Predicted polypeptide sequence is orthologous to G154, G1797
gaattcggcacgagctaacaaccaccgagggacaaaaacagagcgagagacgagcggcggccggtggggatggcgcggcgcgggcgtgttgagctgcggcggatcgaggaccggacgagccggcaggtgcgcttctccaagcgccgcgcggggctcttcaagaaggcgttcgagctcgcggtcctctgcgacgccgaggtcgcgctgctcgtcttctcccccgccgggaagctctacgagtacgcctcctccagcattgaaggtacatatgatctctatcagagatttgcaggagctggaacgaacttgaatggaggcgatgcaagtagcaacaatgatggtgatccttcaaacatacagtcaacgcttaaagagatcgcttcctggtctattcaaaacaatgctgatgtctcagatgctaataagctagagaaactggagaaactcctgacagatgctttgaggaatacaaaatccaagaagatgtcggcgcaacaaaatagcggggcaggcacgagtggcgagaacgccaatggtcctaggggaaagaagaagcgaggaaggacttgagagcagtcatgtggtgtgtctgcatt

SEQ ID NO: 6785 - DNA, 734 bp, Triticum aestivum
  Predicted polypeptide sequence is orthologous to G154, G1797
tcggcacgaggccatggcgccgtcgtcgccggcggcggcggcggtggcggagggagacgagcagcagcagcagcagatcgtggcggcggcggcggcggccaagaagggcggcgggaagaggggccggcgcgagatgcggcggatcgaggacgccaccagccgccaggtgaccttctccaagcgccggagcgggctgctcaagaaggccttcgagctgggcgtcctctgcgacgccgaggtcgccctcatcgtcttctccccccgcggccgcctctacgagtacgcctccgcgccagatttgcagaaaacgattgatcgctatctgaaccacacaaaagggacatctgccaatgagaaaactgttgagcaaccagctgctggcgtccagatgtgtagatccgaagctaccgccttgaagcacaagatagacgcaattgaggcataccagaggaagctatctggagaaggactggggtcctgttcggcccatgagctgcaagagctggagctgcagctggagaagagcctaagctgcatccggcaaaagaagcaacagaaaatgctggataaaatcttggagctgaaggagaaggagagaaagctgttgacggagaacgtggtgctccgcgaggagtacaaggcgctgcctctgctagagctggccactgctgctgctgctgaaagatcgcctgacggcgccggagctgaagaagctgaggaggacgagcggcggc

SEQ ID NO: 6786 - DNA, 635 bp, Triticum aestivum
  misc_feature (438)..(438): n is a, c, g, or t
  misc_feature (449)..(449): n is a, c, g, or t
  misc_feature (453)..(453): n is a, c, g, or t
  misc_feature (534)..(534): n is a, c, g, or t
  misc_feature (537)..(537): n is a, c, g, or t
  misc_feature (541)..(541): n is a, c, g, or t
  misc_feature (560)..(560): n is a, c, g, or t
  misc_feature (574)..(574): n is a, c, g, or t
  misc_feature (583)..(583): n is a, c, g, or t
  misc_feature (591)..(591): n is a, c, g, or t
  misc_feature (607)..(607): n is a, c, g, or t
  misc_feature (621)..(621): n is a, c, g, or t
  misc_feature (634)..(634): n is a, c, g, or t
  Predicted polypeptide sequence is orthologous to G154, G1797
ctcattttcgcccgctcccctctccatccaatcatcgagagacgtacgccagcgagcgagcggcagcccgaaggaggaaggaggcgaggcgagggatagcgcggcgcgggccggttgagctgcggcgtatcgaggaccggacgagccggcaggtgcgcttctccaagcgccgctcgggcctcttcaagaaggccttcgagctcggcctcctctgcgacgccgaggtcgcgttgctcgtcttctcccccgccggcaggctctacgagtacgcctcctccagcatagaagatacatacgaccgctatcaggcatttggaggagccggaaagaacctgaatgaaggcggtgcaagcaccaacagtgatggagattcttcaaatatacagtcaagcttaaagaattgcttcctggtctcttcaaaacaatgctgatgaccanatgctaatganctanagaaactggagaaactatcacagatcttggagatacaaatccaagaaatgttggcgcaacgaaatacgggcaagaacaatncancggngcaatcataatctaagganaggagaagaaggantgacatcanttatgatnattgcgtatcaaaggncttcttggtttcanatcgttgatctant

SEQ ID NO: 6787 - DNA, 532 bp, Triticum aestivum
  misc_feature (430)..(430): n is a, c, g, or t
  misc_feature (495)..(495): n is a, c, g, or t
  misc_feature (501)..(501): n is a, c, g, or t
  Predicted polypeptide sequence is orthologous to G154, G1797
gttacccctaacaatcaccaagatacaaaaacagagcgagagacgagcggcggccggaggagactggtgggatggcgcggcgcgggcgtgtggagctgcggcggatcgaggaccggacgagccggcaggtgcgattctccaaacgccgcgcggggctcttcaagaaggcgttcgagctcgcggtcctctgcgacgccgaggtcgcgctgctccgtcttctcccccgccgggaagctctacgagtactccacctccaggttccataggaaatctactttgataaatattcactgaagtgggaattgctgcaacaactgggagttataggatctttgcttcgtatagtgggtgatgggtgcctacaatgatataaaattactatgttttactagtataattgttggcatgattggttgatatacatatactngaatttatccaacattgtctaatgtaaacttcatacacttgaatattgctactttacaatcatgngacccntcaattgaagttaatttgtaaaaaaaaaaaa

SEQ ID NO: 6788 - DNA, 507 bp, Triticum aestivum
  misc_feature (482)..(483): n is a, c, g, or t
  Predicted polypeptide sequence is orthologous to G154, G1797
gcacgagggagaggacgaggctggtggggaactggggatggcgcggcgcgggcgtgtggagctgcggcggatcgaggaccggacgagccggcaggtgcgcttctccaagcgccgcgcggggctcttcaagaaggccttcgagctcgcggtcctctgcgacgccgaggtctcgctgctcgtcttctcccccgccggcaggctctacgagtacgcctcctccagaattccactattcgctggtgcttctacatgctttcattggatattccagaccaccttagtcggagttcaacaagcttctcttcaatcaacgccacccctacctcatcatgtattcactcttcataattaaatcctttattgtagggccacgcatccaccttagcatgtgcatcttagtgacacatttattggatgtggtgtctcttagtagcccaacactctgctccatatatcatcacaggttcgttcgatgtcctaannaaattaccttttaaaaaaaaaaaa

SEQ ID NO: 6789 - DNA, 757 bp, Triticum aestivum
  Predicted polypeptide sequence is orthologous to G154, G1797
tttttttttttttttttttttttttttttttgacagcaactttgtaatttctatatatacagccaggccaagaaacaattggtgtgctgggcgtttcaacttgagttcagtcgtgagaggttctctgcaggtttgtcatcgtcgcagccgctaatttagctttgcaagacattacagattctgtctaaatatagagaataacagaaatggtggactactgatcgggcacttcaaggatctgtagagagtttattggtgtgaggctcaaccttcgggctggttacctatttggcttgacctgaccgcaggctggagcagcgaaccccgggcaacccaatgtagagctccgtctccacgtcctcgtccctctgtaccggctcctgctctggcgctggctagccacgtggctgcaggggtgccacgctgttcggggcaggaagcaacagccgcgcctcaaggttgcgctgctttccgcgcaagtcttcgttgtctttgagaagcgtcctctccttctctttcagtttagctatctgctgttcgagcagctgggtcttctttcctctgagaacgcggagactcttctcaatttttccttccagaaaatgcagttcttcagtagagcatcctcctaaattttcgcccaagatctttcgcttcgaatcttcaagagcttcaagtttctttgccaagcttagagcatcagctttgacttgctgtatatctggctgtactgtcttgttattaacagtatcctttg

SEQ ID NO: 6790 - DNA, 742 bp, Triticum aestivum
  Predicted polypeptide sequence is orthologous to G154, G1797
cgcctccaacgcagagtgctgttccttctggcactggctatatagttcttcattgtcctgccgcaacttcatctccttctgcctcaacgtagagagctgctcttcgaaccgccgagtcttcattgccctgatgcctagaaggcttctttcaattttgacctctaagctttgcagttcttcaatagagcattcttccaaattttggcccaaaagtttgcttttgcaagcttcaagagcatcaagcttctttgacaagccctcagcatcagcttttactttctctatatcttgctgtaccgtctgtctgcccaaattatcctttgtgactgtcttataacgttcaattgtgttcttcatgctggagctggcgaattcgtagagcctgccgcggggggagaagacgacgagcgcgacctcggcgtcgcagaggacggagagctcgaaggccttcttcagcaggccgccgcggcgcttggagaaggtcacctgccggctcgtcgggttctctatccgcttcatctgcgtcttcccccgcaccattttcgcccctcttctcttctcccaccacaaatctaatcggaaaccaaaccaaaccagaaaaatctccctcctccgatcagccggccaaaaacggcaagcgcggcgcggtgaggtcgctgggtgtagggttcggccgtactggccgctgctcctcctcgatcacccaccaccctccccctccttctctccactggctttcctt

SEQ ID NO: 6791 - DNA, 1118 bp, Triticum aestivum
  misc_feature (794)..(797): n is a, c, g, or t
  misc_feature (799)..(823): n is a, c, g, or t
  Predicted polypeptide sequence is orthologous to G154, G1797
gacgacccacgcttccgggaggaggatggcgcggcgcggacgggttgagctccggcggatctaggaccggacgagccggcaggtgcgcttctccaagcgccgcgcggggctcttcaagaaggccttcgagctctcgctcctctgcgacgccgaggtcgcgctgctcgtcttctcccccgccggcaagctctacgagtacgcctcctccagtcagagcatggtccttcaagcggcttcattcacaagggacttcagcctaaaactagcattgaaggtacatatgaccggtatcagcaatttgcggtgcccggaaggaacttgattcaagaagatgcaactgtcagcaacgatgaagatccttcaaatatgcagtcaaggcttagcgagattgctgcctggtctctcgataataatgctgacaattcagatgccagtagtttggagaaactggagaaactactaaaggatgctctgagaattacagaatctaagaagactttggtgaaacaaaatagtggcgggagcacgagcggagagagctcctacggacctacggggcaggagaatgggaggaaggcttgagcagagcaaagttcccctgtgctgtgtatgcatttggtactatgttgcttcccccaacacactgttccccagttaggctgttaatgggcaagaattagttgccagggctgctacttgtaagttgtaagggaggaaattttagcgaaagcgtggcttaataatactaataataatacagtgtccgtgctataaagagaccccgttgtaccttnnnnannnnnnnnnnnnnnnnnnnnnnnnnaaaagggcggccgctctagagtatccttcgaggggccaaggcttacccgtacccagctttcttggtacaaaggggtccctatagtggagtcgaattattaggctaggccctggccgtcggtttaaaaaggtcgtgaactgggaaaaatggttacttggggatcttgggaaaggaaccttacttctgggggggggacttaattggccaacctaccttaggaggattaaaggcctcagggtaatttaaaattttaaagggtataaatgtgttaaactaaccggatatgcgtgcgggg

SEQ ID NO: 6792 - DNA, 652 bp, Triticum aestivum
  Predicted polypeptide sequence is orthologous to G156
ccacgcgtccgcccacgcgtccgcacatcacaagttaatgtgcatatcaccaccaccgctgcagggggagagagaccaaggggccggagacgcgcaaagccatagcttggttcctctggttggatcgatcgtcgcggttgcggttgcggagatgggtcgcgggaagatcgagatcaagcggatcgagaacgccacgaaccggcaggtgaccttctccaagcgccggggcgggctgctcaagaaggccaacgagctggccgtgctctgcgacgcccgcgtcggcgtcgtcatcttctccagcaccggcaggatgttcgagtactccagccccgcctccagcttgagggatctcattgagcagtaccagaacgccaccaacagtcagttcgaggagattaaccacgatcagcaaatatttgtggagatgacacggatgaggaacgagatggagaagctggatggcgccatccggaggtacacgggcgatgacctctcctccctctccctcgccgacgtcaacgacatcgagcagcagctcgagttctccgtcgccaaagtccgtgcaagaaagcatcagctcctgaaccagcagctcgacaacttacgtcgcaaggagcatatcttggaagatcagaacagtttcctgtgccgc

SEQ ID NO: 6793 - DNA, 1999 bp, Triticum aestivum
  Predicted polypeptide sequence is orthologous to G1635
ctcgtgccgaattcggcacgagctcgtgccgcgcctcttcgcctctcttctcttctcctgcctgcccctccctcctcgcgctccatcgacaacgagcacctcgtcttgttcttggtcttggcttttggtgtggcgacgttgggtagtgtgattatcttgttctcgctggcaggagatggcctgtacgcaggagaacgccatggcaaccgacgaaagcacggcggatcatcgcgggagtcgtccgagttcccacgacatggatttatcaggggatgaccacgtgccaaaggcacgcaagccgtacaccatcacgaagcagcgggagaagtggaccgaggaagagcacaagcgcttcctggaggccctgcagctgcacggccgcgcctggcgccgcatacaagagcacataggcaccaagacggcagtgcaaatccggagccacgcgcagaagttcttctctaaggtcaccagagagtcgtccgggagctgcagcggctcgggcgccgcggccgcgacggcgacggcggcgatccagatccccccgccgcggcccaagaggaaaccgacgcacccgtacccgcgcaaagcggacgacggcgcggcggccggcggtaagcacgccccggggctcacgcatctggagaggcctcccgtgcggatgggcgagcaggaggaagggtcgccgacgtcggtgctgaccgcgtcgcgggtcgaggcctccggtggccgcttctcctacaactccagcggcagcaggtcgccggttccgtcggccgccggctccctctacggctcgtcggtggacagaggggacggctgcctctcgcctaatacgactaaggcttcagagttcactgcaaatggtgatgtcaaagaggggtcatgtacaggatcagcgacatcagtccttaagctattcggcaagaaagtcgtggtgaatgattcattccagaagccgaataccagcaccggcaacccgcagaatggtggcgacgtcggaactgaagcttcagacgatacaaccacacaaggaagcagaaacctaccttctggcggtgccacagaaggaagctcatggaatccatggccgagcagcatgcagcagtttgtgtattttgttcctcaaccggatggtttcgccacacaatctgcggtgccatggtttggcaccctgcctggtgcaatgttctaccagcaagccatggctccaaatcagcaccagcgccatcgctcagagaccgcagaccacaagttcatgcagagggaaggatcctggacaggatcaaacactggccctggatcagctgcgcataattcagatgctgccgactcccgagggagaggaaacagcagtgagagcgacaaaacgcctgtgccgcggttaacaaagtgcgagagctctgtttcggtcagtctgcaaagaggtttcatgccatacaagagatgcgcggccgagagcgaatcgctgcggtcggaggcgcccagagaggagaccgacggtgagttgacgaggctgtgcttgtgacagccgaagattcgacacgctcttcacagtttagatgtttgctagttttgctctagactcttgagctggtggtgtgatctgcagtgggaagaagcgaccactcatcctgctggttttgcctgtcggtatgtcgcacttctccgaagcagctcgaagccgcattagattgagcatttctggttcttgctcgtgaatatatatagttggaatatgtagtatccatgtttttgttctctacagagtgtctctgcagtttttaccccaaatcgggaggctcagagttcagtgttgttgcctgtatcaacctgggcctgagagagggttgtcgtagtcttaactgcatgttgtaagctaggcaggcttgtatcactctgtagtctgcattctgtaaaacatatgataggcagaagacgaacaaaaacgtcgaatgctctgtatatctaaagtataacataatataaaaaaaaaaaaaaa

SEQ ID NO: 6794 - DNA, 819 bp, Triticum aestivum
  Predicted polypeptide sequence is orthologous to G1635
gcttgacattaggcctatttaggtgaactatagaacaagtttgtacaaaaaagcaggctggtaccggtccggaattcccgggatatcgtcgacccacgcgtccgctttgaagagagaaacaacaacaaagattaggagctgctgattttgcctctgttcttcgtcgcccgcctctcagcccgatttggcttcgccggtgctccgattttgaaggatccagagagagatatggctcgttttcaggaaaccaagccggatctgctgaattccggcagcgatacgcggatgatggccgaagcccgcctccccaaggcgcgaaagccgtacatgataaccaagcagcgggagaaatggaccgaggaggagcacaagctcttcctggaagccatgcagctccatggccgcgcctggcgccgaattcaagagcacataggcaccaagacggccgtgcagatcaggagccacgcacaaaaattcttctccaaggtcacccgggactcgtccggggacagcggcggcagcagctccggcgccgggccgccgatccagatcccgccgccgcggcccaagaggaagtcggtgcacccgtacccgtgcaacctgaggagcgcgcagccggggaagcgcgcccccgcgctcctgcgggtcgacaagcctcagctgtccatgtgtgagcaggggaatggctcgccgacatccgtggtgaccacctcgcagataggcttggggcggctccgagagcttcgacagcgacacctcgaccatcgacgttgaagagcgatgccccacgccgagcacgggggaccgccgaggtcgctg

SEQ ID NO: 6795 - DNA, 687 bp, Triticum aestivum
  misc_feature (522)..(522): n is a, c, g, or t
  Predicted polypeptide sequence is orthologous to G1638
tcggcacgagggtgaagaagtacggcaaaggggactggaggaacatttcgcgcaacttcgtgcagacgaggacgccgacgcaggtggccagccacgcgcagaagtacttcatcaggctcagctccggcggcggcaaggacaagaggcggtcgagcatccacgacatcaccacggtgcacctggacgaccagcccccctcgccgtcccagtcatccatgatcacccagtccagcgcaccggctccgagctcggcaacggggcagttctcgctgccggccgacaccaagcagcacggcggagcaaatgcgccatacaattcgccgccgagctacggcatgggtttgcaagatcaaggcatccagtgtggccctctgcatgatcagctggcggcaaaccggagcatgttgtattagaagatgcaacctttcgatccatttcgacgacaccgatcagatgtctagtgtaatatggcccttgctgtagcctcactgcctgtattattattgaagtaagtaattgatntatggggatttttcagaacatagcagagagagagagagagaggtatgatgctggtgatgctttggtagtagtccataatttctggtgtggatactgaagaatgtaaggggagaagaatggcaagaacttgatgctgtagtatcttgagacagacagggaatacta

SEQ ID NO: 6796 - DNA, 1085 bp, Triticum aestivum
  misc_feature (914)..(914): n is a, c, g, or t
  misc_feature (950)..(950): n is a, c, g, or t
  Predicted polypeptide sequence is orthologous to G1638
ggccgcccttttttttttttttttttttttttttttggaccgagaaacgtttgaaccaattttcaggccggcgctagctagctcctgaccggagcacaccggagcacaagcttcatcgaaggcttattacagattcttttttcagtacagtggaggttcttgggtgtggcggaattatgtacactggacggcacgccgatgggttcttgaggtttctccatggacgcagacctgcacgtacgctcaacaccgccgtgtcgctctcagatattttcgcttgcgttccatcatctgagtgtcggtcgagagagacacaagcacagcgactctgcaaccaaactgctctcgaggcaagcgcgcccgcctgcctgcctcgtccctggtgtggtagcgcccgtggatgcgatgatggtgagaggtggccgccgctgttttgtcctccgtgcgggcttcgccgcggcgagaaagctccgtcacagctggccgcattgcatctgcaggaggagcgagtcgtcgaggtcgaggcccgcgccggacatgaacgagctctggtgctcgagcttcacgttgccgtacgggtggccgccgccgagcgtccccgctggcagcgtcgacggcacgaaggcatgccgttgccccccgtaggacggcgagggcttcgtgtcgacggtggtgaccacggacggcggtgaccctgaggggctgtcgcggtcgtcgtcgtcgggcacgttgacggtggtgatgtcgtggatgctggaccggcgcttgttgtccttgccgccggaggtgagccggatgaagtacttctgcgcgtggctggccacctgcgtcggggtgcggctcgtcacgtagttgggggagatgttcctccagtcccctcgcccgtactctttagcccccttcagaggaccggntgttcttcttccgtcaaggggagcccctttttccgntcctggtcgggcgcccccgcttaaggaaataaccgcccggaacccgccgtgcccggggggcccccgtcccattcaaaattaacctcgaaaaagggaacaacttttctatttagggacgggacccccccggcctta

SEQ ID NO: 6797 - DNA, 396 bp, Triticum aestivum
  Predicted polypeptide sequence is orthologous to G1638
aggcgagttttttttttttttttttgaaaaatccccataatcaattacttacttgaataataatacaggcagtgaagctacagcaagggccatattacactagacatctgatgcgcttgcatcttctaatacagcgtactccggttcgcggccagctgatcatgtagaggaccacactgcaggccttgatcttgcaaaccctgccatagttcggcatcccgagcgaccggctcggcgaactgaagggtgtgctcgccccgccgtgctgccccgttgccgcgctgagccggtgcgctggactggttgatcatcaatcactgggacggcgcgggaggctggtcgtcggtcaggtgaactgtggtgatgtcgtggatgctcgacctccttgccacccct

SEQ ID NO: 6798 - DNA, 824 bp, Triticum aestivum
  misc_feature (752)..(752): n is a, c, g, or t
  Predicted polypeptide sequence is orthologous to G1640
acccgctagtgcgatataggcctatctaggtgactagattgaacaagtttgtacaaaaaagcaggctggtaccggtccggaattcccgggatatcgtcgacccacgcgtccgatgctcatgatacaagaaagatgtatggttcgtcgaatgtatttagttccaacaagggaatggtgctgtataaagttttaccgaaaactgaagcgggttctattgtacgtaaaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctcccccctgaacctgaaacatacaatgaatgcaantgttgttgttaccttgcttattgcagcttataatggttacaataaagcatagcatctcaaatttcacaaata

SEQ ID NO: 6799 - DNA, 1019 bp, Triticum aestivum
  misc_feature (22)..(22): n is a, c, g, or t
  misc_feature (28)..(28): n is a, c, g, or t
  misc_feature (662)..(662): n is a, c, g, or t
  misc_feature (827)..(827): n is a, c, g, or t
  misc_feature (873)..(873): n is a, c, g, or t
  Predicted polypeptide sequence is orthologous to G1640
cgacgacccacgcttccgtccncaaatnacacaagaagaacaagaatcatacgtcggcagcaccatgcttgtccaagttgatatcctaacaccgaccgctgtcaatgcgaggggtacatgctcacgaattaagggccacagagacaatgaaaagaaggcagggtcaaataagaagaaattaggggttactctacgggtaccgcgcacttgcagaacatgcaaggaagttgtgttacatgacagtcgtatctgtccgaagaaaaaataaaaatggttgtctaagtatgaacgctactaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtntgtgtattttagattcacagtcccaaggctcatttcaggcccctcagtcctcacagtctgttcatgatcataatcagccataccacatttgtagaggttttacttgctttaaaaaacctcccacacctccccctgaaactgaaacataaaatgaatgcaattgtngttggtaacttgtttattgcagcttataatggttacaaataagcantagcatcacaaatttcaccaataaagcattttttcactgcattctagttgtggttgtccaaactcatcaatgtatctatcatgtcgggatcgatcctgcattaatgaatccggcaacgcccggggaaaggggtttgggtatgggtt

SEQ ID NO: 6800 - DNA, 853 bp, Triticum aestivum
  Predicted polypeptide sequence is orthologous to G1640
aagctatgacattaggcctatttaggtgacactatagaacaagtttgtacaaaaaagcaggctggtaccggtccggaattcccgggatatcgtcgacccacgcgtccgaacactctccttgccctggcgtcctggctcatgctgcttctgcttgcgctcttcatcacaaccaccactgcttcactgccgtgccagtgctgctggatcgtggagcatccgacgaggacctgcggccacgcctgctgcggcgacaactgctgcccgcccgctccaccgccgtcggcacgctgaaaaaggatgcccaggcttgttcatcggaagtaaaaataaaaataaaaataatccagagggaatgatgttgtactcatacttacctgctcttctgtgagcatgtaatggtctctataactttccagcaataaacatcccttggctccttcaaaaaaaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggaaatataaaatttttaagtgtataatgtgtttaaactagctgcatatgcttgctgcttgagagttttgcttactgagtatgaatttatgaaatattatacacaggagctagggattcaattggttggggattttaaaatccaggcccaagctcatttcaagcccct

SEQ ID NO: 6801 - DNA, 1874 bp, Triticum aestivum
  Predicted polypeptide sequence is orthologous to G1646, G715
gcacgagcccacccacaaccctagctcccccgaacccatggatcccaccaaatccagcaccccgccgccgccccccgtcctgggcgcgcccgtcggctacccgccgggggcgtaccctcctccgccgggcgcccccgcggccgcctacccgccgcagctctacgcgccgccgggcgccgccgccgcccagcaggccgcggcgcagcagcagcagcagctgcaggtgttctgggcggagcagtaccgcgagatcgaggccaccaccgacttcaagaaccacaacctcccgctggcccggatcaagaagatcatgaaggccgacgaggacgtccgcatgatcgccgccgaggcccccgtcgtcttcgcccgcgcctgcgagatgttcatcctcgagctcacccaccgcggctgggcgcacgccgaggagaacaagcgccgcacgctccagaagtccgacattgcggccgccatcgcccgcaccgaggtcttcgacttcctcgtggacatcgtgccccgggacgacgccaaggacgccgaggcggccgccgccgcggccatggccacggcggcggccgggatcccgcgcccggccgccggcgtgcctgccaccgacccgagtatggcatactactatgtcccccagcagtaatgtatcatcgatctaaacttgcgcatttctaatcggagaatgtgttgttgttctgtgactgtccttggtgctgttgttgctgcggcgtaataagatttatgggcctcccctgagcttatgaattgagctgttcggttctagtattacagtaggattgttgtaatgggggaggccgtatgattgcttccgtagtgcatgactaactggccacccagtgtaatctgataactattatctggcgcctcccatggttactatgtatttatgttcttcacacagtcctctttgtctctaccacttcgaggagttcttcggaaggatgggctccaagatgcttctggtcaccgctctcttggtgggcatagcctctcagagctatgccaccaggagccttgacggaaaccacttggctgatcagaagtacggcggcggcggctacggaggtggcggtgggggctccggaggtggtggtggctacggaggaggtggcagcggcggcgggggtggctatggaggaggcggcggcggtggctacggaggaggaggcggcggttacacaccgatgccaacaccgtcgacccccagccacagcggatcctgcgactactggaagggccacccggagaagatcatcgactgcatcggcagcctgggcagcatcctgggctccctcggagaggtgtgccactccttcttcggcagcaagatccataccctgcaggacgcgctgtgcaacacccggaccgactgctacggcgacctgctgcgcgagggcgccgccgcctacatcaacgccatcgccgccaagaaggagaagttcgcctacaccgcctaccaggtcaaggagtgcgtcgccgtcgggctcacctccgagttcgccgccgccgcgcaggccgccatgttgaagaaggccaactacgcctgccactactaggaggctaggctaccggccggccgccccagctggtggtcgtcggtggctaaataagtccatatatgcatgcacgtgtcgtgcatgttttcatgcagtttcccggatgcgcgcgcgcgtgtcctccgctatgcctttatgtgtttgcttgccgtttgatgatgcatgccatgccgtctcatatatacgtagtgatgcttaatgctttgcttgcttttcttatcttcgttggtgatgtaagaataatttgattgaggagttattagtgaaagacatagtatgcaaaaaaaaaaa

SEQ ID NO: 6802 - DNA, 1070 bp, Triticum aestivum
  misc_feature (955)..(955): n is a, c, g, or t
  misc_feature (994)..(996): n is a, c, g, or t
  Predicted polypeptide sequence is orthologous to G1646, G715
agacccctcacacctgccgccctgtttttttttttccactgctaattacgatgcacaaaaatatttggagaaatggcgcgacggaaattatcttatcagttagacatgcatgagcatcatacggcctgcctcgatcagaagaacctagccgggttcttctcggatcgaatcacttgtaacatagaggaggcccctcaaataatggcaacatcttaaattattcagcggtgaacaaacaaacataggagagcactaaatcaacagcacaatcttagatgcaagtgggatccgctgtaacatactgcaggtgttactgctgcgggacgtagtagtaccccatgtcggcggcgggcatgccggcggcggggtggggcatcccggcggcgacggccgcctcggcgtccttggcctcgtcccgcggcacgatgtccaccaggaagtcgaagacctcggtgcgggcgatggcggcggcgatgtcggacttctgcagcgtgcggcgcttgttctcctcggcgtgcgcccagccgcggtgggtgagctcgaggatgaacatctcgcaggcccgggcgaagacgacgggcgcctcggcggcgatcatgcggacgtcctcgtcggccttcatgatcttcttgatgcgggcgaggggcaggttgtggttcgggaagtcggtggtggcctcgatctcgcggtactgctccggccagaacacctgcagctgctgctgctgctgcgccgcggcctggtgggaccccgggggaaacgcgggcggggggcgcttggggcgcgtataagggcccccgcgtccggttacccgggggggggggggggccgggttaactggcgccggccgggttaccgtctggccgccccccatcatgcggcccccggggcccgaaggggtgggggacttggggccctactccacgttaaggttcttcggccacacggacgtganggcgcctcaaaccagcgcgcgccagcttatcccacggcnnnccagccccgcgcccagggggcttgttggtcccaggcgcggtcaccctgggctgcgccaccatccgcccggggca

SEQ ID NO: 6803 - DNA, 1028 bp, Triticum aestivum
  misc_feature (8)..(8): n is a, c, g, or t
  misc_feature (10)..(10): n is a, c, g, or t
  Predicted polypeptide sequence is orthologous to G1646, G715
gggagacncnagagcggccgcccttggttttttttttttttttttccaaaagggacaaataactagcttgttgttagtccttagtggacgcaagacatgccatatacttgcacaattacaattacattgcgcgccgtggtaaatagcattgagtatacaatgcgcgcatacagctctggcatcgatcactcggagcttggaggcccaggagggaaaccagctgagccaccatggccccccgtgtacccttgcccttcctcgccgaagctcccggcaccctggtccacgtccggcccgccttgctgccacgccggttcccacgccggaacatgccaggccggcatcatcggtgccgccggctgccccatcggcggatagtagtacggcagcccagcggcggggcccccaccggccgcaccaacccctccggcggcaaacccgagggctgcgctgccgggctcctccttggcctcctcgcgcggcacaatgtcgacgaggaagtcgaagacgtcggtgcgcgcgatggcagcggcgacgtcgttgcgctgcagcgtccggcgcttgttctcctcggcgtgcagccaggagcggatggtgagctcgaggatgaagagctcgcaggccttggcgaagagcacgggcgcctccgcggagatcatgcgcacgtcttcgtcagccttcatgatcttcttgatccgcgccagcggcagctggtggttcttgaagtcggacgccgatgcgcgctccgcctcctggcgctggtacgcccagaaagcctgcagctggggctgctgctgctgaagcaggtggtggtgtggcaccggcggcggcccaggcacgccaggcaccggggctcctccggccgcgccccgtgccggcgggtggggtggtgtagggcaactggtgggtcctccattggcgatctagcttgcgatctgcaaacttaggggaatgtataacctggggcttgggagaatcaaaagaaccccccgtgggtgagacttggagttccttcttggcttcaagat

SEQ ID NO: 6804 - DNA, 832 bp, Triticum aestivum
  Predicted polypeptide sequence is orthologous to G1646, G715
atgaccattaggcctatttaggtgacactatagaacaagtttgtacaaaaaagcaggctggtaccggtccggaattcccgggatatcgtcgacccacgcgtccgtctagcttggcaatggccgcgagggcgtgtcctgctgcttctggttaccgtgtgtgctgaagcatctgacgcgcttgcgccgagcagcaggagctagccgttcatgctcttcttccctccccttggcatctgaagcagtaagagctcaagttcacagagggcgttcgtccgatctacaaagcccagctgtacatcgccttagctagcttgcagatcgcaagctagatagtaatggagaaccaccagctgccctacaccacccagccgccggcaacgggcgcggccggaggagccccggtgcctggcgtgcctgggccaccgccggtgccacaccaccacctgctccagcagcagcaggcccagctgcaggcgttctgggcgtaccagcggcaggaggcggagcgcgcatcggcgtccgacttcaagaaccaccagctgccgctggctcggatcaagaagatcatgaaggccgacgaagacgtgcgcatgatctccgcggaggcgcccgtgctcttcgccaaggcctgcgagctcttcatcctcgagctcaccatccgctcctggctggccgccgaggagaacaagcgccgcacacttgcacgcaacgacgttcgccgctgcattcgcgcggaccgacgtcttcgacttcttccgtgaaatttgtgccccgcgaggaggcccaaggaggagcccggcagcgcagccctcgggtttgccgcccggaaggg

SEQ ID NO: 6805 - DNA, 764 bp, Triticum aestivum
  Predicted polypeptide sequence is orthologous to G1660
ttttttttttttttttttttttttttttttttttttagcattacctcatgttatcaatggtaacgtgctactgtagctcaggtcatagccattcagattgtacagactacacagcaaaccaaaatctgcagcacaccgattcaaataattgcatgtgcatcttgtcccacggcttgcatcgagacattcaagcttcttcagtgagattgcatttcagacgcaatctgaaatttgtttggttttcagcacaggaaccagttgcaacactggaaccgggacggcacgtgtccggtcttccagatgcgctccacctgtcgcgccaaccagactgcctgctggtcccgtctcacctcgaccctcacttgcttcccctccaccttgtgcctcaatgtgggaagcctcttggtgaagttgttcttcacccccgccttctcggcctgcacctgaaataaaatttgcacaattacaaccagctgagatttgtttcagtcttatctggacggtgcaacaagttcatggatgctgagctctgcattcatcttggcttcgaatttggatttctggcagttctcccactcctgtatcgtcacctccttcctttgatatctgatccatcatgaccaaaacaacacaagattcagaagaaaatacgtggagattttgttcgtgacttgatgcaagtttacacttcttggactctgctcatgccgcaactcgagcttcaaactcctccttcgcctcgtattctttgccggcgctcttct

SEQ ID NO: 6806 - DNA, 397 bp, Triticum aestivum
  Predicted polypeptide sequence is orthologous to G1660
cagaacgacagttggcggttacagacctgtacaaacatttcctccaacttcaggactacaatgatagggtcaaaacagctgaacagaggctgcagtctctcgttgatgctgccttggtcgagctcgacatggccgaagatgctactaccagagatggctcgatgtacgagaacggcgtgctttgaacacccaactgccatgggtttgtgtggttgctgatttgttagatttgtagtttgcgtctgccatgtaatagaactgcattgtaactagaaacaggaaaaatgttgtgtaagggtcggagaatctgctgtcgtggtccctgagcccggatttctctttcgaagttggattcattaaccggcctgattattcctgataccgtaaaaaaaaaaaa

SEQ ID NO: 6807 - DNA, 345 bp, Triticum aestivum
  Predicted polypeptide sequence is orthologous to G1666
tagcgtggtcgcggccgaggtacaacaaaactacagcagaacagctagcaggaggtagcagcaactcaaagaagccttcaggtgtttcttcatgcatttgcaggcactttctcttgagctcgctcatgtcctctctttttataccagcagtgctgccctgaacttcagacttttcagaatgaggcccatgcagacgactctgcaccagcagcaacataagcgaacggcgacgacagccctggaggagcaggagcagccgagccgccctgctcaatgattccatagtgcaccaggagccgcgtgatcagcacgccggcgacgtacctgcccgggcggccgctcgaa

SEQ ID NO: 6808 - DNA, 1150 bp, Triticum aestivum
  misc_feature (1066)..(1066): n is a, c, g, or t
  Predicted polypeptide sequence is orthologous to G1730
ttatgctccaacgcgttgcgagcctctcatatggtcgacctgcaggcggccgcactagtgatttcgagcggccgcccgggcaggttgaaactattaccaactatttttatttttttgcaaacatattccagaaacttttactgactatagtaagcctttggagttaaattccagtaaaacattgtctcaacaaacaagatggagagattccaggatatataaatgttctaaaaaaaaaaaggccaccacagcatcaaacgttatgatgaaagagagaagtggaaccaacatcacccatcatctaactggattttgtgtagacattgcaagtaaaaatgatgattcaatttgttccaaacttataggaaactaaaccacaccgggcagaaaatcaaatcacagaaagtgatcaagcctaacatcgcagcatacatgcgagaattgtggacaggtgcatgattcagatgaatatatcaatgcgtaatctgaaatgccagtgcccccagcccagtttaatctcaagcattgccacagaagaaaaagggtcagcttctactcaaacacaacttactgctacgcaaaagcacaagggcaagaattccagggtaacaagtaacggcacaggatgccacttagcatttcaaaagtctggaggcttagattgacatcttctaacagaacagaaacaatcttcgacatagctcgcagaggaagcaggttacgctgtagggacttgcactgcacgagcttccaaagcagggaacaataaagctcagcgccctcggccgcgaacacgctaatcccgcggccatggcggccgggagcatgcgacgtcggccccaattcgccctatagtgagtcgtattacaattcactggcccgtcgtttacaacgtcgtgactgggaaaaccctggcgttacccaacttaatcgccttgcagcacatcccccttcggcagctggcgtaatagcgaagagcccgcaccgatcgcccttcccacagttgcgcagctgaatggcgaatggacgcgcctgtagcggcgcattagcgcggcgggtgtgttgntacccgcacgtgacggtaaatttgcaggccttacggccgctccttcgtttcttccctccttctcgccaggttgcggggtcccga

SEQ ID NO: 6809 - DNA, 1079 bp, Triticum aestivum
  misc_feature (815)..(815): n is a, c, g, or t
  misc_feature (883)..(883): n is a, c, g, or t
  Predicted polypeptide sequence is orthologous to G1758
ggttacttcgacccacgcgtccgcgactggagcacgaggacactgacatggactgaaggagtagaaaaccaaccctccctttcccttcacgagcctccccaagcaccaaaccgacaggagtggtcgtccgcttcaactccgactgtttcggccgccgccaacctccggtcgattctgacgcaactagggactcctccctctctttatctctaccattagaatctttgtggtccctctaacccaccccactcgtcattttttctcgggaagtgtcgtaggcaaaatccccgatttggctccgccggaacatctcgggagagctcgccgctggcggctacgtccctcccagagactgttgcgcacctccacctgaccgctacgagtccctaagaatgatggtgcggtcttcttccgtcgccatgcccccaatcaccggcgagggtcgtcaagagcccctcctccgctcggccagaggagggagaaggccggtttgaccagggccaaacccgaccgaaggtccccgcgcgtcagtgactagggcgtgcctgagccatcctaagtgatggcatatttcggaaagaaaatggagggaagattatttttacaaacttttggagtgcacccaactcttctacatcaccaagatttacgattcagagaggagtactacgaagacaccccgcaacctagaaaatggagatagcagccacgtgagatagaagttagccaggccagttgttcctgtgggaatggagttccatcaacgttggagatcgacgagtcgctttcgtcatccaccactagagatcattgtnatactcgatgggcctttatatggtcttgtacccaaattcttctaaactgtttgaaatctgtatcaggnaaatgttcaccagcaaaaaaaaaaaaaaaaagggcgccgctctagagtatcctcgaggggcccagcttagcggtaccagctttcttgtcaagtgttcctatattgattcgatatagctaggccggccgctgttaaacgtcggactggaaaatgtaacttggattttgtaaggaccctattctggggggactaatga

SEQ ID NO: 6810 - DNA, 803 bp, Triticum aestivum
  Predicted polypeptide sequence is orthologous to G1760
acctgctattgcgattaaggcctatctaggtgacttgattgaacaagtttgtacaaaaaagcaggctggtaccggtccggaattcccgggatatcgtcgacccacgcgtccgcccccgttctggctggatggtggccggagctcgcggaggactcgagatatgcatgtggcggcaccgagcatgaggcaacaactgcattacttgcggggaaggcgcaagtaggacacctgcattacttgcaaacaaggcgcaaaattaatagaagatcaccatacttgtggctttcttgcaagtcgtgcagttgctgcctcaagcttgctgcctccctttgccaaagctatcagaaaaaacataaagttctgttagtttccctaaactttaaaaacataaagttctgttagtttccctaaactttaaaacatgttctacaaaattgatctagaaatgattggcttactgtgctaatttaaagcaatataattactcgacaactgcatatgcacatgttagaagcaaggcagtagaatacttatgttttcatctactggcaggtagcaacatgtatagatatatcactctgaattgagttatggaccaaacattaagaattgctcactttgttggcacatcgcatctgtgaaattgcatataaatttatgtatagccagtgctctcagggtatgaattcaaatattttggtgaaaacagaattgctgctgtaataattttaaaaatattatgcacacggaggatttttagtgtaatggtgtggctgcacacctataagcctccacttgcccta

SEQ ID NO: 6811 - DNA, 616 bp, Triticum aestivum
  misc_feature (266)..(266): n is a, c, g, or t
  misc_feature (424)..(424): n is a, c, g, or t
  misc_feature (527)..(527): n is a, c, g, or t
  Predicted polypeptide sequence is orthologous to G1767
ctagcccacagtgcaccatcctcccagtagcagcaagccgtccaccgcggcaggagcagcagcggcaccgaggagaagcagcgccgtcaaccaccaccggatagatgcagcagcaccttccaccagtgaggagaagcagtaccgtcagccacggaggatccaccgtggtttcctgctgatcttctttcctccgcccagcctacaaaattaaagaggggagatcgggatgctgcgcgccgcgccctgcttggatctgatggagcggnggagatagtggtcggggcatgggatggcgccttcgtcgtcagaccattgggattcagcatatttctgcagtcttctttagagatcaggagggttcgattcaacacaattccgggcttgggttcctgtcgaacaaaatcatctcgacagcattcctctntcttgcttcttattagtcaaactctgaaatcaatttctatattttagtgggtacttaattgatttgataggctatatctacgtgtgatgcatcaactaggctntgtaaatggatacatagggttttctggttattttcttcaataattatgtgttcccatttctcccaaaaaaaaaaaaaaaaaaaattcct

SEQ ID NO: 6812 - DNA, 651 bp, Triticum aestivum
  misc_feature (635)..(635): n is a, c, g, or t
  Predicted polypeptide sequence is orthologous to G1777
gttgaagcagttacttctacaataaattgcaatttgcagcacaaatatagtagaacatctctacagttctctcccaaaaagtcatcttcttgctcaacaggtagatttagcattataggaactatgcacaacggcatcatgtcatgtcatgatatacaagaggataagttgaaagtttgcttgctctattggtcgggatcacagccccagggcgaggttgcagcgcaagcaagcgccccaaggcaacaaaagagaacacagattcctttatgtagctgaagaaacacaggtcagctgtacagttgcagcggaatgttccgtcagatactggagcttcagatcttgtccgccacttcggctggcacgttgagatcaaaaagagcaccgccgccatgagcatctcttctttctctcttgtgagacgggcgtccactgttgtcagaacttgatccgtgcatctgaataataggtcgctttcccgtgagggacgagcctgattcgctacataaaccaagctgactcttgtgttcatcctgactacacttcatagatggcgaactttgttcagcagagtccacacaaatgtggagctctgaggctctatcaagacccttggatttgtatggggccatatnatgaggcgtgcggaga

SEQ ID NO: 6813 - DNA, 1174 bp, Triticum aestivum
  misc_feature (3)..(4): n is a, c, g, or t
  misc_feature (8)..(8): n is a, c, g, or t
  misc_feature (17)..(17): n is a, c, g, or t
  misc_feature (25)..(25): n is a, c, g, or t
  misc_feature (141)..(141): n is a, c, g, or t
  misc_feature (708)..(708): n is a, c, g, or t
  misc_feature (716)..(716): n is a, c, g, or t
  misc_feature (733)..(733): n is a, c, g, or t
  misc_feature (739)..(739): n is a, c, g, or t
  misc_feature (750)..(750): n is a, c, g, or t
  misc_feature (756)..(756): n is a, c, g, or t
  misc_feature (776)..(776): n is a, c, g, or t
  misc_feature (824)..(824): n is a, c, g, or t
  misc_feature (838)..(838): n is a, c, g, or t
  misc_feature (848)..(848): n is a, c, g, or t
  misc_feature (860)..(860): n is a, c, g, or t
  misc_feature (862)..(864): n is a, c, g, or t
  misc_feature (867)..(867): n is a, c, g, or t
  misc_feature (881)..(883): n is a, c, g, or t
  misc_feature (891)..(891): n is a, c, g, or t
  misc_feature (893)..(895): n is a, c, g, or t
  misc_feature (903)..(903): n is a, c, g, or t
  misc_feature (916)..(916): n is a, c, g, or t
  misc_feature (922)..(922): n is a, c, g, or t
  misc_feature (927)..(930): n is a, c, g, or t
  misc_feature (936)..(938): n is a, c, g, or t
  misc_feature (940)..(940): n is a, c, g, or t
  misc_feature (943)..(943): n is a, c, g, or t
  misc_feature (947)..(947): n is a, c, g, or t
  misc_feature (952)..(953): n is a, c, g, or t
  misc_feature (956)..(957): n is a, c, g, or t
  misc_feature (962)..(962): n is a, c, g, or t
  misc_feature (964)..(964): n is a, c, g, or t
  misc_feature (969)..(969): n is a, c, g, or t
  misc_feature (977)..(977): n is a, c, g, or t
  misc_feature (981)..(983): n is a, c, g, or t
  misc_feature (985)..(986): n is a, c, g, or t
  misc_feature (990)..(990): n is a, c, g, or t
  misc_feature (992)..(992): n is a, c, g, or t
  misc_feature (995)..(995): n is a, c, g, or t
  misc_feature (1001)..(1001): n is a, c, g, or t
  misc_feature (1005)..(1005): n is a, c, g, or t
  misc_feature (1007)..(1007): n is a, c, g, or t
  misc_feature (1009)..(1009): n is a, c, g, or t
  misc_feature (1011)..(1011): n is a, c, g, or t
  misc_feature (1013)..(1013): n is a, c, g, or t
  misc_feature (1016)..(1016): n is a, c, g, or t
  misc_feature (1018)..(1019): n is a, c, g, or t
  misc_feature (1022)..(1022): n is a, c, g, or t
  misc_feature (1025)..(1026): n is a, c, g, or t
  misc_feature (1029)..(1029): n is a, c, g, or t
  misc_feature (1031)..(1031): n is a, c, g, or t
  misc_feature (1035)..(1037): n is a, c, g, or t
  misc_feature (1042)..(1042): n is a, c, g, or t
  misc_feature (1046)..(1046): n is a, c, g, or t
  misc_feature (1049)..(1049): n is a, c, g, or t
  misc_feature (1054)..(1055): n is a, c, g, or t
  misc_feature (1057)..(1060): n is a, c, g, or t
  misc_feature (1068)..(1070): n is a, c, g, or t
  misc_feature (1075)..(1082): n is a, c, g, or t
  misc_feature (1094)..(1095): n is a, c, g, or t
  misc_feature (1100)..(1100): n is a, c, g, or t
  misc_feature (1104)..(1105): n is a, c, g, or t
  misc_feature (1108)..(1108): n is a, c, g, or t
  misc_feature (1113)..(1113): n is a, c, g, or t
  misc_feature (1120)..(1120): n is a, c, g, or t
  misc_feature (1123)..(1126): n is a, c, g, or t
  misc_feature (1128)..(1129): n is a, c, g, or t
  misc_feature (1132)..(1134): n is a, c, g, or t
  misc_feature (1139)..(1143): n is a, c, g, or t
  misc_feature (1146)..(1152): n is a, c, g, or t
  misc_feature (1154)..(1157): n is a, c, g, or t
  misc_feature (1160)..(1161): n is a, c, g, or t
  misc_feature (1164)..(1165): n is a, c, g, or t
  misc_feature (1173)..(1174): n is a, c, g, or t
  Predicted polypeptide sequence is orthologous to G1789
tgnnatgntgttttganccctattnaaccctcactaaagggaacaaaagctggagctccaccgcggtggcggccgctctagaactagtggatcccccgggctgcaggaattcggcaccagatcagggcttctgaagtgcanaaacttcagcgctaactgagctcggtttccgagaaacatactaccaattccgatccaggttgagatgtcagggagctcatcccgcggcggcgacgacgcggcgtggagcgccaaggagaacaagctgttcgaggaggcactcgcctaccacggcgagggcacgcccgaccgctggctcaaggtgtctcgcgccatgggcgggaccaagacggccgacgaggtgcgccgccactacgagatcctcgtggacgacatcaacctcatcgagtctggcagggtcccgttccccaagtacaaggacaactgattcctcatggagcgaagcatctgaattctgaagatccggcaatcaggagaacctgtttataatctagtccttagttgggaccatgttactgaagcaataaaaagaagaaaacatgtgtgtgtgtgtgtttgtttgtgtgtgtgtgtgtgtgtgtgtgtgtgtaattttaggtttgtaagcaaatcaagtgcgcctagtcttgcatacagtaccatgtaatttccgtgcctatacttagcttttactccttcagtcctctncaatatgntttggagtaaacatcantggtgnaaatccccggnacttgnttgcaatggttatgaacccntgcttgtacaatatacatgctttgctaaaaaaaaaaaaaaaaaacttnagggggggcccggncccaaattgncctatagggagncnnnttncaattaatggccgnnntttacaangnnngaattggnaaaacctggggtncccaanttaannnnctttgnnnanatncccnttttnncannttggngnaatancaaaaggncccnnncnnatgncnttncaaaanttgncnancntnaangnnaanggnnaantntaannntaaantttngtnaaaanncnnnnaaaatttnnnaaaannnnnnnntttttaaccaannggccnaaannggnaaaanccctttnaannnnannaannnccccnnnnnggnnnnnnntnnnnccnnttnnaaaaaaann

SEQ ID NO: 6814 - DNA, 690 bp, Triticum aestivum
  Predicted polypeptide sequence is orthologous to G1789
ccacgcgtccgccaaagcttctccaagagcaaaggacttcctcaattccacaggagcaccccaggcacaagaaagtagtgttattagttcgagtagaacatcacatctcacctgaaagatgtcttccgggtcgtcgtctcggagcacctccccgagctcagactcggagtggagcaaaaaggagaacaagatgttcgaggaggcgctcgcctactacggcgtgagtgcccccaacctctgggagaaggtggccagcgccatggggggcaccaagtccgccgacgaggtgcgccgccacttccagatccttgtcgatgacgtcaacagcatcgagcatggccgcatcccattccccaagtacaagacccagggcttctggaccaaataaaaggatcgatgaagcagtgtaagctccagtggacagtgaacaaagttctagaaaatagatctcttaagaatgggctgatgttctaggaggaagcaagggtatccagcattggttagaataacaggaaggaatagagtattgtctattgtgtggacaaagtattgttaggccctgtccaaggttaagtcttttagattctcgtctacattcatgaaccggatgttgttcattatctcctcgaaccaagtcgtcaaataaaatgtcatgtaaactcatgtgtttgtgttatttgtagaagttta

SEQ ID NO: 6815 - DNA, 1068 bp, Triticum aestivum
  Predicted polypeptide sequence is orthologous to G1789
gagccaaagcggccgcccttttttttttttttttttttttttttttttcctttttttatttttttttttttttgtttgttggcatcatcatcaatttcttttctctttggatgggtagggacatattgttacatgtgcagacaatataaatattgtacattaaaatacatacgaaataagttaaacccatgcagcaaggaaacaggacgatcccgccataaaccacttgctactgaagtattatgaacatgcatgcatctgcatagccttgcatgggtacgttgacttggacaccatgcacgaaacttatctcatgcacatgcacatgcttccagttccatcgatctatgtggggtgtatcattcattgtccattgccgcctaaatcttcaagtgcttcaacctgtcggcctcgtaaccggcgttgtggcccgggcctgggcagggggaacggtaggcggggaaggccaccttgccggcctcaatgcgggcgatgtcgtggacaaacagctcgtaatagcgtttgacatcgtcggccgatttgccgccaccaacggcacgagcgacgttgtgccagcggtcgggcgtgtcccggtcatgcactggcagtgcctgctcaaacagcttgttctgttggggggtccatccagccctcccggccgggctcattgacagcgacgccattgctcgatctacctagctgggattgggcttatgatgttggtaccgtgaacccgttggttgcacagggctgcttctgaaatggattttcaactccttcagtccatggtagtgtccccgggtcccaatgccccaaccttccggggagcgtgggttaacaaattcccgggaaatcccgaacgggacccacctggttttttggtaaaaaccgtgtcctaaaaggccccccaaaaatggccaaagggccaaaccggtccccggggtgaaaattggaaacccccccccggcccaaggctaaaaatcccggggggtggactcggcccgggttttttttatggggggcaaacaacgcgggggatgggttcctcaggggaattgggacggttcc

SEQ ID NO: 6816 - DNA, 1141 bp, Triticum aestivum
  Predicted polypeptide sequence is orthologous to G1789
tgcgacccacgcttccgcccacgcgtccggactggagcacgaggacactgacacggactgaaggtagtagaaaaccaaaccaaaccaccagcgcttctacaagagcaaaggactacctcacttccaggagagcaccccaggcacaagaaagtagtgttcttagttcgagtggaacatcacatctcacctgaagatgtcttccgggtcgtcgtctcggagcacctccccgagctccgactcggggtggagcaagaaggagaacaagatgttcgaggaggcgctcgcctacgacggcgtgagcgcccccaacctctgggagaaggtggccagcgccatggggggcaccaagtccgccgaggaggtgcgccgccacttccagatccttgtcgatgacgtcaacagcatcgagcatggccgcgtcccattccccaagtacaagacccagggcttctggacctaataaaaggatcgatgaagcagtgtaagctccagtggacagtcaacaaagttgtacaaactagatctcttaagaatgggccgatgttctaggaggaagcaagggtatccagcattggttagaataacaggaaggattggagtattgtctattgtgtggacaaagtattgttaggccctgtccaaggttaagtctgttagattctcgtctacattcatgaactgcatgttgttaattatcccgtggaaccaagtcgtcaaataaaatgtcatgtaaactcatgtgtttgtgttatttgtaagaagttgtacctgtagcaaaaaaaaaaaaaaagggcggccgctctagagtatccctcgaggggcccaagcttacgcgtacccagctttcttgtacaaagtggtccctatagtgagtcgtattataagctaggcactggccggtcgtttacaacgtcgtgactgggaaaactggtaccttgggatctttgtgaaggaaccttattcggtgtgggacataattggccaactacctacggaaattaaggcctaagggaaatttaaattttaagtgtttatgtggtaactagctgcattgcttgcggttgaaagtttgcctccgggtttattttgaaatttttacccggagcgggggcctattggtggggtttaaattcaagcccag

SEQ ID NO: 6817 - DNA, 832 bp, Triticum aestivum
  Predicted polypeptide sequence is orthologous to G1789
acgctatgacattaggcctatttaggtgaactatagaacaagtttgtacaaaaaagcaggctggtaccggtccggaattcccgggatatcgtcgacccacgcgtccggcctgagccgatgcccaaaccaggtccaagcatccaagcatagttcaggtcataacttaaggtatataatagcagctgattgatcaaggaaccaatagtcgagtgacatccatggcttctctgtcgatgagcgcggggtggacgccgaagcagaacaagctgttcgagcaggcgttggcggtgcacgacagggacacacccgaccgctggcacaacatcgcccgtgctgtcggggggcggcaagtcggcggacgatgtcaggcgctactacgagctgctcgtccacgacatcgcccggatcgaggccggcaaggtgtctttccccgcctaccgtccaccatgccccggccccggccacaacgccagctacgaggccgacaggttgaagcacttgaagatctagctaggcggtaatctggtaatggccaagggatgatacacaatacacagatggactgaacgaagaagcatgtgcgtgcatgggggtaccttgtaatactcataagcgtgtgcatggtgtccatgactccatgtcaatgtatacatgcactactagccggcagaaaagttggccgattatgcagatgcatgcatgttcataatactctagtggctagtggtctataagtatgtacgtgagatttactcacatgggtttaacttatatcctatgtatctaatgtacaatattaataatatcctttatattataaaaaaaaaaaaaa

SEQ ID NO: 6818 - DNA, 833 bp, Triticum aestivum
  Predicted polypeptide sequence is orthologous to G1789
aaagctatgacattaggcctatttaggtgaactatagaacaagtttgtacaaaaaagcaggctggtaccggtccggaattcccgggatatcgtcgacccacgcgtccgcggagcttcggaagtgcaaaaaccatcagaaaaagcatcagcgctagctcggtttccgatccagttggagatgtcttctgggtcaaggagcgcatcccgcggcggcgccaacccggagtggagcaagaaggagaataagctgttcgaggaggcactcgcctactacggcgagggcacgcccgaccgctggctcaaggtgtcccgcgccatgggcgggaccaagaatgccgacgaggtgcgccgccactatgagatccttgatagcgacatcaagctgatcgactccggcaggctccctttccccaagtacaacacccagggccagggggcttggaactgattcatcaatcaaggagaaaagcttctgaattctgaagatcctgcaaacacgataatctgttcataatcaagtccttagctgggaccatgttattgaagcaagcataattatgtaccgtaaaacaaagattatgagcacttggttaggaataaaagaaaaaacatatgtgtgtgtacataatattaggtttgtaagcaaatcaagttcgcttggttttgcagacggaagcatttatttttcattgtggaacagaatactcctccccaataagttttggggtaaacatcattggagtaaatccccagtactctccgtactccctttaagaaattggggctcaaaaaaaattcatgtttggtcaaaaaaaaaaaaaaaaaaaaaaaaa

SEQ ID NO: 6819 - DNA, 805 bp, Triticum aestivum
  Predicted polypeptide sequence is orthologous to G1789
gcaggtcggtaccggtcccgaattccctagatatcgtcgacccacgcgtccgcggacgcgtgggcgactggagcacgaggacactgacatggactgaaggagtagaaaatccatctcagaagcagccctgtgcaaccaacgagttcacggtaccaacatcataagcccaatcgcagctaggtagatcgagcaatggcgtcgctgtcaatgagcgcggccgggagggctggatggacgccgcagcagaacaagctgttcgagcaggcactggcagtgcatgaccgggacacgcccgaccgctggcacaacgtcgctcgtgccgttggtggcggcaagtcggccgacgatgtcaaacgctactacgagctgctcgtccacgacatcgcccgcatcgaggccggcaaggtggccttccccgcctaccgttccccctgcccaggccccggccacaacgccggctacgaggccgacaggttgaagcacttgaagatctaggcggcaatggacaatgaatgatacacaccacatagatcgatggaactggaagcatgtgcatgtgcatgagataagtctcgtgcatggtgtccatgtcaacgtacgcatgcaaggctatgcagatgcatgcatgttcataatacttcagtagcaagtggtctatggcgggatcgtcctgtctccttgctgcatgggtttaacttatctcgtatgtattctaatgtacaatatttatatcgtctgcacatgtaacaatatgtccataccaatcaaaagagaaaagaaattgatgatgatgcaaaaaaaaaaa

SEQ ID NO: 6820 - DNA, 645 bp, Triticum aestivum
  misc_feature (49)..(49): n is a, c, g, or t
  Predicted polypeptide sequence is orthologous to G1804
tattaaagtgctattacacataaacatattgctaactttcttttgttcnttttcctgaagtttctgacaaacctatatacctataaacagtaacaacaacataagttcacttgcttgaccagaaaaacactgacatttgggtccttatgggttttaggtactactagtaaattacgataccaccccgctctagaaaggaaaggtaaccattattcattctcatcctcctgccagcatgactatggaagctgaatggtgggtcacctatcaccagatgcagctagcgcagcgccgcgacagggtgccacccttcttggtgttcacattttccttggactgctccatcatcttctccactagcatttgtttcttggtcagcaaaatcgtcttctcctcagctttcagacgagcgttctcctccttgaggtggtttagtttggcttcaagctccttggtataagcctgcttcctgccacacgattgtgcggctgactcatggttcttgatcatgtggtggtggcggcgctcgatgctcccctcacaggactgatcctccggagcgccgcgcttccgcgcgccgctgttatccatcatcgttttgtcgcccatacagttcatcatgtcaacctccatcatggtgctcct

SEQ ID NO: 6821 - DNA, 667 bp, Triticum aestivum
  Predicted polypeptide sequence is orthologous to G1804
gaggaattcggacgaggggagtcgttctccttgcctcccccgctgtgccggaagacggtggaggaggtgtgggctgagataacagggagccccgcccggtgcatgcccagcctcaggccgcgcgaccctcacagcagcctcctgtccagccaccggttgtggccaacgaccggcaggggaccctaggcgagatgacgctggagcagttccttgtcaaggccggcgtggtccgtggatctggcaccggcgtccaggcgcctatgccggtcggcatggtccatggacagatgaaccccgtgcagcaggggcagcagcctggcccaatgatgtacccgatggcaccagccaacggtatattccaggtgatgggcgacgacatggggttcatccccaacgggtacgcggggatggccgtggtgccgccgccaccacctcctcaaggtggggtcggtatcgtgagccccgggtcgtcggacgggaggagcgccatgacgcaggctgacatgatgaactgcatgggcgacgtagtgatgatggagaatggtggcgcccgaaaacgtggcgccccgaaggatcagtctcgcgagaggagcatcgagcgccgccaccgccgcatgatcaagaaccgtgagtcagccgcacgatcgcgtgccaggaagcaggctta

SEQ ID NO: 6822 - DNA, 1582 bp, Triticum aestivum
  Predicted polypeptide sequence is orthologous to G1804
aaaagaaggaagattctcatgtccagagcccatcaccaaaggctataaatagagagcgtggcgcacaagactgaaccacacacaccacaaccaccaagcaagagcgtacgtagatagtggtgaggagagataggatggcgtcggagatgagcaaggatgtgaagttctccgaggaggaagtcacctcacacccgcgcgttctcgaaggtgaggagcaggcggttgcgccggcgcggcagtcttccatcttcgcgctgacgctggacgagctgcaatactcggtgtgcgaggcagggcgcaattttgggtccatgaacatggacgagttcatgagcaacatatggaatgccgatgagttccaagcagcgaccggcggtggcttggtgggcatggaggtggctcctgtggtaggtgctggtgggggcggaggtggccttgatgcaggaggaagcaacctagcccggcaggagtcgttctccttgcctcccccgctgtgccggaagacggtggatgaggtgtgggctgagatcaacagggagccccgcccggtgcatgcccagcctcaggccgcgcgaccctcacagcagcctcctgtccagccatcggttccggccaacgaccggcaggggaccctaggcgagttgacattggagcagttccttgtcaaggccggcgtggtccggggatctggcgccggcggccaggcgcctgtgccggtcggcatggtccatggacagatgaaccccgcacaacaggggcagcagcctggcccaatgatgtacccaattgcaccagccaatggcatgttcccggcgatgggcgacggcatggggttcatccccaatgggtatgcagggatggttgtggtgccgccgccaccacctcctcaaggtggggtggtgggtatcgtgagccccgggtcgtcggacgggaggagcgccatgacgcaggctgacatgatgaactgcatgggcgaaggagcgatgatggagaatggcggcacccggaaacgcggtgccccagaggatcagtcttgcgagagaagcatcgagcgccgccaccgccgcatgatcaagaaccgtgagtcagcggcacgatcgcgtgctaggaagcaggcttataccgtggagcttgaagctgaactgaaccacctcaaggaggagaacgctcgtctgaaagccgaggagaagacaattctgctgaccaagaaacaaatgctggtggagaaaatgatagaacagtccaaagagaacgtgaacgccaagaagggtgcccccctctcgcggcactgcggcagctgcatctggtgaaaggtgacccgccatccagcttccatagccgtgctcgcaggaggatgaggaggaattgtggtgtttaagcggggtcgtatagtaatttactagtagtacctaaaaccataaggacccgaatgtcagtgtttatctggtcaagcaagtgaactttgttgttgttactgttcataggtatatgggtttgtcagaccttcagacaaatggaacaaaagatgattagcattaaaaaaaaaaaaaaaaaaaaaaaaaaaaaaaaaaaaaaaaaaaaa

SEQ ID NO: 6823 - DNA, 1332 bp, Triticum aestivum
  Predicted polypeptide sequence is orthologous to G1804
cgcgctgacgctggacgagctgcaatactcggtgtgcgaggcagggcgcaactttgggtccatgaacatggacgagttcatgagcaacatatggaatgccgaggagttccaagcggccaccggcggtggcttggtgggcatggaggtggctcctgtggtgggtgctggtgcaggcggaggtggcgcagatgcaggaggaagcaacctagcccggcaggagtcgttctccttgcctcccccgctgtgccggaagacggtggaggaggtgtgggctgagatcaacagggagccccgccaggtgcatgctcagcctcagggcgcgcgagcctcacagcagcctcctgtccagccaccggttgcggccaacgaccggcaggggaccctaggcgagatgacgctggagcagtttcttgtcaaggccggcgtggtccgtggatctggcgccggcggccaggcgcctgtgccggtcggcatggtccatgcacagatgaaccccgtgcagcaggggcagcagcctggcccaatgatgtacccgatggcaccagccaacggcatgttccaggtgatgggcgacggcatggggttcgtccccaacgggtacgcagggatggccgtggtgccgccaccacctcctcctcaaggtgggatgggtatcgtgagccccgggtcctcggacgggaggagcgccatgacgcaggctgacatgatgaactgcatgggcgacggagcgatgatggagaacggcggcgcccggaaacgcggcgccccggaggatcagtcctgcgagaggagcatcgagcgccgccaccgccgcatgatcaagaaccgtgagtcagccgcacgatcgcgtgccaggaagcaggcttacaccgtggagcttgaagctgaactgaaccacctcaaggaggagaacgctcgtctgaaagctgaggagaagacaattctgctgaccaagaaacaaatgctagtggagaagatgatagaacagtccaaggagaacgtgaacgtcaagaagggtggcaccctctcgcggcgctgcggcagctgcatctggtgaaaggtgacccgccatccagcttccatagccgtgctcgcaggaggatgaggaggaattgtggtgtttatagcagtaacattatctttccggagcggggtcgtataataatttactagtagtacctaaaaccataaggacccaaatgtcagtgtttatctggtcaagcaagtgaacatttgttgttgttactgtttataggtatatgggtttgtcagaacttcagacagatggaacaaaagaaaattagaaatatgttgatgtgaaaaaaaaaaaaa

SEQ ID NO: 6824 - DNA, 582 bp, Triticum aestivum
  Predicted polypeptide sequence is orthologous to G1804
ccacgcgtccgggatgaactgcatgggcgagggaacgatgatggagagtggcggcacctggaaacgcggggccccagaggatcagtctgcgagagaagcatcgagcgccgccaccgccgcatgatcaagaaccgtgagtcagccgcacgatcgcgtgctaggaagcaggcttataccgtggagcttgaagctgaactgaaccacctcaaggaggagaacgctcgtctgaaagctgaggagaagacaattctgctgaccaagaaacaaatgttggttgagaagatgatagaacagtccaaggagaacgtgaacgccaagaagggtggcaccctctcgcggcgctgtggcagctgcatctggtgaaaggtgacctgccatccatccatagccgtgctcgcaggaggatgaggaggaattgtggtgtttatagcagtaacattttctttcccgagcggggtcgtatagtaatttactagtagtacctaaaaccataaggacccgaatgtcagtgtttatctggtcaagcaagtgaacttctgttgttgttactgtttataggtatatggatttgtcagaaagaaa

SEQ ID NO: 6825 - DNA, 1098 bp, Triticum aestivum
  Predicted polypeptide sequence is orthologous to G1821
gcacgagcaagtgcgagtgcgactacctgcattgcaccttggctagccctagacatggagaacgacggcgtccccaacggaccagcggcgccggcacctacccaggggacgccggtggtgcgggagcaggaccggctgatgccgatcgcgaacgtgatccgcatcatgcgccgtgcgctccctgcccacgccaagatctccgacgacgccaaggaggcgattcaggaatgcgtgtccgagttcatcagcttcgtcaccggcgaggccaacgaacggtgccgcatgcagcaccgcaagaccgtcaacgccgaagacatcgtgtgggccctaaaccgcctcggcttcgacgactacgtcgtgcccctcagcgtcttcctgcaccgcatgcgcgaccccgaggcggggacaggtggtgccgctgcaggcgacagccgcgccgtgacgagtgcgcctccccgcgcggccccgcccgtgatccacgccgtgccgctgcaggctcagcgcccgatgtacgcgcccccggctccgttgcaggttgagaatcagatgcagcggcctgtgtacgctcccccggctccggtgcaggttcagatgcagcggggcatctatgggccccgggctccagtgcacgggtacgccgtcggaatggcgcccgtgcgggccaacgtcggcgggcagtaccaggtgttcggcggagagggtgtcatggcccagcaatactacgggtacgggtacgaggaaggagcgtacggcgcaggtagcagcaacggaggagccgccattggcgacgaggagagctcgtccaacggcgtgccggcaccgggggagggcatgggggagccagagccagagccagcagcagaagaatcgcatgacaagcccgtccaatctggctagtcgcgtgcgcggcgcgcgttagcttctgcgtcctgtgtactgtaataatttgccgtgtcgatccggccatggtttgtgtgtgcgtagtgcttatctaatgtgggcttgtcctctagtaattcatgtattgcttatctaatgtggacttgtcctctagtaattcatgtactctttgctgttgaaaaaaaaaaaaaaaaaaaa

SEQ ID NO: 6826 - DNA, 658 bp, Triticum aestivum
  Predicted polypeptide sequence is orthologous to G1850
gagggcggttgacccgcgagctggggcagatgaaaaagctgtgcaacaacatcgtgagcctcatgtccaagttcgcctcgagccagcagccggacggcggccccgggtcgctgtcgtccgtagtaaactgctcgggtgagtcggcgctggcgcctccgccgccgctccccgcggggatactggacctgatgccatcctgctcggcgctggccacggccgccggcctcgccgtcgacggcgggccggatacggacgcgaggctgttcggcgtctccatcgggctgaagcgagcgcgagacgaggaagaaggcggcgacgggggggagcttcctaacagcaacgacgacggcgcggacgtgaagccggaggaggcagcggagcggcggcccgagggcggcggcagcgaggagcggcagtcgtggccgatataccggcccaagcccgtgtaccgggcctgcacgggcaggacggggccggctccgggtcagaccaggacagatccaactcgaggtgagtggacgatgttgtagaagcttcgagcacctactaattattaatcaccaccaaataataatactgtaagcatcactagagtcgtgataggatcttgcattactttgctaggctggtggggagctcggctgccccctctacccct

SEQ ID NO: 6827 - DNA, 504 bp, Triticum aestivum
  misc_feature (271)..(271): n is a, c, g, or t
  misc_feature (274)..(275): n is a, c, g, or t
  misc_feature (492)..(492): n is a, c, g, or t
  Predicted polypeptide sequence is orthologous to G1850
gccggacggcggccccgggtcgctgtcgtccgtggtgaactgctcgggcgagtcggccctggcccctccgccgccgctccccgcggggatactggacctgatgccatcgtgctcggcgctggccacggccgccggcctcgccgtcgacggcgggccagagacggacgcgaggctgttcggcgtctccatcgggctcaagcgagcgcgagacgaggaagaagacggcgacggcgaggagcttcctaacagcaacggcgaaggcgccgacgtntanncacagtgctttgatgtttgatctggcctgggaaggcatctacacggttgtgccattcttaatgtagcatattactgagagtcttgatactgttgtactacgatacatctggtatgttctagtagatgtgattttaagcttgtaaattttctcttctctttgctgcaacattcgttgatgcaaatgctgtcttaagatcgtgaattttgcacgtcaanaaaaaaaaaaaa

SEQ ID NO: 6828 - DNA, 707 bp, Triticum aestivum
  Predicted polypeptide sequence is orthologous to G1850
agaggagagccgtcgcggcaaccacagacaaacccagctgaaagccgccacaccaccgtgccggttacatgggaggaggccgcggcctggtcaccgggttctacgtctggggctgggagttcctcaccgcgctcctcctcttctccgccgccgtctcctgctagccgcctctgcttctcgatcgatccttgactgatcatatatacatagatacatacaccagcttattattaggtagaggaatctgttaggtgattaagccggcgacgatggccggggcggcggcgcagcagcagcagcagaagggtggtggtgcggtgagggtcggcggcggagggccggcgccgttcctgaccaagacgcaccagatggtggaggagcgcgggacggacgaggtgatctcgtggggcgagcaagggcggtcgttcgtggtgtggaagccggtggagctcgcccgcgacctcctgccgctccacttcaagcactgcaacttctcctccttcgtccgccagctcaacacctacggttttcggaaggtggtgccggaccggtgggagttcgcaaacgagaacttccggcgaggcgagcaaggcctcctctccggcatccgtcgccgcaaggccacggcgacgacgacgactccccagtcctctaaaaccagcggaaccggcgtaacggtcgcgttccctccgccgctgcctgctctg

SEQ ID NO: 6829 - DNA, 696 bp, Triticum aestivum
  Predicted polypeptide sequence is orthologous to G1850
cacgcgtccgtctcgccctcgcggttcttgcatcgcgcagccaggggccaccccctggcggtcctgccctgctccctccaccccaagcaatcggcgacgactgcccgcgcggccgtgccgttgtgttgccggccgactatcctgcgtctcctctccccaatgctccagcactccttcgctgaccaccctgcctgccgggttgccggacagaattttattgaggccagccacatcacacacagcacgcaggagctggccctatgtcatggcaaaaggtattcagccttgtcaaggtccagtggtgatacatatgcttcttatggatgagctggccctatgtcatggcaaaatgtattcagccttgtcgtggtgatgcatatgcttctgcatgcacaagagccggccctatgccatggcaaaaggtgaaggacttctcttctcatgttactattcagagcatggtaagcatggcatcaaactcttcctagaggtctgccaactgtatgcaggtggtggcgaaggggatcactttgtttcttgtggtagtgaccactcatcaccttcgtctcatgtttacgaagagacagtcgtcaaagcttatttgagatgggccctaggctgtcgcacttcttgcctgctgcttggttcgcccatgctctggtgcactgcaaatgtatatgcccttttatgccatat

SEQ ID NO: 6830 - DNA, 887 bp, Triticum aestivum
  Predicted polypeptide sequence is orthologous to G1850
acgcttgaccttaggcctatttaggtgacttctcaccgggtttgtacaaaaaagcagtctcgtaccgggccggaattcccgggatatcgtcgacccacgcgtccgtttgcttgctgccccgtatagggatttaggaagatcgtgccggaccggtgggagttcgccaacgactgcttccggcgaggctagaagcgcctgctctgcgacatacaccgccggaaggtggtccagtcggccgggcttgctgctgcggctgccgccgccgcggctggggcggtcacggttgccactgcggcgatccctatggcgctgccggttacgcgctccggctcgccggagccgcagctctcctccgaggagcaggttctgtcgtccaactcgggatcccgcggagagctcccgctggccgctccgtccggctcaggctccggcctgggcggcgccgctgccggctcctcgtccggcgatatgggcgaggagaacgaccggctgcggtgggataacgcgcggttgacccgcgagctggggcagattgaaaaagctgtgcaaccacatcgtggagcctcatgtccaatttcgcctcgagcccacagccggacgggggccccggggtcgctgtcctcccggggtgaaactgctcgggccaatgcggagcctggacccctcccgcgaccgctcccccgggggggatactgggaccttggagcgcactcctggctccaacgccgggctcacgggccgcacgcgcctcacccttctcaccgccggtgccgacagacggaccctccaaggccgtttccagtatcctcaactccgggcttacagcgagggcgccgaaaacgcagggacaaacaacggcccaccagggcaagcgaacatttcctcac

SEQ ID NO: 6831 - DNA, 708 bp, Triticum aestivum
  misc_feature (644)..(644): n is a, c, g, or t
  Predicted polypeptide sequence is orthologous to G1855
gagggaattcctcttttgtaacggttgactgaatacctcgtgtagcatcgtgtcatactcacagctcacgagtcagagaccgcaaaattgaaccgatgatgatacagcgaattcccacctactatatacagatatatcctgaagctaagagaacagtcgatgaagactcaacagaaaggttttctgtttgaactttcgcagcagacgacatagaacaacactgaggaaggcgatagctattgctgcttttgggcaggctccgcggtccagtaagttttgacggccacaaggatcttctcagggttgaacggcccggattcatgatccatgatctggctcttccatctcatgccattggtgatggcttgtatcttcactaacatctccacggtgtccctgaagatcaccgtcccttcaggccgcagaatccggtccatctccaggaggatgtatgttatgtcacacctgtcatgataaaagctgaacactttgttagcgtggatgaggtcatacgtcctgggatacgtcgagaaagcctcgcaccagtcatggaatgtcccgataaacccccgctcgtagataacaccgagggcatcaggagcagaacctgaaggcaccacattcatcacccagagcggatactncatcagcgcagcagcaaaaccccccatccctgcatccatgtccatcacgttcctgtatcgcccc

SEQ ID NO: 6832 - DNA, 520 bp, Triticum aestivum
  Predicted polypeptide sequence is orthologous to G1855
taaggcctgaagggactgtgatcatcagggacaacgtggaggtgttggtgaaggtacaagctatcactggaggcatgaggtggaagagccaaatcatggatcacgagtccggtccgttcaaccctgacaagatcctagtggctgtcaagacttactggaccgggaagcccatggaaaagcaataatcaccgcctttggtactgttttatctgcgaaaatctagacatgacttgcttttgagttctgtcttcattgccattttttatctagcttcaggatatctgtatataggaggcatgtggaccatgtagctggaattggtatcaaacatcttcattagccatatagtatgtatgtgacacattgcaatggtgtataagatgttcactcatattttgatgtgctattgcaatctaataagctgatgcctgatgtgacaaaaggatattgtaactgataatatgttcctgtcaaaaatacgatgacaaggttgtggtacagaaaaaaaaaaaaaaaaaaa

SEQ ID NO: 6833 - DNA, 801 bp, Triticum aestivum
  Predicted polypeptide sequence is orthologous to G1855
acgcttgaccttaggcctatttaggtgaactacagaacaagtttgtacaaaaaagcaggctggtaccggtccggaattcccgggatatcgtcgacccacgcgtccgcgctgcctcatcccctggcacctctacgatggattgtacctgatcgaggtcgaccgtgtcctgcgccccggcggctactggatcctgtccggcccgcccatcaactggaagaagtactggaaggggtgggagaggagcaaggaggacctcaacgccgagcaggaggcgatcgaggcggtcgcccggagcctctgctggaagaagatcaaggaggccggcgacatcgccgtctggcagaaacccgccaaccacgccggctgcaaggcctcccgcaaggccgccaagtccccgcccttctgctccaagaagaatgccgacgcagcatggtacgacaagatggaggcctgcgtgacgccgctgccggaggtctcggacgcgagcgaggtggccggcggcgcggtgaagaaatggccgcagaggctcacggccgtgccgcccagggtctcccggggcacggtcaagggcgtgacggccaaggcgttccagcaggacacggagctgtggaagaagcgggtccgccactacaaggcggtgatcaaccagttcgagcagaaaggacggtaccggaacgtgctcgacatgaacgcccgcctcggcggcttcgcggcggcgctggcgagttacccgcagtgggtcatgaacatgggcccgaccgtgggcaactcccgcgcactccggggtggtctacaagcgcc

SEQ ID NO: 6834 - DNA, 1075 bp, Triticum aestivum
  Predicted polypeptide sequence is orthologous to G1855
gaagcgtaagataccccatatctgcaagagtgacaacctgatgctgcctgtacaagaagatgaatcctgtcttactccattgcctgaagtaagcaaccagggatcaatcgccggcggagaggttgcgagatggccaaagagggcattcacggtgcccccaagggttaagaggggcacgattccggggatagatgaaaagaagtttgaggatgacatgaagctgtgggagaagaggttggcgtactacaaacgcaccacgcccatagcacaggggaggtacaggaatgtgatggacatgaatgcgaacttgggcggttttgccgcttccctggttaagtaccctgtgtgggtgatgaacgtcgttccagttaattcggataaagacacccttggagcaatttacgagcgagggttcatcggcacttaccaggactggtgtgaagccttctcgacgtatccgaggacctacgaccttttgcacgccgacaatttgttcagcatctaccaggacaggtgcgacataacggacatcctcctggagatggacaggatactgaggcccgagggcacggcgatcatccgcgacacggtcgacgtgctcaccaaggtccaggccatagcccagcggatgcggtgggacagccgcatcctggaccacgaggacgggcccttcaaccaggagaaggtcctcgtggcggtcaagacgtactggacggccgacccatcggagcacagctgagctgcagctctctgagctccgaaatggcttgtccggtaactaggtgtgacgcgatgatggtgtcggttttcgccatctcggtgtgtgtgtgtgtgtgtgtgtgtgtgtgtgtgtgtgtgtgtgtagtaagcagtgtgtgaccacgtgcgcagtcgcttgttcctctcgccttttttgtctaattctttgtagttcgggtcgaaatggaaaccaaaaaaatacgtcgagcagatcataggttctttttagcttgtacgaccagagattgttactatgtagtactaagattgacttactggaaaaataggccttttactgaaaaaaaaaaaaaaaaaa

SEQ ID NO: 6835 - DNA, 586 bp, Triticum aestivum
  misc_feature (16)..(16): n is a, c, g, or t
  Predicted polypeptide sequence is orthologous to G1863
caatataacttacatnaataaaccccataaataacaaacattatctgtacagagacagcacatgccactctcacatctgtgaataaatatgcaaagtgggatgaaataattaggacagaaaaacccttgtgactgacctcgcccacggcacgttcgcaaccccgtgtgcataacttgttatcatgacataacttaattgccaccgcaaacctcggttgaaaccgaaagtcactctcataacttagggagaaaaagccttctcctcctcctcctggactcggatttcagcatgatgcattaaggcacaaggatctagcactgaagcaggtactgacggaggaagaagaagcggatgctgcagctagcacacggcgatgttgagcgccgatagcttgtgtgcatggttcttgccctgctttttggatgagcttgctgcaggatgttgttgctgctgctgctgctgccgtggcttgctgctgctgtggtatttgcagtggctgtcgtgtctgtcgcggcttgcgcggcagcagggcctcgtgctctcgctctcctccgatgagtgtgaggtgttcatggcggccttctt

SEQ ID NO: 6836 - DNA, 851 bp, Triticum aestivum
  misc_feature (814)..(814): n is a, c, g, or t
  Predicted polypeptide sequence is orthologous to G1888
acgctatgaccttaggcctatttaggtgacactatagaacaagtttgtacaaaaaagcaggctggtaccggtccggaattcccgggatatcgtcgacccacgcgtccggagagagagcccgagataactctattggcctggccccgtgacctaccttgcctatctctcaccgccccctccatctctctctcgcgtggcggggtcgaagctgcgtgcccagatcgtgccatgaaggtgcagtgcgacgtgtgcgaggccgaggcggcctccgtcttctgctgcgccgacgaggccgcgctgtgcgacgcctgcgaccgccgcgtccaccgcgccaacaagctcgccggcaagcaccgccgcctgtccctcctccacccatcgccggcctcctcctcgtcgccttcgccgaagccgcctctctgcgacatctgccaggagaagagggggctcctgttctgcaaggaggacagggcgatcctgtgccgggagtgcgacgtccaggtgcacacggccagcgagctgacgaggcggcacggccggttcctgctcaccggcgtgcgcgtctcgtcggcgccggcggagtcccccgcgccgtcgggtcaggaggaggaggggaacagcaccagcccctgcatcgccgactcctgcagcggcgacgccagtggcacggcgagcgccagcgcgagcgcgagcgacggcagcagcatctccgagtacctgacgaaacgctgcccgggtggcacgtcgaggacttccctctggacgacgccgccgtcgccgtctcctcgaacagccgtaatcaggggaggagggnctggctaggatccgtgggccccaagaaggtgaaggta

SEQ ID NO: 6837 - DNA, 486 bp, Triticum aestivum
  misc_feature (264)..(264): n is a, c, g, or t
  misc_feature (365)..(365): n is a, c, g, or t
  misc_feature (369)..(369): n is a, c, g, or t
  misc_feature (372)..(372): n is a, c, g, or t
  misc_feature (452)..(452): n is a, c, g, or t
  Predicted polypeptide sequence is orthologous to G19
gttcgtttatgtttctctttataaggtgaggaggtgacggagaaatcgccggcgccggggcggaagacggcgtaccgtgggatcaggcgccggccatggggccgctgggctgcggagatccgggaccccaggaagggcgcgcgcgtctggctgggcacctacgccagcgcggaggaggccgcgcgcgcctacgacgtcgcggcgcgcgatatccgcgggccgaaggccaagctcaacttcccacccgcggtgggcgcgccgcangaggccgcggccgttgcaggggcgggggcgcccaagaagcgtcgcatcgtcgcggcagaggagagctccgcgtcttggtctccacttccggccccggctancggnggnggcggcggcacaaacagcctgcgggagcgcatgtccggcctgggaggcgttcctggggctggaggacgggaaacgtggancccttgggaaggccgtcaatctcaatcaatggat

SEQ ID NO: 6838 - DNA, 559 bp, Triticum aestivum
  Predicted polypeptide sequence is orthologous to G19
ttttttttttttttttttttttttttttttgagagcgtgaaaattccattttatgtcagaaaagtgggtgcaagttctccacatttcttctgatcgtcatgcttgaattacatagcattccactacaaaggacctggatatgcccggcgaaagcccaggaaagccgaatgatactctaactaatcaaaagacttcgaccaatctgcttatttatcggcaaatgtaacccatgcacgccgcagagctgccgcacgtggcgacggcacacgcctactccatgatgagattgacggcctcccagggctccacgttgccgtcctccagccccaggaacgcctccaggccggacatgcgctcccgcaggctgtctgtgccgccgccgccgccgctagccggggccggaagtggagaccaagacgcggagctctcctctgccgcgacgatgcgacgcttcttgggcgcccccgcccctgcaacggccgcggcctcctgcggcgcgcccaccgcgggtgggaagttgagcttggccttcggcccgcggatatcgcgcgccgcgacg

SEQ ID NO: 6839 - DNA, 763 bp, Triticum aestivum
  misc_feature (760)..(760): n is a, c, g, or t
  Predicted polypeptide sequence is orthologous to G19
cgccccactgccacagcagcgccacttttcttctacagaactcgatcgtctcctacaccagatccagcgctctcctctacttgctctataagcagcatacaccatgtgtggcggcgcgatcatctccgacttcatcccggagcgcgaccaccgcggcgggagcaagcggagcctctgcaccgccgacttctggccaaatgcggccggcgccggcgccgcgttcgacgaccctaccggccaccacgacttctacccagccgacctgaccggcgccggcgccttcacgcctgagcaccaagcggaggaggagccgagcaggaagcgggagcgcaagacgatgtaccgcggcatccggcggcggccgtggggcaagtgggcggcggagatccgcgacccggccaagggggcgcgcgtctggctcggcaccttcgccacccccgagggcgccgcgcgcgcctacgaccgcgccgcccgccgcatccgcgggaccaaggccaaggtcaacttccccaacgaggacccgcccctcgacctcgacgactacgacgtcgccaacgtggccggcttcatccaccagccgtcgtacatggcgccagaggtggcgtacgcgcaccagctgccgcagcaggacgagcccgggatggagctctggaaactttggcacatcaacgctcaagtgcctatgtgatagatagaaactgttcgtttcttctaccatgtatattgcttttacctaaattattatgggcctatgatgaantat

SEQ ID NO: 6840 - DNA, 658 bp, Triticum aestivum
  Predicted polypeptide sequence is orthologous to G19
cgcaccaccttgatcagcctgccctgagttcatcactcaaagtaagaaagagggtagcgacggacaagcagagggacgcaggcacgtactataccttagtcacgtacacacagcgagaagtgagcaaagatgtgcggcggtgccatcctcgccgagctcatgccgagcgcgccgcccaggagcgtcacggcggtccacctcttgcccaagcggcagagggtcgacgacttcgaggttgctttcaagcgcttcgacgaggaccccgaggaggaggaggaggtgcgccagtgcgcgggcttcgagtttggcgcccgcgggcagccggcagcgaggcgcggcggcggtaggccggcaaagtacagaggcgtccggcgcaggccttggggcaaatgggcggcagagatccgcgaccccgtcaagggcgtccgggtctggctcggcaccttcccctccgccgaggccgccgcgcacgcctacgacgacgccgcacgcggcttccgcggtgccaacgccaggctcaacttcccctcctcgttcacgagcgcacccaagtgccgcgtagccgagaaaccgacaccgttcgttgttattgacctcgacgacgacgaagagggtgatgccggagcagctgatgccggcgggataagctccgaattca

SEQ ID NO: 6841 - DNA, 611 bp, Triticum aestivum
  Predicted polypeptide sequence is orthologous to G1944
tttttttgatacatgtaaatttttaactattggcggcatcgatcagttcagttcagttcagttcacatggtgtataaatttccaactatttgaattcctccgaatttctccgcacgtttgcagagccctgagagcttctgagcagggctggctggctggcgagctctcctcctcttcaccctccggagacggggaccttggccgcctccgacgacggcgtcctcctcgcctcggctgcgggcggcgccgatgccaccggctgggcggtccagttctccaccctgaacgctgacgcacccttgccggcccgtgcctggcttccgctgtacgagtcctccatgtcgccgccgctggagatggtgaaccccatggccggctgcgccgccaccgtcttcatctcgatcaccggcttcttgccgttctgctccatctggtagctcggaaggaagcttcccaccacaacctgaaccgggcttgcggcaacaaggaggccagtcacgccgcctccgatgacgcggccatcggcggtcgccctttctttttttttttttttttagacaaggctgaacccaagcttagtgcgagattcagtaccctaattagcaaggtca

SEQ ID NO: 6842 - DNA, 826 bp, Triticum aestivum
  misc_feature (5)..(5): n is a, c, g, or t
  misc_feature (575)..(575): n is a, c, g, or t
  Predicted polypeptide sequence is orthologous to G1944
cacangctattagatatatggctatctaggtgactagattgaacaagtttgtacaaaaaagcaggctggtaccggtccggaattcccgggatatcgtcgacccacgcgtccgcctttcctccaaaatttcacatcgcacgcaaccttctctcgtgccgccgccgccgccgccgccgcctcttctctcccccgattctcctcgcgactgctccgagcccctcctcttccctgtgtcggctgctcgacgcgccaccgctgcgggagaaggtgaacacgaggagatgcagggtgggtggcctcgccggaagagggtgacgccgggaaccaccggctggccaaggaccgtgtgggctggcacttccccgcggcgccctccttccccgacttcgccgtcgccactgccccctcccctcctgtcaaggctgagcgtgcacagagtggacgagtcgatcgcggcggaaccagagtcactcgaggccggggtgcgagatgatgtccagcaggcggaggggtggccatgggaggagtagcccacaatgaaatccattttctctttgtgtgtgtgtgtgtgtgtnggatttggatcgaggaaggggatggcgtggggatgaggcggtggacagaggaagagggcgatgctggctggctgagcgggcggatctggtctcgtttgttctgtagagcgggcagaggagcaggccaacataacaccaacgtggtgagctttccctcctcccacatctacccccagatctgaacatcaactacaatttgtacgtttgggtatctctattcagttatacaattcgtttgggtaactctgctg

SEQ ID NO: 6843 - DNA, 1128 bp, Triticum aestivum
  Predicted polypeptide sequence is orthologous to G1944
cgccgacccacgcgtccgcctctggcggcacgttaacttatgagggacgctttgagttgctgtccttgtctggttccttcatgccaactgaaaacagtggcgcacgaagtcggtcaggtggaatgagtgtttctcttgccagcccagatggtcgtgttgtcggtggtggagttgctggccttctggtagcggctagtcctgttcagattgtcgtgggaagcttcctgccaagctatccgatggaaccgaagcagaagaaggcgagggtggtcgcggcaccaatccttagccaggcaccccctgctgttcagctctctagtgcggatacgcacagcagcgagcaagggcagcacagctcggccgccccaagaatgaacgtcgtaacttcttcagcgtacagcgcagaccagaactgggcatccaccgttgttcagtcggctcctgccgaggcatcaagaagcgcatcgtcgggcgatctgaacctcactgcctctggatcctgaagcccatcgagccaaacccgaggaattcatccacagagtctctgtgtggtgcatttcctttctgacatgtaaaagatgtatccactaggttggttttcaaaaaccccactaggttttctgtcgggcagctcaagagtctaactgcatttgctgtagctatgtgacgttagtacctgtcgatcttgttggacattgtgtagctacactctattgttagtgtgtcttagcctcttaggcctacttcatctgttggattacatggattaattttgagttagagtttttctcaaaaaaaaaaaaaaaaaaagggcggccgctctagagtatccctcgaggggccccagcttacgcgtacccagctttcttgtacaaagtggtccctatagtgagtcgtattataagctaggcactggccgtcgttttacaacgtcgtgactgggaaacctgctagcttgggatctttgtgaagaacttacttctgtggtgtgcataattggacaactactacggagatttaagccctaggttaatataaattttaagggtttatgggtaaactaactgctttgctggcggttgaaaatttgcttcctgggttgatttggaaaatttttcccggcgccta

SEQ ID NO: 6844 - DNA, 889 bp, Triticum aestivum
  misc_feature (563)..(563): n is a, c, g, or t
  misc_feature (614)..(614): n is a, c, g, or t
  misc_feature (644)..(644): n is a, c, g, or t
  misc_feature (662)..(662): n is a, c, g, or t
  misc_feature (691)..(691): n is a, c, g, or t
  misc_feature (736)..(736): n is a, c, g, or t
  misc_feature (850)..(850): n is a, c, g, or t
  misc_feature (863)..(863): n is a, c, g, or t
  misc_feature (872)..(872): n is a, c, g, or t
  misc_feature (874)..(874): n is a, c, g, or t
  misc_feature (876)..(877): n is a, c, g, or t
  Predicted polypeptide sequence is orthologous to G1944
aacagctatgtacgatgattacgccacgctatttaggtgacactatagaatactcaagctatgcatccaacgcgttgggagctctcccatatggtcgacctgcaggcggccgcactagtgatttgtcgcggccgaggtgaatgatctcaaaaaccgaatgggctattccaaagtatacatttggtattctttttgggaacagaaaaatctctcaagagatggaagtgtcgacaaatatgagctatcctctagaagagttgatatcaatgttggaacttcgtgtgtcaaatatcccagagctaggccaccctcccgtcgatacaacggagggcggcgacgttaggttttggttatgtcctgagctgggcgacaccacatctggcccagcgccggtgagcgagtcgggaccgaaagccggtggtttcgcggctttcttggactttgatttggatcctccttgcacaaaagtccctagcaccacctgcacagtactggcagccaccaatgctccacccaggacacctccaatgacatgcctctccgggctgcagagcgtgacgctnatcccgtcggtttgattttgctggccctcgttcggattgtaagagccggantaactcaggatttcatacaatccctcgtanatggcagggttattgtangaaggaggatgatctgccgggtggcgcangacgggcctggagacggaccccatcgctgagagcacgcacaccgncctcggtggctggctcgcgaatgccgcgatcttcccgcgacgtcctctgaaggagatgctgtgatgatgtgggggagtaaagctcgtccagctgaaccaaggaacgcattgccngagggttactgcntgggactcngncnnggacacgctatc

SEQ ID NO: 6845 - DNA, 895 bp, Triticum aestivum
  Predicted polypeptide sequence is orthologous to G1950
gacccgctagtaacatgattacgccacgctatttatgtgacactatagaatactcaagctatgcatccaacgcgttgggagctctcccatatggtcgacctgcaggcgggcgggctagtgattagcgtggtcgcggccgaggtcatcgacatcctgctcgatcacggtgcaaatgttgatttgactactgatgctggccgaactgctcttcactatgctgctagtaaaggaaggcttaacattgctgaaatgctgatagctcatcatgcaaatgtcaacaagaaagataagtggggctgcacacccctgcatagagctgtgagtactggaaatgctgagctgtgtgaatacctgcttgaagaaggcgcagatattgatgcagttgacaagctaggacaatcacctctaatgcatgccgtcatatgcgaggacagaggggttgcctttctgctgatcagacatggtgccgatgttgacattgaagacaaggagggctacactgtccttggccgagcctctgatagcttcaggcctgcactgattgatgcggccaaggcaatgctcgaaggctgaggatgttttgctgccctaaggtaagagatagatggaagaacatgtggagtagaaaaactgccgctgtgtaccttgtggtataagtatgaagtgtttccctccaaaatcagattgaccagccagactttttgttcgcggttaatgattctcgtgttgactttggtggtctgcttttgtgctctcttcagatgacttactgacgattgtcgtagttcaggacaaaatgaaaacttggtctcttctgccaacagaacttttagggctgtgaatatatgtattacgcgacacctggcttgagtagatgtgacccctccggcgggac

SEQ ID NO: 6846 - DNA, 1029 bp, Triticum aestivum
  misc_feature (5)..(9): n is a, c, g, or t
  misc_feature (14)..(29): n is a, c, g, or t
  misc_feature (43)..(43): n is a, c, g, or t
  misc_feature (46)..(47): n is a, c, g, or t
  misc_feature (49)..(49): n is a, c, g, or t
  misc_feature (53)..(53): n is a, c, g, or t
  misc_feature (55)..(56): n is a, c, g, or t
  misc_feature (58)..(67): n is a, c, g, or t
  misc_feature (70)..(72): n is a, c, g, or t
  misc_feature (74)..(74): n is a, c, g, or t
  misc_feature (81)..(81): n is a, c, g, or t
  misc_feature (94)..(94): n is a, c, g, or t
  misc_feature (96)..(96): n is a, c, g, or t
  Predicted polypeptide sequence is orthologous to G1950
ttttnnnnnttttnnnnnnnnnnnnnnnntttttttttttttnttnntntttntnntnnnnnnnnnnttnnntnttttttntttgggggaagtntnacagctatgacattaggcctatttaggtgactctctcagaacaagtttgtacaaaaaagcaggctgccaccggtccggaattcccgggatatcgtcgacccacgcgtccgcccaactcagaactcgcaagcttcgcttactcgccggagcagcacgcgcaccagatggccgcggcaatggaggtcgacgccggcggagagaagccgtcggagaaggagctcttcctcgccgcggagtccggggacgccagcgtcttcgcctccctcgcccccgccgacctcgccgcagcactctccctccgcaacgaggacggccgctccctcgtccacgtcgccgcctcctccggccgccccgaggccgtcgccgcgcttgtggctgccgggggcgacgccgtggccagcgccgtgaacgggaaggacgaggaagggtggacgccgatttcctcggtggacagcagcggcaacgcccagatcatcgaaatccctgctccggcacggaggcaaatgttgatttgactactgatggtggcccgaatggctcttccctatggcggcgtagaaagaggaaaggcttaacattggctggaaaggctgatagcttcatccgcgccaaagtcaaccaagaaaagataaggttgggctggaaaacccccaggaaaaaactttgccagacactggcacaagcctgagctcgaggacaataccccgccctagaacaacgggccccaaatttggatgccacgttgtccaatgtaaggacctatacaccttacaaaaggcattcccgtcactctgtccagcgacccaaggcggttgccgctttctgctttgaattagaaaaacgaggcccaattgcctgtcttctgcagtcaccagggggggacgccctcccgcgtcccttgagtccgggggcactccctcacccacttacccg

SEQ ID NO: 6847 - DNA, 524 bp, Triticum aestivum
  misc_feature (403)..(403): n is a, c, g, or t
  misc_feature (485)..(485): n is a, c, g, or t
  Predicted polypeptide sequence is orthologous to G1957
aggagaagagactcaatgctggggacaccgtttccttctgccggggcgccaccgaggccacgcgggaccgcctcttcatcgactggaagtgccgggccctagtccatgattcgttgccaaaggtagacaggccgtcgagggcggtcaagaagcgggtgcggctgttcggagtcaatctcggcacccagcagccccaaggtggcgagttaacccacgatgccaatgccggtgcagctggagtggagtcctcagctgctgcctcatcgccgtcatcctcccagacagaagcacattcctccttggatctcggtctgtgaatgcgtgcccacggaaagttcaacagcacaattccttcagtttgtcacctttatttcttctccaccttttgtggtccgtctgtaanacattgatatagccaacattcaacttttttaggcatcaaatcctgggttggttcaaattataatacagagagatgaattagngaatatcaatccccatgattgttggtcaaaaaaaaaaaa

SEQ ID NO: 6848 - DNA, 462 bp, Triticum aestivum
  Predicted polypeptide sequence is orthologous to G2011
gaggcactgttgcaggggccgcagctgccaccattcctgtccaagacgtacgatctcgaaggcgagccgcagctggacggggtcatctcctggggtccttcgtcgtgtggaatccttccacctttgaccgggacgtgctcccgcacaacttcaagcacaagaagttctccagcttcgtcagccagctcaacacctacgtgtgtatcgtatcactgtccaatcctctgttctcatctttcttttcttttacaatctctcactggattattattcatgatgccgtcctctgctggggaggcactctgtttctgtttggtatctggcactctgtttcggatgctctatttttggttttgttccttctggtttctgctgatgtactcaacccaaatctgttgggtgtatatatatatatatatactctttgtacttcccttcatacttttagtgagaggagttgtg

SEQ ID NO: 6849 - DNA, 705 bp, Triticum aestivum
  Predicted polypeptide sequence is orthologous to G2057
gaggcttcttccagaggggtccccttcagtccagtaaccagccctccgaccgaggatggccggagaccgtcgaagctgacgacaacaacccgatgcagcagcagcagcagcaccaagggggcttgaacccttccgtgtcggcaatcgggttcggtcccggcgtcagcttctccggattccgcgtccccgcgaggatgcagggcaacgaggagcacaacggcggcaatggcgacaagccgccgtccgtctcctcggcttcccaccactgacagcagcagtggatgacagatgacttcaccaccaacctccacagtgtaccagcaacgacatcggccatcagctcctccacttgcatcactggtgctaatttgattccgcttcatcatttataggagctggtgattgcattgcaactaggaggagcgaaattcggagctggttctacgtctggttggttggtatggttggttttccatctcttctgctacgtgtgtcattgtcttttgcttcaagatcactcggagcttcttagaattaggcttgtgagagtgcagcgacacagcaagctggtgagccagcctctttgtggcattgcattaggtgtagttgatgttgtagtttgctgtaggtcaagctcgattgctttctttctttcacttgttgctgtatgctactactagatgttattctcaaacttataaatgg

SEQ ID NO: 6850 - DNA, 568 bp, Triticum aestivum
  Predicted polypeptide sequence is orthologous to G206
ccgctacgaacgattattgttcccttcacaagctctcccgttttacaggtatacacccaccaaatgatcagatgccaaagattttaaagaatatcgagagacaaaaaaatgaacaagaaactagccgaggagccgatgtcctctgcctaaatctgagacaaactctgcacctcaccagcctgcatgaacagtctgacccagaagtccatctcgtcgttgctggacgacggcgatgcactgtctgcgcccaaggtgacgccggcctccatggcggaaccggagctgtccaccgtcattgccagtgtctccgaccaaaagctgtcttcaatctgaaactcctccgatgtaaagctgtctgtgttctccaacgacgacggcatcgagtaatcggtggcggacgacgagatgggctgctccggtgacgacactggcatggaggccgggccatcggctgtgctcgctgcagccacaggcttcttggctttgcgcttaggcgctgcctggccggacgtcttggacgaggacgagtcgagtcgcttcttgaggtgtgtgtgccagacgttcttga

SEQ ID NO: 6851 - DNA, 1072 bp, Triticum aestivum
  Predicted polypeptide sequence is orthologous to G206
tacgtgcgacccacgcgtccgcagcttcctccgagcatccgactccctccctcgcctccgacccatcacacacacacagcgcgagcgtcttatccgggcctgcgcgaagagaagagaagagtgcagaggagcatacagagtaagcaacagcaatggtgagggctccttgctgcgagaagatggggctcaagaggggcccgtggacagcggaggaggacatgaccctggtcgctcacatcgagcagcacgggcacagcaactggcgggcgctgcccaagcaggccggcctgctgcgctgcggcaagagctgccgcctccggtggatcaactacctgcgccccgacatcaagcgcggcaacttcaccagcgacgaggaagaagccatcatccaagtccacgccatgctcggcaacagatggtccaccattgccgccaggctgcctggcaggacggacaacgagatcaagaacgtctggcacacacacctcaagaagcgactcgaatcctcgtccaagccctccggccaggcagcgcctaagcgcaaagccaagaagcctgctgtggctgcgagcgcgctcgagggcccgacctccgagccggcgtcgtcgtcaccggggcagtccctctcgacgtcgtccgccaccggctactcgatggcctcgtcgttggagaacacgggaagctcttcctcggaggagttccagatcgacgacagcttctggtcggagacactggcgatgtcggcggacagctccggttccgggatggaatccagcgacaccttcggcgtagatagtggagcaccgtcttcgagcaacgatgagatggacttctgggtcactcgtgtcatgcaggctagtgacatacagagtttgtcacagatttaacttttaatgagaagattgggctattttcgtaaaaaaaaaaaaaaaaaaagggcggccgttctagagtatcttcgaggggcccagcttacgcgtacccggtttcttgtacaaggggtccctatggtgagtcgaataatagctaggccctggccgccttttacaacgtcgtgaatgggaaaacgtta

SEQ ID NO: 6852 - DNA, 1086 bp, Triticum aestivum
  misc_feature (32)..(32): n is a, c, g, or t
  Predicted polypeptide sequence is orthologous to G206
atacggcgacccagccgtccggtattcttctnagcagctctggcagcctttaccttcggaccagcgtcaacacactgagcaatccatccatcacacccacagcgccagcggtttcacttcattagtcggccgagaagcgcagaggagtgagcaaggtagctatggggaggtctccttgctgcgacaagacagggatcaagaggggcccgtggacggcggaggaggacatgaccctggtcgctcacatcgagcagcacgggcacagcaactggcgggcgctgcccaagcaggccggcctgctgcggtgcggcaagagctgccgccttcggtggatcaactacctgcgccccgacatcaagcgtggcaacttcaccggcgaggaggaaaacgctatcatccagctccacgccatgctcggcaacagatggtccaccattgccgccaggctgcctgggagaacggacaacgagatcaagaacgtctggcacacacacctcaagaagcgactcgactcgtcctcgtccaagacgtccggccaggcagcgcctaagcgcaaagccaagaagcctgtggctgcagcgagcacagccgatggcccggtctccatgccagtgtcatcaccggagcagcccatctcgtcgtccgccacagattactcgatggcatcgtcgttggagaacacggcaagctttacatcggaggagtttcagattgaagacagtttttggtcggagacactggcaatgacggtggacagctccggtttcgccatggaggccggcgtcaccccaaacagtgcatcgccctcgtccagcaacgacgagatggacttctgggtcaaactgttcatccggctggttaggtggacaaattttgtctcatattaaggcagaagatatcggctcctccgctagttcctgtccaattcttgtctctcgaatctttaaaaactttgggataagctgcttccgtcggatcatccgggggtggtttcctgttaaaaaaaaaaaaaaaaaggggggccggcttaaaatatccctcaggggggcccatattaccctctacccgtttttttgataaaggggg

SEQ ID NO: 6853 - DNA, 393 bp, Triticum aestivum
  Predicted polypeptide sequence is orthologous to G2071
ttttttttttttttagaaaaaaaaaaagctgatgttatgcaaacccagacaagctctacacactagattctgaaggactgccaaattacagcggttcttacggcccccctcctcgactacacactagcctacaggtcagcggtctctgaagcagcacgagaaaggaaactagcaggtcaatcaagcacaggtcatcggtttacaatagagcaaattatatgtacaaagcaggcaggccggtggaatgccgatgctgactccttgatcctcctcaccaggggccggtcaacgttcttcgcaagcactgccgcttcttccgtccgaactgatccttcatctcagggggcctgctctcttttctgcatttccagtatctctttctgtttccccacc

SEQ ID NO: 6854 - DNA, 568 bp, Triticum aestivum
  Predicted polypeptide sequence is orthologous to G2071
tcggcacgaggcgtcgcggttggatggacgccgcccttttgccttgtgacggaggaagccgcggatgagggcgcgctgcgccatgcgcgtgcgcctgagggcgctgccgtcgcgttgccgctgtgcctcttccagccccagccattcatccgctctggccgttgcatcccgtggatgagcagccgaggcgcctggacgcgggagccgctagcgatgttgcagatcgtttgatccagtgcaagaaaaactgaacttttcttccttggtcaaggatctcttccggttgatgcttcagccatctattcatctcaccatgtccacatactatgtgcagaaaagcagttaatcttcagatcatgggaagaacaaaaattaaacggaattagtgtttcctgattgatttcccgatgctcgttcaggcagtcgctgtgctgacgccgtttaagggttcgtgcttgactcattggctacagccgccgccgactggtagggtccccgctgatggtgtctgcgccaccgggaggagcgaggccgcatcaccccgcgccggaggacgccccatgcgcca

SEQ ID NO: 6855 - DNA, 568 bp, Triticum aestivum
  misc_feature (380)..(380): n is a, c, g, or t
  misc_feature (411)..(411): n is a, c, g, or t
  misc_feature (413)..(413): n is a, c, g, or t
  misc_feature (427)..(427): n is a, c, g, or t
  misc_feature (472)..(472): n is a, c, g, or t
  misc_feature (520)..(520): n is a, c, g, or t
  misc_feature (524)..(524): n is a, c, g, or t
  misc_feature (536)..(536): n is a, c, g, or t
  misc_feature (540)..(540): n is a, c, g, or t
  misc_feature (543)..(543): n is a, c, g, or t
  misc_feature (547)..(547): n is a, c, g, or t
  misc_feature (551)..(551): n is a, c, g, or t
  misc_feature (555)..(555): n is a, c, g, or t
  Predicted polypeptide sequence is orthologous to G2071
agatggaattgggagactgaggtgggcaaaacttaaagagcggaatgaggagttgcaagagaaaacaggcggagatgctagagaggcaaaagaatgaggtattcgagaaggttacccggcaagctggaccgacgtcgaagaggatctgcctgcggaggacgctgacgggcccttggtaagccgaaggcctgtaaactaagagcgcactactttcgacgccgcgcggttatatacatacagtagatgaatttcaaaatcgccaggagttgcgcttgtagagcagccactgatccgatgcttcagagctcaagctcctaagccgatagactgccggcgattttcacttcataggttttttaccgtccgcctgccgttccgtnggagttagagagcaatttgtatgttaaaatncnacttaaccaagttnttggggtgatactgcatttaaactaacatttcccaatttttttanggttccgggaccccattacaaaaccaatgtttaaaatggagtttttgncccnccaaaaccgatncccnggnccgntttntaancaaaaaaaaaaaa

SEQ ID NO: 6856 - DNA, 893 bp, Triticum aestivum
  Predicted polypeptide sequence is orthologous to G2071
ctagcttttaggtgactatagaacaagtttgtccaaaaaagcaggctggtaccggtccggtaattcccgggatatcgtcgacccacgcgtccggcatgtgacccgctgcggtttgaggcgaattctctgctggtgtccgtgtccgtttgatgctgaaggaggactggcggcggcgtggagaaggtggtggagaggaggcagaggaggatgatcaagaacagggagtccgccgccaggtcccgtgcccgcaagcaggcttatacaatggagttggaagccgaagttcagaagctcaaggacctgaacgaggaactggtgaggaaacagaaagagatactggaaatgcagaaaagagagcaggcccctgagatgaaggatcacttcggacggaagaagcggcagtgtttgcggagaacgttgaccggcccctggtgaggaggatcaaggagtcaggcattccaccggcctgcctgctttgtacatataatttgctctattgtaaaccgatgatggaccagacctgtgcttggttgacctgctagtttcctttctcgtgctgcttcagagaccgctgacctgtaggctagtgtgtagtcgaagaggggagccgtaagaaccgctgtaatttggcagtccttcagaatctagtttgtagagcttgtctgggtttgccaaaaaaaaaaaaaaggcccggcccgctctagagtatcccctcgaggggccccagctttacgcgtaccccagcttttcttgtaacaaaggggccccctatagtggagcccgtattaataaacttaaggcacttgggccggccgtttttacaaccgtccgtgactggggaaaaactggttaaccttgggggatactttgggggagagaaaccctttcctttc

SEQ ID NO: 6857 - DNA, 869 bp, Triticum aestivum
  Predicted polypeptide sequence is orthologous to G2071
acgctatgacattaggcctatttaggtgactctatagaacaagtttgtacaaaaaagcaggctggtaccggtccggaattcccgggatatcgtcgacccacgcgtccgcgcgcaccaatcgctcctggcagcagtagtagtaactgctcggatttgctcttgctaaattcggcagtgccgcccatacttaatcgagcccggccgcctcctgtcctcctgcttaaagcagctcgagctcgctcgctcgcccgctgctccccatcacgactaccacggccgctgtgtctgtcaggctggagctcgaacacctgtaacgccctgacttgtgcctgcctgtgtgctttttgattcggttggattaattggcgggactgagtgaggggatcggatccgatggactttccgggagggagcgggaggccgccgccgccgccgcagcagcaccagcaccagctgctgcccgcgatgacgccgctgccgctcacgcgccaggcctcctcggtctactcgctcacgttcgacgagttccagagcgcgatcggcggggcgggcaaaggactcggatccatgaacatggacgagctcctccgcacatctggacggccgaggagtcgcagggcatcggcgccgggcccaaagccgccgcctcgtcctccggcggggggggggccggaacacgggcggaatccagcgccaagggctccctcacgcttccccggaccttaacccaaaaaaacgtcaaaaaaggtctggcccgaattgatgttctttcgaaggcccttccgcttcccctccggggccgctttaaatatccctccggggggccaaagtttaccgtaacccctcttttttgtaaaaaggggccccct

SEQ ID NO: 6858 - DNA, 1228 bp, Triticum aestivum
  Predicted polypeptide sequence is orthologous to G2071
gagggggtcatggacttcaggagcagcaacggcgggtcgtcctcggagcgcaggccggcggacggggcgccgctgacgaggcaggggtccatctactccctcacgttcgaggagttccagagcacgctcggcgggggcgccggcgtgggaggcagcgacctcgggaaggacttcagctccatgaacatggacgagctgctccggagcatctggaccgccgaggagagccaggccatggctgcctccgcctcgggcgcgggcgcgggcgccggcccgccgcccacgtcgctgcagggccagggctcgctcacgctgccccgcaccctcagcgccaagacggtcgacgaggtgtggcgcaacctcgtgcgcgatgacccgcttccggtggggccggagggtgccgagccgcagccccatcggcaggcgacgctcggggagatgaccctggaggagttcctggtcaaagccggcgtggtgcgagagatccccaccgctcctgcagtgccgcccccgcccatgcagccgcggccggtccctgttgtccctaaaggcccttccttctacgggaacttcccgagcgccaacgacgccggtgcggcggcgctggggttcgcgccggtcgccatgggggatctggccattggcaatgggctcatgccgagggcagttggtatgggaggcgcccctctggttgtgcaaactgcggtcaacccggttgattctggcagcaaggggagcgaggatctgtcatcgccgtccgaaccaatgccgtactcgttcgaggggattgtgggggggaggaggactggcggcggcgtggagaaggtggtggagaggaggcagaggaggatgatcaagaacagggagtccgccgctaggtcccgcgcccgcaagcaggcttatacaatggagttggaagctgaagttcagaagctcaaggacctgaaccaggaactggtgaggaaacaggcagagatactggaaatgcagaaaagagaggcccctgagatgaaggatcagttcggacggaagaagcggcagtgcttgcgaagaacgttgaccggcccctggtgaggatcgaggagtcaattggcatcggcattccaccggtcgacctgctttgtacatatattcgctctattgtaaaccgatgatggaccagacctgtgcttggttgacctgctagcttcctttctcgtgctgcttcagagaccgctgacctgtaggc

SEQ ID NO: 6859 - DNA, 464 bp, Triticum aestivum
  Predicted polypeptide sequence is orthologous to G2085
ttttttttttttttttttgtaaaatatgtttaagtttgaacgaactcgccgctgtttgcgttaaatttgagtcgttttttacttttttgactaaccgtgggcgccgcgactggggggcaacacgcccccagtgcgcggtttagcgccggtgcgcccccagggggcgattttttgcccctcctggggggccaacggctggagatgccctaagatggatgcagcttgcaatgacaacatgacatggggggatgaggatcaatcaatcatcaattgataaaagagacaccaaatgtggcaatattctctattatggtctctttctcattaattttctgtcctgattgtatattatatggcatatttttattttattttatatatacttgccgtatccccgaatggctgtttttgaaaaatgccgtatcccgtatccccgtatgcgtatccccgtctttccgtccccg

SEQ ID NO: 6860 - DNA, 886 bp, Triticum aestivum
  misc_feature (823)..(823): n is a, c, g, or t
  misc_feature (870)..(870): n is a, c, g, or t
  Predicted polypeptide sequence is orthologous to G2085
aaccagctattgagcatgattacgcccagctatttatagtgacactatagaatactcaagctatgcatccaacgcgttgggagctctcccatatggtcgacctgcaggcggccgcactagtgattagcgtggtcgcggccgaggtagtaaacgcaaattatctggtacacatatccatgtaacaaattaatgaaaaaatgtcattccgaagcatttgtcgaacagattttctcatacgccatgcaggagaggatgttgctgtctctaacagtgtcatttctagaagatttaaatctaatgaacgctcagaaaaaacccatgtcgaaaaacgtctattatctatatacacatgcggcaacagagtcagaccatcggtacatccacaccacaatgcgcacattgcaagcctccagttcaaattatgccgattataacttctaagcatgcaactccatgacaaacgcagcgtcctctgaagcatccaccacctgatggctatgaatcatggccattggcagcaggagcaggcgctactggtgcttctggtgcagcttctagtgcgagatgttgctgctcagcagtgggtgcttcagcaactccattctgagcgtcatcggctgctggcagcacaactttcaaaggtgtatgacctttgacctctctcatcatacccttgtttgcccacgcgagtccacatgcattgcacagagtccttggtccatccggtcctcgacgcatcataggtgtattgttagaactaatacacaatgctggcatacaggtgcagaaagaggtcgaccttccactgcaccccaatctgaanttagcgcagctgccgcacctcggccgcgaacacgctaatcccgcggncatgtgcggcgggagc

SEQ ID NO: 6861 - DNA, 1115 bp, Triticum aestivum
  Predicted polypeptide sequence is orthologous to G2107
cggccgccctttttttttttttttgggtttaagttccacaattttcttatgctgactgggaacagcttcggtttgttccatgcatagagtcaaagcagctggctggagtgttttagtagctcgagagcgcggcgtctgctccgctgccttcggtgtcccagcacgcgccggcgaccggcggttgcggcggctcgaggagaagcccctccgcgaagtacgcatagtatgtgtccaggtccatttccccggacatatccagctcgaacatgttgcagcccagtgtggccggcaccgcaaacattccgtcgccagaaggtagggacgacgacgacgacgtccacgacgagccggtattttccatggacgactgcgcggattggctacagcttccgtcatcgacggggacggtggcggccagggacgtggtggcggcgccgctggcggcctcccggcgttggaagtccgcgacagcgctgagagccgcgcgccggacgtctgcaaagtcggagagcgcggacggcacggcgaggagccaagcggagtcggcgaagttgagacacggggtggaggggccgatcaggccgagcatggcggcatcgtgcgcttgcgcggccgcctcggcagtgaggtgcgtgccgagccagagccgctcgccgcgcttgccggggacgcgcacctcgcacacccaccggccggcgctgccgcggcgccgcacgccgcggtacaccgggtggcgcgtctccttgaacttggtgcgccccggcagacgcttcaggtgcgaggaggacgacggcgaggacggggagctccgctgctggtcggagccggtcatgtccattggtactgcaggtggtcggtgctggctcgagcttacgtacggggggccgaggtcgatcttatggatgtgaaagccggctgacctttacctggggagggtgggttattttctaacccctcagtccagcaagggtcctcgggccccaaatccgggacccggtggttgccaaattccggggaaatccggaccggacccaccgtgttttttgtacaaccttgtctcttagggccccaaaaaaggccaaggggcataacgttccctgtggggaaaagattac

SEQ ID NO: 6862 - DNA, 1129 bp, Triticum aestivum
  misc_feature (691)..(691): n is a, c, g, or t
  Predicted polypeptide sequence is orthologous to G2107
gtcgcccttttttttttttttttttttgggccgaaaaaataacccaagtacaattgcgccctccccaagaatagacagcggaggctttcacaatgaacgagcacatagggacatatggggaaaatattcccttctgtttcctcccatatttggtggaacagaagcagagaaaccgtctaaaaacttttaactgcttagtcgaacaagtagctccatggcggtgtctcgacgccaccgagctcaaagtcttcccgccacggtctggtgtccggcgactccgtgaactccgagtagcacgatccggcatccatgccgccaaaccagtgctcattcaacagctcgctggacatggacagggcgctcggtgccggcaagccatcgatttccttctcgtcatcggttgtccgcgcaggggacaatggtgccatggacgcgaccgggtgctgcctttggaacgccaggacggcgacggcgacggcatccttgatctccttggccgtgctgaacgggccggcgaggacggggagcatccgccaggcggagtcggcgaagttgaggcaagcggcgcggccggagagcgcgagaacggcggcgtcgtgcgcgcgcgctgccatctcggcggtggtgaaggtgccgagccaaagcctggagcccctcatcccgagcacgcgcacctcgcacacccaccggncggcggggccccgtcgccgcacgccgcggtacagcgggtggcgcgtctccttgaacttggtccggccggccggccgcttcggcgtttctgacacaccgtcctgtgcccatcacacggggaaggggcatcagcggggtccatcgatcgatcgcagtgttgccggggagctgccgactgtggggtaattaacaaggagtttacctgctgcgttaaaaatttgaaaaaatggattctggaaaggagaccggtgaggttttccatatcttcagtcaaggtcagggtcccgtgcccaattgcgaaccttggttaacaattccgggaattccgaaccgttccaccctgtttttggtaaacttgttctttaggttccctaaatagcctaagggtaaaccgtttctgggggaaatggtttccgcccgcggcttaggtaaatccgga

SEQ ID NO: 6863 - DNA, 1034 bp, Triticum aestivum
  misc_feature (964)..(964): n is a, c, g, or t
  Predicted polypeptide sequence is orthologous to G2107
gggtcaccccagagcggccgccctgtatctttatttttttttttttttttaagccatctagggttcatttctcacaaaagtagaaaccgggaacttcaaactgcctactacaaccttcaaaaaaaaaactgcctactctgttcgttcccaaattgggaagaacacaacgcaactatcgacaactttacactgcgtgctgaattagtcaaacaaatagctccataacggcgtcggtgtctcgacgccggtctgctcggcgtcctcccgcctcgctctgtcgtccggcggcgccatgagcatcccctgcgccaagctctcgtagtacgacccagcgtccatgccgccaaaccactgctcctcgtcgagctccagcaagtcgacggacgacatgtaaaacagagagttgctcgggctggcggccgcctccaccgttggacacgcgactggaagaataatctgctgctgctggaacgcaacgacggcaacggcgacggcaagcttgatctcccgcgcgctgccgaagccgaacgatccggccgcaagcacgggcagcatccgccatgcggagtcggcgaagttgaggcaggcggcgcggccggagagcgcgagcaccgcggcgtcgtgcgcgcgcgccgccatctcggcggtggtgaaggtgccgagccagagcctggagcccttcaccccgggcacgcgcacctcgcacacccactgcccgacccggccacggcgccgaacgccccggtacagcgggtggcgcgtctcgtggaacttggtccgccccgccggccgctttgggggatcccacgacaccgtcctgtgaccctgctcatgctggccgggacttggaggcagcgtcggcgacgtccatctgattcgaaagctagtgaagagggttgagcaccttgaacgatggtgttttttccctaccccttcagtcccatgtagggtccccggtgctcantcggggacccgtgggtcaaagatttccggggattcccggacgggtaccagcctgtttttttgtaaaaact

SEQ ID NO: 6864 - DNA, 1148 bp, Triticum aestivum
  misc_feature (16)..(16): n is a, c, g, or t
  Predicted polypeptide sequence is orthologous to G2107
aggcgacccacgcgtnccgcccacgcgtccgcgactggagcacgaggactgacaatggactgaaggagtaaaaggctccatccaccgatcgatcaaaacctctcaacacagccgctgattcttccagtactcctgctccacacctcccacgagcgtctccgccagctctcgactcagatggacgtcgccgacatcgcctccccgtctggccagcaggggcatcggggacaccggacggtgtcgtcggagccgccgaagcgccccgcggggcggaccaagttccacgagacgcgccacccgctgtaccgcggcgtgcggcgccgtggccgcgtcgggcagtgggtgtgcgaggtgcgcgtgcctgggatcaagggctccaggctctggctcggcaccttcaacacggccgagatggcggcgcgcgcgcacgacgccgctgtgctcgcgctcatcggccgcgccgcctgcctcaacttcgccgactccgcatggcgcatgctgcccgtgctcgcggccgggtcgttcggtttcggcagcgcgagcgagatcaaggccgccgtcgccgtggccgtcgtcgcgttccagcggaagcagattattccggtcgccgtcgccgtcgtggcgctccagcagcagcaggttccggtcgccgtcgccgtcgtggcgctccagcagaagcaggttcgggtcgccgtggccgtcgtggcgctccagcagctgcaggttccggtcgccgtggccgtcgtggcgctccagcagcagcagattattcttccagtcgcgtgcctggcgccggaggtttacatgtcttccggcgacctgttggagcttgacgaggagcaggggtttggcggcatggacccggggtcgtactacccgagcttggcgcaggggattctcgtggcgcccccggacgaaaaaccgaggccgaagcacggggagcaaagggggtccagaacgcccctatggagctgcttggccccttaatttaaaaatactttcaaggtggttaatttaggaaaaaacattctgggcgaggggtcccttcattggaggaatattggggggggtcccgggttctaatttggggggaaagggctaaatgttaaaaaaccaaattttgggttcgaaaaaaaaaaaaaagaggg

SEQ ID NO: 6865 - DNA, 941 bp, Triticum aestivum
  Predicted polypeptide sequence is orthologous to G2107
ctcaaaccaacctgcaactctcaacgcagcgactttccactagtttttgacgctgcaactgatggacaccgccgctgccggctccccgcgtgaggggcacaggacggtgtgctcggagccgcccaagaggccggcagggcggaccaagttcagggagacgcgccacccgctgtaccgcggcgtgcggcgccggggccggctcgggcagtgggtgtgcgaggttcgcgtgcgcggcgcgcaagggtacaggctctggctcggcaccttcaccactgccgagatggcggcgcgcgcgcacgactccgccgtgctcgcgctcctcgaccgcgccgcctgcctcaacttcgccgactccgcctggcggatgctgcccgtcctcgcggctggctcgtcccgcttcagcagcgcgcgggagatcaaggacgccgtcgccatcgccgtcctggagttccagcggcggcgccccgtcgtgtcaacgtcggagatgcacgacggcgaaaaggacgcccaaggctcgccgacgccgagcgagctgtccacgtccagcgacttgttggacgagcactggtttggcggcatggacgccggctcgtactacgcgagcttggcgcaggggatgctcatggagccgccgtccgccagaacgtggagcgaggatggcggcgaatacagcgccgtctacacgccgctttggaactaattatccgactaattaagccatgtacagttttggaaactactccctcggtaaactaatataagagcatttaaatcattaaaatagtgatctaaacactcttatattagtttacggagggagtaggctactagtggttgtgttcttccaaatatgggaagatacagagtaagcatcaggagcaatttttttcccgtatttgaaagcttccggtttctatttgcagggaaggactgaatttgta

SEQ ID NO: 6866 - DNA, 882 bp, Triticum aestivum
  Predicted polypeptide sequence is orthologous to G2107
acgcttgaccttaggcctatttaggtgacactacagaacaagtttgtacaaaaaagcaggctgctaccggtccggaattcccgggatatcgtcgacccacgcgtccgcaaaaccacttcacactcgatcaacccaagagcacccaggacctccaagccggccaaggaacagagcatcgaaggaagaagaagatgtgtccgatcaagaaggagatgagcggggagtccggctcgccgtgcagcggggagaacttctactcgccctccacgtcgcgggagcatcagcaggcgaagcaggcggcgtggacgtcggcgccggcgaagcggccggcggggcggaccaagttcagggagacgcggcacccggtataccgcggcgtgcggcgcaggggcaatgccgggcggtgggtgtgcgaggtgcgcgtgcccggcaggcgcgggagcaggctctggctcggcaccttcgacaccgccgaggccgccgcgcgcgccaacgacgccgccatgatcgcgctctccgccgggggcgcgggctgcctcaacttcgccgactccgccgagctgctcgccgtggcggcggcctcctcgtacggacgctcgacgaggtcccccgggccgtgggggggggggggaggggccttctgcggcggggagcggaggtgccaagggggatgcgatttgggggggcggggggggcggggccttccttccgtaggcgggggatcaggcccagcccttgcggggaccggggaaccccccgggttcggggggggggggcagggggtaacttgggccgcggcccgtctatcgacgtcgactggggatgggggggtcgggctaaatgggctcggctctactttatcaaggtagagctcccctccgg

SEQ ID NO: 6867 - DNA, 1146 bp, Triticum aestivum
  misc_feature (944)..(945): n is a, c, g, or t
  misc_feature (949)..(950): n is a, c, g, or t
  misc_feature (952)..(953): n is a, c, g, or t
  misc_feature (962)..(962): n is a, c, g, or t
  misc_feature (972)..(973): n is a, c, g, or t
  misc_feature (979)..(979): n is a, c, g, or t
  misc_feature (1010)..(1010): n is a, c, g, or t
  misc_feature (1099)..(1102): n is a, c, g, or t
  Predicted polypeptide sequence is orthologous to G2107
gacccacgcttccgcccacacaaacaaccacccagcatcacctcactcaccaccattgttacaaacacatcgacaccagctatataccacctcgtgcaaggccatggaccagtacagctaccgcggcggcggggacgacaatggccagggcgggtacgcgacggtgacgtcggcgccgccgaagcggccggcggggcgcaccaagttccgggagacgcggcacccggtgtaccggggcgtgcgccggcgcggcgcggccgggcggtgggtctgcgaggtgcgcgatcccaacaagaagtcccgcatctggctcggcaccttcgcctcccccgaggccgcggcccgcgcccacgacgttgccgcgctggccctgcgcggccgcgccgcgtgcctcaacttcgccgactcggcggccctgctcgccgtcgaccccgccacgctccgcacccccgacgacatccgcgcggcggccatcgcgctcgccgagactgcctgccccgccgcgccggcctcgtcgtcggccgtggccgccgtggcgtccgcgccggcgcccccgatgatgacgatgatgcacgagtccgcggcggtgcactacgacgactacccgatgcagtacgggtacggcggcattggggacttggaccaggattcctactactacgacgggctgagcgccgccggcggcgactggcagagcggctcgcacatggacggagccgacgacgactgcaacgaccgcggtgggtacggcgccggcgaggtcccgctctggagctattgatcgagccgctccattgaaccattttctagcccgcatgcgctgctccgatgggggctgtggaccacatcacgctaggatcacgagaagcaccggagtccccgcgactatagtacccgcgttatagttatgtgggccctaacccaacaggcaccggcatgctcannaaannannccgggggcncccccccggnngagccngagcccccacgggccccccgcgggggcgcangtgggcccggtgtcgccgcgccgtgccacgccccccccgctgcttgggtccccggaaataagggccgcccgcccccccatctcccgcannnntgcgctcggccgccgatcgtcgggtgccgtcccctgacccccca

SEQ ID NO: 6868 - DNA, 1130 bp, Triticum aestivum
  misc_feature (791)..(791): n is a, c, g, or t
  Predicted polypeptide sequence is orthologous to G2107
ttcgacccacgcttccgcgactggagcacgaggacactgacatggactgacggagtagaaataccgctcctctctcaagtgtctcaacgcagcagctaaacacgctaagctacctcgctgcttaattactccacagtcgacaggctcccggcgacactgcgatcgttcgatggacgccgccgacgccgcctccccgtgtgatggccacaggacggtgtggtcggagccgccgaagcggccggccggccggaccaagttcaaggagacgcgccacccgctgtaccgcggcgtgcggcgacggggccccgccggccggtgggtgtgcgaggtgcgcgtgctcgggatgaggggctccaggctctggctcggcaccttcaccaccgctgagatggcagcgcgcgcgcacgacgccgccgttctcgcgctctctgggcgcgccgcttgtctcaacttcgccgactccgcctggcggatgctccccgtcctcgccggcccgttcagcaccgccaaggagatcgaggacgccgtcgccgtcgccgtcctggcgttccaaaggcagcaccgggtcgcgtccatggcaccattgtcccctgcgcggacaaccgatgacgagaaggaaatcgatggctcgccggcgccgagcgccctgttcatgtccagcgagctgttgaatgagcactggtttggcggcatggatgccggatcgttctactcggagggcctgttcatggagtcgccggacaccagaccgtggcgggaagaactcgagctctgtggcgtcgagacaccgncatggagctacttgttcgactaaagcagttaagttaaaatgttgtatagatagtttctctctcctgttccacaaatatgggaggaaacagagggggatatttccccatatgtccgtatgtgctcgttcatggtgaaagcctccgctgtctatttttggggagggcgcatttgtacttgagttatttttcggacatcaatttgagtgttttttggcgttgagttgatcattggagtgtctagtgaatacgaatggtacttccaattaaaaaaaaaaaaaaaaaaaaaaaagggggcggcctaatttcctcggggggcaagtttaggttcaggtttttgta

SEQ ID NO: 6869 - DNA, 1134 bp, Triticum aestivum
  misc_feature (770)..(770): n is a, c, g, or t
  misc_feature (1006)..(1006): n is a, c, g, or t
  misc_feature (1008)..(1008): n is a, c, g, or t
  misc_feature (1018)..(1021): n is a, c, g, or t
  Predicted polypeptide sequence is orthologous to G2107
aagcagtcggtaccggtcccgattccctggatatcgtcgacccacgcgtccgcgactggagcacgaggacactgacatggactgaaggagtagaaaaagctctgaatatacagccacctgcgttacaccacaaaccactctcaacgccagctgcgaccgatggacaccaacgccgcctggccgcagtttgacgggcaagagtacaggacggtgtggccggaggagcaggagtaccggacggtgtggtcggagccgccgaagcggcgggcggggcggaacaagttgcaggagacacgccacccagtgtaccgcggcgtgcgccgccgtggccgggaagggcagtgggtgtgcgagctgcgcgtgccggccggaagccggagttactccaggatctggcttggcaccttcgccagtgcccagatggcggcgcgcgcgcacgactcggccgcgctcgcgctctccggccgcgacgcgtgcctcaacttcgccgactccgcctggcggatgatgcccgtccacgcagccgggtcgttcaagttggccgccgcgcaggagatcaaggacgccgtcgccgtggccctcaaggagttccaggagcagcagcgccctgccgacgagtcaacggcgccgtcgtccacggccgaggagagcgcgctctccatcatccccagcgacctgtcggggctcgacaatgagcactggatcggcggcatggaggccgggtcgtactacgcgagcttggcgcaggggatgctcatggagccgccggnccgacgagcttggcgggaggaccgcgaacacgacgacggattcgacacgtcgctgtggagctactagtgtgatcaaactgattagcaatgtaaagatctagagagtactgctagtgctagattgtgtttcaccaaatatgggaagaagagagagtaagcatcgggggaaaggtttccccccaatgtgaaaccgctcggtttctactcccggaaggggcccaattgagcttctaaananaaaaaaaaannnnaaaaaaaaaaagggggggggccgctctaaaattttcctcgaggggcccaaggctttaccggtacccggttttcttgtcaaaaggggcccctattagggggccgtatttaaggc

SEQ ID NO: 6870 - DNA, 1141 bp, Triticum aestivum
  misc_feature (966)..(966): n is a, c, g, or t
  Predicted polypeptide sequence is orthologous to G2107
ggtcggtaccggtccgcgattcccgtgatatcgtcgacccacgcgtccgcgactggagcacgaggactgacatggactgaaggagtagaaactcagttctcacccacccaaacaccgccgctgaaacctccagttctcagcacacatcgacctgctcgaccgtctccactagcgctcgtccaagatggacgtcgccgacgccgcctccccgtctggccaggagcagcaggggcacaggacggtgtcgtctgagccgccgaagcgacccgcggggcggaccaaggtacatgagacgcgccacccgctgtaccgcggcgtgcggcagcggggccgggtcgggcagtgggtgtgcgaggtgcgcgtggccggggtgaagggctccaggctctggctcggcaccttcaccaccgccgagatggcggcgcgcgcgcacgacgccgccgtgctcgcgctctccggccgggctgcctgcctcaacttcgccgactccgcctggcgcatgctgcccgtgctcgcggccgggtctttcggcttcggcagcgcgcgcgagatcaaggccgccgtcgccgtcgccgtcgtggctttccagaaggagcagattatcccagtcgccgtcgccgtggtggcgatccagaagcagcagattatcccagtcgctgtcgccgtcgtggcgatccagaagcagcagattatcccgtcgccgtcgtggcgctccagaagcagcagattccagtggccgtcgccctcgtggcgctccaggaacagcaggtcccagtcgccgtcgccgtcgtggcgcttcatcggcagcaggttccagtcgcgtgcccgggaaacctcggcccgggcagcgctctgttttacatgtcgtccagcgacttggtggagctcgacgaggagcagtggtttggcggcatggaggccggtcgtactacgcgagcttggcgcaggggatgctcgtggcaccgncggacgaaagacgaggaccgaggacggggagcagagcggcgtcagaacgcgctatggagcactggtcccctaattaccatgtaagttgacccctcggccggaataattgtgccaaaggataaaatgaatgttttagacctaaatcgttagaatctcaattccaaaaaaaaaaaaa

SEQ ID NO: 6871 - DNA, 1127 bp, Triticum aestivum
  misc_feature (669)..(669): n is a, c, g, or t
  misc_feature (679)..(679): n is a, c, g, or t
  misc_feature (682)..(682): n is a, c, g, or t
  misc_feature (697)..(697): n is a, c, g, or t
  Predicted polypeptide sequence is orthologous to G2130
cccacgcgtccgccacaaccgcacgccaccaacacccccgccgcacccgccccacccaccgacggaccaaaccctaaccctagcccttccccggcggctgcggctgcggcggaggcggaggcggaggcggaggcggcggaggcgcagccgaggggccgcgtggtgcggatcatcgtgcacgacgccgacgccaccgactcctcctccagcgaggacgagtcggcgccgccgccgctggccccgatgccgacgaccaaggaggagcgccggagggagcgcaggaagcgccgccgcgtcatggaggccgggaggagggacgactcggggccgccgcagccgcaggcaaccggggcgcgcacgccctcggtgcggtaccgcggcgtgcgccagcgccgctggggcaagttcgcctcggagatccgcgacccgatccagggccgccgcctctggctcggcaccttcgacaccgccgaggaggccgcagcagcctacgacgccgccaagatccgcatcagcgggagccgccgcccggctgacggcgccaccggcttccctttctccttcccgccgccagagcctgccaagccgaccgtcttgcgtcttcccatgccgcagcctgccaagccgaccatcctgcgtcttcccatgccacagcctgccaagcagatnacctcgccgncgnctcctcctcctccgnctgagcctgccaagccgggcatctcgccgactcctctgccagctaaaccgttcgccctcccgttgaagctgaggctgacgctttcctttcatgcacagggtaaggacaaagggtggaaccggtgctcctccaggcaatgttcaggaagaggggggacggggattgttaatgccaaggccaaaggtggggttttttaccattgccaggcacagtcaacggtggagggttgggggcttccccagggaaggtccaggtataaagggcggggctcgtcaaaatggttaaagaaggcccctcacctttctccgaatccaagaggggccactcccattggcggaaattccccccgcgaaaacaaaaaccgcgcgggcgtgcgcccccgtttgtggcccccccgccgcgcctttcgggtgaggatagcaatcggtga

SEQ ID NO: 6872 - DNA, 539 bp, Triticum aestivum
  Predicted polypeptide sequence is orthologous to G2141
ccctggtgccaagctgcaacaagatcaccggcaaggcactcatgctcgacgagatcatcaactacgtccagtcgctgcagcgtcaggtcgagtttctgtccatgaaattgtcgaccatgaatcctcagttggagctcgacgagcagcacatcccgtccaaagagatgaaccagatggcagtgcccggcttctcctacgccggttcacccgtcgccgtcgcgaccggccacggccacggggcagagctagaaggcaccttcagctgggagcatgacctccagagcatggtgcagatggggggagccagcagcagccataggcaggacccccaagctttctacggcgagtgaaatactaccaatcacctttccttggttgcttcatgtcctgaaaacggccggttctcgattctgtgctgaggttgccctgtctggcccgttccatgtcattgaatgcaggcagtggccagccggcgactacagtaaatacatgaaggttgaaccaaaaaaaaaaaaaaaaaaaaaaaaaaaaaaaaaact

SEQ ID NO: 6873 - DNA, 745 bp, Triticum aestivum
  misc_feature (26)..(26): n is a, c, g, or t
  misc_feature (711)..(711): n is a, c, g, or t
  Predicted polypeptide sequence is orthologous to G2141
gtggggctgctcggccccctttttcngttccagccccgaatacaacaagaacacgcccgatccatccatggatcgatttacacacggccacgcacgcacggcgcagttaaaggctccagctgtgcactgcacgcacgcacgcacgggcggcagcagcttcagtggtcatattgctcgtgcatgtggcctctgctctgctgcccgtcccgttggcggtcagatgattgatggctaggcctaggccagctagctggacaaacaaactcgggccgggtggctcttcaggaggctggctggcgatggcatcaatcacatttggtaggcgtcctgggacggcctgatgctgaggtcctgcgagtgcgagtgcgaggagcccatggacgggtacgccatctgcgcaacgtgatcgctgaacgggccattcaatgcgtgggccatctgtgaatgggatccatcttttgctcctagttgcgcttgcatgattcttctgaacacgtccgagttcgccatggcggcggcgcctccctgcatcagccccggctgcgacagctgcagctgcgggtgcatcatctccggggagaatcccatcgacgaggaggacaccccagggaagcgaagaagatcctttgagagaagcccttctatgttgaggtcaagcctcgggtttactgtcgccagcttcatcgataagaactcgacttgtctttgcanggactgaacatagttgatgatctcgtcgagcatc

SEQ ID NO: 6874 - DNA, 998 bp, Triticum aestivum
  Predicted polypeptide sequence is orthologous to G2141
gggcggatgcgacgacccacgcgtccgaaaacgatattgagacgtctagggagatgaatgtggaccaaggttgaaatggtgcattattgagcggtgataggcagcaaggagacaccgagagttcacatggtgttgatgcctctagcaaggagttaagcaagccggagtgcagtggtggcgctggtcaggatgaagggcctagtgtctcttgtcccaagaagaggaaaagaccaagccaggatcgtggggtgaagcatgtacaagaagggagccagcaattggcaactctggctgcgaagcgggagaaagatgacgacgacaaagatgaaccaaagaggcctgttgggacatccagaaagtccaacgggaagcaaactgaggataaatctgatgcgccaaaggaagattacattcatataagagctcgaagtggccaggctacaaacagccatagtcttgcagaaagggttcggagggaaaagattagtgaaaggatgaaatttcttcaggaccttgttcctggttgtagtaaagtcattggtaaggccgttatgctggatgagataatcaattatgttcaatcattacagcggcaagttgagtttttgtcgatgaaactttcagctgtcaatccagcactagacttcaacatagagcgcattctatctaaggatttatttcagtctcaaggaactgcatcgtctacctttggcttcttaccagacattggccatcaatttttgcatccaccaaaacattctcaagctgcgttgcacagcattgtaaatcccgccgatgcatttggaagggtaacaaatgctccggtaggatgtacattcaaagaaggcacacatcaggtgcccaataaatttgatggagagttccacaacgtgattgggatgcctttaccctgttttatgaccatgattcaaatgataaacctgagcaatagatccgcaaccgaagcaagaatcataacgggccagagattcaacgaa

SEQ ID NO: 6875 - DNA, 836 bp, Triticum aestivum
  Predicted polypeptide sequence is orthologous to G2141
agcttgacattaggcctatttaggtgacactatagaacaagtttgtacaaaaaagcaggctggtaccggtccggaattcccgggatatcgtcgacccacgcgtccgcgggaggaagcagggcaaggacggcgcctccaagctcccggagccgcccaaggacttcatccacggccgggcccggcgcggcgaggccacggacagccatagcctggccgagagggtgagaagagagaagatcagccagcggatgaagctgctgcaggacctcgtgcccggctgcaacaaggtggtgggcaaggccgtcatgctcgacgagatcataaactacgtgcagtcgctgcagcggcaagtcgagtttctgtccatgaagctggccacggtgaacccgcagctggacttcaacaacctgcccagcctcctcgccaaagatatgcagcagcagtcatgtgggcagctgcagcagggctcgtcgcatttcccgctggatgcgtcgggcgcgccgctcccctacatgggccaggggagcggcgaccctctcggctgcggcatgtccgacggcggcggcatgggcgacgatcagggcgccatgcaccccggtggaccaggccttctgccggcccatggggttcctcgcagcagcagcagcacttcctcagcgacgccgcctctcaggttgggggctttctgggcagatctgcagagcgtggttcagatggacatggggcagaaccaggagatcgccacttcttccaacagctacaaacggtcgttgcaaacggccaacatgaaatggagctttgactcaccggcggggagaaactccatccgaccggaa

SEQ ID NO: 6876 - DNA, 835 bp, Triticum aestivum
  misc_feature (765)..(765): n is a, c, g, or t
  misc_feature (789)..(789): n is a, c, g, or t
  Predicted polypeptide sequence is orthologous to G2145
tgtacacgacgttagttgcctagcttatcatacgacttactatagggaccactttgtacaagaaagctgggtacgcgtaagcttgggcccctcgagggatactctagagcggccggccttttttttttttttttttgccaagaaaagtatgaagtaaaacaaagtgtagttacattatacatgtataatgattggaactatatataaggaccagaatcaattaatccctatgcagttcagtgttagctagcgccacatctccagagtggtatttatttttgcagagcagcgatgtgcatctcaagactgctgacgttaatcccattgtaagcgaggggtgcgtacatccacatgtcgtcggagctcaacaacttaatctgaagctgcataaacttaacatactccactgcttcctctagcattgtactgatgtcaacctttgttccattgggaaccaagttctgcagggttttcaatctttcattgatcctctctctccttttccttgcatagaggctctgaggatcagttgctgctccacggctggtctgtgctgtttgatcatgttgctcacctctccacttggtgttgccatccaaatccccatcttctgaggtgcagctgctggagctttgaggatcgatgacataggtgtcgtcgccttcgatgtccttgctggtttgcaatcttttgccagcctttttggccttccttgatgcgtgtgcagtctgactctctgtatccagtttatctcgtgtctcacgngtgtgccatgtgtaagatcatctncggcgcagtagtttcgcatgatgatcgaatggagtctacggatcat

SEQ ID NO: 6877 - DNA, 427 bp, Triticum aestivum
  misc_feature (266)..(266): n is a, c, g, or t
  Predicted polypeptide sequence is orthologous to G2147
ttttttttttttttttttcgaaagagaaacaacagtttgatttcggtgtgatttgtgaaaaaatccagtgttctcaacatggcctggatttgaccgatccttacaggttgcaagacgccatggactgatcgagaatggaagccttatgagttctaatggcctagagctacatgctaatcagtagtggttccttcttggttgttcagtagaaccagttgggtccaacgtgcttctgcggctgcggctgctgcatggcgccggcgtantccgccgctgacaggtcgaaccctgggccgaacctgcccagctccggcgccgccatgccgaacggcgcgtcgtcgcccatgaaaaacgccgcgctctgctgctgctgctgctgctgctgctgcatcacgttgttcgcgccagcaagcgagcgtggcgccag

SEQ ID NO: 6878 - DNA, 669 bp, Triticum aestivum
  Predicted polypeptide sequence is orthologous to G2147
tgtcgtcgtacgctattcccatgccaatgtccatgggaggagaggagcaacatggcttccttgaatccggtacattgcctcctttcatgggctatggtgcatcatcatcgctggtgcccccatcgtccctacctgcatcttcttcgtaccagctgcatgacactggggccagatcgtcaatgatgggtactgcggtgctcctgatgatgaacgaccgctacttcgggaaccaccactaccagaatatggctaccccaccacgaccgttggtgtcgttctaccaccatgaccaccaacagcagcagcaacaacaacaacacatgattcaaatgccgatgcagatgcagataggtgcagatgagggcctcatgatcggggtcgagcctgggagcgggccatcatccatagtgtcgcaggaggatactttggccaggttgagcagcaacgacgttgcaacaactgctgaagagatctcatcagtgaacatgggtacggatggcatgtggaagtactgataatcagatgatccaagtactaatatatatactatcagaagatcgatcagtatataccgccacacacacacacacacacacacacagatctatatatatatctatatatatatatatatctcggtctgcactcattcactatagtgtgtgagac

SEQ ID NO: 6879 - DNA, 380 bp, Triticum aestivum
  Predicted polypeptide sequence is orthologous to G2157
tttttttttttttttttttaaatgcactttgccatattttctaaggtatggaaattatttcgctcagacagccataactgaacatatcaacccaaataaccatcacccactcttaaacctcacttttataataaaatccactaactcgtgttcaaattgaaccagtaatcgacgccgccttggcaggccatcaacaaaggacaagggcggaaatgaccttcctatcttagtgctagtaccacctgcttatatactggacccacccttcatgccgggctctaccacaatggcggcacataaaatatatcagaataatgtaccaccatttatgttcttcaagcatggcggtgtgagcttttcagtggagccagacacggtga

SEQ ID NO: 6880 - DNA, 598 bp, Triticum aestivum
  Predicted polypeptide sequence is orthologous to G217
tcgcggccgcgtcgacctcgtctcctcccttcaagctcctcgatggtagttggaaactgcacatgctcaagtggcctgtcctcacccactgtatcataaaagcctggagggggtctcttttcaaaagggatctcagcattatagtcaattccctttctcttccttttcttgtgccggttgtcaataccagctgccttcagttctctccttttttgcagtgatgcaagccgcctcgcctcttcaagctgtttctctcttgccttccgttttgcctttttacccctggtgttagccaagcgagcccttgcctcagaaagcatttccttttcatcttcatccatgtcaacaggatccggacgtgcaggttttgactcggggtttggatcaatctccccaggtcgcaactttcttgggtcatcattaggctcataattctcatcctttgcacaggcagcatcgagcaatttttcataacgctcgaggcactgggatggtgttcgacccacgataggtgcaatagtcctccattgagtaggcatgagcttagcaagatggagcagcttctcatcctcttcccttgtccactcagtcttcttga

SEQ ID NO: 6881 - DNA, 702 bp, Triticum aestivum
  Predicted polypeptide sequence is orthologous to G217
gagaatcttgcacgtttaagggaatcacaaacacctcttttaggaggcgataacccagagcttcacccatcagatttctcaggcgttacaccacgtaagaaagagatacagactccgaatcccatggcaacgcctctggctagccctggccctggtgttaccccaaggattggtttgacaccgtccagagatggaaattcctttgggttaactccaaaaggaacccctttcagggatgagcttcacataaatgaagaggtggaaatgcaagacagcgctcagcttgagcttcgtaggcaagcagagttaagaagaggtctgcggtctggttttgcttctattccacagcctaagaatgagtaccagatagttatgccacctatcacagaggagaaggaagaagctgaagagagaattgaagaggatatgtcagacaggttagcacgagaaagggctgaggaacaagcaaggcaggaggcattgctcagaaagaggtccaaagtgttgcagaggagtttgcctaggccacctgctgcttcagtggagattctccggcaatctcttattaaaggtggtgaaagcagaagtacctttgtgcctcctacatcacttgaacaagctgacgagctaataaatgaggaactccttaggctccttgagcatgataatgctaaatatcctcttgatgaacaaactcagaga

SEQ ID NO: 6882 - DNA, 856 bp, Triticum aestivum
  misc_feature (612)..(612): n is a, c, g, or t
  misc_feature (761)..(761): n is a, c, g, or t
  Predicted polypeptide sequence is orthologous to G217
cgcttgacattaggcctatttaggtgacactatagaacaagtttgtacaaaaaagcaggctggtaccggtccggaattcccgggatatcgtcgacccacgcgtccgagaagaagcggatcgatcgagtcggcgagagcgatggcggcgctccggcacgcggcgaggcgtgcgctccagcagggaggagcgcaggtgaggccttcggtcgtggcggagggacctcggcggctcttgctaaacggcgcttcccctgcccgccggcccatgtccacctcctccatcagtcgcaagccgacatctagtgccaagcctcacggcgagctggaattgctggaaatgcgattcaagaagacgaaggaagagttgtttgatttgctcgtagcagtgagaagggcagaactttacccacagttgtcctgggaagacatccaaactcatcggctcatcactcaccttgctgctcaagtggagcctaggcctcacgaccccaattggcgcatgtttcgacgaacaagaagactcaacgattttaacactataaccgttcctctgggatattttggtctgttcgcctactgcgtggcaactaacatgagagaagatggcgctancaagcagaatagtgaagccaatttcgtctccgagccagagaacgatatgaactagctttatatcagaagtctagatagtctatgatatgaactaccccctccgtttccctaataagtgtcgtttcaaatatgaactagccttgtattancagtctagaaagtctcctgagcgtatgtaattagtattatgacatctagttgtagttgtaggatttgctggatgctggccaccggtatggaatcc

SEQ ID NO: 6883 - DNA, 693 bp, Triticum aestivum
  misc_feature (244)..(244): n is a, c, g, or t
  misc_feature (246)..(246): n is a, c, g, or t
  misc_feature (249)..(249): n is a, c, g, or t
  misc_feature (251)..(252): n is a, c, g, or t
  misc_feature (258)..(258): n is a, c, g, or t
  Predicted polypeptide sequence is orthologous to G222
ttttttttttttttttttagggaaatgttttttaaataaaaaagaaagaaagagaagtcaaaatattgttccaaattgaactcgaaatttgcgaggctctgttcttggcagggtaacgagaacttgtgctccaacggctcgtcgtgctgctgctccatctccgccttggcccagtgcagcacctcgccgtcgagcacgctgcccacctcgccgccgtagttccagttgctgctgttgcttgagncntcntnnccccgntttagcccagggttctccgacacgtccagcacgcagctgtagtcggcggcgccgaacccggcatcgtcgtccgcgccgtccttgcagtcgccgaactggacgtacagtgcggccgcgttcgcggcaccaaggtcgccggcgaacccgccgccgtagtcggcgcacaccgggaacgggtcgaactccgccgactgcttcagagcgaggctgccgtcggcggccgcggcaaggggcttacggtcttccacttccacgtccggcaatgccgccgtgactgcgccggaggccatgggcttgtgcgtggcggggtcgatgccttgttgccggagcttcttcttgatgcagctgttccagaagttcttgatctcgttgtccgtccggcccggcaggtgcgacgcgatctgtgaccacctgttgccgaggatctggtggagc

SEQ ID NO: 6884 - DNA, 1010 bp, Triticum aestivum
  misc_feature (693)..(693): n is a, c, g, or t
  Predicted polypeptide sequence is orthologous to G222
tcgacccacgcttccgaccggcggccgatcatcccgatcgccattacatccaccgactttgcctcgctcgtcggagtcacttagctacgaggccagcagctgccgtagagtaatcaatagaatgggacgtccgtcgtccggcggcgtggggcagcccaagctccgtaaggggctgtggtcgcctgaggaggacgagaagctctacaaccacatcatccggcacggcgttggctgctggagctccgtccccaggctcgccgggctgaaccgctgcggcaagagctgccgtctccggtggatcaactacctccgccccgacctcaagcgcggctgcttctcgcagcaggaggaggaccacatcgttgcgctccaccagatcctcggcaacaggtggtcacagatcgcgtcgcacctgccgggccggacggacaacgaaatcaagaatttctggaacagctgcatcaagaagaagctccggcagcaaggcatcgaccccgccacgcacaagcccatggccgccgccgacacggccacggcgccattgccggatccggaagaggaagaccgtaagccactttccgcggcggtcggcggcagcctcgctccgaagcagccggcggtgttcgacccgttccccgtgtgcgccgactacggcggcgggttcgcccacggcctcggcgcggagaacgcggncgcattgtacggtcagctcgttggctgcaaggagggcgcggacgacgacgccgggttcggaggcgcggactacagcagcgtactggacgtctccgagaacctgggctacggggagagctcgagcaacagcagcaactggaactacggcggcaaggtgggcagcgtgctcgacggcgaggtgccgcactggggcaaggcggatatggagcagcagcacacaccgctagaagcacaagttgtcgctgccctgccaagaacagagcctcctcgcaagtttcgatttccactgggattgggacccatatttctgaactttt

SEQ ID NO: 6885 - DNA, 1099 bp, Triticum aestivum
  misc_feature (25)..(25): n is a, c, g, or t
  misc_feature (719)..(719): n is a, c, g, or t
  misc_feature (1042)..(1042): n is a, c, g, or t
  Predicted polypeptide sequence is orthologous to G222
agcggccgccctttttttttttttntaccgagaaaaagagtaagaatcttattccttatccttacaaaaaaaagagagagagcagaatcccatggtaaattacagagtgttcacatttctatacctcttatttcggccatgtatatagaagaaccataaacagacggtgaaaagaaaagaaacagtgttaaaggagtaacaaagactagagaaaattgacaaagtacagtctctaatcttcccagttggttggtcttgcccgtgtccgtgtgtaaataagaacaatatatacgacgatggctagatcagaacggcctcagaagtactcgaggttgaagtcaaaatgcgccatgctgtgctcttgctggccgtggcagggcagcgcgaacttgccgtcctcgtcgccggcgtaggcggcgaaaggctccaccttgctctcggaggcccaatgcagcgcctcgccctccagcgcattgctcgcctccggcgcgctgttccagttgctgctgttgctggagctctcgccgtagcccaggttctccgacacgtccagcacgctgctgtagtccacgaacccggccgcgtccttgccgccgaggtggtcgtacagcggcatgcccgccccgtcgaagccggcgccgaaggtgtcggccaccgggaaagggtcgaacacctgctgctgctgctgcttcagggctataccgtcggctccctgcggnctctcgtctttcgacgcctggtccggttccacccccgccacgccggagatgggcttgtgggtgctggggtcgatgccgcgctgccgcagcttcttcttgaggcagctgttccaaaagttccttgatctcgtgtccgtccggcccggaagtgagacgctatctgcgaccacctgtccccaggatctcatgcaggccgacgatggggtcctctcctgctgggagagcttccccgtttcaggtggggggcaggtattgattcaccgaaccggaagttctgccgaaccttggaaaaccgggagttgggccggaaccccaaaccccanctctaaaggataattggtttgtaaattttcgtccccccgggaaacaaacccctggga

SEQ ID NO: 6886 - DNA, 1187 bp, Triticum aestivum
  misc_feature (27)..(27): n is a, c, g, or t
  misc_feature (777)..(777): n is a, c, g, or t
  misc_feature (869)..(869): n is a, c, g, or t
  Predicted polypeptide sequence is orthologous to G222
tgccgcaggcaacgaaccaacaaccancacactgacgaggtagctcgccggttgctcggtcgtttgttcgttcgtcccttgagccggccgcgcgcgcgtgccgggcgggcgggagaatgggacggcacgcgggcaccggcggcggcggcggcgtccagcagaagctgcgcaaggggctgtggtctcccgaggaggacgagaagctctacaaccacatcatccgctacggcgtcgggtgctggagctccgtgcccaagctcgccggtctgcagaggtgcggcaagagctgtcggctgcggtggatcaactacctgcgccccgacctcaagcggggaagcttctcgcagcaggaggaggacgccatcgtcggcctgcatgagatcctggggaacaggtggtcgcagatagcgtctcacttgccgggccggacggacaacgagatcaagaacttttggaacagctgcctcaagaagaagctgcggcagcgcggcatcgaccccagcacccacaagcccatctccggcgtggcggggttggaacccgaccaggcgtccaaagacgagaggccgcaggcggccgacggtctcgccctgaagcagcagcagcagcagcagcaggtgttcgaccctttcccggtggccgacaccttcggcgccggcttcgacggggcaggcatgccgctgtacgaccacctcggcggcaaggacgcggctcggttcgtggactacagcagcgtgctggacgtgtcggagaacctgggctacggcgagagctccnagcacagcagcaactggaacagcgctccggaggcgagcaatgcgctggagggcgaggcgctgcattgggcctcggagagcaaggtggagccnttcgccggctacgccggcgacgaggacgacaagttcgcgctgccctggcacgggcagcaagagcacagcatggcgcattttgacttcaacctcgagtacttctgagggcttttctgatctagccatcgtcgtatatatggttttaccacggggacgggcaagaccaccaccgggaaattaccaagggacttggcaattttccagctttattaccccttaaaccggttcctttttttcccggccgttatggccttatttatttggcgaaaaagaggtataaaccggaaccccgtaataccagaatttgccctctaatta

SEQ ID NO: 6887 - DNA, 811 bp, Triticum aestivum
  misc_feature (29)..(29): n is a, c, g, or t
  misc_feature (649)..(649): n is a, c, g, or t
  misc_feature (661)..(661): n is a, c, g, or t
  Predicted polypeptide sequence is orthologous to G2226
ccccgcggtattagatataggcctacctnaggtgatagattgaacaagtttgtacaaaaaagcaggctggtaccggtccggaattcccgggatatcgtcgacccacgcgtccgccaccacaccgcagccgctcagaccgccccgcccccgaaagaaggcgcaaattgcagacgggtccacggatcgatccccaatcccaatcttcccggccgccgcgatgggcatctccagcatgccggcgcccaaggagagcctcctgatctacctgctctaccacgccgtcgtctcgatcgccgccctggcgggcctcctccgcgccgcgctcgtcttcctcggcctccccgcgccgccctcgctgctggccggcgaggacgccgacggcgccgaccagctcacggcggccaccccggcgggccccagcctggcggagcggttcaggagcaggttccgccccgcgcggttcggccggagaaggggcgcggcggcgtcggcgacacccgactgccgcgtctgcctggtgcggttcgaggccgacgccgtggtgaaccggctcccctgtgggctgctcttccaccgcgcctgcctcgaaatctggctggactacgaccacggcaactggccggtctgttcgtcttggcttctcccgggncggcgcctccgncggcgacgaatcgtggtctgcgccgggggccaccctgaacggcctggattttgagaagacgagcgaagagaccaggaagagagagattccgcccgtccgcgtccccccgggctatgtgttagctcccgggtgtgggcgtctccgggttga

SEQ ID NO: 6888 - DNA, 831 bp, Triticum aestivum
  misc_feature (517)..(517): n is a, c, g, or t
  Predicted polypeptide sequence is orthologous to G2239
aagcttgaccttaggcctatttaggtgaactctagaacaagtttgtacaaaaaagcaggctggtaccggtccggaattcccgggatatcgtcgacccacgcgtccgaacatccgcagccagtcagctagctaggttcccagttaggcgcggcgagctagcgacgacgagccccggagcccgcccacatgtcccccggcgcgcgctcccgaaagatggaacacgcgctgctcgccgcactcctggcgtgcgcgctcgcgtcggccggtagcgcgcagccggcggagccgaggcaggggggctatgacaacgacttggccgaccaggagatgcgcgtcagcacgaccatggtcgcgctgctggccgccgtcgtcgccgtgttcttcttcatcctcgcctccatcatctacctccgccactgcaccggctactcgtacccccacgccccgcggccggacgactcccgcggctccggccccggcgccggcttctcgagcttcatcgccaggcggcagcagncggcgggcggcgacgcgcgggctcgccgccgaggtggtcgaggcgttccccaccatgcgctacgcggaggccaaggcgctgcgcgtgggggaggaaggcggccccccccctggattgggcggtgtgcctccgcgaattcgaggacgaggacagggctccggctgctgcccagtgcagcccccccttccacccggacgccatgggggaggggctcgcagccacgttccttggccgggttggccgcgtgaaccttcaacccttagaagggagggggggcagcagaggaacgaggcgaataaaccccccgggtggcg

SEQ ID NO: 6889 - DNA, 845 bp, Triticum aestivum
  Predicted polypeptide sequence is orthologous to G225, G682
acgcttgaccttaggcctatttaggtgacactacagaacaagtttgtacaaaaaagcaggctggtaccggtccggaattcccgggatatcgtcgacccacgcgtccgcccccaccaccaccaacgaccgccgcctacactcacaagctaacctcaccatttcaggaagcatatgagcagcgaaagcttgggcaagaactccaagatcatgggtggccgtgaaagaaaagaagttaatagcaccgcaaagcattttgttgatttcacagaagcagaggaagatcttgttttcagaatgcacaggcttgtcgggaacaggtgggaacttatagctggaagaatccccggaagaacagcagaagaagtagagatgttctgggcaaaaaggcaccaggaccaatgaaaatgaaaacaggatgcatgcagtaaaatagattgacatataggatcatgtccatcaaaaacctgtgttgatcttactcgtcctatcttctcagccatgctaaaagcaacttgttctgtaccaagcatggatgtacataagaaaacctcaagaaaaaggaggaacatgtgctaaataaacaaaaatatgaattcgctttgttccaggattaaaaaaaaaaaaaaagggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagctggggatctttgtgaaggaccttacttctgtggtgtgacataattggacaactacctacagagatttaaagct

SEQ ID NO: 6890 - DNA, 1106 bp, Triticum aestivum
  misc_feature (637)..(637): n is a, c, g, or t
  Predicted polypeptide sequence is orthologous to G2251
acccacgcttccgcgactggagcacgaggacactgacatggactgaagcgagtagaaagattttagcttagatcaagtacatatatcctctgttcctcccccgcaaacgatagacaggcctggccggcgcagcctgtgacgttcgagctcccgccgggcgtccacgcgtcgtctccggccatggggttccccctggtgtgctactgcgttgccatccccaagccggtcatcgccttctgcaagctcgtcgccgccgtcagggacgccttcctcctgctgctctccctcgtcggcctctgccgctccccgcgccgctccgtggacgacgccccgctgcccgaggaggtcaaggagcgcctcccggccgtcgagttctccttgctggcgcgtccggcaaagcaggggtgccacgacggggacgacgacgtcgccgccgcggcggccacgtgcatcgtgtgcctggagaggctgcgggcggcggacgaggtgcggcggctgggcaactgcgcgcacgccttccaccgcggctgcatcgacgggtggatcgacctcggccggaccacctgcccgctgtgccgctcccacctgctgccccgcgcgcggagggacggcccgctcgccagcctcctcacgcgcngttggtgacgaccaaccgcgccactcgttagctcggaagccacgtctttcgttgtcccagcgcggtggcggccgacacagagaatcgcgatctcgaccgggtgcacgtatatttaaaaatggtgggtttacattcgtctcaaaatcggggatttattttagtttagggcgccaatttggtatagcccatccactcaagaaggcacccaataagggccccaagccttagtttttttttccgtaaagaaggatttagttggtcccaaatatatccccgggccgggtttgggctaagtggatcctcgaaaatgttaaacagcccccaaaagccattttcgctggttcgaaattgtaacaatcccaacccggggggaactcccaacgtaaaaagtgggtattaacccaaaaccccttatggcttcaattaaaaaaaaaaccttggagggttgtgttaaaaaaaaaacaaaaag

SEQ ID NO: 6891 - DNA, 642 bp, Triticum aestivum
  misc_feature (376)..(376): n is a, c, g, or t
  misc_feature (396)..(396): n is a, c, g, or t
  misc_feature (401)..(401): n is a, c, g, or t
  misc_feature (408)..(408): n is a, c, g, or t
  misc_feature (444)..(446): n is a, c, g, or t
  misc_feature (473)..(473): n is a, c, g, or t
  misc_feature (479)..(479): n is a, c, g, or t
  misc_feature (484)..(484): n is a, c, g, or t
  misc_feature (489)..(489): n is a, c, g, or t
  misc_feature (503)..(503): n is a, c, g, or t
  misc_feature (506)..(506): n is a, c, g, or t
  misc_feature (520)..(520): n is a, c, g, or t
  misc_feature (523)..(523): n is a, c, g, or t
  misc_feature (534)..(534): n is a, c, g, or t
  misc_feature (543)..(543): n is a, c, g, or t
  misc_feature (545)..(545): n is a, c, g, or t
  misc_feature (562)..(562): n is a, c, g, or t
  misc_feature (569)..(569): n is a, c, g, or t
  misc_feature (571)..(571): n is a, c, g, or t
  misc_feature (581)..(581): n is a, c, g, or t
  misc_feature (586)..(586): n is a, c, g, or t
  misc_feature (605)..(606): n is a, c, g, or t
  misc_feature (613)..(613): n is a, c, g, or t
  misc_feature (632)..(632): n is a, c, g, or t
  Predicted polypeptide sequence is orthologous to G2269
gattaaaacattggtcagactgtatactgatcatggatgttgattaagaaagttgcaaattttgtgcatgcaacttccacactgcttaagtgtattgttattcttctaggcaaaagctgacgaaatctgatcaaacttgtcataatcaaccaatacctactttgatctagtccctctactcttcataagtacaaggcttgctatgtactaaatcaacacattcaatatctcctttgatctagtcgctctactcataggaataagaacttaatatgtactgaattaacacactttccgcaaaaagaacaacttcttgtggctgggttgcctacagaagttaaaaattctccttggtggaactcgatttcgtgttggncttcctccaaaaatcttgcncaagncaccacnctttggttacacggtgcaccgcagtagaaacccgannncgtcacggggtttaggcaaaccttgtnaacttncccantttgncgggaaatggcctnaancggtccggaaaatncanccttcttggangttaggacngncagggatacccgacggntccgtcngnaaacatgatntaggnccagaacctctgcgacaanncctcagnccggacaccaagggggcgnccatttccaa

SEQ ID NO: 6892 - DNA, 722 bp, Triticum aestivum
  misc_feature (21)..(21): n is a, c, g, or t
  misc_feature (23)..(23): n is a, c, g, or t
  misc_feature (697)..(697): n is a, c, g, or t
  Predicted polypeptide sequence is orthologous to G227, G242
aacacaaatagtaatgacagnanattacactgaaaaccatccatatatgatacgactacccaccttagtggtggccgttggttgggtgatcggacgatgatgccccgtcgaccctggcagcggtggtggccatgacaaccgagtacaagagctgccctgcctgccgctccacctcttccctcaccacctgccgtatcgccgccattagtcgcacgtcattgccccccacacccactggtggtggtgtcttttcctttgcctttgcctttgcctcctctgaggccttatctgcggccatctggggcaggcccaggctcaaggtcagtgacagcattggcatcgggtcatcaataacagcagtaactgcaccatgcacgacggctggtggcgacctgttcatcaccatgacttgttcctcctgctgcatcttcgctctcacagccgatccagacgacgaggaggaggcggcgacacgtgcggcagtggcagcggccatggccttggcgcggcgctggcacctgcggaggttggagttccagtggttcttgacggagttgtcggtgcggccggggaggagtcgcgcgatgtcggcccacttgttgccgtagcgtgcctgcgcggcgatgataagcgcatcctcctgcactgtgaaggggcgatgctgcacggccgggctgagctggttgcaccaccgcanccggcatgacttgcccgtgcgcccg

SEQ ID NO: 6893 - DNA, 1128 bp, Triticum aestivum
  misc_feature (802)..(802): n is a, c, g, or t
  Predicted polypeptide sequence is orthologous to G227, G242
tccgtgccgccgccacaccccagcccaagtagactaccagatcggtaacctccctaatcactcgctcactactcgtatcacttacgatcgaggatctaccggcggccatggcggcgtgcagaggaggcgggggcggcaaggacgtggaccggatcaagggcccgtggagccccgaggaggacgacgcgctgcagcggctcgtgggccgccacggcgcgcgcaactggtccctcatcagcaagtccatcccggggcggtccggcaagtcctgccgcctccggtggtgcaaccagctctcgccgcaggtggagcaccgccccttcacccccgacgaggacgacaccatcctccgcgcccacgccaggttcggcaacaagtgggccaccatcgcacgcctcctctccggccgcactgacaacgccatcaagaaccactggaactccacgctcaagcgcaagtactcctcctcttcctctgcatcggcatcgccggctgatgacgccatggcaaacgacgatgaggaccgccggccgctgaagcggaccagcagcgacgggtacccggggctctgcttcagccccgggagcccgtcggggtcggacctcagcgactccagtcaccagagcctcccctccgtcatgccgtccgccgcctcgcagcagccgcacgtgtaccgcccggtcgcgcgggccggcggggtggtcgtgctcccgacggccacgccgcagccgtcgcctccgtgttcgtctccgccggcgccccctcctcctcggcgacgtcggtctcgctgtccctctccctnccggcttggacgcgcccgagccagccccggtggcgcagcctatgtcatgccagccacacctcctcctgctcctgtacagcccgccgcagggcttagaatgccgcgccgccaccatgcgttcatgctcagccgcgccggagcccagcacggcgggggggctttcacggggagttctgtcatgatcaagaatatcggatgaggccggaataattccgggttaacccggtcgcccggcgagggtcaacccccagccttagagctgccaaatccgttaaccggaacaaacccccccacaaagaaaaacctctcccaccaaaccaaaaaaa

SEQ ID NO: 6894 - DNA, 1113 bp, Triticum aestivum
  misc_feature (719)..(719): n is a, c, g, or t
  Predicted polypeptide sequence is orthologous to G227, G242
gacccacgcgttccgcccacgcgtccgctaatcactaatcaatcggggaagcacgcgcaccgccactaccaccggagtgtctgctcgtgaggccaaggggaggggaggagaggagaaggtttttggttgtagtgtgtgtgtttcgccggcgatgggggcggaggcgaagtgcgacaggataaagggtccgtggagccccgaggaggacgaggcgctgcggcggctggtggagcggcacggggcgcggaactggaccgcgatcgggagggggatccccgggcggtcgggcaagtcgtgccgcctgcggtggtgcaaccagctctcgccgcaggtggagcgccgccccttcacggcggaggaggacgccgccatcctgcgtgcgcacgcgcggctcggcaaccgctgggctgccatcgcgcggctcctgcccggccgcaccgacaacgctgtgaagaaccactggaactcctcgctcaagcgcaagctcgccaccgccaccggcggcggcgcggcgtgggaggaggccagcgactccggcgactccccgcggccgtgcaagcgcgcgagcccggggccggagagccccaccggatcagaccgcagcgagctcagccacgggagcgggcaggtgttccggcccgtcccgcgccccggcgggttcgacgccatcagcgcggacgtgaggccgcctccaccgcgccaggacgaggatccgatcnactctctctcgctctcgctccccggactagagcacgggttccacacgacagcgcccggagccacttccaggagctctcgccatcgccacgctcgccttctcctccaacggggccggcgccccagccgtcgtcctcgtaccccgtcagcggcgatctggtgggcggcattcaggagatgatcgcgccggaggtttgcaaatacatgtccgcggtggggctcccggccgggtggggccccggcccccgggcgaggcgttcatccgcaacttctcaagggcgtaattcccccccccccgaacggttcggcttttaacccgccttaataaaattaaagcccgttgaaaacccctggcgccccccgttcaattcaaaaaatccacccgcctaaacttgg

SEQ ID NO: 6895 - DNA, 1110 bp, Triticum aestivum
  misc_feature (27)..(27): n is a, c, g, or t
  misc_feature (703)..(703): n is a, c, g, or t
  misc_feature (785)..(785): n is a, c, g, or t
  Predicted polypeptide sequence is orthologous to G227, G242
gcgacccacgcttccgccttgcccccncttcatcccaccaccaccgagcagattaccagatccaacttggttttattgccatttcatttcggtaacctccctcccgagttactcactcaccacccgcagcggttacgatcgatctcccggcggccatggcggcgtgcagaggaggagggggcggcaaggacgtggaccggatcaagggcccctggagccccgaggaggacgacgcgctgcagcggctcgtgggccgccacggcgcgcgcaactggtccctcatcagcaagtccatcccgggccgctccggcaagtcctgccgtctccgctggtgcaaccagctctcgccgcaggtggagcaccgccccttcacccccgacgaggacgacaccatcctccgcgcccacgccaggttcggcaacaagtgggccaccatcgccaggctgctctccggccgcaccgacaacgccatcaagaaccactggaactccacgctaaagcgcaagtactcttcttcctcctcggcatcggcatcgcctgctgaagacggggccgccatggccgacgacgaggaccgacggccgctgaagcggaccagcagcgacggatacccggggctgtgcttcagccccgggagcccgtcggggtcggacctcagcgactccagccaccagagcctcccctccgtcatgccatccgccgnctcgcagcagccgcacgtgtaccgcccggtggcgcgtgccggcggggtggtcgtgctccaacggcgacgcctcagccgccgnagccgtcgcctccgtcttcggcggcggcccctcctcctccggggaggtcgttctcgctctccctctccgggcccgggctggatgcgcccgagccaaccccggtggggcagcctatgtccatgccgccgccacctgctcctgttaagcccggccgagggccttaaattccgcgccgccggccaatgcccgtcaattccaaccgccgccgtacccccgccaaggacgggggggcccttcaaggggagttcctttcaatattcaggaaatgatcggatcagggtcggaaataaagttcgggtttatgccccggttccctcgaagggta

SEQ ID NO: 6896 - DNA, 473 bp, Triticum aestivum
  misc_feature (392)..(392): n is a, c, g, or t
  misc_feature (394)..(394): n is a, c, g, or t
  misc_feature (424)..(424): n is a, c, g, or t
  Predicted polypeptide sequence is orthologous to G229
ctcgtgccgaattcggcacgagaaaagcttgtatacggaaatagtgttgactaagcacgccacgtggtgtggggcccgctatcatctactgaacggtatagtacgacgtgtggccgattattttttgaaaaccccttggaattatttttcctaacgagaagttcgtagacacgtgtcaggtccatccgtgagcgagcaaattatatgcaaaaatggcggctgatgtgattttgaacccatgatctggggcatgaaggggtatgcgcccaaccaatgcaccaagaatgttttcactttttgccgaagatacccatcatatatgttccttacaccttaaagcggaccggccatttgctcctgacattccttttaaaaattggtaattatatgtnanttatatgtgtgttaaaaattattattggtngaataaaaataatatttatataataatatttttggttaaaaaaaaaaaa

SEQ ID NO: 6897 - DNA, 421 bp, Triticum aestivum
  Predicted polypeptide sequence is orthologous to G2343
tataagcagctaccaaatggttgagagggagtgtgcattgcagtgttgagatcagtcactggtcgatctgatctctaagctgaggtgtgtgcatggggcatcactcttgctgcaaccagcagaaggtgaaggggggcctgtggtctcctgaggatgattataagctcgtccggtacatcaccacccatggctatggctgctggagcgaggtccccgagaaagccgcggtgtgggaagagctgccggctgcggtggatcaactacctgaggcccgacatccggcgagggcggttctcgccggaggaggagaagctcatcatcagcctccacgccattgttggcaacaggtgggcccacattgccagccacttgcctggccggaccgaccacgagatcaagaactactggaactcgtggatca

SEQ ID NO: 6898 - DNA, 616 bp, Triticum aestivum
  Predicted polypeptide sequence is orthologous to G2371
accatcctgcctctcccctcctctcttctcttctctccactgcccaacttttgccatagacaagaacctctaggtagcttacctccagagcagcaatggccatgcaccctctctctcaggggcacccacaggcctggccatggggggtagccatgtacacgaacctacactaccaccaccagtacgagagggagcacctgttcgagaaacccttgacgcccagtgatgtgggcaagctcaacaggctggtgattcccaagcagcacgcggagaggtacttccccctgaacggcggcgactcccccggcgagaaggacctgctcctgtctttcgaggatgaggccggcaagccgtggcggttccggtactcgtactggacgagcagccagagctacgtgctcaccaagggctggagcaggtacgtcaaggagaagcagctcgacgccggagacatcgtgcacttcgagagggtgcgcggccttggcacaggcgaccggctcttcatcggctgcaggcgtcgtggcgagagcgcgccgccaccacctgtacgtgtacctccgcccgctctgaacgccggggagcaccagccttggagcccaatgtgttacagcacgtc

SEQ ID NO: 6899 - DNA, 670 bp, Triticum aestivum
  misc_feature (26)..(26): n is a, c, g, or t
  misc_feature (35)..(35): n is a, c, g, or t
  misc_feature (49)..(49): n is a, c, g, or t
  misc_feature (55)..(55): n is a, c, g, or t
  Predicted polypeptide sequence is orthologous to G2394
catttgcattgtcaaggagtgtgtgncagcgagangagctgtaacttcnccaagnttaaaaaaaaggacaaaaaaaaccttgggacaccatcgctacaatccatagatcaaaagcatcaactttatacatgcagaccggcaccgcgagcaaactatatgcttatgtatcacctcggaagatggaaggcagaccaatctaatgcatttcgatctcctgcgtcggtactgtatggtcgatgtggcgagtatcagatgtgccagatgagcttgctatctcggctttgcacagagggcatagtgcatttatcttgagccatttgtcgacacattccttgtggaagcagtgtgtgcagggaagttcacgaagctcttcgttgtgtgcatacttggcaaggcagatgcagcaaacagcatcttcagcagaaagcgatcgctccttgtcagtccctgcagccactatacctccctcttggccttcggcttcattacctgaaccatggcggcgtttcttggttttgaatttataagttggcaaagtattgatggattcccgaagtggcccctcttgtattgtttgtgtcttctctgaagcccatgacggatataatgcaggggagacaacagcatatcattgcacagaggatgaaaggcatggcatacccaatacagc

SEQ ID NO: 6900 - DNA, 731 bp, Triticum aestivum
  Predicted polypeptide sequence is orthologous to G2394
catgctccaaccctgtttctggtgaatgccacatttgacaaatactgagtataatcactagctaagcaggtgtgagtatttacaatatatacgagacaattccgccagaatgggagaaatggacttgcgtcctacttatagcgtgttccatccatcctcatgcccatgctcatgggacgaagcagaagaacagctaccgctgtgactcgacgtcgcctctttccctgttttcattctgttggtgttggccctcggggccagcctcggaagacgccgccgttgagccgcccagctcggacttgcaaagagggcacagcgcgttgatcttgagccacttgtcgatgcactccatgtggaagacgtgcccgcagggaagctctcgcagatcttcgttgtttgagaaccttgataaacagatgcagcaaacggcgtcttccgcggagatagtccgctccttgtcggtcccagatgccagaaccccgccattgtcttcccccacttctcctccatcgcggatcctcatcgacttgtacttgtacgccaccagcgtgttgattacttccgcggtagcgcctttgttcatatccagatcctcgtggaagcctaccatggagattatgcagggcaggcaacagcatatcatcgtgcacaggatgaatggcagtgcatagccgatgaagccgaatgcaaggaacactatacacagcctgtacaagttaggagcgtcatgg

SEQ ID NO: 6901 - DNA, 1101 bp, Triticum aestivum
  Predicted polypeptide sequence is orthologous to G2394
acgcgtcccgaggaggaggaggactgaggaggaagacgaattcgactccgagttttgaatttggccatttggcccaatcttgccgtccggcgatttttctttggatttctttggtgaaaccctcggcggatggtcgcttgggagccaggcatttgattcgatcttaagtggtccaggcgattggaggagcagctggctgctgctgttcccggggagtggattttcttgaggtgcagtgaatctctcctgctgtcataggttaaaaaaaacaattcaaattgcctggccttggatcaagtccattttcctatagagattgtctgtcttaagtcaaagcagctatatttctggcaaacacaacgagctagtttcatatgcagcgttcagttgatggctgctcatcctgttgaatcagaagcaagcagtgaaacagacaatcaccctttactgatagaccacatggaaaatactgctcatctcgagattgcaattgagagcccaagggatgatgttgcttcatcgtcaaccgctcgtcgggaggataatgatggcttggatcgattgcctcacatctcagaaagttcttcggagacaactactgcatctaactctcaaagtgctccctctagcagaagagatgctaatcgtgctcgtcgtcggcaaagtccgttgaattctagttgctggatctccattgagcttgttgtaacagttagccagattatagcggccatttgtgttctgtcattgtcaaggaagggacgtccgcattctccattatttgagtgggtcattggttatacggtaggttgtgttgctactcttcctcttctctactggcgctatctccatcgcaaccgcccaaacactgggcaagacccagcagtcagaactccctccgaacagcatacctgagtccatttctcacacacaaattcggccctggcatgtctgagctgttttgtaactgaccaaatggagttcccaaaacacgtgttaccaaaatttagggcccagcttttgcgatcactcaggatgcccctgactttttttccccgttgttgttttggggaagtttggatttgggggcattccctgccc

SEQ ID NO: 6902 - DNA, 938 bp, Triticum aestivum
  Predicted polypeptide sequence is orthologous to G2394
ggtgccccaccgcaggctggaccggtcctgacttcccgggatatcgtcgacccacgcgtccgtgtgtgcagcgatatgctgctgtttcccatgcttaatttccgttttgcgcctccaagaggatttgggtcaaagtagaggagcggctcaagagctaattgatgcattgccaacctacaaatttaaaccaaaacgaagcaaaaactgggtgcttgatcatgcttcgagctccgagaatcttagtgagggtggcatcctgggcccaggaactaaaaaggaaagggctgtttcttcttaagatgctgtttgctgcctctgcctaactacatactgatatgccccccacctccgcgagggggcgtggcaacaatatgcaatcatgcgcaatgatgcccgacaaaagcctcaacacaaatgcacccatgcgccacccctgccgctaccgcacactaacacgcgcggcgactcatccaacccactagcacaaaccccgcaaagccaacccgcccacacaccaaacgccccgccaacacaaccaacaccacccatcaataccaaccaaacccaagcaatacaccaccccccatgcccttatcgcccccgaatccacccaccacacccacttctcgaccaccggaccgaccaccccccagccaatccacctatcgaacgataattgctctcacacacaaccaaatccaaacgatcccccgactcgccctcccctccctcccactactaacacaggatcgcactcaacctaaccatccgaccacgccagctaagactcctagacgaacactcaccaccaccccccatcgcagaccccgacccccgcatgtcgatgagggcaacgtcaaccacgaagcacgcagtatacgtccatcacaacacgagagacgcacgatcaactctactgaacgcctgcgctcacgccc

SEQ ID NO: 6903 - DNA, 854 bp, Triticum aestivum
  misc_feature (17)..(18): n is a, c, g, or t
  misc_feature (488)..(488): n is a, c, g, or t
  misc_feature (582)..(582): n is a, c, g, or t
  Predicted polypeptide sequence is orthologous to G241
tgcacacgactggtagnntgctagcttatcatacgacttagtatagggaccactttgtacaagaaagctgggtacgcgtaagcttgggcccctcgagggatactctagagcggccggcctttttttttttttttttttgaacatagcccaatcttctcattaaaatttaaatctgtgacaaactctctatgtcactagcctgcatgaacagtgtgacccagaagtccatctcatcgttgctcgacgacgacgtcgaagcactatctacgccgaaggtgtcgccggtttccatcccggaaccggagctgtccaccgacatcgccactgtctcggaccagaagctgtcgtcaatctggaactcctcggactccgaggaagagcttcccgtgttctccaacgacgaggccatcgagtagccggtggccgacgacgtcgagagcgactgctccggcgacatcgagagggactgccccggtgacgacgacacngctcggatgtcggtctcttacctgatcgcgctctcaattgcagaccagagaggcttcttggctgtgcgcttaggcgctgcctgcccggacttcntggacgaagattcaattcccctttttgaggtgtgtgtgccagacgtccttgatttcgttgtccggtcctgccagggcagctggccgccatggtggaccatcttgttgccaaccatggcgtgaagtttggatgatgggctcctccctccttcacaggttaatttgccctcccttgatgtccggggccccggttattttatccaccggaaggggggaagcttttgcccgaaacccaacaaggccggcctggtttgggcagggcccgccattttt

SEQ ID NO: 6904 - DNA, 1082 bp, Triticum aestivum
  Predicted polypeptide sequence is orthologous to G241
ctgcgacccacgcttccgctagcatccgactccctcccttgcccccgacccaccacacacacactcacacacagcgcgagcgtcttatcagggcctgcgcgaagagaagagaagagtgcagaggagcacagagacagagtaagcaacagcaatggggagggctccttgctgcgagaagatggggctcaagaggggcccgtggacggcggaggaggacatgaccctggtcgctcatatcgagcagcacggccacagcaactggcgggcgctgcccaagcaggccggcctgctgcgctgcggcaagagctgccgcctccggtggatcaactacctgcgccccgacatcaagcgcggcaacttcacctgtgaggaggaagaagccatcatccaactccacgccatgctcggcaacagatggtccaccatggcggccaggctgcctggcaggacggacaacgagatcaagaacgtctggcacacacacctcaagaagcgactcgaatcctcgtccaagacgtccggccaggcagcgcctaagcgcaaagccaagaagcctgctgtggctgcgactgcgagcgcgctcgagggaccgacctccgagcctgcgtcgtcgtcaccggggcagtccctctcgatgtcgccggagcagtcgctctcgacgtcgtcggccaccggctactcgatggcctcgtcgttggagaacacgggaagctcttcctcggagtccgaggagttccagattgacgacagcttctggtccgagacagtggcgatgtcggtggacagctccggttccgggatggaaaacggcgacaccttcggcgtagatagtgcttcgacgtcgtcgtcgagcaacgatgagatggacttctgggtcacactgttcatgcaggctagtgacatagagagtttgtcacagatttaaattttaatgagaagaatgggctatgttcatattttggccgattgttctgtaaaaaaaaaaaaaaaaaaaagggcggcgcctcaaagttccctcgagggcccaagcttagcgttccggctttctgtacaaaaggggccccattaggagtggtattaaa

SEQ ID NO: 6905 - DNA, 1078 bp, Triticum aestivum
  Predicted polypeptide sequence is orthologous to G2457
gcacgagggaaagctagacagctcaatttctccttcctctctgcccatacatatctctctctctctccatcgatctaacctacacacccagagaaagagagagaagcagcagtagctcatgtaacctagctagcctgcagttctccacggcaacgcttcttcttcttggctgccgcctgttgaacctcgccgtggtctgaacggctaggggggcagtgaggcggcggcgccaggggataatcagaaggaagaatgtcgtcgtcgggccagatcacaccggcagaagaagtctgctacgtgcactgcaacttctgcaacaccgtactcgcggtgagtgtccctgggaacagcatgctcaacatcgtgacagtccggtgcgggcactgcacaaacctactttcggtgagcctgagagggcagatgcactcaccggtccctcctgcggcacaggtccaggagagcagcctgagcaagcccaatggcagcaacggcttcattcgtgaccacggcagcgcctacaatagcccggagtttgcttcgtcttcttcttcatcgtcgtccaaattccggatgccgacgatgatgttctcatcgcaaaacgatctgctgcaggagcaaacgctgcacgcacgtcctcctgagaagaggcagcgtgttccttcggcgtacaacagattcatcaaggaagagatacgaaggatcaaagcaaacaaccccgacattagccacagggaagctttcagcactgccgcaaagaactgggcacattatccaaacatccatttcggtctaaaccccgagcgcgacggtggcaagaggctcgccgtcgacgatgccgcgccggctgccaagaagatccaaggtttctgttcatagacacgacggctgggagtccaaacaagaacaactgtatctatatatagtattagtaatatcgcatatgtgtatacgtaccgcatgtgagtaagtaaagatgcaaaggaaaagagaagtcgctacgtaccttaccttatacaattgtacgtacatatatatatatatatatggcgatcgagtgaataaaaaaaaaaaaaaaaaa

SEQ ID NO: 6906 - DNA, 1115 bp, Triticum aestivum
  Predicted polypeptide sequence is orthologous to G2457
gcacgagctacacacacactcgtccccctcctccaccttcttcttcttcttcttcttcttcttcttctacctcccaccctcctaccctccacatcctcgtcttctgttggctcttcgcgcgcgcccaagctcactcttgacctctccgtcccaccgacgccggccacccaccgccggaacgacccgtcgtccgttggctagcgagcatgcagagcatggatttggtgtcgccgtccgagcacctctgctacgtgcgctgcacgtactgcaacaccgtgctcgcggttggggttccatgcaagaggctgatggacacggtgactgtgaaatgcggccactgcaacaacctctcctttctcagcccacggccgccgcccatggtgcagcccctctccccaaatgaccaccaccaccccatggggccgttccagggatggactgactgcaggaggaaccagccgctgccaccgctggcctcgccgacatcaagtgatgccagccccagagctccctttgttgtgaagcccccagagaagaaacatcgcctaccatctgcctacaatcgcttcatgagggaggaaatacaacgtatcaaagctgcaaagccagacatccctcacagagaagccttcagcatggctgctaagaactgggcgaagtgcgaccctcgctgctcaacgactgtctctgcttccaacagcgccccagagcccagaatagtagtgcccggtcctcagctgcaggagagggccaccgagcaagtcgttgagagcttcgacatcttcaagcagatggagcgcagcgcctaaggcatcacaagcatgctgggattaattagtactgctaccgcatgcatcggttacttatcagctagctcatcatcatcatccgtcgctatgcatatatataatgcataagcgcacgcgtttaatttatgtttggttacttcgttgctgctgttgctgtgtcgttaagttgatggtgttgtctgttatatttgttgttggagcgtacgtacgcaccctttaattatgaacagctgctaccttataatattttttcatcgcgaaaaaaaaaaaaaaaaaaaaaaaaaaaaaaaaaaaaaaaaaaataaa

SEQ ID NO: 6907 - DNA, 898 bp, Triticum aestivum
  misc_feature (427)..(427): n is a, c, g, or t
  Predicted polypeptide sequence is orthologous to G2457
caacagctatatggatgattacgccacgctatttattatgatactatagaatactcaagctatgcatccaacgcgttcggagctttcacatatggtcgacctgcaggcggccgcactagtgattagcgtggtcgcggccgaggtttttttttttttttttttttttgttttttttttttttgtactcactcacaaactgattcataaattaacttaggtttttcttacgttactcacaatatgaaagtatcatgcatatatgaatatatgtctcactaaaaaccttgaactttctgggggataggtgccgccatggactcctccagcttcttgctgctctcattggagcctaccccgaaatgaatgtttgggaaatgcgcccaattctttgctgcggtgcttaaggcttctctgtggcttatgtcanggttgtttgtttttatccttcgtatctcctccttaatgaatcggttatacgctgaaggaacccgctggctcttcttaggagctggtctcatgtggagcatatgctcttggtcactttttgttgagacatcattggtattcggtatttataagagtgtcatactccgggtgattccaccaaagctgatattgttgggcttgaaattctcctgggaatgattttgcacaggtggggactgaattattccctcagtttacccaacacaggttcttcattgccgccacggacggggacaatttcagcatgcttttatttggacaaatacccgcaaaattgtttttttaaaattttttgcacttacaaacatcttccgcggagggaattgtttctacttcctggggggccgttcaaattcctgcgcattgtggcggggagaattcaatttgggcccaatttcccttcattaatttt

SEQ ID NO: 6908 - DNA, 297 bp, Triticum aestivum
  misc_feature (281)..(282): n is a, c, g, or t
  misc_feature (297)..(297): n is a, c, g, or t
  Predicted polypeptide sequence is orthologous to G246
ttttttttttgacaacaccaaccgaacgatccggctcggaatggccgatttaactatagcggagtaggcaactatcagcctcatttccgtgacaaccaagaggagaaacaggccatacacgtgtctggaaaatggaccatactgggcagcaaagtactactagtattccacatgttgccaactgggtcagcgtctgcccctgtgaaacaatccaactcaagtgtactccaaggcaaaaacgagctgccagattggcacccgaaatcttgcacaagtcaatnnttagggggggggggn

SEQ ID NO: 6909 - DNA, 691 bp, Triticum aestivum
  misc_feature (2)..(2): n is a, c, g, or t
  misc_feature (4)..(4): n is a, c, g, or t
  misc_feature (7)..(7): n is a, c, g, or t
  misc_feature (633)..(633): n is a, c, g, or t
  misc_feature (678)..(678): n is a, c, g, or t
  misc_feature (691)..(691): n is a, c, g, or t
  Predicted polypeptide sequence is orthologous to G2505
gngnttnatccgtaagctcgaaattaaccctactaaagggaacaaaagctggagctccaccgcggtggcggccgctctagaactagtggatcccccgggctgcaggaattcggcaccagcctcccctctccatctctgtgaaagcatcggcgcaaaaaccagttgacctgaccatgccgtgcgcgggcgcctattaatacccctcgtcttcctcgcgcccctcctcgatatccctctcggtagacggtacaatcataccgatcaggagccagctgctgcttcttgtgttgtgttggtcccactgccgagatcggcagcagaagcagccgtcggtcctctgtacctctcgttgatcgcttgatccgaggggatccgaggggatccaaggcgagctgcgtgcgtggtggcggcgatgagttcgctgagcatggtggaggcgaggctgccgccgggcttcaggttccacccacgggacgacgagctcgtgctcgactacctgtccaggaagctcggcggcggtggcgccggaggggcggcggccgcggtggcgagcatctacggctgcccgccatggtcgacgtcgacctcaacaagatcgaaccctgggactcccgaaatcgcatgcattgcggnaaggagtggtacttctacagcttaagggacaagaagtacgctcangccagcgaacaan

SEQ ID NO: 6910 - DNA, 561 bp, Triticum aestivum
  Predicted polypeptide sequence is orthologous to G255, G664
acacgcacatcaagcgcaagctcctctcccgcggcatggacccccacacgcaccgcccgctcaccgccgtcgacggcggcgccgcgtcgtcccgcccggcacacatcgcagtgccggcgagggcagcgccgcccacgatgttcgccctgccaacaaagcagcctcccgtggattcctcctcctccgacggcagcagcggcgcgacgagcacgggggagccgcgatgccccgacctgaacctggacctgtcggtaggcccgccggcggccgacacgccgacctcgcaccccgtctgcctctgccgccacctcggcctccgaggcggggcggcgtgcagctgccgccagggcgacagcccgggctcccagggggggcgggttcagatatttcaggccgctggaggaaggccagtacatatgagacgagacgggacggctaggccctaggctccacagcaatttgtaagacggcgaatttttccacctccgcagcaccactgtccaacgaaacggtgaagaaaaatctaatctgttcatattttccttgtaaaaaaaaaaaaaa

SEQ ID NO: 6911 - DNA, 728 bp, Triticum aestivum
  Predicted polypeptide sequence is orthologous to G255, G664
ccaacacgtgagctaagaagcaaaagcaaggcggatatacgtttacaccaccatcaaagagcttagcggccatgggtcggtcgccgtgctgcgagaaggcgcacaccaacaagggcgcgtggacgagggaggaggacgagaggctggtggcccacgtccgggcgcacggggagggctgctggcgctcgctgcccagcgccgccggcctgctgcgctgcggcaagagctgccgcctcaggtggatcaactacctccgccccgatctcaagcgcggcaacttcagccgcgacgaggacgagctcatcgtcaagctccacagcctcctcggcaacaagtggtcgctcatcgccgcgcgcctccccgggaggaccgacaacgagatcaagaactactggaacacgcacatccggaggaagctgctgggcagggggatcgaccccgtcacgcaccgccccctcaccgacgccaccaccgtctccttcgtccatcctgcagaggcgccaaagacgcagccggtgacggaggagaggaagccgcccaggtgcccggacctcaacctggacctctgcatcagcttgccgttccaacaggaggaggaacggccgccggcgagagcatgcgccaagccggtgaagatggagcagctgcagcagggccgcctctgcttccgctgcagcatcctgagagtgagaggagcggcgacggagtgcagctgcggcagcaacttc

SEQ ID NO: 6912 - DNA, 1183 bp, Triticum aestivum
  Predicted polypeptide sequence is orthologous to G255, G664
ggcacgagaacaacaacagcaccaacttccactcctgcaaacccgacccaacccaacccaacccaccaccgagcacaagaaaaggagagtcatcggcggcggcagaccatctacagagatagtgagatggggaggtcgccgtgctgcgagaaggcgcacaccaacaagggcgcctggaccaaggaggaggacgaccggctcaccgcctacatcaaggcgcacggcgagggctgctggcgctccctgcccaaggccgcggggttgctccgctgcggcaagagctgccgcctccgctggatcaactacctccgccccgacctcaagcgcggcaacttcagcgatgaggaggacgagctcatcatcaagctccacagcctcctgggcaacaaatggtctctgatagccgggagactcccagggaggacggacaacgagatcaagaactactggaacacgcacatcaggaggaagctcacgagccgggggatcgacccggtgacccaccgcgcgatcaacagcgaccacgccgcgtccaacatcaccatatccttcgagacggcgcagagggacgacaagggcgccgtgttccggcgagacgccgagcccaccaaggtagcggcagcggcagcggcgatcacccacgtggaccaccatcaccatcaccgtagcaacccccagatggactggggccaggggaagccactcaagtgcccggacctgaacctggacctgtgcatcagccccccgtcccacgaggaccccatggtggacaccaagcccgtggtgaagagggaggccggcgtcggcgtcggcgtcgtgggcctgtgcttcagctgcagcatggggctccccaggagcgtggagtgcaagtgcagcagcttcatggggctccggaccgccatgctcgacttcagaagcatcgagatgaaatgagcagagcagagcagagcaccccctccctcctctctcctgtgacttggatattggtttagcctgtaggtgaaaatacagcgagtgaaagagatgcaagaagaaagagcgatgatcttgtggtgccctgtttcgccaggatcatctcctttccttctttatgccctctcgttgctccattttgtttgtccggttgtaaaaaaataaattaccgtttgcctaaaaaaaaaaaaaaaaaaaaaaaaaaaaaaaa

SEQ ID NO: 6913 - DNA, 598 bp, Triticum aestivum
  Predicted polypeptide sequence is orthologous to G255, G664
atccggaggaagctgctgggcagggggatcgaccccgtcacgcaccgccccctcacccacgccgccagcgccaccaccgtctccttcctccatcctgcggagccgcccaagacgcagccggcgacggagttgagtaagccgcccaggtgcccggacctcaacctggacctctgcatcagcctgcccttccaacaggaggaggaacggccgccggcgagagcgtgcgccaagccggtgaagatggagcagctgcagcagggcggcggcggcctctgcttccgctgcagcatcctgagagtgagaggggcggcgacggagtgcagctgcggcagcaacttcctgggcctcagggccggcatgctcgacttcagaggcctccggatgaaatagatgaaacttaggaataattattccatcaaactttctgcctgctgtaaatcgttgctcccttctactaccaagttttcatttagcttttaggaaaagaaatactactactacagtagatggtgaggaggagactagtattatcaggtgaggattcgtagccagatcctccctggcctcctcggtctgctcagtttcatgtaacttatta

SEQ ID NO: 6914 - DNA, 381 bp, Triticum aestivum
  Predicted polypeptide sequence is orthologous to G2574
attcggacgaggccgaccaccgccgcgacggcagctgcagcatcatcacgattccctccctacgttgttacgacgcaaggcccggcgggctgggttcagaagaatggcttccattcgctggccaggcccacctagtagaccaagaactaccacgacccaggcgttcgttcaccgatcgtcttccacggcagagccatcggtcgatcatttgatttgacccaagggcaaaaggagtcctcgaaccactgcacggcggcgacgttaaattttactgccggagaaaacccccccgctttctttccctttacccttgttctgtgttcttgattgggtgagacatggatccgaggatggatggacctgtaaaaaaaaaaaaaaaaa

SEQ ID NO: 6915 - DNA, 611 bp, Triticum aestivum
  Predicted polypeptide sequence is orthologous to G2574
ttttttttttttttttttttcccaagaaaaatgcttaccacttggtgctgtcaccagctacaaactctcatgtggtcggatgttaatgaattacacaagtggcaggctacgtacactgaatttatttacagtgacaacacacatctacaaaggaacacatattcagagtatagatgttgctgccgccatgacaaccatttcttttttggatcaaagctagctagccagtatctgaagatacaatctcggaatacagtttctcccttcttctgcatgcatgcagaaatgcaacgcaagaaagacagtggagcagagcattatactgtgtgaatgtaccagttggatgtaagatatcggggacgatgagtcgtcggccatggcggtcgaaaagcacacaccaagccacctaattaacttgttcgtcggcgcacatggagcagataacagacggtagtagcttccgcagctcactcaagaaccactaacttcagacttgacagtaaagaacaatacacaaaaacgaacctgcatggcgtgctgcggatgaatcaggtgagaagggtgccgatagggctgcaaccacattgtccttcttccctcctctcagcgca

SEQ ID NO: 6916 - DNA, 1066 bp, Triticum aestivum
  misc_feature (39)..(39): n is a, c, g, or t
  misc_feature (815)..(815): n is a, c, g, or t
  Predicted polypeptide sequence is orthologous to G2574
cggtatccgtgcgacccacgcgtccggggggtgatcacncaaaagttatagatctttttagcacaaattgttccggtagtttcaataggcgtagtgaagcttggtgtagacaggtagaggttcctcctgttacagatgctcgaagtgcatgcagatacagaaatgctatgatggattatgccaatgtaactgttccaaaaccaaaagtagctcctgaatccaatgatgaaccaaatggcaggcttaacggctttgctgaagttgatgattttagtgatcaaacgggaagtggccatgacttcagaccttctagcttctcaagtgctaaacattatgaggaccagattgttgatcgtggctttcctgtttcaaagcgtggcgaggtcaataatactgtgaaagcaagagacgtcaaccttaattcatgcctggacacaatatctttcccgattgctagtgcaaacaatcaaacttctactgctgttgatgaggctaatcaatcatccattgctggaaaatgcttcattggcagttttaataataatgatggtgcatctactacatcatcctgttctggctcaaataataaagtatctggttcccttggtggatctaacggatcctctaatgctgccagatgcatcggtggtagttatggtaatgatgctgcagctaacatttttggaaacaagaacaataccatggtgtaccagcctagtttgaacacatgccccatctctcatgttgcaactaatgtggattctcttgtttcccgttcaacacatgcaaagaacagtgacaaagagcgtgcatancatacccaggaaacaatgaataccacacagaacagaggcagtaatgaagctggtgaaggctataataatgatgtctatactggtagtatcactgaaaggagtcttgccagtgtattaataattgagttacccaaaaaccacattctgagccgctgtggactaacggactcaagcactttgaagccagtaatttaccaggggttttggggtcaccggctgaaatggtcttttggttataaaaatttgccaaa

SEQ ID NO: 6917 - DNA, 970 bp, Triticum aestivum
  misc_feature (48)..(48): n is a, c, g, or t
  misc_feature (572)..(572): n is a, c, g, or t
  misc_feature (617)..(617): n is a, c, g, or t
  misc_feature (639)..(639): n is a, c, g, or t
  misc_feature (698)..(698): n is a, c, g, or t
  misc_feature (707)..(707): n is a, c, g, or t
  misc_feature (710)..(710): n is a, c, g, or t
  misc_feature (725)..(725): n is a, c, g, or t
  misc_feature (734)..(734): n is a, c, g, or t
  misc_feature (760)..(761): n is a, c, g, or t
  misc_feature (765)..(765): n is a, c, g, or t
  misc_feature (768)..(768): n is a, c, g, or t
  misc_feature (770)..(770): n is a, c, g, or t
  misc_feature (777)..(777): n is a, c, g, or t
  misc_feature (792)..(792): n is a, c, g, or t
  misc_feature (817)..(818): n is a, c, g, or t
  misc_feature (845)..(845): n is a, c, g, or t
  misc_feature (848)..(848): n is a, c, g, or t
  misc_feature (852)..(852): n is a, c, g, or t
  misc_feature (868)..(868): n is a, c, g, or t
  misc_feature (878)..(878): n is a, c, g, or t
  misc_feature (881)..(881): n is a, c, g, or t
  misc_feature (884)..(886): n is a, c, g, or t
  misc_feature (889)..(889): n is a, c, g, or t
  misc_feature (891)..(892): n is a, c, g, or t
  misc_feature (909)..(910): n is a, c, g, or t
  misc_feature (912)..(912): n is a, c, g, or t
  misc_feature (916)..(918): n is a, c, g, or t
  misc_feature (920)..(920): n is a, c, g, or t
  misc_feature (925)..(926): n is a, c, g, or t
  misc_feature (929)..(931): n is a, c, g, or t
  misc_feature (936)..(936): n is a, c, g, or t
  misc_feature (939)..(941): n is a, c, g, or t
  misc_feature (950)..(958): n is a, c, g, or t
  misc_feature (967)..(967): n is a, c, g, or t
  misc_feature (970)..(970): n is a, c, g, or t
  Predicted polypeptide sequence is orthologous to G2604
ggcacgaggagttttttttttttttttttaattgaacataaacatggngggttcatatatctgtctgatccagttacacagatgattcgacgaatttcgagcactatgtattaccaaaaactcttgtttattctgcaagctcgccaggtccaacgaaggagggaaatggagaggggaggaagagattgcttctgggaagaactctatacatgtgcactcaaagcattcttattgcgggaagctgccttcagtatgaacttgaaggacttcagttgctgggcttttgctctgcacccgatgatgccccaactgatgtgacgaaactgcagactgcacatttgacggacctcgcgccatactggtacatgagcagcattcgacaactcccgcagtttacatgcgcaacctgattcgcttccattgccaggttgacagtgtggcagcaagaacactgtacacttgtggcgccgcgtatgtacatgagaagagtgtggcatcctccacaaactagctgcgccatctcagtcccgggagccggaacagcggtcaccgtactgcaaactgcgcagcanaccgacgttgcgccggcaggaaacatgagcagattccggccccanagcagacaaagttggctttgangctcctgcattgggaaccgggtggtgtgaaaggccacaaggaaggaagtttggggtaanggggccaanaangaacccggcatttgnccgggcccncgggttggccttgcacccgggggttnncccnttngnttgcccnaactgggaacttttncaccgcttcccggggggggaaaatnngaaggggccttggggaaaacaagggtnggncccnttccccctaaaatggnaaaaaccccngcntcnnntgncnngggaaactggggctttnngncccnnncncaccnnaannnttttnttnnnccccccccnnnnnnnnnccccccaanggn

SEQ ID NO: 6918 - DNA, 1047 bp, Triticum aestivum
  misc_feature (328)..(328): n is a, c, g, or t
  misc_feature (381)..(381): n is a, c, g, or t
  misc_feature (629)..(629): n is a, c, g, or t
  misc_feature (635)..(635): n is a, c, g, or t
  misc_feature (678)..(678): n is a, c, g, or t
  misc_feature (689)..(691): n is a, c, g, or t
  misc_feature (723)..(723): n is a, c, g, or t
  misc_feature (760)..(760): n is a, c, g, or t
  misc_feature (763)..(763): n is a, c, g, or t
  misc_feature (791)..(791): n is a, c, g, or t
  misc_feature (821)..(821): n is a, c, g, or t
  misc_feature (841)..(841): n is a, c, g, or t
  misc_feature (864)..(864): n is a, c, g, or t
  misc_feature (872)..(872): n is a, c, g, or t
  misc_feature (916)..(916): n is a, c, g, or t
  misc_feature (961)..(961): n is a, c, g, or t
  misc_feature (964)..(964): n is a, c, g, or t
  misc_feature (992)..(992): n is a, c, g, or t
  misc_feature (1000)..(1000): n is a, c, g, or t
  misc_feature (1014)..(1014): n is a, c, g, or t
  misc_feature (1044)..(1044): n is a, c, g, or t
  Predicted polypeptide sequence is orthologous to G2604
tttttttacttgaaaaatgaggcgcaatgcccttgtgtttatttattgtttgtgtgcatgcatgccttgtgtgtgaatgtgtaggtatgtgcaaacttacatcatcgtacttgctgagccctgagccacaacttatttatgctactccctgctgtacttactgaactacatacaccacacaatgtccagctctcaaactggctgctggtgctccagctcacattcacttgacatgctgaccttgcctgcctcagagctgctgtgctgtgtttgccattctcatgtgaatgtgcctccactgtgttctgatcatgcactgctgtgccgnatgtgtcaccactgtgctgtgctgtgtcccctgctgctcactgcatccatganttgacatctggtgtcctgtgctgactgaaatgccctcgtcacatgacattgatcactttgtgctgctggaaccaccatccttgcacactcccccattgtgactgtgatgccaattgacacctgaaaactggttgatgcatcacttgctgctgtgagtgtttgtccaaaagacttgacacagaattcacaatgtttggtatccatcacactgtggctgaagccaacacacctcatcagtaacaccatcntctgtngctgtatgaatcatcagaaaagcacaaaccaaaccctggcganaacaggtgttnnngacatttggctctgacccaggcttgatgtagncaactgaatgagctggatactcacaaactgaaacccngcngcgattgagccccttgtggagtgtcgtngccaccccaacagaaacctgacccagaacngacctgatgacggaaacacnctgacgcctggctggggaaaccntttcctcnggataaaccctctggcatttggaattcactcttggactccactncactcaccggaaacctcgggaaaagccgggaagactcggcgagtncanggacgattcggcatttggcacgacatgnggcacagncccaacacactctncccatccgaactcaccgcccatggacccanatg

SEQ ID NO: 6919 - DNA, 647 bp, Triticum aestivum
  Predicted polypeptide sequence is orthologous to G2604
caatgaaattgttttttctgggctaggatttctcccaagcatcaacgaggttcaggttggagtttactttcctttggattgggacaggataagggccgctcgggatcatgagactcagtacaagataattgaggaagaaaagcaggaagaaaggcgcaagagaggtgagctcaagaagaaaatccaggaacagctagctcagaatacaaacgaacccattgtgacggtggactgagtacgtctggaacagccacaggctgattcgatgatccgtacaaggctgaagacgatcagagcgggctgcctgggagcaacagccaggtgggtccaaatccaatatggtacctacgtgggtgcgtaccgtaccagtgcatgtgccgccattccctgatatatatcatatatgtgctatgcgcatgcatgttgttcatttctgttttccaaaggattggtggtgtacgtgtctgtgcctgcgcatgttgtaaacaagtactgtatttgaatacagcctcttctacctatttcttcttggtttctgtattataaattgaagatgcttttacgagacaagaatccatttatgtggcccattcaaatatactcaagtggccaaagtttatttccttttaaaaaaaaaaaaaaaaaaa

SEQ ID NO: 6920 - DNA, 388 bp, Triticum aestivum
  misc_feature (365)..(365): n is a, c, g, or t
  misc_feature (368)..(368): n is a, c, g, or t
  misc_feature (370)..(370): n is a, c, g, or t
  misc_feature (378)..(379): n is a, c, g, or t
  misc_feature (384)..(384): n is a, c, g, or t
  Predicted polypeptide sequence is orthologous to G2604
ccgccgtcgtcacatccccagccgaccacatccacccctccctcggcttcgaaatcaagctcaccgtctgattgggtaaccctgggcgtccgatcgaccagagctagcgggttctgcacgactctgctcaactgccgatggttagtaccaccagacctaattccatatctgacctgcagcatcttcactactgcatttcttaggcaaactgttataagagaactattgtggtcaatgtgcacaacaatggctttattcgataagtccacatggtaacaatgactgtgttgctatgtattatatctcggtatagttcttgaataatatagcactgctgagttgtgatttaagagctatggtgccanaananaaagaaannccggncaaa

SEQ ID NO: 6921 - DNA, 846 bp, Triticum aestivum
  misc_feature (15)..(15): n is a, c, g, or t
  misc_feature (19)..(19): n is a, c, g, or t
  misc_feature (90)..(90): n is a, c, g, or t
  misc_feature (534)..(534): n is a, c, g, or t
  misc_feature (684)..(684): n is a, c, g, or t
  misc_feature (699)..(700): n is a, c, g, or t
  Predicted polypeptide sequence is orthologous to G2604
gaccacgacgttgantagngagcttaccatacgagttagtatagggaccactttgtacaagaaagctgggtacgcctaagcttgggcccntcgagggatactctagagcggccgccctttttttttttttttcaaatcacttacataatcaatatttcaaacagaacagtacaaacgtagttcatcaaataaaactaagtctactacaatctgtatatagttattacaacccagatatgcctactattacaatattacaatatttacattctattacaatcaaatagaagagacgactctttgctgagtagagctatatggtttcgaacttcaaattttgtagaactcgagctcctggcgctgggggtggcacggcggtgatggcttggcacatggcgccgcacacgctgggcgccctgacaggtaggccagcacccttcggcaacggtggcacacgatttggctctgcataactacaatcaaagcagataagaaagaggagcaacggcgtaacgggcaaggcattcgaggttngcgtcacacagtaccagcaatctacgaaatgtacccaaaaataatctgatcgtctgtccgaccaacgacccgacatcgctggccagaccccacgggccacactatgcaaaaactatcagcacacatgcagcagggcaaaatagaatccangagggcatgcagtcnnattatattacacaatcatatatgtttatgctcttgttcagagtactactgactggacccaaaaccaagcgtcccagcaaagttactcaacatgagatatgatgcatcatggacattatgtgggcaatcagtacccagaaaagggga

SEQ ID NO: 6922 - DNA, 544 bp, Triticum aestivum
  misc_feature (344)..(344): n is a, c, g, or t
  misc_feature (408)..(408): n is a, c, g, or t
  misc_feature (431)..(431): n is a, c, g, or t
  misc_feature (449)..(449): n is a, c, g, or t
  misc_feature (521)..(521): n is a, c, g, or t
  Predicted polypeptide sequence is orthologous to G2632
cccatcttcctcctcatgctacttcatcgcccaaagtagctcgtccttctcttctccatccactaacaccagccaagcgctgctctcctcttctcgcccacggtggctaggcagccacttcctggctggcagcgccgacgtgtttgctgcaacagctggggcggtgacagcgtgctcgtcggtgcaccgggacaagggcggagtccccgtgccgtggtggtgtagctcaccccgattgtggctgcaggcaacggagccggtgtgcagtggctcggttgctcgccagatctggcggccgaccatatgccatgccagcgcgcgggggtgtggcggaggcgcggtangagggtggtgttgctcgtctgccggtaagcgcggatgtgggagttcgaattcctccggtgaaantccacatgactgtaccatagaancaagtctctccctctttngattataccaaatggattaactgagacttcttcaatatcgctcccctttgtcaatcgatgggaccatataancacaggactctaaaaaaaaaaaa

SEQ ID NO: 6923 - DNA, 589 bp, Triticum aestivum
  Predicted polypeptide sequence is orthologous to G2632
agaagagtcgctgccaagcaaaaggatgcgcgctaccacgcggaggtggccctgcgtaaatacaaccgagcgaacaacaccaagtttgagctggtggaggtaaaagtgatatctatattttacgagtttggagggggcggcgcccattataacttcacagctaagcagcctgaggaccagcagaatgctgatgccgacagtaccaagctattcttctctgaagtcgacctctattttcggagtgagaaagatgtgattatgtgctgtatagttggggaaaatgacgcagggcgttgctatggctgcgaaaaccgccagcctgttgttcacccaagcagcgaagcatatggcggtggtagtagtacctgtattgactatcctggttcggacagtgatagcgacagcgactagtactcgaaccctggtggctagtgctggcttgtgtggccagtcttctctcgtgtgtattggcttgccctttgcgagaataatcatggcatggagtttttttttgcggggtaatcatggcatggagtgatcaacttgagaaatgtgtcatgtgggatggaggactgatctcactgatgtg

SEQ ID NO: 6924 - DNA, 1142 bp, Triticum aestivum
  misc_feature (15)..(15): n is a, c, g, or t
  misc_feature (757)..(757): n is a, c, g, or t
  Predicted polypeptide sequence is orthologous to G2632
ttccggggagaaganttcggtgtgctttcctactgcggcatggactgagggtcatgttcaccgtgtcttttgctccgagcttgacactggttgcgctttgcctcggaaagtaacaaaccatgacttctgtcgccgacggtgtttcaggtgatcatagagctgatgagcaacagcagaagcaagctgctcaagggaaccaggaagaggccccagctactagtataggtagtcaggcaatggtggcaacacctgccacagattatgtcacaccctatggccaccaggaagcttgccatgcaatgggtcaaattgtcgatccattctatggaagcctttatgcggcctacggtggacaacctatgatgcatccaccaatggtcggaatgcatgcagccgcaataccgttgcctactgatgcaattgaagagcctgtgtatgtgaatgcaaagcaatataatgccatattaaggcggcgccaatctcgggctaaagcagagtcagaaaggaagcttatcaagggccgcaagccatatctccatgagtcaaggcatcaacatgccttgaaaagggccaggggagccggaggccggtttcttaacgcaaagtcagatgacaatgaagagcattctgattccagctccaaagacaagcagaatggcgctgcaccccgcagcagtggccaatcctcccaatctcccaaaggcgcaacttcggccgataagtcggggaaccatgaatgagatgctagaaggtccgncggacgcgacgatccatgccaacagttttgtacagtatatatatgctagtgagcgagagagagtcgcgccggcgggtgccataagatatatccgctctgctctatagtagtggtagacttatccgacgattttttttgcagaaattggtccgggtttgctggttgggttctacattccgtacaagactaagttttttcctttggtggttttggggtcccggggttacccgcgggtcgggccggaaggttttgtagcttataaagaagtataattagggccaaatgtttcccttggggggattgggccttaactggggggcaccctatccgggggaaaaaaaaatttgggtaaataaaaaaaaaaaaggggggcgctcaaaattcc

SEQ ID NO: 6925 - DNA, 1152 bp, Triticum aestivum
  misc_feature (745)..(745): n is a, c, g, or t
  misc_feature (893)..(893): n is a, c, g, or t
  Predicted polypeptide sequence is orthologous to G2632
ccacgcgttccgagtagacagagggagaggagacttgcagaggagaggagagaagaggcggaacaagggaggagggaggggtcgccggaagggggacatgctccctccgcatctcacatctcgcagcttgaactgagagcaagagcagaagcccatgagatgagacgcaagcaaaatatgcaagaaaatggcacaatcatgattcagtttggtcagcaagtgcctaactgcgagtcctcagctagcgattctcctcaagaagtgtccggaatgagcgaagggagctttaatgagcagaatgatcaatctggtaatcgcgatggctatacgaagagtagtgatgaaggcaagatgatgtcggctttgtctctgggcaattcagaaatggcatacacaccgccaaaacctgaccgcactcatccctttgccatatcatacccatatgctgatccttactatggtggtgcagtggcagcctatggcgcacatgctattatgcacccccagatggtgggcatggtaccatcctctcgagtgccactaccgattgaaccagctgccgccgaagagcccatttatgtgaatgcgaagcaataccatgccattctccgaaggagacagctccgcgcaaaattagaggctgaaaataagctggtcaaaagccgtaagccgtacctgcatgagtcccggcaccagcacgcgatgaagcgggctcggggaacaggcgggcggttcctcaacgcanaggagaagtctgaagcttcaggcggcggcaatgcatcagcgaggtctggccacgccggcgttcccccggaatggcggcatgttctcgaagcacgaacacaccttaccatccgggtgatttccattaccgggcgagagggggcggcttngggtgggcacgcaggttgccccctgggcaaatcatccttggccttatgtgtgttggcaaatggacggtcaatccggtcccggtgatatggttaaactgaattttaaagtccggtgcaattgtgttaattggggggttggttaaacaggccctttggttgggggaggggacgaaatcatctgcacttggagccgggtctcctgtttggtggtaggtttgtgtgggaatggcaggttctgtttaactcgtgaccctgttta

SEQ ID NO: 6926 - DNA, 444 bp, Triticum aestivum
  Predicted polypeptide sequence is orthologous to G2640
taaacatagtggcaagcaaatatacaccaaactctcagcaaaatcaccagtacagcaaaattcccagaaaaatcagcgttacaacaaagtcatgcacctccctagctaggttcagaagcagggatactagagcatgcatgcatgcctagatccagcatgcattgcttcttccaacttcttcatcctaaagctcaagacgaatcatgaatagaggccaccatctccggctctgtacagctgctcagctactagctgctggccttctatgttgcacgcctccagtccccagtgccagggtgcacacctgcacactgccggccgccgaggagactgctgccgctggccatggcgactgggcgcggtggccgacaccggcgtggaagcagcagggcgcaggcacgcagtcattgccagcctgccggggaaggatgcagcgtccgtcga

SEQ ID NO: 6927 - DNA, 706 bp, Triticum aestivum
  Predicted polypeptide sequence is orthologous to G2650
cggcacgagggttgccgaaatttaatgaggagctcaagggaaaaaatgaaccaaggagaagggatccagagaaggagaattaagatgtgcctttcacttataatttctaaacactacaggaatcatgatatcgtgttagcataattgcatggttacgtgttagaagtgtgaatgtgggaggcttggccgggggattgtgagctggagattgtggaggaaaataaacaagactgatttgactgtaaaaaaatgttgatgtgctttttatgaaatatttggccaatcatgtgttgcaacgtgggcacatattttcatagttctatatcagtcatatctgacagagatctggatgttcggtatatgatatgtagtatactatgcagaccgctgttaaatatcatatacccagcccgtgtactacatatcatatatccactctgcacactacatatcatatacccagtctaatgaaccatgcggttctggcatgaagaaaaatccgtatatggattttttttcatggttcatgggaccaacaacattgaaagagcatttcagctgtatgattaggcttcttgaattctgacgtggagtatgtgatcgcgagctcacaggagctcggaatcacgcccgtccagaattgctatgagattcgtcgcattaaatgctatagccaagttggtgggtccatgccgacaaaggaaaa

SEQ ID NO: 6928 - DNA, 683 bp, Triticum aestivum
  Predicted polypeptide sequence is orthologous to G2655
ctagaatggattccattttcaggacgcggcaggtacacgacatgcacagatgcagggagcagtgcgcgcgtcacaggcttgcacgacgacggtctcctccttggcatcgatcagccatcagcatcagctcgagctgctgagtcgaccggcctcctcctcctcccgctgtatcctggccaggatctcatgcacagcggccgcaatatcttccacagagcccagcttggagccatcctccacctaccgtacgtgcatgcaaaacaaagaaagatcgatgccatcaccaccaccggacgccgttcttatatagaaacggaaacaaaccgtcgacgtgccacggctcgatccgtcgatctgtctccatcaccttatactccatgtaaataaactacttcaggagaaggttaattaccttaaggctgaaggaatacaggaccatggcgtcgacggtggtcacgttgagatggagcggcgggatgcgcagctgctgcagcccggcgacaagcctcaggagctgcttcggccgccgccgggacagcaccttgaggctcgcgtggccttccaccatggtcacctcgatgtcggccacgcccgcctcgctcttgtcgccgctcgaatcggcaccggagccgccgtcgctggcggtggcctgcgtggcattacacgaggtggagtactgtggg

SEQ ID NO: 6929 - DNA, 678 bp, Triticum aestivum
  Predicted polypeptide sequence is orthologous to G268
attcggcacgagggtaggaccatcgtcgacatagacaagttctgcttcaaggaagagacatagaagaaggctcgacaagaggaaggaagcaggtgtggtttagcaacatacctcatacatggttggttgctgacaaaggagggcagaattggattacaaaggctaaagatggtaccatctggctctcgcactagagtttttctggatgttggctttggagtaacaagttttgggccatacttaatttcacgtgaatttgagcatggtgttcctgcaatggtggcaactaatttaacaccggctattatccaatgttcccgctgtagaataaattcgacatgtgatggtgagctgagagatggaggacctagctctcaaacggaccatgttgggagattgtgaggaaaatatgtttctatgtggaggaagccttttataattaactcatggtacatgagtcgtgatcctagggtcaaacatccactttgtgatactgatgataattccagataatgtctggtattttcaaccccacctggcatgcttttaattgttaagcctcaattcaaggactaaattcagaatatgtattaagaaagtagtccatactttttttagatttgttttgaacatttgcataattatgcaattatctcttgcaaaaaaaaaaaaaaaaaa

SEQ ID NO: 6930 - DNA, 1174 bp, Triticum aestivum
  Predicted polypeptide sequence is orthologous to G268
aaaagcaggtggtaccggcccggaattttgggatatcgtcgacccacgcgtccgcccacgcgtccgattaaggaaaacatgtcaggatggttgatgcttgatgcagcggagagtcacatgtgcattgccgacagtttcaatttaatcgggcttccgactggaggaacagaagcgactctccgttctccagccattaagttcattactgaataacaaaatcagcttcagacctaaggtttgatcaggaaaattcagctatgtctatctatgtgcattggtcttaatttttttagatgagcaaattgtctacttccataggaagtggatgggatgatctacatagcctcctgcagcaccggattcaaggaatcagtacaacagtgtggcctcttactagacagttttcttctctctgctttcgagaatgctagacacttttcagttttctttgatgctgatctaaatgtttaaatatctggatgtgttttcttgaatacaggttcgatctttgattatctgcatagtatatctaaccactctgactttcctttattattaagatgcatcaaatcgcaatcccctccgagaggaagggccaactcaacatccatgtacgagaatctctgtaatgtagttatgtgaactagaggtgtggtttagcaatgtacctcatacacggctggttgatgataaagatatctcagagatggaggacctcgtaaccgaccatgttggaagcttgtgaagaaatagtatgttgctgtatggaggaatcctttaaataactcttgctacatgagtcagtgatcctgaggcaaacctccactttgtgatagtgatgataattccagataatgtttggtatttttttaccccatctaatctaccttttattaattaaagcctcaatttgggtttgaacatttggcaataattacttaaatccttaaagattatcctttacgggtttaacaaagcaagcggatccgtaaacaatcaaaaaaaagggggcgggccggccctaaagttattccccggaggggggcccaaggctttgccgttaccccggttttttttgtaaaaagggtgggcccctatagggtgggctgttattattaaacccaagggccacttgcccgctccgtttttaaaagcgttcttgcacgttggaaaa

SEQ ID NO: 6931 - DNA, 864 bp, Triticum aestivum
  misc_feature (794)..(794): n is a, c, g, or t
  misc_feature (803)..(803): n is a, c, g, or t
  Predicted polypeptide sequence is orthologous to G268
ttgaccattaggcctatttaggtgactctctagaacaagtttgtacaaaaaagcaggctggtaccggtccggaattcccgggatatcgtcgacccacgcgtccggtgaatagtgacggatcaactccctttccatggcctgcacgcttaatggagcctccaaggagacttcaaggtgttgaaatggacgcctactcatcaaagaatgagcttttcaaagcagagacgaaattttgggatgatatactcgaaggttatattcgtgttttcaagtggaaaaagttcaaactccggaatgtaatggacatgagggctggatttggagggtttgctgctgcattgatcggtcgcaagcttgattgctgggtgatgaatgttgttcctgttactgagccaaacacactgcctgtaatttatgaccggggacttcttggagtggcccatgactggtgtgaaccatttgacacatatccaaggacttatgatctgctgcatgcattcgggctattctcaaaggagcagaaaaggtgtaacgcctcaattatcttgcttgagatggatcggatactcagacctggtggtagggcgtatatccgtgataaaaaggaaacgatagtggagatcaaggaaataacagacgcgatgggatggagatccaccatacgtgacactgctgaaagcgcgtatgctagcaggaaagttttgatgtgtgacaagccgatggtgcgctagccgatcaggcagagcattctccggccaagaatgctgtggcgggtgcctgccggttttagtccncggcaacgnttggaacgactacaaaacctgcagtggactggagattgacattgtgctccgtaataaggta

SEQ ID NO: 6932 - DNA, 459 bp, Triticum aestivum
  misc_feature (209)..(209): n is a, c, g, or t
  misc_feature (257)..(257): n is a, c, g, or t
  misc_feature (286)..(286): n is a, c, g, or t
  misc_feature (293)..(293): n is a, c, g, or t
  misc_feature (303)..(303): n is a, c, g, or t
  misc_feature (322)..(322): n is a, c, g, or t
  misc_feature (327)..(327): n is a, c, g, or t
  misc_feature (345)..(345): n is a, c, g, or t
  misc_feature (361)..(361): n is a, c, g, or t
  misc_feature (365)..(365): n is a, c, g, or t
  misc_feature (372)..(372): n is a, c, g, or t
  misc_feature (389)..(389): n is a, c, g, or t
  misc_feature (407)..(407): n is a, c, g, or t
  Predicted polypeptide sequence is orthologous to G2686
cttgatggcaatgaattaccatgtcaatacatccaatagcgctttgtgggatcacatgccaatggttttccacacctgacctgagccgaaatttttgcaccgtacttccgccatgttaggccgcgtttcatcttttgcttgttctgatagtatttcaaccctttttgtgggaaaagctgatattgggttagatgttgggtatagaagancatagagggaacctggacaaagcatttccggcagcacggccatccttncatatgccctgactttgggtgcattgtgntattaantgggtacctncctttgagcaacccgatgnacctngtccctggtaggtttggnaaactatcctggccangcantaataantattgtgaaagtttaanacaggcaaatccatacanacaggtattaacaaatttgggtattttttttgaaacctggaaaaaaaaaaaa

SEQ ID NO: 6933 - DNA, 715 bp, Triticum aestivum
  misc_feature (120)..(120): n is a, c, g, or t
  misc_feature (613)..(613): n is a, c, g, or t
  Predicted polypeptide sequence is orthologous to G274
cacgcgtccgctgtataactccgcttctgaggttaaaagcgtgtcagaggttgctggtggtgaactagagccatttccccagaggctcaatgcagtaccacctcggatagcccgtggttntgtacctgggttctcagttcaaacatatcaggaggacaataaactctggcagaaacatgttaatgcttacaagaaaaccaatgacttgcttgatactggaaggtaccgcaacataatggacatgaatgcaggtcttggtagctttgctgctgtactggagtctccaaagctgtgggtcatgaatgtcgttccgttcattgcagatacttctactttaggtgtaatctatgagcgagggttaataggaatgtatcacgactggtgtgaagggttttctacttacccaaggacatatgacctcatacatgctaacggtgtcttcagtttgtaccaaaacaagtgtaaatttgaagatatactactggaaatggaccggatcttacgcccagagggcgcagttataatccgtgacacggttgacgctcttgtaaaggtggagaaaatagccaatgccatgaggtgggagacaagactggccgaccatgagggcggncctcgtgtgcccgagaagatcctctttgcagttaagcaatactggactggcgacagcaagagccgcgctaacatgtctggattattttctcgtttcattcag

SEQ ID NO: 6934 - DNA, 1100 bp, Triticum aestivum
  misc_feature (41)..(41): n is a, c, g, or t
  misc_feature (419)..(419): n is a, c, g, or t
  misc_feature (560)..(560): n is a, c, g, or t
  misc_feature (710)..(710): n is a, c, g, or t
  Predicted polypeptide sequence is orthologous to G274
tgatagcggccgcccttttttttttttttgggaaaatccancaattaatgtttcttttatcgacatgcgcatatgaatgtttgtcaactataccatctcaacagagatctgtatctatgaacaagcactattaatcgatgtggagggatcaagaatctatgaaccgtcactttttcgctgtccaaaatcatgatgcagggacaaaacctattaactgtttcctaacgcggcacccaacagcaatcagaagtccaaaatcttgacgcagggcaagagagtctatggactgcttccttctttgctgccaacccagtacgtttttacagcaatcagaagttttcaggcacgagcgggccatcttcgtgatcaagtagcttggacttccatcgcattcccgtcaccgtactcctgaccttgtncagcacctcaacattgtcccgcagtatgacagcgccctcgggacgcaaatcctatccatctcaagaagatgtcttccaggtcacacttgttctcatacaaactgaagacaccgctggcatgtatcaggtcatatgtcctanggtacgtagagaaagcttcgcaccaatcatgggtatatgccaaatagaccccgctcatagatgatgcccagagtgtcctctctgatatcgtaggccaacgttcatgacccaggagccgggagaatcagcactgcagcaaaactcccaggnctgcattcatgtccatgatatccctataccttgacttccctatcaaacttgtttaccctcttgtatgtatcaacatgcttcttccaacaacttcttatcctctccatagacttcttctgtaacacctggggtgccttctaaaattctggggagggactggaaatagtctctggggaaaattctgtaactgctgtgccccctctggaattaggtgttataaggttcccatttcttttaccaaaatgcccctgctttttaaacgttgaaatcttggtggtaaaacaatcttgttatgggatgctttgaatttgcgcttttctgccaaaaaaagtattctcctccccttttttttttccccaaaaattttacaaatgttcctatttatttggt

SEQ ID NO: 6935 - DNA, 1161 bp, Triticum aestivum
  misc_feature (27)..(27): n is a, c, g, or t
  misc_feature (31)..(31): n is a, c, g, or t
  Predicted polypeptide sequence is orthologous to G274
gtctaccgctggtggagggacacagtncctncaaggtgctgataagtacattgatcaactggcgtcagttataccgattgccaacggaaccgtcaggactgcattggacactggttgcggggtggctagctggggagcttacttgttaaagaggaatgttttagccatgtcgtttgcacccagagattcacacgaagcccaagtacagtttgctctggagagaggtgtcccagctgttatcggtgttcttggcacaattaaactcccttatccatcaagagcctttgatatggcccattgttctaggtgcttgattccatggggaatgaatgatggactctatatgatggaagttgatagggttctaagacctggcggatactgggtgctgtcaggtcctccaattaactggaaggcgaactacaagggttggcaacgtacaaaggaggatcttgaagcagagcagaacaagatagaggaaatggctgagcttctatgttgggagaaagtctcggagaagggtgagacggcaatatggaggaaaagagtaaatactgagtcctgtccatctaggctagaagaatccactgtgcagatgtgtgaatcaacaaatgcagatgatgtctggtacaagaagatgaaggcatgtgttacacctcttcctgatgtacaaaatccaagtgaagttgccgggggagcaatcaagcccttcccaagcaggctcaacgcagttcctccaagaaattctaatgggttaatccaggggtttcatctgaggcatatcagaaaagacacaaaatgtggaagaagcatgtgaaggcttatagcaatgtgaacaagtatctactactggtaggtcagaaacatcatggacatgaatccggtttgggggggtttgtgtggggaaatcaacccccaaaattttgggttatgaatgtgggcgcacccattggaaaaattgaaccctgggggctggtttttacccaggtttggtgggttttaccgagatggggggaagctttctttttttttccagggtcaatgttttttcccacctaggggcttttcccctggttagcaaaaggggggaggtgagaatcctccttaatagtgcccttttgagcccaagaggtggtttaatgggaaaattatcaattctaa

SEQ ID NO: 6936 - DNA, 1048 bp, Triticum aestivum
  Predicted polypeptide sequence is orthologous to G274
tgcgacccacgcttccggacagttgaaaaggcagttcagaactggatccagcaccagggagatgtcttccatttcccaggaggcgggacaatgtttccaaatggagcaagctcttacattgatgaacttgcatcagtcattccacttactgatggcaccattaggactgcacttgacactggatgcggggttgcaagctggggtgcttacctaatggataggaatatattgaccatgtcatttgcacctcgagactcacacgaagctcaggttcaatttgctttggagcgaggtgttcctgctgtaattggagtgcttgggactatgaagctcccatacccatctagatcttttgatatggcccattgctcacgctgcttaatcccctggaaatcaaatgatggaatgtacatgatggaagtggatcgggttcttaggcctgggggttattggatattatctggtcctcccatcaattggaagaaatattacaaaacatggcaaagatccaaacaagattcagaggaagaacaaaatagaattgagaacattgctgaaatgctttgctggaataaaatatatgagaaggaagatactgttatttggcagaaaaaggcaaattcaaatgcatgccataacaagaatggtcgtaccagcaagatgtgcaacgttcaagatgcagatgacatctggtataagaaaatggaaacctgtataacacctatcccagagggagcacagcagctacagaagtttccacagagactatttgcagtccctcccagaattctagaaggtaccccaggtgttacagaagaggtctatgaagaggataagaagttgtggaagaagcatgttgatacatacaagaggggtaaacagtcgatagggaagtcaagtgataggaatatcatggacatgaatgcaggcctggaaattttgctgcaatgctggattccccggctcctgggtcatgaacgtggtgccctcgatatcagagaggaacaccttgggaatatcttattaccgggggctcattgacaattcc

SEQ ID NO: 6937 - DNA, 968 bp, Triticum aestivum
  Predicted polypeptide sequence is orthologous to G2754
gcgcttaccgcgttaattattttcaactattacgagactgtatatggcagagttctggcaacacacktacaacctccttcagaatagactaccctaagtgcataacagtcttactacatacagtatagcttgctgacccaaagcaaatggggaagaaggtgcgggctcaagtttagttagagcacctaatctacgggtgcaacgcccggtcaataattacttccttttggattcttttcgagatatgttaccacatactgtatcacatatgccatgcggtcgataattacttgggcggataatgttttcccccaaacatcaactagctagcggtgaccaagccgaatcacccgaaatgccgaggcgtcgtcgtttctaggccagggcggggctcagctggtgagcgccgagagcacgccaccaccgctcttggaggccatcacgacctcccagccaggccctttcagggggataagagggggggcatcggcggcggcaggcggcccggtgaggtcgctccggtccatcaccttcaaaaggtcctcgtcgctgatgtcggtctggatcatcctgtcttcctcgtcccgctcgtccctcagcagcgcaasagctcctcctcatctaagacgttaggcttcgcgctattttgttcaaactgtcccttcccgatcacaacgtgctctagcttcagctttccaaaagctctcttgataatccgtccctcaacagagttggatgttgccaaccgataaacatgcactgggcgcgtttgaccaatccggtggcatcgatccatggcctgcaaatccatctgaggattccagtcactgtcatacaggatacatgtatcagcagaagcmagaattgattgcmagcccaccggcacgagtgctcagaataaagacattcatactgctgttcaacgtcattaaactcygctatctgtcycatcctgtcttctaatttaa

SEQ ID NO: 6938 - DNA, 1128 bp, Triticum aestivum
  Predicted polypeptide sequence is orthologous to G2754
ccgagagcggccgcccttttttttttttttttttccagactaattcagcagccactagtagtttcataacagtcttacatagctactagggtggttgccttggatgaaagagctcgagttacatcacaacacagctcgccaaaggatcgatcagctcctaatctagggggtgcaacgcccggtcgtccataattacttaggggggatacatcatgttcacaaaaacatcggccttaacacaggcgacgaacaaagccggagcaccagtacaccgagggcgtcggtcgtcgttgccaggccggtgactggggcgggcgcggggctcagctggtgagcgctgagagcatgccgccgccggcagccaccacgacctcccagccaggccctttgagggggaagtgcggggcggcatcagcggctgcacgcgcgccggtgaggtcgctccggtccatcaccttcaggaggtcctcgtcgctgatgtccgtctggatcatcctgtcttcctcggcctgctcgtccctcagaagcgccagcagctccccctcatctaaggcgttaggcttcgcggcatcttgctggaactgtcccttcccgatcactacgtgctctagcttcaactttccgaaagctttcttgatgatccgtccctcaacagaattggatgtcgccaatcgataaacatgaactggctgtgtttggccaatacggtggcatcgatccatagcctgcaaatccatctgaggattccagtcactatcatacaggatacaagtatcagcagaagtaaggttgataccaagcccaccagcacgtgtgctgagaatgaagaattcataccactgtttaagtcattaaacgctgctatcgggtccctcctgtcttccacctaacataacatcaattcggcgacccttaaggcctttttaagacaattatagttaaggatgtccaaaattttggtccttgtaaaaaattcgggagcgtgggttgacaaaatcccgggaattcggaacggtaccaccctgttttttggcaaaattggttctaaaggttccccaaaaaagcccaaaggggcaaaacggttccctggtgaaaattttatccccccgcggggctaagtttaactta

SEQ ID NO: 6939 - DNA, 532 bp, Triticum aestivum
  Predicted polypeptide sequence is orthologous to G2766
ccacgcgtccgctctctccggtgctgcagtcacacacacgcccacggccaggcattcacctctctcttcttcctccacaatgaaccaagcaccactctctgctggaccgtggcggcagaatcgagcacgggtgcgcgcggccgtcttgctcgtgactggtggctgcttcgcgttcgtcgacagattgcgatgctgctgctgctcgtatgggctcccggtgaccgggccagcacgcgctggggctggctgggctcctagcagccggcctccccgcctcctccaacatcgcctggagaggagctcctctgtgcttccgagccgcctcctcgagcagggcagccagagggaagggagtcgccacatggaacacaactggaacgccccgccttggagctcactgcctcctggccgccgtccatctcttggtggtgcctgttaggcaggcattgatgcttatcctcggctctctctctgtcagatgtctccttcaggccgaggaggatgagtggggctctcgcaactgggccgctgc

SEQ ID NO: 6940 - DNA, 836 bp, Triticum aestivum
  misc_feature (622)..(623): n is a, c, g, or t
  misc_feature (836)..(836): n is a, c, g, or t
  Predicted polypeptide sequence is orthologous to G2766
cacaggctattagctttaggcctatctaggtgacattatagaacaagtttgtacaaaaaagcaggctggtaccggtccggaattcccgggatatcgtcgacccacgcgtccgcgacggcgacgacggcatggtcaccagctacagcaacatcgactcccagtttggctcgtctctggacatgcctggcatggacgactacctgcagctgcagcaggactccgtcgcctgcagggtccgcgccaagcgcggctgcgccactcacccgcggagcatcgccgagagggaaagaagaacgaggatcagcaagaggcttaggaggctgcaagacctcgtgcccaacatggacaagcaaacaaatacttctgacatgctggatattgctgttgactacatcaaagtgctgcaggaccaaatcgagaaactgaaacaggaccaaggaaactgctcttgctcagccgatcagaagtgctgacgccgaaacccagatatgtgaggttatgtttgtaccaatgtgattagcaagcccaagttttgcttcgggagattaagttgtaaatgcccttcgtatctcaagtagtctccatatgcctatcttcccctttcgtggttgtactatggatnnactagttcaatggcttaaagactaggaggtgacaagtagagtgttgtaatttgagtatgtaaggcattgccaatctttcatttcaaaaaaaaaaaaaaaaaaaaaaaggcgggcgctctagagtttccctcgaggggcccaggcttacgcgtacccagctttcttgtacaaggtggccctatggtgggtcgtattataagctacgcactggcn

SEQ ID NO: 6941 - DNA, 1088 bp, Triticum aestivum
  misc_feature (715)..(715): n is a, c, g, or t
  Predicted polypeptide sequence is orthologous to G2789
cccacgcttccgcgactggagcacgaggacactgacatggactgaaggagtaaaaaaacgccaacgcccatagttccgtcccataccatacaaccactcgctagcaaccagaaactcactgccgccgccgccgccgccgccgccgcttgcattggagaagctcttgcaggagcctaaggctgtgtgtgccatcttcgttcctcggcgacgaccgcgaaaattgtagggctggcagactggtggccggccggcgcggcggccgaagcccaagccgaggagatggggagcatggacggccacccgctccagggcaaccacgcctacgcccacgtccctgccggcagcaacaacgacgaggacgacgcgtcgccgccgccctcggccggcgggggctcctcggggtcgggccgccggccgcgcggcaggcccccggggtccaagaacaagcccaagccgcccgtggtggtgacgcgggagagccccaacgcgatgcgctcccacgtgctggagatcgccagcggggccgacatcgtggaggccatcgcggccttctcccgccgcaggcagcgcggcgtctccgtcctcagcgggagcggcgccgtcaccaacgtcacgctgcgccagcccgcggggaccggggcggccgccgtcgccctaagggggcgcttcgagatactctccctgtccggcgccttcctcccggcgccggcgccgncccgggcgacggggctcgccgtctacctcgccggcgggcaggggcaggtggtcgggggcagcgtgatgggggagcttctcgcgtccggccccgtcatggtgatcgcggccacgttcggcaacgccacgtacgagaggctgccgctggatcaagacgcgaggagggcgccgtgctgtccgggtcggagggcgcccccacccacctggagcaccaggcaacgggggcgccgccgtgccccgccgatgtacgcggtgccccaaacccccccctaccaacttttcggccattggggcaagcggccgtggccggcctccgccaatttatcttagcccttacccgggaaggtgaatcggcccgccggttctctaaccta

SEQ ID NO: 6942 - DNA, 684 bp, Triticum aestivum
  Predicted polypeptide sequence is orthologous to G2791
ccacgcgtccgcagtgagtgaagcacaagggacactgattccttcaaagataagctcaacgatccataacaataaaagtgagtaccctgtccctatcagccattctgctgatgcgcagaacaaggcaaattcagctaatggaaatagtgccagtgctaagccacgagcaagggctcgtcgtggacaggcaactgaccctcatagtattgctgaacggcttcgcagagagaagatctcagagaggatgaaaaatctccaagaccttgtaccaaattcaaataaggcagataaatcatcaatgcttgatgaaataattgattatgtgaaatttcttcagcttcaggtgaaggtcttaagcatgagtaggctaggagctcccggggcagttcttcccctccttgcagaatctcaaactgagggccatagcaattcatctctatcacctccaaccgcttcacaagggcttctggatgcagcaggcccagaagacagcttggtctttgagcaagaagttataaagctgatggaaacaagcatcacaaatgcaatgcagtaccttcagaacaagggcctctgcctgatgcctatcgctcttgcttcagccatatccaaccagaaaggcacttctgcagctgcagtccctcctgaaaggtgaaaacagaaagcacatcatgctcctcccat

SEQ ID NO: 6943 - DNA, 834 bp, Triticum aestivum
  misc_feature (733)..(733): n is a, c, g, or t
  Predicted polypeptide sequence is orthologous to G28
acgcttgaccttaggcctatttaggtgacactctagaacaagtttgtacaaaaaagcaggctcgtaccggtccggaattcccgggatatcgtcgacccacgcgtccgcacaaagcaacgtccaagatatagcttcaacgttgaagaagttggctggctgactccttttaaatctcatggcgatcctcatgtcatgcgttactcccaaaacgttggcgacatgcactccggaggtttctcggcaacaacgggacacatgtatttctgtctcagctcatcgccggcaaatccgaatcggcttaaccatgaagtcttggggcaccagctgtaccgttccgccgatgcggataagaggagcaacacgaattactgcagctggttccggtcctggagaattgccagaagaaaaatcaccaatacccaacaaagaggctgcaattagttcggaccctgtggaattaccaggaaaatccccaccgcccaacaaatcttcattggtcacggtggtcgttggtggcgtctttggagcagtatctttttacggacagatgagagcaatggaagagaatgtggaaaagacggcagaggtagctatcgagactatcgagaaagcggcggatgtggttgacaaactcgcagacgaagtcctagcatttccccggtaatgaaacccttaagaagggcacccttcaggatcaaagtcattcgcagaagataatagagagggatgcagnaggaacgcggaggcccctaaacccccaagggttggaaaagataaaaaaaggagggggatggctgcagggggatacttttcctgggggaaggggcaataaaa

SEQ ID NO: 6944 - DNA, 759 bp, Triticum aestivum
  misc_feature (486)..(486): n is a, c, g, or t
  misc_feature (506)..(506): n is a, c, g, or t
  misc_feature (615)..(616): n is a, c, g, or t
  Predicted polypeptide sequence is orthologous to G280
gagagagagagagagagagagagagagagagagagagagagagagagagagagagagagagagagagagagagagagagagagagagagagagagagagagagagagagagagagagcgcagtcgccgcagacctcctctcgggaagaaaaattccccacctctcctccctttcccctcctcgtccccgccgcttcgccatggccgacgagcaggtcgccaagccggcgagcctcccgccatatcccgagatgatactggctgccatcgcggcgctcaacgacaagaacgggtcgaacaagtccgccatctccaagcacatcgagggcaagtacggcgacctccccaaggagcacgctgctctgctgacggcgcatctggtgcgcatgaaggagtccggccagctcctctttctcaagaacaactactttcgcaccgacgcgccggacgccccgcccaagcggtgccgcggccgcccgcgcaagcncattgaccccaacgcgccgnccaagcccgtctcgccgcgcccccggggacgcccggtcaagcccaaagaccccgaggccgaagccgtcaacccgtctaggaaggccaagaccgttcccggccttgcgtnnacggttcgccaagcgcgggcggggctgttcgcccaggcgccccccgccaaccggggggggcttactcgttctccgtccacttggggccggtttgggtttttttggtatacccgggggtgggtgggttaattttgtttgtgggg

SEQ ID NO: 6945 - DNA, 1117 bp, Triticum aestivum
  misc_feature (816)..(816): n is a, c, g, or t
  misc_feature (834)..(834): n is a, c, g, or t
  Predicted polypeptide sequence is orthologous to G280
cctgcgacccacgcttccgcgactggagcacgaggacactgacatggactgaagggagtagaaatttttcccctccccgcagcccgctccctcctccgcgcccgcactgtagcccgagcgctcggctccaccgccgtgggctgtagccgccgtcgctgccatggcgaacgacgggtcccccaagtccggtgacatcccgccctaccccgagatgattctcgcggcgatcgaggcgctgggcgacaagaacggctcgagcaagtccgccatctccagctacatcgaggagaagtacgatggcctcccctcggcgcacgcctccctcctcacggccaacctcgccagcatgaaggaggccggcaagctcgccttcgtcaagaacaactacctcaaggctgacgctccctccgccaccccggcaaagcgcggccgcggccgcccgcctaaggaccctaacgcgccgcccaagccgaaggctgcgcccaaggaccccaacacgcccaagcgcggccggggccgcccgcccaaggctaaggatcccatggccgacgccgtcaaggatgccgtcgccaaggcgaccaccggcatgccccggggccgcggccgcccgccgggtccctcctcggccaagaaggccaaggtcgccaaggaggctgcctctccggctcccgcggacggctccgctcctgccaagcgtggccgtgggcgcccacgcaaggtggcggtgtgaggcctgcgtgctgatgcctttcggtctgtgtatctcgctgtggttgcgacggtggtaagctcctaggtgtgaccgtgcttcttcgnattgtgctccgtactaanttgtccgtcggcttagttgctcagtatgtgttgtaactaatcgagatgagtgtgcacaatggatggatggatgttttagcttcggttgtagttgactgtgctgctgtgagtgacatggtcatttttttaaaaaaaaaaaaaaaaaaaaaaaaagggcgccgttctaagtatcctcgaggggcccagcttaccgtcccagcttctggtcaaggggtccctataggaatcgtatttaagtaggcctgcccgggtttaaaaattggtatgggaaaatgttacttga

SEQ ID NO: 6946 - DNA, 632 bp, Triticum aestivum
  misc_feature (7)..(7): n is a, c, g, or t
  Predicted polypeptide sequence is orthologous to G2802
tgcaggnaattcggcacgaggagaaggtggactacacgcggtacctggcggcggcggcggcccccaacacggagcacgacatgggcggcgacaacagctcccccgacgagcagtggttcgtgcggttcggcgaggtcatctccaagcacaccatgtgacgcgacacgcgaaccgacgacgccccccaaagtcttctcctccccaaggtgtagcgagagccggaagatgcagctaggacagcatagtagagcacagtgcagggaaaataggcctagggtttctttctgagtagtacatggatggatggtgccattgctcttcctcacaccttcccattttgctcttcttcttcttcttcttggtggtgttgattatcagaagcaagcatggtggagctcttgctgggcattcatggcgtggatcggtcaggttgagagtgatccatctcgtgagcgccttgaaggcccctagcaaaactttatgcgctctgatgatgacgatgaccagaggcagagggggagatactactactgctactgctgtgacgatgatgatgggttgttggatcctgtgagcgcattgaattgtattgatcgaaccccatgccctgccgcatgatgcgtcgtcggcaa

SEQ ID NO: 6947 - DNA, 689 bp, Triticum aestivum
  Predicted polypeptide sequence is orthologous to G2802
ataactttatttcttggaaacaatctcgaatgtgaatccaactcgttacaaagtaaagtaacagtaagcaattaaaactaaacaattttgcgtcactaaaaagaaaaagaagcgtctcaaactaagcgaaaaacaaagttaatgtacatgcaaacagtattactttttacaattgaaaaatatctaatgcacatcaaaagttgtgacaaacaatgatgtgcttataatcaaacttggattaaggttcattagttatgcttctatcaggctccattctgatgtcagcacaacaatgcctttccccaaccgttctcctcctctttcccctcaacacctttgcaaagttaaattgtatccttttccccccattgacagagcaagatctatgagatctcccggttcttctcccaattaacagtagtgcattctccaagaaagcagtaccgtatattcaaggagggagagaccatactagctagagaaagaggtcgtggttgcttttgtttaatctggtatttaccagtcttgttgctactatccatgatgatcttggttgtcaggaggccagtatgggtaaggccattctgtctcttgggagtgaggaatcgaagtctctccttttgtgcatgtagacgtgcaccccattaccagttcttccaagccagcagacctgcggtcaatcttttgct

SEQ ID NO: 6948 - DNA, 695 bp, Triticum aestivum
  Predicted polypeptide sequence is orthologous to G2802
tttttttttttttttttgaaaaatcagcatcaatttggaaagcaaaagaaattaaaagggttaatgtacacgcaaacaataccactactctttacaattagaaaataggtagtacgaataaaaaaactatgataaacggtgaactgattatagttgtacttgattaagtggtctctaatacatctagcggcccacacatgatcccttcagtgtcagcacaaacaatacctttcctcccatcgatctttcatcttctcttttcgttggccattttgtcttttctgtcttggagagctcacatagttccttttttttattgagggagatctacagagatcaatttttctctgttcttccccccactatagtaggtgtacattctccaagaaaagcatcgctgcatgttcaagcagacaaaaaccattccagtgaaagtggttgtggttagtgttccttttagcattcatcgccagtcgccactattttaccagtccttgctactatccatgatgatcttggttgtcaggtggccagtacgggtaaggccattctgtctcttgggggtgagcaattgaagtttcccctttcgtgcttgtggacgacgtgcatcccattatcagttcttccaagccggcagacctgaaatttgtcatggcgatggagaaggattgctggcacatggaactgatcatgat

SEQ ID NO: 6949 - DNA, 573 bp, Triticum aestivum
  misc_feature (543)..(543): n is a, c, g, or t
  misc_feature (572)..(573): n is a, c, g, or t
  Predicted polypeptide sequence is orthologous to G2802
tcgagcggccgcccgggcaggtgaattcctgcgatttcagatgcaatgatcagttgtactgcaatccagggatgcagcaggccaggacaatggatgacgatggtgttatgagtggccaggttttggggcaaggtgccggcgactctatgggctgtgtaaaaccaggttctttaaaccccccaggctgccgtgggggccaaatgctgtaaacaggtcgaggactccgaggcgcctattgtctccttgcgagagactattggcttccccgtacaaggaggattgtataaattgctggttctaccagagggccgcgtttggttcaaactgtcgtgtttgtggctctgttgccaatgatgccttctatggtgcccggggcgccacaagttcattagctatgatgctgtcaagacatccccctttattgttgcttagttccagccttggtaatgttcttggagttggacagccttcgctcctagtcctagatgctcgccgataattagtagaacagaccgtgtttgaaggtatcttgaataatttagntttcagcacccaggttttgtgcgaagatnn

SEQ ID NO: 6950 - DNA, 1080 bp, Triticum aestivum
  misc_feature (1031)..(1031): n is a, c, g, or t
  misc_feature (1059)..(1059): n is a, c, g, or t
  Predicted polypeptide sequence is orthologous to G2837
ccagagcggccgccctgtatctttatgattttttcttttttttttcctttttaatttttaccgaaaaaggcttgcgccccgctttataaataaagcacccaccaaggacaaagtatcaaggtaacaacagaacacagcgcacacacaaacgcaacgccaccgcaagtcatgaaccacaccaacaagcacggacacacacacaatacccaagttccgttgtgggcacggcacatcacgcccaacacaaaaggacgaagacacaatctgagacgatgggggcggagtggacgacatgacgatctaatctggttccggaggaggtgggggaagcggcggtgtcaatcggagggccattagctgggtgatgatggaggtgatggcgtctctctccctgggccggctaagcggccgccaaagcaagatgatgccggccttcggggtccgcacggccactgtcgtgcgcgcacgccatggccaggacgccgccgcccttcgcggtggctcgtggaatgaaacagcagccgccgctgccattctcatgcacgtgcgcatcgcctggcctccgcgcctcggatgtcgccgcctccaaatgcttgcgccggcagccgccggcgaaatgccccacaattgcgtcgccgggtcaccggaactaccctcgacggaggagcgggcgggacgaaatccttgtgcacgctggtccgccgcgccgccgtgtcttatctgggggcacccctcgcccgtccccccggaatggagctctctctcgggagcgagtgaatcgggaccaaaagggggatttctaaccccttcagcccatgtcagggtcctcgtggcccaatcgcggacgcgtgggtcgagtattctccgggaattccggaccggtaccacctggttttttggaaaacctggtcctttggggccccaaaaaaggccaatggccaagcggttccccgggggaaaaggtttcccgccccgggcctaggtaaaaccccaggggtgaacggccccgggttttttttggtggtaaaaantccgagggcggccccccgcacttgacgntccaaaaacaagcctgttttt

SEQ ID NO: 6951 - DNA, 884 bp, Triticum aestivum
  misc_feature (643)..(643): n is a, c, g, or t
  misc_feature (652)..(652): n is a, c, g, or t
  misc_feature (682)..(682): n is a, c, g, or t
  misc_feature (814)..(815): n is a, c, g, or t
  misc_feature (864)..(864): n is a, c, g, or t
  Predicted polypeptide sequence is orthologous to G2885
ttacacagctatatcgattgattacgccacgctatttattttgatactatagaatactcaagctatgcatccaacgcgttgggagctctcccttatggtcgacctgcaggcggccgcactagtgatttcgagcggccgcccgggcaggtgggcttttttttttttttttatttttttgatacaaacaaactcttagactgaacaacgatacaagctcacagactaagtaggaacagaagccatggagaaactgtaagcaacaacacatagcttccaaaccttcttgtgacatcagtacacacatctaacataaacataagacgcacaagaaatgcacctgagcaaagcaccaacacatgagatcagctaaccaaatgtcttagaaaccagtcacactgcactccaattccacacactgtttggagcagctgagccaacgagtctagtactctagtcctcaccggagtagtcagattcgctcggctccgacgcatcttcatcctcggactcatcatcttcgctcccagaatccgcgtagactaccgtcaccttcctctcccttactgtccttctcggtgcaaccagctcagcagagctgccggaaggaggagcacctcggccgcgaccacgctaatcccgcggncatggcggncgggagcatgcgacgtcgggcccaattcgncctatagtgagtcgtattacaattcactggccgtcgtttttacacgtcgtgactgggaaaacctggcgttacccactttatcgccttgcagcacatcccccttttcgcagcttgcgttatagcgagaggccnngcacgatcgcctttccaacagtttcgcagcctgaattgcgaatggaccncccctgttaccgcgcataat

SEQ ID NO: 6952 - DNA, 698 bp, Triticum aestivum
  Predicted polypeptide sequence is orthologous to G2982
ttttttgagctaaaagttaaaatcaggcctggagcttcacatgccgatcagcctaccatcggctgcaaagctaaattagaacatcacatttccccatggacataatttacaagcctttttacatgttaagttacagaagccaagggagtataaatccaagtagctctcaaaacattaacaacccattttagtgcctagtgttcatgcttgacacgccctttcagtatccctggaataggaggtgaggttcgtagcctaattccatttggccttgcaggttgtggtgatcgacgcccataaacatttgatgcacttgagcattcaaccgcatttgcaaccagagccactgtaccgtcagtttcttctttaccagagaaccccattgctttcaatacaaaggaatcatcgtgcaactcaaacggagtgctattgaaatcaaaatgcaccaactgcatatcttctgatatctccacttcgacagttgcatgaggacgtgtctgaaccaatatgaatggcagggccactccgccagatggagcatctcccgaaccatatagctgctcatttcgctctaccaaattttggaggcccgcatattgatcttgtaattcctgcagatatgcacttttcttgtcaattctacctttcagcccaatgacctcagtcttcaatttatcaatatcactcaaacctcgtgc

SEQ ID NO: 6953 - DNA, 681 bp, Triticum aestivum
  misc_feature (492)..(492): n is a, c, g, or t
  Predicted polypeptide sequence is orthologous to G2989, G2990
gtttggtacgtagcattgaggctctacatctggaccactggacgtgacacaaccaacggcgggttcgaggttgtgtgtccatctacgaaagagtggtgtgtaatctttgtcaagcaagtgacatcgtggaggccatggacgtcaagtaccccagcggctctgtcaagaaggtgaggcaggcagctgtggcgccggcggtgcaagaggcgaagtacaacgagtgcggcaggaaccacgcactggctagcggtgggcatgtcgtggacggctgtggggagtggatgcccttgagggacctcaaccccgccgacgcgtcgtcgtacaagtgcgcagcctgcggctgccaccgcagcttccaccgcaaggtgatgacggagaggtcgccgatgttggcgcccatggtggagacagtgctccacggcctgccgcagcgcaggaaggaggagacgccggaggactggctcccgggtgtcgactctgacaccaactcanatggcatgaagtacgactcggatgccacagagtacgactcagaaggcacggagtacgatgacgagcgctccgtgccccaaccactgcaacctccacctgtgtaccatccagcacaggtgacgcaacaactctcttctgggcaacataacttcctgccgagggcactgcagatccacaggcttgccaccc

SEQ ID NO: 6954 - DNA, 894 bp, Triticum aestivum
  misc_feature (816)..(816): n is a, c, g, or t
  Predicted polypeptide sequence is orthologous to G2990
caccacgctatgagattgattacgcccagctatttaggtgacactatagaatactcaagctatgcatccaacgcgttgggagctctcccatatggtcgacctgcaggcggccgcactagtgattagcgtggtcgcggccgaggtaaagactgacctttttcttctcatgagctaaaaatcaagagttcaaagctgctacttgaaaagtgcatctgcatctacaactattttgctatacaaatgtgcatctcaaaaaaagaaaccacaagatcaggaatcaagatcagccaaaacttctcatacaaacgttgactaaagtagccactagcctttctgagttttgcatccctcatggtagaattatccatcactggtgatggaggcaatggaactgcaaaatttacaccacacatcacgcatgcatgcgctcccatgtgcaaatgcatcaacagccactcacccaaaaacatgtacacccgggcatgcacatacggcacacacgctgatgcgaggaggaactgtacgccttggcctttatttgggggggggggggggggggggcttgttctgaaattgatctctggattaacccggtttctggtcattggtggaaaaccccctttttctggactaatttaaattctccccccgggggcagaacattaacgttacattttctggggccacccttggttgcacctattaaaaaacgcgcatggctttggatgtaatggctgatggggcacatatttaacattaggtacacttccaatttggggaagttttttgggatgggctttttagaaggccggtaancaccacaagaaggtacttcccgtggttgggcggttagcacattcataagtccatctggccctctcttttgctgggtag

SEQ ID NO: 6955 - DNA, 441 bp, Triticum aestivum
  misc_feature (248)..(248): n is a, c, g, or t
  misc_feature (276)..(276): n is a, c, g, or t
  misc_feature (318)..(318): n is a, c, g, or t
  misc_feature (333)..(333): n is a, c, g, or t
  misc_feature (382)..(382): n is a, c, g, or t
  misc_feature (397)..(397): n is a, c, g, or t
  misc_feature (421)..(421): n is a, c, g, or t
  misc_feature (434)..(434): n is a, c, g, or t
  Predicted polypeptide sequence is orthologous to G2996
ggttttttttttttttttttttttggtggaataaaagttcaacatatatactagaatggcaaaatccaacacattgaaacaacaaacatatgaacacaccaccttcactaagacaataccgttacacgaacaaggccatagtcctgaaagagggtgacgtgatgacatgattgaagcagaaacaatgtgcgtgccatgattctaacgctaggttgatgcttacggagcagcatcatgcagccaagtgntctccaccaccaccttcttccccctccnggcgggggcccccgaaggacactcatctcctccaactagctngtttctccctccaancaactcctactggcaaccaagccaactggagcaaacaaccctctctggncttctcccttctctnccaaacaaacggttttctggggangccaacaagcggncaagcct

SEQ ID NO: 6956 - DNA, 494 bp, Triticum aestivum
  misc_feature (158)..(158): n is a, c, g, or t
  misc_feature (290)..(290): n is a, c, g, or t
  misc_feature (308)..(308): n is a, c, g, or t
  misc_feature (338)..(338): n is a, c, g, or t
  misc_feature (345)..(345): n is a, c, g, or t
  misc_feature (347)..(347): n is a, c, g, or t
  misc_feature (357)..(357): n is a, c, g, or t
  misc_feature (361)..(361): n is a, c, g, or t
  misc_feature (364)..(364): n is a, c, g, or t
  misc_feature (379)..(379): n is a, c, g, or t
  misc_feature (401)..(401): n is a, c, g, or t
  misc_feature (420)..(421): n is a, c, g, or t
  misc_feature (436)..(436): n is a, c, g, or t
  misc_feature (442)..(442): n is a, c, g, or t
  misc_feature (444)..(444): n is a, c, g, or t
  misc_feature (451)..(451): n is a, c, g, or t
  Predicted polypeptide sequence is orthologous to G3
ctccttccccctcgagcacggcgcgtcgtcgacagcctccatccctcttcttccctcttcatcagccgagcacaactccgtttcacaggtccttcagaaaatgggaaaagtgggttttcttcatgtttatctacaaaatgttcaatgcctcctgtttnataggaggcacggagatgtttccctgggacggatgtgcaaatcctgggttaaaatggggcgaagggcacaaaattaaggcccttaagaatccgggaatgggcgctccttaagatgccaatttgattcaaatnggagtgggtgcttgtgtngtcaagaataaagacatgaattgtgttaangggattnanaaaagaaatngtgnaanagataatgccatagncttggtaaatcctgattttagnagatgcatacacatgtgtnnacatcccaattcaanacccananttccccnacttttttttggaaaaaaatgtgccccggctaaaaaaaaaaaa

SEQ ID NO: 6957 - DNA, 740 bp, Triticum aestivum
  Predicted polypeptide sequence is orthologous to G3
gattcggccgagggagaccgggagcccaacaagcggtcgcggatctggctcggctcctacgccaccgccgtcgccgccgcgcgcgcctacgacaccgccgtcttctacctccgcggccgctccgcgcgcctcaacttccccgaccagctcctcgacggcgcccccgccgccgcgcccggggacctcaccgccgccgccatccgcaagaaggccgccgaggtcggcgcgcgcgtcgacgcgctccactccggcgggatcggcgtcgtcgcccctccggccccgccgtcgccgtcccagcgccgccggcccaagaaccccgacctcaaccgggagcccacccccgacaccgacgacgacgagtaaacccccgccgattcttcagttctcctcctccgaccaccaccaccgcctacatacctagtactagtgcgtcttaattagtccttagcagcaatcagcagcgagctagctagcagtagcagagcatcaaccatctcagtgagcaagaaggcatggggaagcaagcgtggatccgacacgcaaggtgttcggtgaaatgccgggcgagctcgggggccgacccgaccaataatggagccgcgacgttgccgtcagctcggccagggggttactaagtagggcctggactgtcagcgacggcgagcttggtagcagtagactcggggcgtgtgagtgcgtgcgcgtgcttgggcatgggcatgggcatgcaactaagcaag

SEQ ID NO: 6958 - DNA, 859 bp, Triticum aestivum; identical to SEQ ID NO: 2097
  Predicted polypeptide sequence is orthologous to G30

SEQ ID NO: 6959 - DNA, 898 bp, Triticum aestivum
  Predicted polypeptide sequence is orthologous to G3055
aaccgctacttacgatgattacgccaacgctatttagtgtgacactatagaatactcaagctatgcatccaacgcgttgggagctctcccatatggtcgacctgcaggcggccgcactagtgattagcgtggtcgcggccgaggtagcttggacttcggttttttgttaagtactccagtaagcaatgctttttgggatgtaagctgttaaacctatcagctaccgctcgtgtgcctgcacagaagtatttcagagtttagtgggactggatcaggttttgatcaaaaaaaaaagaaaaaaacaaaaaaaaaaaaaaaccaactgaccggaaaagacgcccaaaaatcaaaaggccctcctggccgggaggatgctccatatcccccggtcctgcctatcgggagtattataactatggcccgaccggccctatacagagtcgtgtttgaatacaccgtggggtgttccaaaatattgggattggaaaaatcccgcttttcccaactaaatctctttggaagagatccccattgatcgacctgccctaaaattgaaaaggcccgatgggaaaggccttcccactggtagcggcgccttaaatgcggagtggtgtggccctacagcgcgacgttaaccgccaggcgggtgtggggctttaacccccgcgtcgatccgttatacttcccatgcgtcctatcgccccggtcctttggggtttcctcgcttccctttttatccgggtgccccggttttgcccccgaaaccttttatttggggggcccccttcccggttcagattatttgggttaggggccccgtaccggggaaaatggcataggggagggggtttcccctttgtgccatcgcccccataaaggttattgggccctttttttt

SEQ ID NO: 6960 - DNA, 870 bp, Triticum aestivum
  Predicted polypeptide sequence is orthologous to G3055
gacattaggcctatttaggtgatctatagaacaagtttgtacaaaaaagcaggctggtaccggtccggaattcccgggatatcgtcgacccacgcgtccggagcgagggcgctccatcatcgggatctgacagagtggccatggactacaccaacgccatccatatcatcccggacgccgccggtcccgaaagctgggccaactctgcggcgcctcctggcggggactctgggatttgggccaccgaggacgactacagccagtggaacggcgaccaggggcttagcgggggttgctatggcggtgacaggaactcgtcgcagccgcattcaagggccggcggcgagcagccgccgccgggcaagaagcccaggggcagtgggccgtcgggcggcggcgacgccgggagcacgagcaagtcgcgcgcgattgggaagatgttcttcaagacgaagctctgctgcaagttccgggcagggacgtgcccgtatgtgacaaactgcaacttcgctcatgggatggaggagctgcgcaagccgccccccaactggcaggagatcgtggcagcacacgaggaggcgacggaacagagagaggagcacccgatcccgatcatgacgtcgtccaacgtggtgccgggtgacagcgtgtctgggagggcgtacaaggagcgggcactggcaagaagctctccacccaagaaggggagcccctatggcgacccatggactttcttgcatgatgagcaatccaaaggcgcgtgaaaaacgtcccgattagcccaatcgccctccggttgggcggggggaagctacaaacttctgcctgctgggcggctggcccccctcctccaaaagggacccgacaatt

SEQ ID NO: 6961 - DNA, 520 bp, Triticum aestivum
  Predicted polypeptide sequence is orthologous to G3060
ttttttttttttttttttcgggtctgaagcacatttcattcaaaaaagctgaatctaaatcacaatccatagaaccaaaatacaacaggcctaatcacctagagccaacagcaagggacaacagaatagtcacagtagcagcacaagaacgagcgaggatccaccgcagcagcggggtcatcagacgggggcacccttccgctgctcggtctcgccatgggcgaagtggcagcgctcgccgaaagtgcaggtgcccttgaggaagttctcgcatatcttggtcttgtagttgctcctgcctccaggaccaccgccaccgccaccgccgccgcctcggcctgctggggccgctgtgccggcagggttcttcgacggcgtgctggcgctgatgctggcaatgaaatcacccaccatgtcgttggcttgctttatctggtcgaaactgccttccagctcaatgttcttcaggtctgggtttgattcgtggtcgcgtatcgagagcttgacccccgtgatgcgg

SEQ ID NO: 6962 - DNA, 1079 bp, Triticum aestivum
  misc_feature (14)..(14): n is a, c, g, or t
  misc_feature (744)..(744): n is a, c, g, or t
  misc_feature (800)..(822): n is a, c, g, or t
  misc_feature (878)..(878): n is a, c, g, or t
  Predicted polypeptide sequence is orthologous to G3060
gcttccgaccaatnacaacactgcagaaggctgcaagtttggcgacaagtgccatttcgcccatggcgagagggagcttggcagggcaccatcctcctacatgtcccaggaaagttcctatgctcctcctatgggtggtcgatatggaggtcggcacgaaccacctccgccagcttcgatgggccctccagctggaaactttggcgcctcgtccacctgcaaggtcagtgttgatgctgctctcgccggaggcatcatcgggaagggtggggtcaacacgaagcagatctgccgcatcacgggggtcaagctctcgatacgcgaccacgaatcaaacccagacctgaagaacattgagctggaaggcagttttgaccagataaagcaagccaacgacatggtgcgtgatctcattgccagcatcagcgccagcacgccgtcgaagaaccctgcaggcgcagcggctcccgcagtccgaggcggcggcggcggtgggcctggaggcaggagcaactacaagaccaagatatgcgagaacttcctcaagggcacctgcacgttcggcgagcgctgccacttcgcccacggcgagaccgagcagcggaagggtgctgccgtctgatgacaccgctgctgcggtggatcctcactcctccttgtgctgctactgtgactattctgttctcccttgctgttggctctaggtgattaggcctgttgtattttggttctatggattgtganttagattcagcttttttgaatgaaatacgcttcagaactttcttgctgtccaaaannnnnnnnnnnnnnnnnnnnnnnaaaagggcggccgctctagagtatccctcgagggggcccagcttacgcgtacccanttttcttgtacaaagtgtccctattgtgagtcgtataataagctaggcactgcccgtcgttttacaacgtcgtgactgggaaactgctagcttggaatcttgtgaaggaactttactctgtggtgtgacttaattggacaactacctcacgagatttaagccctagggtaatttaaaatttaaagggttaaggggtaaaca

SEQ ID NO: 6963 - DNA, 726 bp, Triticum aestivum
  Predicted polypeptide sequence is orthologous to G3060
cggcacgagggctcggcaatcagacgttcatcaacaactccatgccaccccatatgggaccaaggcccactggtcactttggacctccggcaatgcccagccctggcatggccaccccggcaggcttcggggcttcttccacagccaaggtcagcgtcgatgcatccctcgcaggcgccatcatcgggcggggcggagtcaacacaaagcagatatcccgggtcaccggggccaagctggccatccgggaccacgaatcgaacgaggccttgaaaaacattgagctcgagggcacgtttgatcagatcaacaacgccagcgccatgctcagggagttgatcttcaggatcagtggcggtgccaacgctcctccgccgggcgtgatcccggctggaggatctcaccgcggcggcggcggcagtgggcagggaagcaacttcaagaccaagctgtgcgacaacttcacgaaaggatcgtgcacgtttggcgacagatgccactttgcccatggcgagaacgagctgcgcaagtcggctgccgtgtgagattgatcaacctcacccaacatgatttgtagtagcgattagtcggtgtaactctgaaccttgagggctgatgatggattttctgactgtccctgagattatgccatcgattttatggatttcatatttgtcatgactcttatcagcctgttgtggtcttagtagaaagcttgacatgtta

SEQ ID NO: 6964 - DNA, 860 bp, Triticum aestivum
  misc_feature (10)..(10): n is a, c, g, or t
  misc_feature (400)..(400): n is a, c, g, or t
  Predicted polypeptide sequence is orthologous to G3060
ctagcattangtgacctatagaaaagtttgtacaaaaaagcaggctggtaccggtccggaattcccgggatatcgtcgacccacgcgtccggttaaaaacgccacgtgccaaactaaacctttgccccagcgcgacaccccatcttctccggttgtgaggccccgtgctgggtgctcctcctctctctctctaccgacgccgcccccgccagagagaaaccctagcctagggttccacgcgccgccgccgccgccgacgtcgaccccgcgtcgccctccccccgagctcgccatggacgcgggccgcaagagggccgtgccggagggcaccaacggcggcgccgccgtcaagcgcgccagagaatcggagtcggttcaagcgggtggaggaagcaaatcnaagccatgcaccaaatttttcagcactgctggttgtccctttggttcaagttgccattttctccataacttccctggaggtcaccaggctgtttcaaagatgaccaacttgagtggtccagctgtttcagctcctcaaggaagaatgcccatgggacctggtgttcctgatgggccacctacacccagcttgaagactcgcttgtgtaacaagttcaacacagcagaaggctgtaaatgggggaacaagtgtcattttgctcatggagagagggagctcggaaagcccatgctgttgaacaactcgatggcacctccaatgggaccaagacccaacggtcacttccagccctcaccgatgcctggcccagacatggttcctccctcacctttggcgcatcggccacagccaagatcagtgttgatgcatcccttgctggcggcattattgggaaaggtgg

SEQ ID NO: 6965 - DNA, 860 bp, Triticum aestivum
  misc_feature (120)..(121): n is a, c, g, or t
  misc_feature (746)..(746): n is a, c, g, or t
  Predicted polypeptide sequence is orthologous to G3067
gacccgactcttagttagtggcttatcatacgacgttgtattgggaccactttgtacaagaaagctgggtacgcgtaagcttgggcccctcgagggatactctagagcggccgccctttnntttttttttttttttttttttttttttttttgaaggcattcacgtacattcacaggaatatggacaaaacgcatctggccgatgctactagcaggcagccgcaccgcgtcacagcccgtgcaaacgttaacagagtggcaggcaagaggcaaccgagagagaaaagaatggttaatttgagtgctcggttagcgcgggatcaaggcttgcagatgaccacgaagcacggcagcagctccctcgggttcagcaggtagagctcttcgatgttggcgtagggccccaccttgccggccagcgagtcgaacccggtctgccccacgaactccctcacgttctctagcggcttgtgcaccctcccggcgatcaccctgcacaccagcagggccctccgcgcgccgccggccgcggctgccgggtcgtcttcctcgtcggcggactcgaaggcccggccggtggtggacgtggtgaagacgccgacgccggcgccggccttgccggccttcttggagctggaggaggagaagccgtggcggatgatgcggcaaacggcgcacttttcggaagcccaaaggctgttggcgccggcgggagcgaacgcccaggcgagcgttgcgccgttggnaccgcaacaattcgtttccgtcgtggagggagcgcgggttgttttttggccaactttctcgcctttgagctttacgcctccccggttttccttgaaagcggtgcaagtttctta

SEQ ID NO: 6966 - DNA, 713 bp, Triticum aestivum
  Predicted polypeptide sequence is orthologous to G3067
tttttttttttttttttttttttttggtccacacctgtacatgcatatatatcgacctatggcctcatgagaatacaagttgcatattcctaataagatttacactataagtaccgctgtaaatccactaagaaaaacactgtaaatccaatatgaatccaccgtaaaacattgtaaaattcactaaatattacaccaagcattttagttcaaatccactaagacactacaaatccagtaggaattacagtgtaaatccagtaagaattacactgtaaattcacatagaattacagtgtaaatccagtaggaattacagtgtaaatccacttagaattacactggacactgtaaatccagtataaatcttgaaacaagggactccgaccaatcttgaaaagtctgaggcttagcggcatttgaagactgaacaagtccaactatttgttgcacaacatcatttccaaaccgtgaagcataagccgtttcagctttacaggcaaaagagacattatcaacagctggagcatgaacttctgatgttgaaatcttattggcaaaggggatactataggttactgaacatgaaaacttttcacaagacttctgtgcgtaaactgatggtgataaacgcttcaacggcctcttgccatacgaacgactgttgctcttatgtaattccgagaaatccttaactttgttacctctccata

SEQ ID NO: 6967 - DNA, 679 bp, Triticum aestivum
  misc_feature (666)..(666): n is a, c, g, or t
  Predicted polypeptide sequence is orthologous to G3074
tgatttacaaccggcgaacctgtctagttatatagttgctacactatatagttgctacacaaaatactagctactactggctattgagcaatcaacatatgtcacatcctaaatcacttctgcagcatctgcgggtacacatactacaagagaattgctactacattgtcaagctgggcctgctaggatgtacatcatgtcatgtctacctatcagcttctcaaactaaatccacgctagagtcacgtcattcttcattgtcatagtcttcgtcctcctctaatctatggtttgacgacagcgcaaactgcaccgggtccatggccatcttgttcatctcaggcatttgccagcccaggaaatccttggtctccacttcttctttcaactgtgaaaccgacggtcctgaagtctggacttgcggtgccacggtcaccacaggagctgaaggagccgaaggctggacttgcggcgtatcctcctcgtagtcagcaagatctaagttcaagtcaatgttccttaaggaggccctggcattgctcaaaggggtatgctctttggtttcacttgtgtccagaacaacgtctccaatctctaccttcaggtggcctggtttgctaaattgggcacaacctaattcatggtgttcaatctccctctcagctncacgcccagcacg

SEQ ID NO: 6968 - DNA, 950 bp, Triticum aestivum
  Predicted polypeptide sequence is orthologous to G3074
gcacgaggaggaagaagctgggcacccggttccccgcggcacggatcaaaaagataatgcaagcagatgaggatgttggcaaaattgcactggctgtgcctgttttagtttcgagagcccttgaattgtttctgcaagatttgatcgaccactcatacaaaattactcttcaaagtggtgcaaagacactgaattccttccacctaaagcaatgtgtgaagaggtacagctcttttgacttcctaactgagattgtcaacaaggtgccagatctcggtggcggtgaatcttgtggagatgaaagaggattacccagaagaaggaaattttcaaatggaagcgacccagagaatgaggagccccgatctagcaaaatgcccataagaagcttgaacaccagtcccagaggacgaggcagaggtcgaggaagagggcgagggcggcctccaaccaagagaaaggaaattggttatgtacagtttgaggatgagagcagcatgtttgctgaacaaagtgaacccttgccaggagatgagatagttccggagaccaaccgtggcaatgagagtattccccaaagctcacatcctctagtggaggctccatcagccatgacgccagctgtgatttcaaaggttgaagaagctagcaccaaccatcagccagattggcctatgccagatgccattggaggcattggtgttggaccatccagttttggacatctgacagtgcaggttgatgaggtagaggactacgacaatgaggattaggcatagtcatcctctcattcatcatatgctctaacaggacagttctcctggtgttgtacattgtaaatattgtttcaagtagttactgcagctatgatgtgtaacctatttctttttcccaataattggttctgagttgccgcattgttgacctaaaaaaaaaaaaaaaaaaaaaaa

SEQ ID NO: 6969 - DNA, 677 bp, Triticum aestivum
  Predicted polypeptide sequence is orthologous to G3075
agctccttaagctaacaaagcaaaactaataaaccaatcaagtcttgtcccgcaagacacctctcatgacatagttacccacaggcgcaggcacaggcacaggtcttactctgtttgttactcaacctatccttgcctagtacagacagacagaagaacatactagtacaaacagctcgaccctcggatcacgtccttccttctccctccctacgctacacaggctagctagcacagcacaagtactggcatgacatgcaccacacccaccaccttgtctgtccattctatggctccttcgccacagccttgagcgcatccccggccgtcaccctcagcggcacgaaatctgatagaaacttgtaccgtttctcgttgcacaccgccgatgaaaggttctcgtaggtaattgactttttacgttccttcagggcattctgatgagcatccttcgcaaatacttccaagaataactccgaggccttgttgacgaggaagacggcctcattgttagatcggatggtggcgtccttgtcccgcatcagcagccgcacccgcgccatcgggaagctgcaggtgcccggctcggcggccacccggcgtcgcccctgccgccttgcccttctgcttcttcgcaggcgaagagccattctgcccgctcttcgccgcatttgggg

SEQ ID NO: 6970 - DNA, 608 bp, Triticum aestivum
  misc_feature (20)..(20): n is a, c, g, or t
  Predicted polypeptide sequence is orthologous to G3075
agggtgggttgacaacatgnaatgtgcttcccttgcccaaggtggatccatatggatacaacatagtacatacattctccatacatacgctggctggtctcaacctaacctgacctactacacaagaacatggtgcacaggatagctagcacaagacaagacaacctatggcatgcgtgcgtgtctccctcatggtctgcctaggaccgctccaccacagccttgagtgcatctccggctgtcaccctcagcggcacgaaatctgatagaaacttgtaccgtttctcattgcacacctccgtcgaaaggttatcgtaggtaattgactttttgcgttccttcagggcattctgataagcatccttcgcaaatgcctccaagaataactccgaggccttgttgacgaggaagacggtctcgttgttagatcggatggtggcgtccttgtcccgcatcagcagccgcacccgcgccatcgggaagctgcagatgcccggctcggcggccaccggcgccgcccctgctgccttgtccttctgtttcttcgcaggcgaagagccattctgctcgctcttggccgcctttgggggttccagatcgccatgctt

SEQ ID NO: 6971 - DNA, 827 bp, Triticum aestivum
  misc_feature (579)..(579): n is a, c, g, or t
  misc_feature (586)..(586): n is a, c, g, or t
  misc_feature (592)..(592): n is a, c, g, or t
  misc_feature (693)..(693): n is a, c, g, or t
  misc_feature (727)..(728): n is a, c, g, or t
  Predicted polypeptide sequence is orthologous to G309
gcagcctagcctagcactcacaatcttcacgcagctcgcccgagaggaacacatgggccacttcgccttcaactggcagggcatggaacccgcccccgccgcctccctgtccggcgccggtgctacgctgcctctccactccgtccagggcgccgccgccgcgacgaacagcgccgacgcctcgtactgcctcgacccggccacgtacgcgcccgcggtcctgcccacgatcccgccggccgttgcggaggtgggagccaagaggcgccaggatgcggagaacatcgcgctctacctcatccacatcctccacaagtgcgctgaagccatcgaggcgggcgactatgcggtcgcggccggcaagctctccgaggcgcgcacgatcctcgcgacgtctgtctcgaccaccactgggattggccgtgtcgccagccacttcgctgccgcgctggcccatcgcctcttccccgcgtcgccgcactcctccttcacgcaggacgcctcaccggagcgcgccggcgagctctaccgtcagttctacgatgcggggccgtacctcaagttcgcacactacacggncaaccangccatnctcgaggcgtttgagggctgcgatcgcgtgcacgtcgtggatctcgccatcaagcagggcgtgcagtggccagccctgatccaggccctttcccgcccgcnccggggccccgcgtccgtccgcataaaccgcgtnnggttccggccccgccgtcgacgaagcttggcctccgcctggccgaagctggcgcgtgccatgaatgtgcccttttcggttcaaaagggcacccgaggaa

SEQ ID NO: 6972 - DNA, 602 bp, Triticum aestivum
  Predicted polypeptide sequence is orthologous to G309
gctgggctccaatgcctacaagcaggcgagcacgctgctggcgctcttcgcaggcggcgacgggtacaaggtggaggagaaggagggctgcctgacgctggggtggcacacgcgcccgctgatcgccacctccgcatggcgcctggccgcgccgtgaccgctagttttgaacgctgtaagtacacatcgtgagcatggaggacgacacaaccccggcggccgccccggctctccggcgcacgcacgcacgcacgctcttgaagaagaagaagaagctaaatgtcatgtcagtgaacgctgaattgcagcggccggccacgatcgaccgtccggcgtgaagagacggacgacgacgaactccgagccgaccatcccaccggcatgtagtaatgtaatcccttcttcgtccccagttctccaccgcctccatgatcacccgtaaaactcccaagccctactactactactactactactactactactatcatgtttaaatgtctattattgcaatgtgtaattcctccaatcgctcatatcaaaataagcgcgggccggactttgttagctgctccaatgagaatgaaaatgaattttgtacg

SEQ ID NO: 6973 - DNA, 628 bp, Triticum aestivum
  misc_feature (471)..(471): n is a, c, g, or t
  Predicted polypeptide sequence is orthologous to G3111
tttttttttttttttttttttttttttttttttttttttttcaagctaagtgcatgtttttatagcaacttccacatatgtacaaataggttacaatcacaaatccccccatcaaatatgtatgtacacacgccttcatgctcaatggttcccatttccagagtagccacacctaaaaagaatcagcacccagcaggcccccaaaccaagagaaaggtaaataagaagctaaccgatggatgagcttatgcaccggctaatttccctcaacacacttttcccttggccttttgcccagagtgcgcacgccactaatgccgagctacagcgacgtcagcggcacagcggcaccgccttgaggagcgcgtcgaggccgccgggccgcgcgccgcaacgtccgctccgctcgccgcgcggcagctcggcgacgagcacccgccggcaggacgggcaggaggagtgcgagcgcanccaggcgtcaacgcaggccgcgtggaacgcgtggctgcactgcggcagcacccgcatgtgctggccgtcctcgaactcggcgaggcagatggcgcactcatccgcctccgacgcctcgccgccgtcggcggcgtacctgacggtgggcagcgcgcgc

SEQ ID NO: 6974 - DNA, 1099 bp, Triticum aestivum
  misc_feature (49)..(49): n is a, c, g, or t
  Predicted polypeptide sequence is orthologous to G3111
cacgcttccgccaccacccccttacgcttctctcgcgtctcgccacaanctttaattttgcggaaaaggcccctccaactaccggcgctggacgaacgtgggcgatgctccggccatcgccgtattcgtcgaggcgtctcctccagagcggcgaccccagccgcatcccgggcatccccccggccgatccgcccgccggcgtcagctcggatgtcgtcgtcatcctcgccgccctgctctgcgcgctcatctgcgtagtcggcctcgccgccgtcgcgcggtgcgcgcgctcccgccgcaacgccaacgcccacgccaaccaatcctcgccgtccggcagcccggcccacgccctggcggccttcggcgggggcggcggtgggcataaccatggtactacaactactacgacgacaggcgcgtcggggggcagcgtgacgaccaccagcaaggggctcaagaagaaggcgctcaaggcgctgccgaagctggcgtacgcggacgcggtggccgcggctgcggcggcgaggggcgccgtggcggggggcgaggaggaggaggggcaggacgggatcctcgccgagtgcgccatctgcctgacggagttcggcgagcgggaggaggtgcgcgtgatgccgcagtgcggccacgggttccacgtcgactgcgtcgacacctggctgcgctccaactcctcctgcccgtcctgccgccgccccatcgtcctcgacgaccccgcgcccgccaagcggtgccgcaagtgcgaggagaccatcctggaggcggtcatcgcctcgtcgtcgtcggccggcggcagccgcggcggcggccgtgggggattctgccgtagtagcagtagagaggcgtcatgtcccctggcgggtgggtcaggtcggtgtggggtagtgagctgctccttctgctgggggccacgctggagtactacgcagtgaagttttcttctcagaatggaaggagaataatagagcgggaatggtgacctttctgcaccttttcgcccgcattgggctaaggtcagaaggtgggattggggaaatgactcaaatttgaaaaggggcgggctctctgaaaaatttta

SEQ ID NO: 6975 - DNA, 926 bp, Triticum aestivum
  misc_feature (15)..(15): n is a, c, g, or t
  misc_feature (218)..(218): n is a, c, g, or t
  misc_feature (755)..(755): n is a, c, g, or t
  misc_feature (836)..(836): n is a, c, g, or t
  misc_feature (897)..(897): n is a, c, g, or t
  misc_feature (916)..(916): n is a, c, g, or t
  misc_feature (920)..(920): n is a, c, g, or t
  Predicted polypeptide sequence is orthologous to G32
catcccttaataatntatttctacactatacacgtttacaactataatttgaacacctgtgtgccataaataaatatatttttacactatacacaagtgaatcatgttgtgtcatttacatgacgggtaaattaaatgaacatgtcttgattaggtatgacatacttcggacaaggaagagacctctagatcacccccatggcaacttgatacatcangagcaagaaaacattccccaatggttacaaaccttcggtgcaaaatgacattcatgggatcaaaacacagttataggccccaactatctcaaccttgcgcacaaaacggcttaatgactcatatgggatcaacaagagtgccagtcgcgtaaagcttgttcagattgccaaggccgtccaccagacgagaaggggaggccatgagtaaaggtggactgaaacttcttgctcgcttggagcttcatgaatctacagatccaatttatatgcatcatgccatggaatttccgaatgcatggccgcagccgctggctgcaacgtcgacccaatggtgcttgtccgggcgaagtacaaggccattgggctcgttgccccgggagttcttcctttcttgcttcgtcaccccctcatgggttatgagctatgacgaccatgatgccggccgtgcgtccgagcgcctgtggtctgtacatcgacgacctgcccttttctcattttttggtcaccaaagagttcgatcgatcagaaacatggaanggcgagaataggtcatgttcctgccctggggtgtggttttctttgcgccgaaagttcctttctttcttgcttggtcaccancttcatgggtttttgagttatgacgaccatgatgcccggccgtgcgtccgaacaccctgtnggtctgtacattggacggnctgncttttt

SEQ ID NO: 6976 - DNA, 666 bp, Triticum aestivum
  Predicted polypeptide sequence is orthologous to G326
ggcaccaggtcggttcaggacggcgttcccgctccgcggcggctcgacggccgcttagttctcgccgggctggctgccagcgttctgactcgccggcgacgtgctcagctctacacggagataaccacgtctgcttggcggtggctctccacgccagcgcccgttccttcttcacccgacgacgatggcagcgccgtgatcgcatagcctgcggccttccacagcgagcggcccgccgatcacgctcgaggtcgccctggtaaccgacttatcgccaacgacgtcgatgattgcggcgagctcgcccacggagggcacccagtgcagccctacaccgttccacggtcgtggagcgacggcgtctgcaccagaccagcccagaatactgctgctcctctaagtcgcagttccagtttctcagaggggcgccacagtggggggagacgtcgacgacgcggcatgcggcgcagagcaggggggtgccgccagcggaaggagaccgtgttgccgttgtggatatggcggtcgcacggcaagcagagccccactgtttccgcccggaagtataccacggccagcgcgacggagcattagcactccgttgtgggcaccatgtcggcggcaacccctggcaccatgcatgtattactccacggagggagtatg

SEQ ID NO: 6977 - DNA, 678 bp, Triticum aestivum
  Predicted polypeptide sequence is orthologous to G326
aaaccatgccaaaatggcatactgtcactctcacttgcctgtagcactaacttttacagagttcatagatggaagctatatacaagggttggactaagaacaactcccctcaaaacattaatatagcccatatgttggcaacatacattattcagattgtacatgaactaccatctgcccaactgaaggcaaccaaaatgttcacggcttatgtatcatctgcactcactcctaattagtgttcttccttctgtccaagatgcaaaatatactgcaaagtcaaggcttaactctgatttgcctttgcaaaacgccccttgatcctcaacctgctgtccgcacgagctttgcgggactcatatcgcacctgtttgtcgaatcttcttgtcctcctcttttctttatagcgggaaatgacaatgtcgcggtcagggccagcaacaacatcaaagccacttcttttggggaaagcttgcattggcatgccagtaccaggatttgcctgctggccatcgtccatcatgctaccattgctcatgctggggcaaagttctgacatctgaacaaacgatgacaagcatgcttcagctgagcttgctggagcctgcttctgttcgtactcggtcttggaggcaccatttagggcatgataatcgttgttgttccatccgccgttct

SEQ ID NO: 6978 - DNA, 665 bp, Triticum aestivum
  Predicted polypeptide sequence is orthologous to G326
gagacatcgcagccgcagggtgtactcggatctgagccccaggactcctcgccggtcctccgccggggctagcgggcgcttgcctgacaagcaggctcccccaccgctgcctcctgctccggaggtaccgtgtccgtacacgtccctgctgatgatgccgtcagctcactgcgccgagcttatcggcaacgaccgcctccgtgacgacgacgaagagcaacttcgatgggagttcgccccaccctcatcagtgccacccacccagatatgggatttcaatttaggaagatcaaggaaccacaatgaaaagactgcacatgagattggatttggttcaaacaatggaggctttatgatcaagagttacagtgacatgctcaaggagatttcttgtggaacaacgaaagatctggaagatatttatgactcaggatatggtgcagctgctgaagatatcatgtcaacaaatatttgccaagtgccatcaaaaaatgttagcacggcgagcaacaagcgaatgaaggtaagctcatgcacctcgacgatggatggcccaacaacctccggcagccatgtgcctgcttcaggaggggccttggggagctcttcccatgaccgaggagcagctcccgctagggagatctcctttggtgatcaaacaatcg

SEQ ID NO: 6979 - DNA, 1100 bp, Triticum aestivum
  misc_feature (45)..(45): n is a, c, g, or t
  misc_feature (932)..(932): n is a, c, g, or t
  misc_feature (937)..(937): n is a, c, g, or t
  Predicted polypeptide sequence is orthologous to G326
cggccgcccttttttttttttttttcgagacgcatatatgcacgnggataaacctaactgtaaaattaggctggctatttatgtgttctgaggagaaaaggagaggtctcttacaaaaaaagaacacaccgtgaatatgatcctctggatcacgatgctgaaaatgatgacgacaaaaaaaatagctgagcaatgcacggcatcatgcttaggtgcagagcaggatgtcatctccgtgctgcgagcaaggaagaaggctagctcatccggcaggggggggggcattgagcgcttcgttcgacttgacaaaacggcctttcacccgcttccgggtatccgccctcagcttccgggactcataccggatgtgcttctcgtacctgcgattcttcctcttctctttgtaccgctgcatcgcgctgtccctgtttagcgcaagcgtctcgctgtcgatcctcgcggcaggcctctcgggtccagtcgggacgattgtttgatcaccaaaggagatctccctagcgggagctgcccctctgtcatgggaagagctccccaaggcccctcctgaagcgggcacatggctcccggaggttgttgggccatccatcgtcgaggtccatgagcttaccttcattcgcttgttgctcgctgtgctaacattttgggatggcacttggcaaatatccgtggacatgatctcttcagcaggtgcgccatatcctggggtcatagatatcttccagaatcttcggttgtcccacaagaacccctccttcagcattttactggtagcccttggaccatagagccttccgtgggttgcaccaacacccagccccagggccggaatttgccattcggggtccctggagccttcctgggttcgaactcccctaccccggccaccccgccccggaaagggcgcccggggngaggncattccagttgtggcgggggagcgccgtcacggacgctccgccgcgcggggtccggcgtgggcgccccgtcgccggcgggcccgcgccgtgcgccttggtgcggtcatggggggcccaccgatcctcggacgcgcgatgggcgacagcccccgttcccgcgca

SEQ ID NO: 6980 - DNA, 826 bp, Triticum aestivum
  misc_feature (23)..(23): n is a, c, g, or t
  misc_feature (30)..(30): n is a, c, g, or t
  misc_feature (610)..(610): n is a, c, g, or t
  misc_feature (713)..(713): n is a, c, g, or t
  misc_feature (750)..(750): n is a, c, g, or t
  misc_feature (788)..(788): n is a, c, g, or t
  Predicted polypeptide sequence is orthologous to G326
tgcttcatagaaagagtttgtanaaaaaangatgccggtaccggtccggaattcccgggatatcgtcgacccacgcgtccgcgaacgatgaggtcatacggcagttacgtgagctcgcggaggtggacatgggcggcggtcagataacacctcgtgaggaggcagagcaagctgctcatcagttgccttcctggacagagtcacagcacaccactggaaatggcgatttcggcacagataacagccatgaggttgcaaccatgccaacccctggttatgagaacggcggatggaacaacaacgattgtcatgccctaaaagatgactgcaagaccgagtatgaacaggagcaggctccagcaaactcagctgaagcatgcttgtcattgtttgttcagatgtcagaactttgccccagcatgagcaatggtggcatgatggacgatagccagcaggcaaatcctggtattggcatgccaatgcaagctttccccaaaagaagtggctttgatgttgttgctggccttgaccgcgacattgtcatttcccgctataaagaaaagaggaggacaaggagatttgacaaacaggtgcgatatgagtcccgcanagctcgtgcggacagcaggttgagaatcaagggccgttttgcaaaggcaaatcagagttaagtcttgactttgcagtatactattttgcatcttggacagaangaaagacacttattttaggacggagggagtacgttgncacatatgggctatattatgttttggggggggagttgntagtccaacccttgtatatagtttccatctatgaactc

SEQ ID NO: 6981 - DNA, 1313 bp, Triticum aestivum
  Predicted polypeptide sequence is orthologous to G328
cactgactgcttctgctcactcccaagtaagttcaagaaaaggatcaaaagccacgggagaagaggaacatgagaagatatgtattctcctaaataggacacactagagactagccacagtcttcggtaagacccctccacctacaagttgcaagatttatatgttcatgaattgcaatttcaacagcaaccttttggagaacgaagctggaaggataagttttccatgggccaggccatgcgatggatgccatgcagcaccaagcacagtatactgctgtgctgatgctgcatatctctgtgcatcttgtgacacacaggttcattctgctaaccgtgtggcatcacgccatgagcgtgtgcgtgtctgcgaaacctgtgagagtgcaccagcagtgctggcatgccatgcagatgcagcagcactatgtaccgcctgtgatgcacaggtgcactctgccaacccaattgctcagaggcaccaacgagtgcctgtgctgccactcccagctgttgccattccagctgcctctggcttcgcggaggcagaagcttctgtcactgcccatggcgataaggaagagggagaggaagtggactcttggctcctcagaagaaattctgatgacaacaattgtgccaacaagatagatcgatactacaaccttgtcggatacaatatgtattacgacaacatcacttgtgacccaagaccagaagaacaatacagaatgcaagaacagcatgtgcagaacaggtacatcgagaaggaagggtgtgagtgtgtagtacctccacaagtcgtcatggcaagtgagcagcaagagagcgattatggaactataggagcagggcaggctgcctccgttaccgctatgaccagtacctacacagcttccatcagcaatgacatatctttctcatcaatggaggtgggtatagtaccggacaactccagaccagatatctcaaacagcaacatcctgactagcagtgaagccatggagctctcaggccattcacttcagatgccagtgcacttcagctccatggacagagaggccagggtcctcaggtacaaggagaagaagcagacgaggaagtttcagaaaaccataaggtatgcaacaaggaaagcatatgcagaagcacgaccacggatcaagggtcgattcgctaaaagatcagatatagagcatgaggaagaccacatgctgtcaccaccagccctaccagatactagtagttataatactgttccatggttctgacgtaatgagataacaaaaaatgtgttgacagacacatgggat

SEQ ID NO: 6982 - DNA, 1070 bp, Triticum aestivum
  Predicted polypeptide sequence is orthologous to G328
caagccttagccgcccttttttttttttttttccagttcactagctttctatataaatgtgaggaagaacaaagggcgggccggcatctttccatatatttacaggtggggggttgacgcctccaataaatttctgaatattcggcaaattaaggagagccaaccaacatgtaggcgtcgatcgaccatggaaggaggaacgttcatggtctctccaccgagccggcctagaaagtcggcacaacgccgcagctggagtcggacagcacgggggcggaggggggctggtccacctcgaggtcggcgtcggcgcgcttggcgaaccgccccttgatccgtggcctggtctcggcgtaggccttccgcgacgcgtacctgatggtcttctcgaaccgcctcatcttcctcttctccctgtaccggtgcaccctggcctccctgtccatggccatgcccatgaactgcggcgacatgtgcgccaccgctgagaagaggtcgacgctgctctcgctgcgcctcatgtacgagctggtcacatcctggacggtgctactgttgtccggtgatgatgacattgaaagccatggttagaattttgtgcatcatacgacatctccgccgtgaagtcctgccgctcatgcagctgcgccaccggctcgccgggcacgacgagctcgtggctgccctcgttgctctcccacacgggggccgcggtactcctttgcccgaggcgttcttctggcctgctcgcccgaggtcaaggaagtcagcgacgaacgggtccccgaaagcggggaatccccctccggccccggaacgggccgggagcaaccacgaagtcgtttcttctcatttcccttcccctgccggcttcgtaataggacctcgggccctcccggtttgggccaggaggaattaaccccgcgggggggaaaaaaaagggccctccggcaggggaagggggggcacccggccccaatgggaacccagcggagcggctggcaccctgtttgaccaatgtcactcccctttcaagcgggcaaaagactccccaaaatggggcggagata

SEQ ID NO: 6983 - DNA, 849 bp, Triticum aestivum
  misc_feature (17)..(18): n is a, c, g, or t
  misc_feature (611)..(611): n is a, c, g, or t
  misc_feature (646)..(646): n is a, c, g, or t
  misc_feature (690)..(690): n is a, c, g, or t
  misc_feature (820)..(820): n is a, c, g, or t
  Predicted polypeptide sequence is orthologous to G344
tgtacacgacgttcagnntgctagcttatcatacgacttactatagggaccactttgtacaagaaagctgggtacgcgtaagcttgggcccctcgagggatactctagagcggccgcgctttttttttttttttttttttgattcaaacagcttcgaaaagctttcttcccgagactccactaaaaaggcgccacttctacggcaatatcctaacagaccaaacctaaaaccgaaagcttagtagagtagtggtaatccctacacctaacacgacctaatagactcctactgaaactactttctgataagttctttctagtagtagggcaacaactaaatagaggacgccaagaaaaatccaggaggagtacgttacaacagactaatcaacgacacggccgaaaaagatgtacactagccgccgcggggaggggcggctagaacgaggcgacggccggcgcggcggcggtctcgatggcgacggggactgggtccttcttgtcggcgcatctccagcaccttgcggtgggagttggagtgcaggttgccacgaacgtgggggttgaaccccggccggtactccgcagagccgcccgattgaacgacccgnagctacgccgcaggcgttgcacagcgtcttggcgncctccggccccgcacgccactggggcgtcttctggacgccgcantggctgcacccgcggtcgccctgggctggcggggaggcggcccccgcagacagctgcggcgggaaatggctcttggctttggcccgcgctctctgagcttgtgcttgggactcttggttctgcccttggntgcgtggcggttcttcaaggaagttgaag

SEQ ID NO: 6984 - DNA, 1254 bp, Triticum aestivum
  Predicted polypeptide sequence is orthologous to G351
caccacacccagctagagcgaggcggacacccaagcaaccacactctcccaccctcagccaccgcacaaggaagaagcagaagaggtcttctctctccctgctttgcttagcttcgtttgtgactgccatgtcgtcgtcggccatggaagcgctccacgccctgatcccggagcagcaccagctggacgttgaggcggctgcggctgtcagcagcgccaccagcggcgaggagagcggccacgtgctgcaggggtgggccaagaggaagcgatcgcgccgccagcgctccgaggaggagaacctcgcgctctgcctcctcatgctctcgcgcggcggcaagcagcgtgttcaggcgccgcagccggagtcgttcgctgcgccggtgcctgccgagttcaagtgctccgtctgcggcaagtccttcagctcctaccaggcgctcggaggccacaagacgagccaccgggtgaagcagccgtctcctccctctgatgccgctgctgccccactcgtggccctcccggccgtcgccgccatcctgccgtccgccgagccggccacgtcgtccaccgccgcgtcctccgacggcgcgaccaacagagtccacaggtgctccatctgccaaaaggagttcccgactgggcaggcgctcggcgggcacaagaggaagcactacgacggaggcgtgggcgccgccgcctcgtcgaccgagcttctggccgccgcggccgccgagtctgaggtggggagcaccggcaacgggagctccgccgcccgggccttcgacctgaacattccggccgtgccggagttcgtgtggaggccgtgcgccaagggcaagatgatgtgggaggacgatgaggaggtgcagagccccctcgccttcaagaagcctcggcttctcaccgcttgagcagctcctgcatggatcccatcgatccatccaaagtttttggtccagtcgatccagtggtgaaattcgttcattcgtttggttaaatttgttctgctcctgtacagattgagtgagtgagtaatactacatacatactccagtagccatatacgtagatataggcagtaagttgtaacgacggaagagtacttgcttcctctttcagatgttgggtaggcgtcagtatattgtactagtcgacagttcatacatactcgtacagagattggtcatgaactagcagtaccgtgtaacataaagcatggatgaaattggagattattggaattgatggaaa

SEQ ID NO: 6985 - DNA, 447 bp, Triticum aestivum
  Predicted polypeptide sequence is orthologous to G351
ttttttttttttttttttttttttttttttaaccaaacgaatcaacgaatttcaccactgggactgggaccggaccaaaaacttgggtggttcgatgggatccatgcaacaacaactaaatcctcaggcggtgaaaacccggggcttcttgaaggggagggggctctgcacctcctcctcgtcctcccaaatcttgcccttggggcacggcctccaaacaaactccggcacggccgggattttcaggtcaaaggcccgggcggcggacctcccgttgccggtgctccccacctcggactcggcggccgcgggggccaaaatctcggtggacgagggggcaaccctccccacccctccgtcgtagtgcttcctcttgtgcccccccaacgcctgcccggtggggaactccttttggcaaatggagcacctgtggaccctgttggtcct

SEQ ID NO: 6986 - DNA, 1113 bp, Triticum aestivum
  Predicted polypeptide sequence is orthologous to G351
ggccgccctttttttttttttttttttttttttttttttttttcttcatccaattccaataacccccaatttcatccatgtttatgttacacggcactgccagttcatgaccaatctctgtatgagtatgtatgaactgtcgactagtacaatatactgacgcctacacaacatctgaaagaggaagcaagtactcctccgtcgttacaaggaaccaacaagatctactgcctatatcttctacgtatatggctactggagtatgtatgtagtattactcactcactcactcaatctgtacaggagcagaacaaatttaaccaaacgaatcaacgaatttcaccactggactggactggaccaaaaacttggatggatcgatgggatccatgcagcagcagctacatgctcaggcggtgagaagccggggcttcttgaaggcgagggggctctgcacctcctcctcgtcctcccacatcttgcccttggcgcacggcctccacacgaactccggcacggccgggatgttcaggtcgaaggcccgggcggcggagctcccgttgccggtgctccccacctcggactcggcggccgcggcggccagaagctcggtggacgagggggcgacgctgcccacgcctccgtcgtagtgcttcctcttgtgcccgcccagcgcctgcccggtggggaactcctttgggcagatggagcacctgtggaccctgttggtcgtgccgtcggaggacccggcgggtggaccacgtggcccgctcggcggacggcaggacgggggcgacggccgggagggccaccattggaccggcggcggcatcaggggaaggagacggctgcttcaccgggtggctcttcttggtggccccccccgccttggtagaagctgaaggaattgccccacacggagcattgaactcggcgggccccggcgcaaaaaacaatccgggtggggggcctgaacaacctgtttgccccccggggaaacattaaggaggcaaagccaaggttctccctcttgaaacgggggggggggaatcgtttctcttgggccaaccctgcagacagggcgccccccccccccgtggggggcccccctaa

SEQ ID NO: 6987 - DNA, 814 bp, Triticum aestivum
  Predicted polypeptide sequence is orthologous to G351
gctatttaggtgactctatagaacaagtttgtacaaaaaagcaggctggtaccggtccggaattcccgggatatcgtcgacccacgcgtccgaaaccaacgagcccttccttcttctacccacctgcgtgatcagcagtcaacaatcatccagcttccagcgctcgatcgatcagcagcaccgcagcagctagccatggttgccgccgccatgcaagccctctttgaccagaccgacctctccctctccctgtccctggctcccaccgccgcgccggcgctcaacaaggacgactacctcgccatctgccttgccgcgctcgccgccaccggcaagggtgggcagcagcagcaggatcaggcgagcgcgtggcgcccggcccccgcgccggcgcaggagctgcgcttcagctgcgcggtctgcgggaaggcgttcgcgtcgtaccaggcgctcggcgggcacaagtccagccaccgcaagccgccgcccaccggagagcggtgcgtcgtggtggcgcaggcgtccgcgggcgctgggtcggaggcgagcgcggcggcgtcctcgggcgggagcagcggcggcccgcaccagtgcaccgtctgcgggcggggcttcgctaccgggcaggcgctcggagggcacaagcgctgccactactgggacggcacctccgtgtctatgtccatgtccgtgtccgtgtcggcgtcgtcctccatgctgaggaacttcgacctgaacctgctgccgatgcccggagaacgccgggttgaaaaggtggggcgaggaagaaggaagtgcaaagccctctgcccgc

SEQ ID NO: 6988 - DNA, 1031 bp, Triticum aestivum
  Predicted polypeptide sequence is orthologous to G351
cgcccttttttttttttttttttttagtttcatgaccaccctctgtaattttgtgtctgaactgggggggagtacaatatactgacgcctacccaacatctgaaggaggaagcaagtactcttccgtcgttacaacttactgcctatatctacgtatatggctactggagtatgtatgtagtataactcactcactcgggctgtacaggagcacaccccatttaaccaaacgaatgaacgaatttcaccactgcatccactggaccaaaaaggggggatggatcgatggtctccatgcaggagctgctcaagcggtgagaagccgaggcttcttgaaggcgagggggctctgcacctcctcatcgacctcccacatcatcttgcccttggcgcacggcctccacacgaactccggcacggtcggaatgtacaggtccaagggccgggccgcggagctcccgttgtcggtcctccccacctcagactcggcggccgcggcggccagaagctcggtcgacgaggcggcggcgcccacgcctccgtcgtagtgcttcctcttgtgcccgccgagcgcctggccagtcgggaactccttttggcagatggaccacctgtggaatctgtcggtcccgccgtcggacgacgcggcggtcgacgacgtggccggctcggcgggaaactaggatggcggcaaacgccgaaaaggccacgattggggcagcaaccccatcaaagggaggaaacgggtgcaacaaccagtgcttcgccctggtgccacaaaactccctgcccgagcggaacgactttccgaaaaggatcacttggaaatcggtaagaacccgggcctccgcaccccatccgtttgggggcacccgaacccggggtttcccacccccgagagctgggggcaccaaaaggcggggttttcccccccggagcgcagagcggggaaccgctcctcttcgcccaacccggcagaactgggcgacaacataaacccggttgctttttaacctggcgagccgctaaaa

SEQ ID NO: 6989 - DNA, 662 bp, Triticum aestivum
  Predicted polypeptide sequence is orthologous to G354
gctaaatctaaaccactcgtgcctagctagctccttcccgcttccagtggtcgatcgcatcccacagtttcctcagctccacaggttccctgttcttcacttgtacgcacgtccatgacgaagcaccagagagcagcagcagaccaggccgtgtcactctccctctcgctctccctcggcgtcgtagccgacatcaacaagaagatgcgccgcgccacggccgccagtggggaccagttcgtgtgcaagacgtgcggccgctccttcccgtcgttccaggcgctcggcggtcaccggaccagccacctccgcggccgccacgggctcaagctcgccctcaccgccggcggtcagtgctactccgtcaaacccaagagtacggatcagaagcctgagcaccggtgccacatctgcggccaagggttcgagacggggcaggctctcggcggccacatgcgccggcaccgtgatgaaggcggcgcaggcgccgcccgtactgctcgagctgtttgtctaggctgatctcagtagttctagtgcagggttgctgacatgaatatatgcgtgcacagtcgtagcagtaggtgttgatcattggttcgttcattcctttatatgtgtacatataagtatgatggcttcttcaatgattaaaaaaaaaa

SEQ ID NO: 6990 - DNA, 795 bp, Triticum aestivum
  misc_feature (704)..(704): n is a, c, g, or t
  Predicted polypeptide sequence is orthologous to G354
attcggcacgaggatcatcatcatctttagagtttcagagattgatcaattggtccagagcaatgacaaagaggtatgcttttgaggagaaggagatggcgcgcatgctgctgctcgtgtcgcgggagcaggcgatgcccatgccgatgccgatggcggtgcgcggtgaccgcgccccggagcgggtgttcgtgtgcaagacgtgcgaccgcgtgttcccgtcgttccaggcgctgggcgggcaccgggccagccacaagaagccacggctggacgacgggggcaacctcaagcccaagttgcacggatgctctgtctgcgggctggagttcgccatcggacaggcgctcggtggccacatgcggcgccaccgtgccatggccgtaggcggaggtggtggcgtcatggctattacgccgccgacagcagcgatcaagaagcacggcgacagcagcgacgacgccgttgtcggcatgaagcgtgggctgtggctcgacttgaaccatccaccttgcgatgagtacggcaccagcagcgagagcgacgacgagtgcggccacgacgcagctgccggcgggtacacgttccaccagttcctggatccggcaccatggaggtggactgcgtctagctaccccatctcccactccgttgccgggtttttgccggatagtacaatattttcctgtgtgtactttggcagnaacttcttttttaccccttttctattcctttttcatgcatggataaatccatattttgtagcagtagacgagtgcccagtgaaaggcatgc

SEQ ID NO: 6991 - DNA, 393 bp, Triticum aestivum
  misc_feature (351)..(351): n is a, c, g, or t
  misc_feature (375)..(376): n is a, c, g, or t
  misc_feature (380)..(380): n is a, c, g, or t
  Predicted polypeptide sequence is orthologous to G354
gcggcgtggagttcgcgctcgggcaggcgctgggcgggcacatgaggcgccaccgcgcccacgagcaggaggggagcactcacgggccggtagtcgccgagcgggagcccggcgagacaagaagggggctgctgctgggcttggacctgaacgctactcccgctgagcaggccatggacctctctctctgggcctgaccgaaccgaggaccggtgggctgctgttccttctgcaatagctcccctcctactactcttctctaacctaagggggggttggaggttcctttcttgtacaatattggttgctgtcaattgattgatttggatttttcaaccccaaaaaaggatnggctgttatatcaataaactttcnnttcnttcctaaaaaaaa

SEQ ID NO: 6992 - DNA, 354 bp, Triticum aestivum
  Predicted polypeptide sequence is orthologous to G354
aagcagttgggttcagaggaatgacgaaaagatttgctttcgaggagaaggagatggcgcgcatgcttctgctcgtttcgcgcgagcaggcgatgcccatgcccaatgccggtggcggtgcccggtgaccgcgccccggagcgggtgttcgtctgcaagacgtgcgaccgtgtgttcccgtcgttccaggctctgggcgggcaccgggccagccacaagaagccgcggctggacaacggcggcgacctcaagcctaagctgcacggatgctcccgttctgcgggctggattcgccatcggccaagcgctccggtggccacatgcggcgtcaccgtcaatgcgccggcgagggga

SEQ ID NO: 6993 - DNA, 613 bp, Triticum aestivum
  misc_feature (515)..(520): n is a, c, g, or t
  misc_feature (533)..(534): n is a, c, g, or t
  misc_feature (555)..(557): n is a, c, g, or t
  misc_feature (581)..(583): n is a, c, g, or t
  misc_feature (589)..(590): n is a, c, g, or t
  misc_feature (611)..(613): n is a, c, g, or t
  Predicted polypeptide sequence is orthologous to G354
cacagacggatcaagaagagcagaaaaagtacaacaaaagacaccatagcgatgggagcggcggtgaagcgcgcgagggaggaggagccggtgtcgctggcgctggcgctcaccacggactcggcggcgtcgtccaccacgtcggccgactcggccggggcggcgccggccaggaagagggcgcggcggggcagagtggtggccacgtcgggggagggggagttcgtctgcaagacctgcagccgcgccttcgccacgttccaggcgctgggcgggcaccggaccagccacctgcgcggccgccacgggctggagctcggcgtcggcgtcgccagggccatcaaggagcggaagaagcaagaggagaagcagcacgagtgccacatctgcggcctcggcttcgagatgggccaggcgctgggcggacacatgcgccggcaccgggaggagatggcgctgcgcggcggcgacgacggcgatcagtgggtgtggcgcggcgtcgggctgccggatcnnnnnncggtggcgcaccnngccgccgccaattacgagccnnncgtcttgctcgagctgttcgtctnnntagctnnctggatctgctagtagttatnnn

SEQ ID NO: 6994 - DNA, 693 bp, Triticum aestivum
  Predicted polypeptide sequence is orthologous to G354
ttcttcttcttcatcatcttcagagtttcagagaccgatcaattgggttcagagcaatgatgaagaggtttgctttcgaggagaaggagatggcacgcgtgcttctgcttgtgtcgcaggagcaggcgatgcccatgccgatgccgatggcggtgcgcggtgaccgtgccccagagcgggtgttcgtgtgcaagacgtgcgaccgcgtgttcccgtctttccaggcgctgggcgggcaccgggccagccacaagaagccgcggctggacgacggcggcgacctcaagcccaagctccacggatgctccgtctgcggtcttgagttcgccatcggccaggcgctcggtggccacatgcggcgtcaccgcgccatggttgcaggcggaggcagcggcgtcatggccatgacgccgcggacagcagcgatcaagaaacacaacgacagcagcgacaatgccgttgtcggtatgaaacgcgggctgtggctcgacctgaaccacccaccttgcgacgagtatggcgccagctgcgagggcgacgacgagtgcggccacgacgcagccgccgccgggtacacgttccaccagttcctggatatcggcaccatggcggtggactgcgtctagctaccccatctccccctattgctgggattttgcagaatagtacaatttttttttctttgtgctcttt

SEQ ID NO: 6995 - DNA, 1098 bp, Triticum aestivum
  misc_feature (771)..(771): n is a, c, g, or t
  misc_feature (792)..(812): n is a, c, g, or t
  Predicted polypeptide sequence is orthologous to G354
tgcgacccacgcttccggccaattccgagcccttccgagtcccagaagccaccccccatctcctccatcgtttcgcagttcgcacagacctacgtagtaccatcgagctcgtaccggaccaggaccagctagccgcgcgccgatggtttcgtcgatgaagcactgcagagatcaggcaccggaggtgcctctgtccctctcgctctccctcggcgccatggccgaccgctccaagaagcagcgccgcggcgcagacggcgagttcgtctgcaagacatgcagccgcgccttcccgtcgttccaggcgctgggcggccaccggaccagccacctgcgcgcccgccatgggctcgcgctaggcctcactggcgggtccgatcagccggcgaccaacaaggcgacggaccagaagcaggcccaccagtgccacgtctgcgggctagagttcgagatggggcaggcgctgggcggccacatgcgccggcaccgcgagcaggaggccgccaccacggcgcaggcaccgcccgttctgctccagctcttcgtctagaaccgcacagatttctctcaagttcaatagctaggcatatcagatttacaggtcgacctatgtgcgcgatttggtttgtacatttgctgcgcactagttggtcttgatccttggcccgttcgctcattttattaggtatatatatacgtacatattttagggaggactcattcattcgttcattcatcactgatctatactttattgattcgtacatttantttgttctacttgattgaaannnnnnnnnnnnnnnnnnnnnaaaaaagggcgggcgctctagagtatccttgaggggccaagcttacgcgtacccggcttcttgtacaaagggtcccctatgtgagtggattataagctagggccgggcggcgttttaaacgtcgtgactgggaaaactgctacctgggatcttgttaaggaaccttactctgtggggtaaatagtgggacacttcctacgaatttaaggctctgggtaaattaaaattttaggggtttaggtgtaaaacacctcatttgctggcggttaaaaattggtttacggga

SEQ ID NO: 6996 - DNA, 1087 bp, Triticum aestivum
  Predicted polypeptide sequence is orthologous to G354
tactgcgacccacgcgttccggtgggacgtggccgccgccggggccgagagcgcccacgccgacgctcagcagctcacgccgcccgccacgcccggcgcggacgatcgggcggcgaccggctctcgcaggcggccacccgcaggcggcggcgacggcgatgggggcgcgttcgtgtgcaggacgtgcagcaggcggttcccgacgttccaggcgctgggcgggcaccggacgggccacacgcggctgcaggcgcgccagcagcggcccgcccctcgcaagcctcggccgcaccacgagtgcgccgtctgcgggctcgagttcgccatgggccaggcgctcggcggccacatgcgccggcacaagcaggttgagccacaggcgcacgtggaggaggcgctgggcgcagtgcacatgcgccggcacaaggaggccggcgcacaggcgcctgtggaggaggaggtggcgctgggctggcacgagcaggccgacgcgcaggcgcctcagccgcgtgtggaggaggaagaggcgccaggcgggcacgtgcgctggcacaagcaggccggggcacaggcggcgcgcgtgcaggatgagcaccaccagcaggaggaggaggcgctggacttgaactgcccgccgccgctggaggatcatcgcggcggtgacgaccgaggagattgttccgccgcgtcagaccctcctctgctcaacctcctcgtgtagctgcatgccgggctgacgattccgagttcgtgtctgtctggatcgatcttattaccattcatcgtggaagaaagtccatgtggcgataaataaacaaggtacttttctgtaaaaaaaaaaaaaaaaaaaaagggcgggcgctcctagagtattcctcgagggggcccaagttaccgcgtacccagcttttttgtatcaagtggcccctatagggggtccgattataagcctaggactggccgttgttttaaaagtctgggacttggaaaaactgctactttgggatctcttgggagggaccctaactccggggggggagcataattggccaacctccctccggggttttaacctcctagggtaaat

SEQ ID NO: 6997 - DNA, 1083 bp, Triticum aestivum
  Predicted polypeptide sequence is orthologous to G363
aatgccagagcggccgcccttttttttttttttttttaatcaacccggcccacaaactggatttgaataaaagatgtggacaacaaataacgtcgtgccgtacctgcacgtacagaaacaactgacgtacgtacgtagtagaagtagaactatagcgtacggacggacaagctactagatgcattctagtccactccatacgcgggcgtgcgtgcgtgcgtcttacagcttgagcgacagatcgatgtcgtcttccccgttgccggccgcgtgcacgcgatgaacgtatcggcggcgcccgccatcggcgatccagctgacgacggccgcggctgcggcggccgaccctgtagcttggccactatccccgcctcccggcgtataccagctgatcaagtcggagggcggcggggaagacgcggcgctggaggaggcgatcgccacctggctggcggcggagagctcgcggctgcgcttggcgaggctgcgctcgagcttgtgcgcgttctggtggccgcccagcgcctgcgagctgtagaacttgcgccggcagtaggtgcacgagaaggtccggtcggcggccaccggcgtctgcgggtgcgggcgccatgccgccgccgccattgggtgaacgagccgcaggtccaggttcacgtcgccggccggcgccctggcgctctccatttcttgcacttggcggcctgcgactgcgatggagagactgatcgaccaaatgtattttctactcctcactccatgtcagggttcctcgtggcccactcgcggacgcgtgggtcgacgatttcccgggaattccggaccgggcccagcccgcttttttgttcaaactgtgtcctataggggtcccctaaatgggccaaatggccatagctggttcccggggcgaaactggcatccggccccgcggccacaagctagaatccgggaggctggactcggccccggggtttttctactggggggtaaaacaagggtggaaggggggtcccgggggaaatggacgggtaccataaacgagcccctggttttatagaaaccttccaaggggaaacggctcgacgg

SEQ ID NO: 6998 - DNA, 662 bp, Triticum aestivum
  misc_feature (31)..(31): n is a, c, g, or t
  Predicted polypeptide sequence is orthologous to G385
acaaattttgggattgaaatggcgacggatnccaggagcgctacaaaattataaacccaatccaaagcagcagacagacagatgggcacaaatctctattctgcagcacctacgaagcactggaagtctgaaacagcagcagcaacaacgacaagtccaacgaattacaagactgactgaagaaaattacggttttttgtactcgacgaagaaccctagaaaagaaacccagaggtagcagcatccgagaggccgacacgaagaggaagtcaatacccgaaccaaccgcccttgcatagtggtgaccgcatcttgttttcgcaaatgttttcttgcacgaaacgaagaagtcgcggagtttccccggtcgaatccacggggaacaatctgtggctatgagcaccacatggcaaggagagtctgaggtgcgttcttgacttcccactaatgaaggctccaaaattttgctgcttctctgatacagaacataggaagattgatgaattgagcgaagctactgcgggggagaggcgcggccattggagatgacggcggtcttgatgcgctccacggtgcaggcgatgaggctgttgacggtggccaccgaccctagggagagcttggcagtggggacggagtcgaccaggatctggaatgccacc

SEQ ID NO: 6999 - DNA, 675 bp, Triticum aestivum
  Predicted polypeptide sequence is orthologous to G385
tttttttttttttttttttttttttttttttgagctaacaaatggttaagcacatcgcatggctgcaaccatgtccaggaagacaattacatgttcactcttttgtacactagagtccaccctttgcgccgctggcgcaagaacgaaacaaaggcgaagtaagtagaacagaagcaatgtggagttcaattatcattggcccataataactgcgtgtcaggtactttaaggcctatagaaggagctggatgaggtgtatggctgtatgctgatgggcaacaaaagcttcaatattggacaatggagaaaataagatcatctgccttaatagccttataggacatcttgcaacacagtaagtgtgccataatttgcaagtgttttggcaaacatatcatgtacacccatagccgagagaaatatacccgatgtgaagatgatttataagcatattgcctcttcgatcacctccacctcgttcaccaagaccaatccatcttctccgagggcataacccaaggcatctccgatttacacacacaatctacacatttgctcatcacacaaattaggaggcaggtcaactgtgggcttcaaggttgctagacgccagtactggctgaaaccctttgtaaatcatgggcactagaaattcatcaaacagaccaccactac

SEQ ID NO: 7000 - DNA, 724 bp, Triticum aestivum
  misc_feature (254)..(255): n is a, c, g, or t
  misc_feature (258)..(258): n is a, c, g, or t
  Predicted polypeptide sequence is orthologous to G385
tttttttttttttttttttttttttaccattaaaaaagatcttaaaagtgtggttcataatgacaaaatctatatgacctatatagattgtacagactaacaatcattaatggttaattctatactctcacatcaagccacatcattgaaatttcagtcattacatagtaatactattttttttgtgtggccatccactaatgatacatggtacatcatctcctcacctccttgacagattaaggtcctttggnncantccaatgcttttgatagtacagctttgaatagccattaggcattccctggatcagacatcgtgatggcaggtgcctgcacttgaggacgaagctggggcgcaggctgtccagctagatgtcaacaatggcccatgttccgtcagcgttctacctacagtacctcacgaaatgctttccctggtcggcaccaatggggaaggcacctgaaacttaactgacatcacttgcaatccaccactcgaggacactgtgcatactaattcttcttggcaacgaactcaaggttgtcatgtagccactatcctcgttctcctccaaccttgaatggttccccaggtacattctatatagaccacacctagggctacctgaaatagggaacgaaacttacagtaacttttaagattgataaacaatatagatgaaaaccttttctgatcactgctcgtactatatattatagtg

SEQ ID NO: 7001 - DNA, 829 bp, Triticum aestivum
  misc_feature (430)..(430): n is a, c, g, or t
  Predicted polypeptide sequence is orthologous to G385
aagcttgaccttaggcctatttaggtgacactatagaacaagtttgtacaaaaaagcaggctggtaccggtccggaattcccgggatatcgtcgacccacgcgtccgccggggcctccgcctacgacgtcttcgccggggccgcctccgtgctgcaggcgccgcccgacgacaagcagcagggcgtcgtcgtcgagctggctgtggcagctatggaggagctgctccgcatggcgcgcctcgacgacccgctctgggccaccacggtggaccaggcgctcgcgctggacgaggaggagtatgccaggatgttcatcgacccacgcggcggccttgggccgaagcagtatggcctcgtctctgaggcatcgcgcgacgccgccgtcgtcatcatgacccccgccagcctcgtcgagatcctcatggacgtncaccagtacgcggcggtgttctcgagcatcgtgtcgagggcggcgaccctggaggtgctgtccaccggcgtggccgggtgctacgacggcgcgctgcaagtcatgtccgtggagttccaggtgccgtcgccgctggtgccgagaaggagagctacttctgcgctactgcaagcgcaacgctgatggggcctggcccgtcgtggacgtgtccctggaccgcctgcaaggggttaaggggccggagcaaggccttccgggtgcctattcaggaagggccccaaaggcttactccaaggggacgggggtgggaccccctggaaagggggacaaaaggtcccttggacaattttttccaagcccgctggtccggctctcggcctccccccttaagtgagaccg

SEQ ID NO: 7002 - DNA, 1067 bp, Triticum aestivum
  misc_feature (9)..(9): n is a, c, g, or t
  misc_feature (724)..(724): n is a, c, g, or t
  Predicted polypeptide sequence is orthologous to G385
gcgttactncgacccacgcgtccgcagtgctcctgctagttttgtgcggtgcagcaagcggcgcctgctgctccggtttggtggtggtgtgtttggcgaagtcatcgcagcataggtgctcggtttccctgacgaaagtcatgctcgactctggtttgagctgatggcaaatgacgccttcgggtgtgatttcccttgttggaggtgccatcaagggggtccgacacctctccctgctccgtgttcttgtctcctggtgaaaaccgtgtgcaatggtggcgtctttgccgtcattactttgttggaagcattgccttggagtcaagtctggtgttggaagcatctgcttggtggtggtgtggtggatctggagcgggcagcgtcttggtcgccatggttggagagtggcaaccacaaaacggccaagtgcatgatgagatcgacctcagcatcccagtcgatgacaaagacttgatctggagcaacacgggcacgatgaatgatgatgaagatgttgctaccgcggatgaaggtattactgatgccgggagtgctagtcacatgaggaagaggggcaggcatgcaaaccgccaaattcaggaacttgaagctatgttccagcaatgtccccaccccgatgagaatctacgtatcgccctcagcaagaaggtgtgcatggatcctcttcgggtcaagttctggttccagaatcgacgcaatgcanagaagaaccagaatgagcgtcaacagaacatggtgctccggacggagaacattatgctagaagaagagaatcgagccatgaacgccgcattactgaagaagacctgccccacatgcaaaagcccgatggtgttctttaggtcgctgaccccggacctgcggcgcctacacatggagaacgcgaggccttaaggccgaactccttcacaggacggcctacctccacggtgttctctgttgaacttcaggtttcctcagggatttttgggaattcaaagtttacccccgttatgccgtttccgttaacccaggaggatccatgggggaccccatgggttaactgt

SEQ ID NO: 7003 - DNA, 1612 bp, Triticum aestivum
  Predicted polypeptide sequence is orthologous to G4
gcacgagaccctcctccctccctccctcccccactccgcccgcaaagctcccccgcctcctccttcactgtgccgcccgtgcttcccctccgctccccgcgccgatccaaagcccagaccctcgccttgatccgcatctcgccatgtgcggcggagccatcctcgcgggcttcatcccgccgtcggcggccgccgcggcggccaaggcggcggcagccaagaagcagcagcagcagcagcagcagcagcagcgcagcgtgacggccgactcgctctggccgggcctgcggaagaagccggccgaagaggaggacttcgaggccgacttccgcgacttcgagcgggactccaacgacgacgacgacgcggtcgaggaggtccccccaccgccggccacggcgggcttcgccttcgccgccgcggccgaggtcgcgctcccggctccgacccgcctagatgctattcaacatgatggacctgctgccaaatcagtgaagcgcgttcggaagaatcagtacagagggatccgccagcgtccctgggggaaatgggcagctgaaatccgtgaccctagcaagggtgtccgggtttggctcgggacatacgacactgctgagtaggcagccagggcatatgacgctgaagcccgcaagatccgtggcaagaaggccaaggtcaattttcctgaggaggctccaactgttcagaagtccaccctgaagccaactgctgtgaaatcagcaaagctggctccacctccgaagacctgcgaggatgagcccttcaatcacctgagcagaggagacaatgatttgttcgcgatgtttgccttcaatgacaagaaggtttctgcaaagccagctgaaagtgtggattcccttcttccagtgaaacctcttgtgcccactgagacattcgggatgaacatgctctctgaccagagcagcaattcatttggctccactgactttgggtgggacgacgaggccatgaccccagactacacatccgtcttcgttccgaatgctgctgccatgccggcatacggcgagcccgcttacctgcaaggtggagctccaaagagaatgaggaacaactttggtgtagccgtgctgcctcagggaaatggtgcacaagacatccctgcttttgaccatgagatgaagtactcgttgccttatgtcgagagcagctcggacggatcgatggacagccttctgctgaatggtgcgatgcaggacggggcaagcagtggggatctctggagccttgatgagctcttcatggcggctggtggttattgatggttcttgtcagtgtggtctgcggatagcacaaatgtcccttgcatgtggccaagatgaagaagtggtggtgcatgtggccaggatgaaggataggttgcatctgttatgcttggtagcggatcaaaccctagctatgctaaagactgtatgctgctagcagtggaaccgtatgtcatgtttataagtattttgttgttgtatatcgcctctatgattgggtgcatgttggagactggagtttaataaataaatacattggtcatatgccaaaaaaaaaaaaaaaaaaaaaaaaaaaaaaaaaaaaa

SEQ ID NO: 7004 - DNA, 1475 bp, Triticum aestivum
  misc_feature (437)..(437): n is a, c, g, or t
  Predicted polypeptide sequence is orthologous to G4
atcatcacacacacacacacaccaacaccacaccaaccgacccgtctcgtctcgcaagcgtttcactctttccctttcctttcgcctcgctctacccgcggtcccacgtgctccagcagccatgtgcggcggcgccatcctctccgacatcatcccgccgccgcgccgggccaccggcggcaacgtctggcgggcggacaagaagaggcgggccaggcccgacgccgccgcggggaggccccgccgtgcgcccgaggaggagttccaggaggaggagggcgacgcggagttcgaggccgacttcgaggggttcgtggaggcggaggaggagtccgacggcgaggccaagcccttccccgtccgcaggagcggcttctccggagatggattgaaggcaactgctgctggtgatgatgactgtgcctcagggtctgctnaaaggaagagaaagaaccagttcaggggcatccgccgccgcccttggggtaaatgggctgctgaaataagagatcctcgcaagggtgtccgtgtctggcttggtacttacaactccgctgaggaagctgccagagcctatgatgttgaagcccgcagaattcgtggcaagaaggcagaggtcaatttcccagaagaagctcctatggctcctcagcaacgctgcgctactgctgtgaaggtgcccgagttcaacaccgaacagaagccggtactcaacaccatgggcaacgcagatgtgtattcctgctctgctgttgactacaccttaaatcagcaatttgtgcagcctcagaacatgtcgtttgtgcctacagtgaatgcagttgaggcccctttcatgaatttttcctctgaccagggtagcaactcctttagttgctcagacttcagctgggagaatgatatcaagacccctgacataacttctgtgcttgcatccattcccacctcaacagaggtcaatgaatctgcatttctccagaacaatggcatcaattcaacggtacctcctgtgatgggtgatgctaatgttgatcttgccgacttggagccatacatgaagttcctgatggacgatggttcagatgagtcaattgacagcattctaagctgtgatgtaccccaggatgtggtcggcaacatgggcctttggacctttgatgacatgcccttgtctgctggtttctactgagggaatcgaggtcgctgggtgcctgtatatatagacaaaggaataagtattcaggacatcaacaagtgcttgtgtctggtgcctctagaattgagcagtagcgatgtcagtctatggttatgtctagcttaaatggtcaggtgactggggtcttttgcaatagacctctgtcttgtgcccccagactatattatatctatatatgagaccagtatgtgatggggaactgcttattttgtattcatgtttctaccttattgtaattgctaaaaaaaaaaaaaaaaaa

SEQ ID NO: 7005 - DNA, 714 bp, Triticum aestivum
  Predicted polypeptide sequence is orthologous to G4
acccaacggaaaaagcaaagagagaacgatgtgcggcggcgccatcctagcgcagctgatcccgccgtcggcgggccgtgccccgaagcaggtggccgccggcggggtcgcgcccaagaatggcggcatgagcaagaggcaccacagcagcacccccgatgtcgacgacttcgaggccgccttcgaggacttcgaggacgacgtcgacctgcaggcggaggacgacggcgacgaccatgccgtttttgcatccaagcccgccttctccacggcctactatgatggccgcgcggcgcaggcggccagcaggaagaagagcgtccgccgcctccacggcatccggcagcggccgtggggcaagtgggcggcggagatccgcgacccgcacaagggcacccgcgtctggctcggaacgttcgacacggccgatgacgccgcccgggcctacgacgtcgccgcccgccgcctccgtggcatcaaggccaaggtcaacttccccgacgcggcgagggccggagcgcgctcgcgccgcgccagccggagaactgcgcagaaaccgcagtgcccgcctgtgcggacgacggcgtactctgccaccgcagctgcacacgcacacgtagtacaggcggagcaggacgctatgatgatcaaacctgagctgatggagttttttgatgcggacgcgttcgtcgacctgaccgccgacgtcgccgc

SEQ ID NO: 7006 - DNA, 824 bp, Triticum aestivum
  misc_feature (655)..(655): n is a, c, g, or t
  Predicted polypeptide sequence is orthologous to G4
aacagctatttgaatagaggcctatctaggtgacttgattgaacaagtttgtacaaaaaagcaggctggtaccggtccggaattcccgggatatcgtcgacccacgcgtccggaaataaaaagcgccagacagaaagagaaaacaatgtgcggcggcgccatcctagcggagctgatcccgccgtcggcgggccgtgcctcgaagcaggtggccgcgggccgggcctcgccaaagaaggccggcaagagcaaggggcagaagtacggcagcgtcgccgatgtcgacgacttcgaggccgccttcgagaacttcgatgacgacctagacctgcaggcggaggaggacggcgacgaccatgtcgttttcgcatccaggcctgcgttctccccggcctacgatggtggccgccgcgcggtgccggcggcgagcaagaagaagagcgtccgccccctccacggcatccggcagcggccgtggggcaagtgggcggcggagatccgcgacccgcacaagggcacccgcgcctggctcggcaccttcgacacggccgatgatgccgcccgggcctacgacgtcgccgcccgtcgcctccgtggcagcaaggccaaggtcaacttccccgacgcggccagggccggggcgcgcccgcgccgngccagccgtagaaccgcgcagaaaccgccatgcccccctgcgaggatgacggcgtactctgccaccgcagcagcacgcgcacaggcggagcaggactctatgatggtcaggcccgagctgatggagtctttagacatggacgcccttgttcgactgaccactgctgtcg

SEQ ID NO: 7007 - DNA, 1180 bp, Triticum aestivum
  Predicted polypeptide sequence is orthologous to G4
cacactcccgcaccagtagtcacacaagagaaaagcaagagcagcaagccccacagagatatagaaaagaggagcgggtcgtcgggaggaggagaaagaaaaagcgagcgaggatgggtggcggagcgatcctcgccgagctcatcccgggcgcgccggcgcggcgcgccacgtccggccatggccacgtctggccgggcaagggcgccaagcagaccaaggccgccgcggccgacgacttcgaggccgcgttccgggagttcaacgaggactctgatgtggaggacgacggggtgattgtgatggagcggcgggaggaggtggccgagagcaagcccttcgtgttcgccgcttcgcccaagaagcagcagcaggaggaggaggaggcggcgcccgtccgccgcaggaagccggcgcagtaccggggcgtgcggcgccggccgtggggcaagtgggccgccgagatccgcgaccccgtcaagggcgtccgcgtctggctcggcaccttcccctccgccgaggccgccgcgctcgcctacgacgaagccgcgcgcgccatccgcgggcccagggccaagctcaacttctcctcctcctctgccgtcgccgccgcggccccgggagcgcgcaagcgcggccgcgccgcgccccccgctgccaagccagcgccggtcatcaccctcgtcgacgatgagggaggagcacgcgtcgtccttcgtcagcacgaggcccaagcgagcgagggctccgagtccagcggggccctcccgacttctcgtggcagggcatatcggcgttcgaacaggccccgggggtaccccgcccgggagccggaaaccgaacagttgcaaaacggggccaagaccacggaggcggaaaacacccaacagggcatgttggcccaaccggcacagacttcgatccgaaggcgctcttggagcccttttctttgccaagccaggtgccttttacaaggcgggcgcttacaatccctcaacagcccttaagacccaagcccaccaaacagcccaccgtcccaccgggaaactaggcggcctgaggctttggactctgcacaaacagggcccgctgccgcatgccacacgttaccatcaacattgtcccggagggctgctactacaaaagaaagcgcgggcaaatacgaaatccgcccggcaaa

SEQ ID NO: 7008 - DNA, 1123 bp, Triticum aestivum
  misc_feature (896)..(896): n is a, c, g, or t
  Predicted polypeptide sequence is orthologous to G4
tacggcgacccacgcgtccgtaaaaactgcccattatttatcaattccggcgaccctcctcccaccggcgacgactaggacgaggcaccgccggcaatcatgtgcggcggcgcgatcctcaaggacctcaaggtccccgcgccgacgcggaaggtgacggcggcggtgctgtggcccgagaagaacaagcccaagcgggccgacggcgtggcccggcgcctcgcggggctcggccggcgcggggggctcgggctggacgacggcgacgtggacttcgaggccgacttcgaggagttcgaggccgactccggggactccgacgtggagctcgggcgcgccggggttgctgggaaggacggccacgacgtggtcgtcgagatcaagcccttattcgccgtcaagaggtccctctcccaagatgacttaagcaccatgactactgctggttttgatggtcctgcacaaaggtcagcaaaaaggaagagaaagaacgagttcaggggtatccgccagcgcccctggggtaagtgggctgctgaaatcagagatcctagcaagggtgtccgtgtctggcttggtactttcaacagtgctgaagaagctgcaagagcttatgatgttgaagcacgaaggatccgtggcaagaaggccaaggttaactttccagaggaactaacagttcatcagaagcgccgtgcttgccctgctgctcctaaagttcccaagtcaagcgcagcacaggaacctaccgtcataccagcagtcaacaaccttgccacccaaatgctttcgtctacccgcctgctgactttgcatcaaagcagccacttgttcagcctgacaacgttgcatatgtcccccgcaataactctgctgccccgtgtgaagctcctgtnatgaatatgtactctgaacagggaagccactcctttggctgctctgacttgggctgggagtatgacaccagactccagattttcatcattgctcccaattccacattgctgaggaacatagttgaatttttcagagtaaacctacaaccaacagtaatgccgaaggcctgatttggcttgtcaaagcaaactaaatcagggtgccccgttatgaaaaaagcgtccat

SEQ ID NO: 7009 - DNA, 1074 bp, Triticum aestivum
  misc_feature (26)..(26): n is a, c, g, or t
  misc_feature (667)..(667): n is a, c, g, or t
  misc_feature (850)..(850): n is a, c, g, or t
  Predicted polypeptide sequence is orthologous to G4
tatacggcgacccacgcgtccgcacnagtcgagagaaaatcaagagcagcgaccagagctaggggggaaaagcagaggcaaagcatcgaaagaagagaaagagagcgaggatgtgtggcggagcgatcctcgccgagctcatcccgggcgcgccggctcgccgcgccgcgtccggccacggccacgtctggcccggcaagggcgccaagcagacaaaggccgcggcggccgacgacttcgaggccgcgttccgggagttcaacgaggactctgatgaggaggacgtggtgattgtggtggagcggcaggaggaggtggccgagagcaagcccttcgtgttcgccgcttcgcccaagaagaagcagcagcagcagcaggaggaggaggaggagcaggcggcgcccgcccgccgcaggaagccggcgcagtaccggggcgtgcggcgccggccgtggggcaagtgggccgccgagatccgcgaccctgtcaagggcgtccgcgtctggctcggcaccttcccctccgccgacgccgccgcgctcgcctacgacgaggccgcgcgcgccatccgcgggcccagggccaagctcaacttcccttcctcctccgccgtcgccgccgcggccccgggagcacgcaagcgaggccgcgccggcgccgacgcggnccccgctgccaagccagcgcaggtcatcaccctcgtcgacgaagaggaggagcacgcgtcgtccttgttcgtcaagcacgaggccgacgcgagcgagggctccgagtccagcggcgccctccccgacttctcgtggcagggcgtgtcggcgttcgacgaggccccggcggtacccgccccggnagccgagaccgagcagctcgcgagccggccgaggaccacggaggccgaggacgccgacgagggcatgttcggccaccaggcgtccgactgggaatcgacccgctggtcgacgcgcccctcttcgccgaccattcgcctaattaaacggggggcctacaagtccctcaaaggccttttaaggccaaccccgtgaaaaggggcccccgccccgaaaaaggggcccc

SEQ ID NO: 7010 - DNA, 1136 bp, Triticum aestivum
  misc_feature (23)..(23): n is a, c, g, or t
  misc_feature (926)..(926): n is a, c, g, or t
  Predicted polypeptide sequence is orthologous to G409
cgacccacgcttccgagtgtccnccacaagaaaaaatatactataagcaatagaaaattggttgtccctcgttaagaaaatcaagaaaaagatttccatttcttcttgagctcccttccaccaccaacctctcctccggccggccgaattgtcccgctctggtttgcgtcttctccggcgaggaagtagctaggcctcccactcctcctgtgagtggtctcctccccgcagggctgaggagatctctcgggacctcgggactggggcgtgtatgatggggatttcgcttatgccgatgaagacgcccacgcggcttctgtggagcaccagcttcttccgccacaagctcgccgccatgatcgcctcctcgtcctgcttcttataagagcccctccgccgcgcagcagctgtatatatacgtctttttcatttgatttcgccccccgttcgatcgacaaccaacgcaacttcttgaagctttctctgcgatggagcccggccggctcatcttcaacacgtcgggctccggcaacggacagatgctcttcatggactgtggcgcgggcggcatcgccggcgcggccggcgtgttccatcgaggggtgagaccggtcctcggcggcatggaagaagggcgcggcgtgaagcggcccttcttcacctcgccggatgacatgctcgaggaggagtactacgacgagcagctcccggagaagaagcggcgcctcaccccggagcaggtccacctgctggagaggagcttcgaggaggagaacaagctggagccggagaggaagacggagctggcccgcaagctcggcctgcagccacgccaggtggccgtctggttccagaaccgcggcgccggtggaagacaagacgctggagcgcgacttcgaccgctcaggggtccttcgagccttcgngccgaccagaagccctcctcaagacaacacgggttctgtcaaggtggtacgttgacgagagatgcagataggagggcggaagcaattcgtcagcgtcaacctcgaccggacaggggggggaagggagggaaacttcttgcccccccagaaaaggcgggaaggaggttcagggggcaaaaaaaccactgtttaaggaaagaagtaacccga

SEQ ID NO: 7011 - DNA, 1100 bp, Triticum aestivum
  misc_feature (19)..(19): n is a, c, g, or t
  Predicted polypeptide sequence is orthologous to G409
gtcgttccgacgaggagcnccagctggacgaggagatgtacgggtactacggcctcgacgagcacgcgcccgagaggaagcgccggctgacggcggagcaggtgcgggcgctggagcggagcttcgaggaggagaagcggaagctggagccggagcggaagagcgagctggcgcggcggctgggaatcgcgccgcggcaggtggccgtgtggttccagaaccgccgcgcgcgctggaaggcgaagcagctcgagcaggacttcgacgccctcagggccgcccacgacgagctgctcgccggacgagacgccctcctcgccgacaaccaccgactacgatcgcaggtgacatcactgaccgagaaactgcaagccaaggagtcgtcgaagccagaggagccaaccgccgtgtcaggcacggcagatgccggtgtcccagccgttgagctgaaagacggctatgccgcctgcgatggcgcggcggggctgctggccggttttgccgggggagccaacgacagcccggagtccaactcctacttggccgacgcgcgctcgcctccgtcgtcctcggacgacgactgcgccggagcggtgcgcggcgagctgaacagctgcgccttcttcctccccgagtacgccatgctcgacgtcgcggccgcggagcgcgggagcgtccaacaaggggaggaggaagaggaggaggcgcagcgcaagtactgggcgtggttctggagctgatcgacgagagcatcaccaaaattagcaatactccgtgtggacgtgcaacatgtttaatccaatccagaagtggtacatatttgctcggtgtgtaaattatttgccctactagcagcgtgggttgtgaattagtgatgcatgttatgaatatatatctccggtattggtcagcagatgtttaggctgaaactgcttggccgtgcttggcaggggcatcagcaacgtcttcaagattcgagtgtcgacctttcgatgataatgattaccgtattagtttaaaaaaaaaaaaaagggcgggcggtctaaagtttcctctgaggggcccagcttaccgttccccgcttttttgacaaggtggcc

SEQ ID NO: 7012 - DNA, 600 bp, Triticum aestivum
  Predicted polypeptide sequence is orthologous to G428
ccacgcgtccgctcaggggacaccggtgcatccgacgccggcatgcaagagcagagctcccggttggccgaccgcgagctcagggagatgctgctcaacaagtacagcggctgcctcagccacctccggaccgagttcctgaagaagaggaagaaagggaagctccccaaggatgctcggcttgctctcgtggactggtggaacacacactaccgctggccttacccgacggaagatgataaggtgaggctcgccgccatgactggcctcgacccgaggcagatcaacaactggttcgtcaaccagaggaagcggcattggaagccgtcggaggacatgcgattcgcgctcatggaaggcgttaccggaggaggaggggggtcctcttacgacacgacactctgcttcggcacggacagcatgagatagttgctcatttcccgcgggcatgaagctcttctgcacacggtggttgtgtgactagcaaggaaggggtacatcaaacgatgaatagccccatgatcattttctcaatcattgtgtacgtatgtagtacatgggcgctgtcagggaaaacttttttgaaaaaaaaaaaaaaaa

SEQ ID NO: 7013 - DNA, 773 bp, Triticum aestivum
  Predicted polypeptide sequence is orthologous to G428
gcggccgctctagaactagtggatcccccgggctgcaggaattcggcacgagggcgcagtggaggcgccgcagccgccggggagattggcctcgaccccgagctcgacgagttcatggaggcctactgccggctgctgtcgcggtacaaggaggagctgtcccggccgttggacgaggccgcctccttcctcaccaccatccgctcgcagctcactaatctctgcggcggcggcgccaccgccacctcgccgcactccgatgaaatggtggggtcgtcggaggacgagccgtgctcgggggacgccgacgggtccgacgccggcatgcaagagcacagctcccggctggctgaccacgagctcaaggagatgctcctcaagaagtacagcggctgcctcagccgcctccggtccgagttcctgaagaagaggaagaaagggaagctgcccaaggatgctcggcttgctctcatggactggtggaacacacactaccgctggccttaccccacggaagaggacaaagtgaggctcgccgcgatgacggggcttgacccgaagcagatcaacaactggttcatcaaccagaggaagcggcactggaagccgtcggaggacatgcggttcgcgctcatggagggcgtcaccggaggagggggatcctcttccggcacgacgctctacttcgacacgggcacgatcgggccatgagatggatggatgattgctcatttccggcggccataaagcttactggctctattgcacacaga

SEQ ID NO: 7014 - DNA, 511 bp, Triticum aestivum
  misc_feature (378)..(378): n is a, c, g, or t
  misc_feature (386)..(386): n is a, c, g, or t
  misc_feature (398)..(398): n is a, c, g, or t
  misc_feature (421)..(421): n is a, c, g, or t
  misc_feature (491)..(491): n is a, c, g, or t
  misc_feature (495)..(495): n is a, c, g, or t
  Predicted polypeptide sequence is orthologous to G450
cttcggatcatgaaaggatcagaagccattggcctggcaccaagggccatggagaaatgcaagaacagaagctgaggagaagaccgacggacggaagcttgcatctcagcaccaccaggggtggatggatgcaagaagaacaaatctccatggcttttgaagctctgctcgtctctgtatcatactcgtcgtccctgccctccagcctctgtatctccctgatcaatgaatccttttggtgtgtcaactgttctctccgtgcccacttgtcaagtgaaagatcatcaatgtccatcaatctcacttgtcctatacagaagagaaaccatgcatgacatgtacctgtccctatacatgtcttttttgctactgttttcncttctccnctttttttgggnaaagatcaaagcacctgccctgntaaagcctttgcacataactgttgatatatacatggtgttcattggacaataacgttcagggtaaaaaantgtnttataaaaaaaaaaaa

SEQ ID NO: 7015 - DNA, 613 bp, Triticum aestivum
  misc_feature (431)..(431): n is a, c, g, or t
  misc_feature (480)..(480): n is a, c, g, or t
  misc_feature (535)..(535): n is a, c, g, or t
  misc_feature (546)..(546): n is a, c, g, or t
  misc_feature (557)..(557): n is a, c, g, or t
  misc_feature (560)..(560): n is a, c, g, or t
  misc_feature (568)..(568): n is a, c, g, or t
  misc_feature (588)..(588): n is a, c, g, or t
  misc_feature (609)..(609): n is a, c, g, or t
  Predicted polypeptide sequence is orthologous to G450
cgagtttttttttttttttttgtaaaactaacattgacagacgtggagttctttacttgcgtagcagcaaaaacatgtggtacagaccataaggcagaattcttcttgaaactgttagacgttttccggcttccacaaagatccctacagtcactggatatctccctcttgctctggactgtaagaagcaaccattctagttgcgattcttggacttatcagctgcccttgggagcaagtccaattgcatctgatcctttcatgatcctgagcctgcggcaagagtcaagcgaacatctcccatggtacatccgccaacaagcatccatctccatccttgtcctccgtaagtcagaacatattcacatccttggggtaccaaataagcacccttgccagtactgaagccactgaacacctctcaagcgcantcacaggcccttgtagtcctggaatccttgaggcatctccctgaggtangggcgcaaccatgctgacttgactaaagaacccggtccgctggctaaaacccctncggcctcaacngggtgggaaanacngtctcggnaactcgtggggcacccaccnacttcacgggggggtccgaantttt

SEQ ID NO: 7016 - DNA, 444 bp, Triticum aestivum
  misc_feature (330)..(330): n is a, c, g, or t
  misc_feature (354)..(354): n is a, c, g, or t
  misc_feature (395)..(395): n is a, c, g, or t
  misc_feature (406)..(406): n is a, c, g, or t
  misc_feature (430)..(432): n is a, c, g, or t
  Predicted polypeptide sequence is orthologous to G450
gcgatgctgatgatgtggtcactacttacgaagacaaggatggtgactggatgctggtcggcgacgtcccgtgggagatgtttgtcgactcatgcaagcgtctgaggatcatgaagagttctgaagccataggtcttgcaccaagaacgaaggataagtgcaagaacaagagctgaagaagatgcagtgttaaagatgttgcccattgtatcaagaagaatggtccccttgcagtgcgctgccgttttttttttcctactaagaaatataacgcgttttaattactaagttggagggagacctgtcttgttcaactcgttcaaggaccangagcaataatatatccgtgtgtanctggattggtgttaagtcatgtcccctaccgtgtctcccanaatcacttggngattttatccaatgtggtaatcannnaaaaaaaaaaaa

SEQ ID NO: 7017 - DNA, 578 bp, Triticum aestivum
  misc_feature (260)..(260): n is a, c, g, or t
  misc_feature (310)..(310): n is a, c, g, or t
  misc_feature (326)..(326): n is a, c, g, or t
  misc_feature (334)..(334): n is a, c, g, or t
  misc_feature (367)..(367): n is a, c, g, or t
  misc_feature (371)..(371): n is a, c, g, or t
  misc_feature (381)..(381): n is a, c, g, or t
  misc_feature (388)..(388): n is a, c, g, or t
  misc_feature (393)..(393): n is a, c, g, or t
  misc_feature (410)..(411): n is a, c, g, or t
  misc_feature (413)..(413): n is a, c, g, or t
  misc_feature (434)..(434): n is a, c, g, or t
  misc_feature (443)..(443): n is a, c, g, or t
  misc_feature (474)..(474): n is a, c, g, or t
  misc_feature (477)..(477): n is a, c, g, or t
  misc_feature (495)..(495): n is a, c, g, or t
  misc_feature (524)..(524): n is a, c, g, or t
  misc_feature (552)..(552): n is a, c, g, or t
  Predicted polypeptide sequence is orthologous to G450
cgctggtgaaggtgagcatggacggcgcgccctacctgcgcaaggtggacatgggcacctacaagagctaccaggagctgtccaaggccctggagaagatgttcagctccttcaccatcggcaacgactgctcgcaggctcaggggatgacgggcatgaacgagagcaagctggtggacctgctcaacggctccgactatgtgcccacctacgaggacaaggacggcgactggatgctcgtcggcgacgtcccctggganatgttcgtcgcgtcctgcaagcgcctccgggataatgaagggatcagaanccatcggtctgacacnaggggcantggaaatatgcaagacaggagctgacgtttgcnacanttcaaattanggtctgnttccnaactattaacatactanngngcgtctctacttccattttanctgttgtanatatgtgtatatgtcacgtaaaaagattcancgnatgcactgtttttagtanatcaatagttttcgttacaccaaaaaggnaaagatccttcattctatcaaaagacancagtgggctaccacaaaaaaaaaaaa

SEQ ID NO: 7018 - DNA, 599 bp, Triticum aestivum
  Predicted polypeptide sequence is orthologous to G450
ttttttttttttttttagctcaacacaatacgattaagatgtataaatggcagctatgccatcagcctcgcacacctatagcaagcaccaccacataaccacaaaatagcaaccgtgtggaaatgtggaagaacgagttcggtttggtgtgtctggtcttatttatcaaaagacactgtagccatgtgtatttcaagcttcggatctataagtagaaactacagataagtaacggaactacaaactttcatcaactcaatagcataaggggaccaaaagcagtaggtgacaactgtacacatttctatctcacgtgaagatcctcaaaacagcaaagtttcctctttccttcaagaagccagtgcgtaccaacaggtggagtgcgcctcatcgggcggctcttggtgctaagttaacggcctctgaacctttcatcagacgaaggcgctggcaggtttccacaaacatcttccaggggacgtcgccgacgagcatccagtcgccatccttgtcctcgtacgtgggcacgtactccgtcccgttcaccgcgtccaccagcttcctctcgtcgtcggcgaacttcctgatggtgaagtggg

SEQ ID NO: 7019 - DNA, 1170 bp, Triticum aestivum
  misc_feature (875)..(875): n is a, c, g, or t
  Predicted polypeptide sequence is orthologous to G450
tggttccaacgcgtcgggagctcacccatatggtcgacctgcaggcggccgcactagtgattagcgtggtcgcggccgaggtcacatcgtcttctcctctcaccgagccagagctatcacatctcgtcattcacatcgcatccaaacgtacttgcaaagttcgctagaccaagcaagcaccaagcatcttcgcacgtacgtccactggaaatggaagctaccgacagcctcctcatggccaccgagctcaggctgggcctccccggcaccgacgacaagccacacaagatcacctcggtgatgtcgccgccggcgactcccagaggcaggaagcgcaccctggacgccttcgaggccaccgcctccgatgaggccgacaggtccgacgacgtcgagaccgcaccccccgtggccaaggcacaagttgtcgggtggccgccggtgaggtcgtaccggaagagctgcttccaggcggcggcgagcaagagcaaggcgaagaaagcagacgaggccagcagcaacaacacgccgtccgcagcggcgccggcgagcaccaacggctccttcgtcaaagtgagtatggacggagcgccctacctaaggaaggtcgacatgaggatgtacaagggctaccgggagctcagggaggccctggaggccatgttcgtctgcttctccggggcagacggcggcgcttccaacggcggcgcgaacccggccgagtacgccatcacctacgaggacaaggacggcgacctcatgcttgtcggagatgtgcccttcgatatgttcagcggcacatgcaagaagttgaggatcatcaagagatccgaagccacaggcctgggatccaaataatgaagatctgagaagcnaagatgatatcatgggctcttttttttttttttacgggttatactttttgttcttcgatctggggtcgatcaccagcccaaagggatgagcttggtgcatcagaaagacacatgaatgtgtgcctttggttgggttcctggagtaagccttttaaaagccaaaggagatgtggagattgggttaaactctcatgtgtttgtacaacgaaacagtatattgatggggacacttatcacctgcaggttttgggggggggttcccttcgggtcccttggatgggctttggtaaacccc

SEQ ID NO: 7020 - DNA, 835 bp, Triticum aestivum
  Predicted polypeptide sequence is orthologous to G450
gaaccgctagttaggtaagggctatccaggtgacgaagtataacaagtttgtacaaaaaagcaggctggtaccggcccggaattcccgtgatatcgtcgacccacgcgtccgccatccacccggccgccatcatctcattcttcgtcccctcccgtctatttgtgctctgctcacaagccaagcccaagcagcagcagacacacgcgaaagcaaactcacaaggaggggcgaagaagaaacccaagggcggctgctgcgttggagcaggagaccaatggcgggcctcgggttcgaggagaccgagctccggctcggcctgccaggcggcagcaacgaggccgaggaggcggccgccgcggtgaggagctccggcaagaggggctacgccgagaccatcgacctcgtgctgaagctggagccggcgtcgggggccggcccgccgtccgaggacggcgagcaagtggccgacggcgtcgcggaggggcagccgtctccggctgctggcgacgggcagttggagcggtcgccgagccagagcagcgtggtcaccaccccgcagctggacgcggaccccgagaagccgcgcgcgcccaggcccaggctgtggggttggcgccggtgcggtcggccgccgacccctgggcggagagagggggggccgggcctggttaaggtgagcatggacggggggccctaccttgcccagggtggacctgggcccctacaaaaagctaacaggggcttgcccagggcctgggagaaaatttcaggttccttcacaattggaaacgattgctctcaaggctccggctccaggggatgacggggattgaa

SEQ ID NO: 7021 - DNA, 876 bp, Triticum aestivum
  misc_feature (456)..(456): n is a, c, g, or t
  misc_feature (566)..(566): n is a, c, g, or t
  misc_feature (671)..(687): n is a, c, g, or t
  misc_feature (689)..(690): n is a, c, g, or t
  misc_feature (692)..(693): n is a, c, g, or t
  misc_feature (695)..(695): n is a, c, g, or t
  misc_feature (849)..(849): n is a, c, g, or t
  misc_feature (851)..(853): n is a, c, g, or t
  misc_feature (861)..(864): n is a, c, g, or t
  misc_feature (867)..(867): n is a, c, g, or t
  misc_feature (870)..(871): n is a, c, g, or t
  Predicted polypeptide sequence is orthologous to G450
caaccgactttgaggtagtggcttacatacgacgttagattgggaccactttgtacaagaaagctgggtacgcgtaagcttgggcccctcgagggatactctagagcggccgcccttttttttttttttttttttttttttacatgccgatgacatatttctcacgtatacatactacacatgtgtaacaacaagataaaacataggaagtaggagtacgtagtatattatggtacagagttgggcaatcaagagtcgtaatcttgaaatggtagcaaacggtcagctcctgctcttgcatttctccattgcccttggcgcgaggccgatggcttctgatcccttcattatccggaggcgcttgcacgacgccacgaacatctcccaggggacgtcgcgacgagcatccagtcgcgtccttgtctctgagtgggccttattcgagccgttaggagncgctgagtaggtccaccagtttgctctcgttcatggcccgtattcccctaaccctgaccctgagagcagtcgttgccgatggtgaaggagctgaacatcttctccagggncttggacagctctctgtagctctggtaggtgcccatgtccaacttgccccggtagggcgcgccgtccatgctcacttttaccagcggcggcctcttcctcgaggnnnnnnnnnnnnnnnnnannanngnatcgggggcaccccccccccttgcccttttgggcggccggcggtttttcgggcccgttcccgttggggggtggagaaacccttcttttttcttggttggagagcgtttttttctcccgtcgtgtgctcgctagagaagggggtgtccccccaanannntttttcannnngtngcnncccca

SEQ ID NO: 7022 - DNA, 1121 bp, Triticum aestivum
  misc_feature (12)..(12): n is a, c, g, or t
  misc_feature (19)..(19): n is a, c, g, or t
  Predicted polypeptide sequence is orthologous to G450
ccgttcgatgantgagcgncgacccacgcgtccgcacaagccatcttgcatacacggagagagaaagagacgccaagagatcagcagctgctcgagtagctcgcgtggaggtgtccaaggtgggagacccaagcacgggctagctagccgaccagctgctccgccggagccgatggctggcgccgacgtcgacgtcgggacggagctcaggctcgggctgcccgggggcggcgccgaggcggccaaggccgggaagaggggctatgaggacaccattgacttgaagctcacgctgcccaccggcggtatgcaggaagactctgccggcaagccggagccggccgccgacaaggccaagaggcccgctgaggccgcggccgccgaccccgagaagccacctgctcccaaggcacaggccgtgggttggccaccagtccggtcgtaccgcaggaacgccatgaccgtccagtcggtgaagatcaagaaggaggaggagaccgagaagcagcagcctgctgctgccgctgctgctggtgccaacggctccaactttgtcaaggtgagcatggacggcgcgccctacctgcgcaaggtggatctcaagatgtacaacacctacaaggacctctccattgctctgcagaagatgttcggcaccttcaccgcaactgggaatgaggggaagatggttgaggcagtgaacggttcagatgttgttactacttacgaagacaaggatggagactggatgcttgttggagacgtcccatgggagatgtttgttgcttcatgcaaacgcttgaggatcatgaagggggtccgaagccatcggtcttgcaccaagggccaaggaccagtacaaagaacaggagctaaagatggggcagtaagaggaagactatgatgccccagggatggtgtcttggagtgtgctatggtctcttagatatttaatggttcaattaatagctggattaaaagaaggagagttgccatgtctaattggttggggggccaaaaaccaaaaatttatctgggtgtatcctggatgggggttatttgaaggtccccaaccagggtcccagaaattaatggggggattaatccccaggggtgcaaat

SEQ ID NO: 7023 - DNA, 1171 bp, Triticum aestivum
  misc_feature (20)..(20): n is a, c, g, or t
  misc_feature (30)..(30): n is a, c, g, or t
  misc_feature (1079)..(1079): n is a, c, g, or t
  misc_feature (1099)..(1101): n is a, c, g, or t
  Predicted polypeptide sequence is orthologous to G450
tttttttttttttaaacttntaacacctgncaataacctttgttctgttgacagtcacaccatggtgataataaaacaacttttgatggacaaaccgcaagaggaaaaatatggtgtctttgcattttgtgccaagaagagacataagagaaaaaaaaggaagaacaaacagagcaaaaaggagaagacacaattatgtggcagacaggtacagatacatctcacatgttcttggattcttctttcttatgtatataacaagatgagacttgggactgactgactggaaaagagaagatcacaaaccaaaatgacttcactgatcaggagatacagacttagacttaggacagagaatatgatacagggatgagcaagcaaggttatataggtattttgattcttgcataacatttagtgcatcctctcctcagctcctgttcttgcatttctccatcgcccttggtgcaaggccaatagcttctgatcccttcattatccgaaggcgcttgcatgactcgacgaacatctcccatgggacgtcgccgacgagcatccagtcgccgtccttgtcctcgtacgtcggaacatactcggatccgttgagaagatccatcagcttgctctcgttcatgccgttcatccctgggagtccacagtttccgatggtgaaggagctgaacatcttctcgagggccctggagaggtcctggtaggtcttgtacatgtggaggtccaccttgcgcaggtagggcgcgccgtccatggctcactttgacgaacgccgcggttgccgccggggacgactctccgccaggaagttcttcggaacgaccggaccggaggccacccaccaactgggcctgggaacccgcggtttctcggggggttcggcatcacggggtggtgaaaaccctgtctggttccgggacctttcatttccctccgccgggttctggccccgttccttccggttcctgcggcgggggggaaccaggccactttggccaatctcttcggcgggccctcctccggcggctccactgaacttaggcaacggtccgaaaaccccttttctntattcctccttccccccttnnncccggggagcccaccgcaacggccccccaaccaagcccctcctagtgaggggtcaccctcatctttttta

SEQ ID NO: 7024 - DNA, 1093 bp, Triticum aestivum
  Predicted polypeptide sequence is orthologous to G450
cgacgacccacgcttccgaccagaggcagcagcagaagacgacgacgccgacgcgcgcggagctcgagagaggctgacgacgaggacgacgacgccggtggccatgtcggcggagacggagcggagctccacggagtcgtccgcggcgtccgggctcgacttcgaggacaccgcgctcacgctcaccctgcgcctgcccggcgaccccgaccgcaagcgcggcgcctcctcctcctcctgctgctccctcgccgaccgctcctccctcctcgccgaggctccgccggcccccaaggcgcgggtggtgggctggccgccggtgaggtcgttccgcaagaacgcgctcgagaacgtcgccgccgggtccaccagggcggcctgcgcgccggccaagttcgtcaaggtggccgtcgacggcgcgccctacctgcgcaaggtgaacctgcgggactatgccggctacgaccagctcctccgcgcgctccagggcaagttctgctcccacttcaccatcaggaagttcgcgaatgacgagatgaagctggtggacgcggtgaacgggacggagtacgtgcccacctacgaggacaaggacggcgactggatgctcgtcggcgacgtcccctggaagatgtttgaggaagcctgccaacgcgtccgcctgatgaagaactccgaggccgtgaacatagcacccagagctgcccggtgaggcatgctacggacggtgctgcctgaaaggaggaggctttgctctgccgaggagataggaatgtgtacagctatcggttacttactgctttgggtttacttgatgctcttgggtcgtgaaaagttgttggtttcattactcgtctgtagcagcaccactatagtctctactactaccacatatagaagatggtgatggttaaagaaagtactgggagctttgaatatacaccttttacataatattggtgggttggttgttggtctcttgatgataagaccaactgcataaaaaaaaaaaaaaaaaaaaaagggcggcggctaaatttccttggggggccaagttatccttcccagttctggaaaaggggccctattggga

SEQ ID NO: 7025 - DNA, 751 bp, Triticum aestivum
  Predicted polypeptide sequence is orthologous to G451
ccacgcgtccggaaagcaattgtgcaatctctttctccagatggtgggacgaatcagaagtccaccaaccgcttgcacgtgtcatgcgtgtttgtcggaacagatttgcagctacccctatcctctccatatcagagaaagatggatggtcgtatgtacaccaatctggatcaacagagcttactacgttgcattaaccatacctttgtggtcgtcaactgaaatggattatttttttcaagtattatttcatggattactgtttgctattccattacttggtggttaacgactattgttaaggaagctcatcgcttgcatcaaatcgaattgcgtgaaaaggaacatttgaagttcttgcgccttcttcttaaggattttatgattaaatatggcattgacactgagaattggattctgatccaatttgcaacagctctgaagattattgttttatgcccctggagcatcagccagatgaaggccatcgaagatcacaagggcagcttgctattgtacaggaattcaacacataagggcagcttgttacatttacagaaactcatgatgttggcaatggtaagggggcgaaatcatgaaggcacggttgggttgcaaggtgctcaaactctcatattgcgatttgcctacaactttgtttgtaggtttgtttggttgggtgtttgtagtttgtttctgtgacctgtactaaagcaaatagcagctatttgcagtccgacatacatgtgca

SEQ ID NO: 7026 - DNA, 571 bp, Triticum aestivum
  Predicted polypeptide sequence is orthologous to G451
tttttttttttttttttttttattacacacaagttctttcttactgcatggctgcctgaacctctgactgtacaccagtacatgcatgtacctactactagtacaacaaaacagtaccgctgctgccggccggcctggccgccggagcgcgcgcgcctgtgagtcctggacccagcctcgcgttcgtaccgagtacatggatcgagtacttcacatgccaggcgcgtgcccgcgtaacccggcctccgtcgccgttcacccatggcctgatcatgcatctggcccatgcgtgcgtccttctcctgatcatgtgccacggccggtttccatcatctccagattgcttcatgtatgtatgtgtgcttgatcgtgtccttttcatcatcgtcatcatcgtgcttcggagcttctcattatcctcagcctcttgcaggaggagatgaacatgctgcagaaccagacgaacaaccgctcgttagttagactcaggttctagctattgcagcacgtagatccacaccaaagatcggcgttggtcggttggtatgcaaattaagatggatggaggttg

SEQ ID NO: 7027 - DNA, 615 bp, Triticum aestivum
  Predicted polypeptide sequence is orthologous to G451
ttttttttttttttttttgttgtagtagtatattataagtatttatagtattacaagatgtctgcaacatgagcagccactgaagttgcatagctgaaatctcacagaagagaaaagaaaaacatttctcaaagtctagcagtgccgttctgtttgtttcttcagagcaaaatcttgaggcgtttcaccgaccgcgcgaaatcctcccacggcacgtcgccgaccagcatccagtcgccgtcggcgtcctcgtacgtgaccaccatctcgccctcgcccttgccggcagcaccaccgaggcaacccgccctgtcgccggcggggtcggggaacatgcgggcgagcgtggcgaggaggtcggcgtaggagccgtggaagggcaggtacaccttccgcccgatggccgcgccctccttccacaccttcacgtgcctgccgcacgccctgctgcgcgcggagctcagcggcggccaccccaccagcgccttcttgctccccccaacgccgccgccgctgccgctgtcgcagctgctgctactgctgccgtcgtcgaagagcggcagcgtcgtggtcgacgtcctgcgctgctcctcgtcctccccgaacgcctcgccg

SEQ ID NO: 7028 - DNA, 1191 bp, Triticum aestivum
  misc_feature (14)..(14): n is a, c, g, or t
  Predicted polypeptide sequence is orthologous to G451
cgccaggcatacgncgacccacgcgtccgctcacctacagccagctgagaagaacgacttgcaagtcctaaccacctctagtcggtagacaagcacctcatcgccggcgacaggaactaatggcggctgccatgagctacgtgcatgccgacgtggagaacctcaaggcgacggagctgaggctcggcctgccgggcgtcgaggagagcgacaagatgccgtcgccgccgtccactcccagggccggcaccaagcgcgcgctcgccggggagcaccgcgaggaggagcccaaggccgcgcccccggccgccaaggcgcaggtggttgggtggccgcccgtgaggtcctacaggaagagctgcttccagcaggcgagcagcaaggccaaggcggccgcaccggcacctgtggtagtgaagcaggaggagacggccgttgccgcggcgccgcccgccgccgctgccgcgggaggatcactgtacgtgaaggtgagcatggacggagccccttacctgaggaagatcgacctcaagatgtacaagggctaccgcgagctcagggaggccctggaggccatgtacctcggcttctccggcgacccaggcagtgtgaaaccgtcggacttcgccgtgacctacgaggacaaggacggcgacctcatgctcgttggcgacgtgcccttcgggatgtccatgagcccttgcaagaggatgaggatcatgaaggggatccgaagccagagggctaggatcatcaaaggggtggaaatggaatccatctacgaagaacacgccacatgccagggggccctgtgtgcaaactggaggaattctttggtccttttgggacatgtgtcgaaccaatctaccaaagggcttctcttccaaggcaaagaacccagcctgattcgagggggggtttaattttaaatttgggtttcttaaaaaagggggtcacgcccccaacaagggtggggaatacctccggggttggaccgggttcccctggggtgttgggacaaaaaaaaaaaggctttcttttccgggtttaaaaaaaaaagaaaaaaaagggggcggccaccctagagaatccccctcggggggccaaagctaggcggtacccagggtttctttgaacaaaggggccccacatagggggcgcggtttaaacggaggcgccgggcgcgccgtt

SEQ ID NO: 7029 - DNA, 1064 bp, Triticum aestivum
  Predicted polypeptide sequence is orthologous to G451
agtacttcgacccacgcgtccgatcgtcttctcttctcagcgagccagagctatcacacctcgtcattcacatcgcatccaaacgtacttgcaaagttcttccctaccgcaagcactacgcggcatcttcccacgtccactggaaatggaagctaccgacagcctcctcatggccaccgagctcaggctgggcctccccggcaccgacgacaagccacacaagatcacctcggtgatgtcgccgccggcgactcccaggggcaagaagcgcaccctggacgccttcgaggccaccgcctccgatgaggccgacaggtccgacgacgtcgagaccgcagcccccgtgcccaaagcacaagttgtcgggtggccgccggtgaggcgctgcttccaggcggcggcgagcaagagcaaggcgaagaaagcggacgaggccagcagcaaaaacacgccgtctgcggcggcgccggcgagcaccaacggctccttcgtcaaagtgagcatggacggagcgccctacctgaggaaggtcgacatgaggatgtacaagggctacagggagctcagggaggccctggaggccatgttcgtctgcttctccggggcagacggcggcgcttccaacggcggcggcgcaaacccggctgagtacgccatcacctacgaggacaaggacggcgacctcatgcttgtcggagacgtgcccttcgatatgttcagcggcacatgcaagaagttgaggatcatcaagagatccgaagccacaggcctgggatcaaatgatgagatatttgagaaccaagatgatttcctggcccccctcccctttttccttttaagggttaatactttggggcctccgaattgggttcgatcacaagcccaaagggatgagcttggtgcatcaaaaacacacatggatttgtgcccttggttggggtcctgaagaaggcctttttaaaaacccaagggaaatttggaatttggggtaaaccccccaggttgttgtcatcccaaaccagttttttgggtggtggccccttttccccaaaaaaaaaaaagtg

SEQ ID NO: 7030 - DNA, 1177 bp, Triticum aestivum
  misc_feature (805)..(805): n is a, c, g, or t
  misc_feature (852)..(852): n is a, c, g, or t
  misc_feature (878)..(878): n is a, c, g, or t
  Predicted polypeptide sequence is orthologous to G519
cgtaagaccgcgagtggccgccctttttttttttttttaaactattattcagtttcatttgatgaatggcttacactaccatcggactataggtatcaacttatcaataaacccttgcaactaaccaatcaagagacagcaacccctgcaccgaaccaatcatgttctccatgtatgtacacccatccatatacacacacacatgcatgcatgcatgcttgctagcgcacgaccgcccgcccgatatgatgcaatgcggcgaacgctttgaagcatctttggcgcacgtcatgtcatgctggtgagagcccggggacccacggtgtcatcgccgccaccttccaatcttcgtcgtcatcaagcacctgattttgtcttatctcccgtctaatatcttcttaaattatctccccttcatcaggtcaacaatggcggctcgcccgtttcatcgcccaaacgccaaggataggaggtactcgcttcaatcgaccgatcggtttctttgctgcctagaacggcttgccccagtacatgaggatgtcctggaggagcgggtcgccgccgaagccgccgttgggctcgagcatggagccggccgccgggttcacggggtcgccgccggaggcgaacgagcgctcccactcgctgatcttgggctggctctgcacctccccggccgggaactccggcgacagcacctgctccgagcagctcgagtcggcgtgcagccgcggcatcgagtcggacgggcggtcgtagtacgccgcgaagtccgggaacggctgcacgccgccgccgccgccgntggcgttcatcccatgacgggcttctgctcctgcggggagctcacangggcccagggccacccccgtagccgnccatgggccgcggcttccggtcacggacgccggctctcatgccgcccttctggtgtaatgcggacagaacccatcatccacctgaagctgtcttctgcgggcggagcgtccacctcggcaaggggtatcgtgcatgatcattggcctctccccctgggggcctgccaggtaaaaaaagccctcttaatgccacggttgggggtgccagggtttttggccggtggcttccataacggaccggggccggttggcctgaccctggggttttggcccccggggaaaaaaacacctttccccga

SEQ ID NO: 7031 - DNA, 1140 bp, Triticum aestivum
  misc_feature (878)..(878): n is a, c, g, or t
  misc_feature (913)..(914): n is a, c, g, or t
  misc_feature (944)..(944): n is a, c, g, or t
  misc_feature (953)..(953): n is a, c, g, or t
  misc_feature (1105)..(1107): n is a, c, g, or t
  misc_feature (1109)..(1115): n is a, c, g, or t
  misc_feature (1117)..(1117): n is a, c, g, or t
  misc_feature (1119)..(1120): n is a, c, g, or t
  misc_feature (1122)..(1123): n is a, c, g, or t
  misc_feature (1125)..(1126): n is a, c, g, or t
  misc_feature (1131)..(1131): n is a, c, g, or t
  Predicted polypeptide sequence is orthologous to G519
gactaccgcccacgcgtccgcatccgacacagtccaccacgcacgcgcagcagcagtagcagcgcccgggaatctcatcggcagagaagcagcaagaagaagcaatggtgatggcggcggaggggcggcggggggacgcggaggcggagctgaacctgccgccggggttccggttccacccgacggacgaggagctggtggcggactacctctgcgcgcgcgcggccgggcgcgcgccgccggtgcccatcatcgccgagctcgacctctaccggttcgacccgtgggagctcccggagcgggcgctcttcggggcgcgggagtggtacttcttcacgccgcgggaccgcaagtaccccaacggctcccgccccagccgggccgccgggggcggctactggaaggccaccggcgccgacaggcccgtggcgcgcgcgggcaggaccctcgggatcaagaaggcgctcgtcttctaccacggcaggccggcggcgggggtcaagacggactggatcatgcacgagtaccgcctcgccggcgccgccgccaagagggacggcgcctcgctcaggctcgacgactgggtgctctgccgcctctacaacaagaagaatcagtgggagaagatgcagcggcagcggcaggaggaggaggaggcggcggccaaggctgcggcgtcacagtcgacctcgtggggtgagacgcggacgccggagtccgatgtcgacaacggtccgttcccggagctggactcgctgccggagttccagggaatggggacgacaaacgcggcgatactgccaaaggaggaggtgcgggagctgggcaacgacgactggctcatggggatcagcctcgacgatcttcagggcccgggntccctgatgctgccctgggacgactcctacgccgnnctcgtcctgtcggcggttggcgtgatgaanatggagcangacgtcagcccattcttctcctgaagcatcactctctcaagtaccattgtgtctgggagtactgtagtctgtaatattcaattgggtcaggattagtttatccggattattggtataataatgctttaaggatcctggcagcggcctggttnnnannnnnnncncnnannannaacanaccccccaa

SEQ ID NO: 7032 - DNA, 1089 bp, Triticum aestivum
  Predicted polypeptide sequence is orthologous to G519
cacgcgttccgcgcccaccacaatctcaacagccatcggaatcaacagcagcagcggagcgatttcatcgactaacaaatcagcggacatggggatgccggcggtgaggaggagggagagggacgcggaggcggagctcaacctgccccccggcttccgcttccaccccaccgacgacaagctggtggagcactacctgtgccgtaaggcggccgggcagagcctcccggtccccatcatcgccgatgtcgacctctaccgcttcgacccgtgggcgctccccgaccgcgccctcttcggcacccgcgagtggtacttcttcaccccgcgcgatcgcaagtaccccaacgggtcgcgccccaaccgcgctgccggcaacggctactggaaggccaccggcgccgacaagcccgtcgcgccccgcggagggcgcaccatggggatcaagaaggcgctggtgtttgatgccgggaaggcgcctaagggggttaagaccgactggatcatgcatgagtaccgcctcgacgacgccggccgcgccgccgtcagcaagaagggctcgctcaggctggacgactgggtgctctgccggctctacaacaataagaacgattgggagaagatgcaactccaacaccaggggggagaggagatgatggtggagcccaacgcggagaacacggcgtccgacatggtggtcagctcgcactcacactcactagtccagtcgcactcgcactcgtggggcgatgcgcgcacgccggaatcgtagatcgtcgacgacgacccgtagatgttccagcacgcggtcgagtacatgtccagagcccgcactgcgtgtcgcgcacaggagatgatgccatcctgatgtgcccacaaagagcagcggaggaggccgtaggactactgttcgtggacttatctacataactcagagatgtacacgcctcgaatgatgcgcggggagactgtttatctcctctcgctcaccgtttcggggaccaccggtgccgggttccgcccgtttataaacaaaaaaacctctaaaaaatcaaaggaaggttatttgcccacaaacctccatgttaa

SEQ ID NO: 7033 - DNA, 899 bp, Triticum aestivum
  Predicted polypeptide sequence is orthologous to G519
cactaaggcctatttaggtgacttccagaacaagtttgtacaaaaaagcaggctggtaccggtccggaattcccgggatatcgtcgacccacgcgtccgaggaaacgagccatcaacaaaagagaaggctccaggtcccaggaggcggtatcacaacctgcagccgcctttctcttctcttcttcttctcttccagcaccgggcgggcgcggccggggttttcttttctccaaggtggtggagcgggcgagcgaacgcgaggagggggaggatgatgacggcaatggtgaaggccgagccgacggcggcggaggggagcagcgggcggagggacgcggaggcggagctcaacctgccgccgggcttccgcttccaccccacggacgacgagctcgtcgtgcactacctctgcaggaaggtggcgggccagccgcagcccgtgcccatcatcgccgaggtcgatctctacaagttcaacccctgggatctgcccgagagggcgctgttcgggagcaaggagtggtacttcttcacgccacgcgaccgcaagtaccccaacgggtcgcgcccccaacgctccgccgggaccgggtactgggaaggcccccggcgcccacaagccccgtggcgccccaggagaacggccggcaaggacggtccggcatcaagaaaggcggctcgttcttctactccgggaaggggcggccaagggggcggccaagaaccgaactgggatcatggcacgaagataacggaatccgccggaaacccgacccgcggcacccccgggcaagaaaggggaaccccctctcaagcctggacagaaatggggggggcgtggtgccgggttgtttacaacacaaggaaagacactccccttggggcaaaaagagcccaag

SEQ ID NO: 7034 - DNA, 1450 bp, Triticum aestivum
  Predicted polypeptide sequence is orthologous to G519
acgaggcactcgccccaatctcgaacaacggccgtcggatccatcatcatcggcagcggagcgattccatcgaccagctttctacagacggacatggggatgccggccgtgaggaggagggagagggacgcggaggcggagctcaacctgccccccggcttccgcttccaccccaccgacgacgagctcgtcgagcactacctctgccgcaaggcggcggggcagcgcctcccggtccccatcatcgccgaggtcgacctctaccgcttcgacccctgggcgctccctgaccgcgccctcttcggcacccgcgagtggtacttcttcaccccccgcgaccgcaagtaccccaacggctcccgacccaaccgcgccgccggcaacggctactggaaggccaccggcgccgacaagcccgtcgcgccccgcggcgggcggaccatggggatcaagaaggccctcgtgttttacgcgggcaaggcgcctaagggggtcaagaccgactggatcatgcatgagtatcgcctcgccgacgccggccgcgccgccgccagcaagaagggctcgctcaggctggacgactgggtgctctgccggctctacaacaagaagaacgagtgggagaagatgcagctgcagcagcaaggggaagaggagacgatgatggagcccaaggcggagaacacggcctccgacatggtggtcacctcgcactcccactcgcagtcccagtcgcactcgcactcgtggggcgaggcgcgcacgccggagtcggagatcgtcgacaacgacccgtcgctgttccagcaggcgacggcggcggcgttccaggcccagagccccgcggccgccgcggcgcaccaggagatgatggccacgctgatggtgcccaagaaggaggcggcggacgaggccggcaggaacgacctcttcgtcgacctcagctacgacgacatccagagcatgtacaacggcctcgacatgatgccgcccggggacgacctgctctactcctccctcttcgcctccccccgtgtccgcgggagccagcccggcgccggcggcatgccggccccgttctaagcagagcaaagacagagaccgtcagagaccccgagatcgacagaagtggaatggacgacttcttggccgcgagcgagcgagaccgcggtgcagtgtaaatacagcataggaaacgggagggagggaggtggcgtcgtgtcgagagaagccggcgtcgtgccggggcgtgccgttgtacatggagagcccggcgccggggcctggccggctgggttgattcttttgttcttactaccttgtactctcaatgcggatgtagctctttcttctcactcctcactagtagaatcgaccgaccgaatacatatgtagctctgttctttccttctcttcagtagaaatcaaccaaattttgctgttatgctgc

SEQ ID NO: 7035 - DNA, 764 bp, Triticum aestivum
  misc_feature (8)..(8): n is a, c, g, or t
  Predicted polypeptide sequence is orthologous to G522
tccaattngcaatgacagcttaatgtagtcttgagtcttgacaacacaaattaatatgtttttgctgatttagcttacattcatttgtgtacagagaaatgcaggatagggcctgaggaggagcagagtgactggtacttcttcagccacaaggacaagaagtacccgacggggactcggacaaaccgcgcgactgctgcagggttctggaaggcgacagggagggacaagcccatctatgcaaagcactgcttggttggcatgaggaagaccctggtgtattacaagggcagagctcccaatggccagaaatccgattggatcatgcatgagtaccgcctcgagaccaatgagaacggccctccacaggcaagctatagctatgttatttcacttgatatacatcgatctctgtccatcttgactcgaatataaacctgcaagctcctcgacaacaagaagagatctagatcatgatgcgccatgctggtacgtcgacgatgatgggcccttcatgcatgatctcaactctcccatgagaggaatgccacctcaccacagcatggcactacaagaacaacacctccagatgctcaacaacacctacaagagagagctgaagctgcaatatcaaatgccaaaccatcatcatgttctcaacaccatccctcacgagctagagagcccttcttccttccactctcttttggtatcgccagacgatcaccaaatcaatgtgcaccatgcccagcaccaccatgttc

SEQ ID NO: 7036 - DNA, 673 bp, Triticum aestivum
  Predicted polypeptide sequence is orthologous to G522
ggacttggtaagtggaacagagtgtctatctaggtacaagtgtccagtgcaacagatgcgcatggacatcatctactatctgtactcaatgatagtactaattattagaaaatcatgtatacaatgaaatcgatgctgctacggtatgtctgctaactctacttcactgctgtaggtgcagctgcgacgtggatagcaggctgtccaggaagttccaatcgatgccggccgctgcctgtccctgctgcacgacatcatagcccgcgtcgccgccaccggcaacggcggtggtcgtcggcgggctctcgatgagctgcgggatgttgccgaagagactctgcttggactccagcaggtcgtcagagtactggatgccctggccggggaagccgaggccgccggctccggcagcgcatgtggcgctttgcaggtaatggaggtcgccgccttggccgtgcagccatggccgcgcctcgtagtagcccccgaggcccggagcggcggcgtatgccgggaagatgtacgacggcctctggttcggggttggcttctggaacgcccggcacaccacccagccttcctcctgggtgggcgcgtgctcgctggtctgcaggcgatactcgtggatgatccagtcagtcttcctaccgttgggtgcacggcccctgtagaa

SEQ ID NO: 7037 - DNA, 587 bp, Triticum aestivum
  Predicted polypeptide sequence is orthologous to G525
gtcgctgcggcgattgaggatgtgaacctcaacaagtacgagccatgggagctaccggagaaggcgaagatgggggaaaaggagtggtacttttactgccgaaaggatcgcaagtaccccaccgggatacgaacgaaccaggcgaagaatgctggctattggaaggccaccggaaaggacaaggagatcttccacccgccgctcacactcatcggcatgaagaagacgctcgtcttctacaagggcagggcacctaggggggagaagaccaactggatcatgcatgagtataggcttgagagcaacaagcagctaacttccaacccgtccaccgcaacccgcaccgtcaccatcaccaacgcgtcttccaaggaacagtgggtggtttgtaggatcttccataagagcgccggactgaagaaggtggtgatgccgtcatatgtcatgccaatgtccatcggagcggaacatcagcaggggttcgccgacttagatacattgcctcctctcatgggctatgagatgtcgtcatcgctagcaaatccaatgttgcttcctacaacttctccttaccaattgcgcgacat

SEQ ID NO: 7038 - DNA, 597 bp, Triticum aestivum
  misc_feature (547)..(548): n is a, c, g, or t
  misc_feature (554)..(555): n is a, c, g, or t
  misc_feature (587)..(589): n is a, c, g, or t
  misc_feature (593)..(595): n is a, c, g, or t
  Predicted polypeptide sequence is orthologous to G525
gcacgaggatcaatcacagaaaatcgtccctccatatctccccagctcttcttcctcctccgacctcctcctcagctcccgtgtcatctggttcttcttcctcagatagcgaagaaggctagtagatccggtcgagagggcgcggcgatgtcggacgtgacggcggtgatggatctggaggtggaggagccgcggctctcgctcccgccgggcttccggtttcatccgaccgacgaggaggtggtcacccactacctcacccccaaggccgtcaacaacgccttctcctgcctcgtgatcgccgacgtcgacctcaacaagaccgagccgtgggatctccccgggaaggcgaagatgggggagaaggagtggtacttcttcgtgcacaaggatcgcaagtacccgacgggcacgcgcaccaaccgcgccacggagaaggggtactggaaggcgacggggaaggacaaggaggtcttccgcggcaagggccgcgacgccgtcctcgtcggcatgaagaagacgctcgtcttctacaccggccgagcgnnccgcgnngacaagacgccgtacgtgatgcacgagtaccnnntcgnnngc

SEQ ID NO: 7039 - DNA, 745 bp, Triticum aestivum
  Predicted polypeptide sequence is orthologous to G525
ccacgcgtcgccgcaagtaccccaccggaatacgaaccaaccgagccacaaaggctggctactggaagaccacgggtaaggacaaggagatcgtcaatccacattgcacgtccatgctcatcggcatgaagaagacattggtgttctacaagggcagagctcccagtggggagaagaccaactgggtcatgcacgagtacaggctcaagatcaacaagcagtcaacaaccagcctgcccagtgccataggaaatgctgcttctattaacatgtcttccaaggagtatgtggtttgcaggatcttccataagaacgctggaagtaggctttcatccatggtgtcacatgagggcaacggtggtgcaacacccaccgacaagatctggtcgatgagcatgggtacagatggggcatgttgaagtattgataatcagatgatccaagacaacatatatatgtgtgtgggcattaattagtcatccatcagaagatccatcgatatataccaacatctatatgggtttgcagcgcattttatttttagagagtttgcatgcaccacatcagaagatcggtcgatatataccaacatctatatgggttggctcgttgggctgccgctctgtgctagtgtgggtgtatgtgtatcggctgtacatgcaccacatatcggggtatacctagctacattgcatggtaaacttcctaggagtgtacaccaggcatgtttaatcctatatggaat

SEQ ID NO: 7040 - DNA, 608 bp, Triticum aestivum
  Predicted polypeptide sequence is orthologous to G525
ccacgcgtcgatggccatcaccctagaatccatggcagagaaatcctccaccaggacagaccaccttcaagttcagcaacagaagttggagctaccgctggggtttaggttccacccgacggatgaggagatcatcaactcctatgtgatccccaaggtgctcgatgaagccttcgtaaccgcggcgattgaagatgtgaacctgaacaagtacgagccatgggagctaccagagaaggcaaagatgggggagaaggagtggtacttttactcccgaaaggatcgcaagtaccccactgggatacgaacgaaccgggcgacgggtgtcggctattggaaggccaccggaaaggacaaggaaattttccacccgccactcacgctcatcggcatgaagaagacgctcatcttctacaagggcagggcgcctacgggggagaagaccaactggatcatgcatgagtataggcttgagagcaacaaggagctgacatccaacccgtccaccgcaacccgcaccgtcaccgccaccaaggcggcttccaagtgggtggtttgtaggatcttccataagagcaccggactgaagaagggggggatgccgtcat

SEQ ID NO: 7041 - DNA, 725 bp, Triticum aestivum
  Predicted polypeptide sequence is orthologous to G525
ccacgcgtccgacctgcccaccgacatcgtgagagccgcctccattaatgcgtcttccaatacttgttccaccgcaccacccttttaagaaagagcctcccccatggcagtccaccttcaagttcaacaacaacaacaacacctgaatctgccagcggggttcaggtttcacccaacggacatggaaatcatcaccttctacctagtccgcaaggttctgaagaaacccttcgatgttacagtaatcaaggaggtggatctaaacaaatgcgagccgtgggatctccgaaataatgtaaatatgggggagaaggaccaatacttcttctccaagaaggacctcaagtaccccaccggggtacgcaccaaccgggccacgaacgctggatattggaaggccactggaaaggacaaggagattgtccacccgccgaccatgagtctcatcggcatgaagaagactctggtcttctataagggcagagcccccaggggggagaagacaaactggatcatgcacgagtacagactcgagatgggaaagcaacacacaccggacctgcccaccgacatcgtgagagccgcctccattaatgcgtcttccaaggaggagtatgtcatttgtagaatcttccataagagcactggactgaggaaggtggtgatgccttcatattccatgcccattcccatgttcatgggggtagagcaacaaaaggtcttct

SEQ ID NO: 7042 - DNA, 1189 bp, Triticum aestivum
  misc_feature (992)..(992): n is a, c, g, or t
  misc_feature (1005)..(1005): n is a, c, g, or t
  misc_feature (1015)..(1015): n is a, c, g, or t
  misc_feature (1081)..(1081): n is a, c, g, or t
  Predicted polypeptide sequence is orthologous to G525
cgttacgttcctgccgctgccgattgagtccatatcatcatcaccagttccaaatgagggaaaaacaagtgatggagcacggcgagcaggagcagcacgccatggacctgccgccgggcttccgcttccaccccaccgacgaggagctcatcacgcactacctggccaagaaggtcgccgacgcccgcttcgccgccctcgccgtctccgtcgccgacctcaacaagtgcgagccctgggacctgccatcgctggctaggatgggggagaaggagtggtacttcttctgtctcaaggaccgcaagtacccgacggggctcaggaccaacagggccaccgagtccggctactggaaggccaccggcaaggacaaggacatcttcaggggcaaggccctcgtcggcatgaagaagacgctcgtcttctacaccgggagggcgcccaagggcgacaagtccggctgggtcatgcacgagtaccgcatcaacgccaagctccacgccgccagcaccagccgcggctccctctccggcggcagggccgcatcgtccaggaacgagtgggtgctgtgcagggtgttcaagaagagcctgctaggcggcgtagtgtcgtcggcgccggcgtcgtcagcagcaaagaaaagcggcgtggggacgatggaggagatagggtcctccgtggccgccgtcaccccgctccctccgctcctggacatgtccggctccggcgcctccttcgtcgacccggcggcgcacgtgacctgcttctcccacacgcgctggaggcgggccagttcttcaaccgacggcgacgggcggctgcgccacggacacggaccacacgggctagcctcatcgtactccccgttgggcagcttcacgcagtacggggggcagctgcaccacggcgtgagcctgagcctggtgcagctcctgaagagcagcgggtaccacgcggtctcgccgacgacatgcgccgggcggcaatagcancaccagcgggggnttgtagggcnaccgggaaagctaaccgtcccaggaaccggcctcactcgagctgacccgaaatttttcctcttggncaaaattgaaccgagcgggccgggggttatgacaaaaacctcccatcccggttcggggaaagaccaccattttggctttccgggttgactggtaatcccgagggcgaa

SEQ ID NO: 7043 - DNA, 1071 bp, Triticum aestivum
  misc_feature (625)..(625): n is a, c, g, or t
  misc_feature (1018)..(1019): n is a, c, g, or t
  misc_feature (1024)..(1027): n is a, c, g, or t
  misc_feature (1036)..(1036): n is a, c, g, or t
  misc_feature (1048)..(1048): n is a, c, g, or t
  Predicted polypeptide sequence is orthologous to G525
ggttgtacttcgacccacgcgtccggacgaaatcacctctaacatctcgatctacctcttcctcctcctcagctctcgttccatcaggttcttccacagcgtagcaaggcaatctagtagatcctccatgtcggacgtgacggcggtgatggatctggaggtggaggagccgcagctggcgcttccaccggggttccggttccaccccaccgacgaggaggtggtcacccactacctcacccgcaaggtcctccgcgaatccttctcctgccaagtgatcaccgacgtcgacctcaacaagaacgagccgtgggagctcccgggcctcgcgaagatgggcgagaaggagtggttcttcttcgtgcacaagggtcggaagtacccgacggggacgcgcaccaaccgggcgacgaagaaggggtactggaaggcgacggggaaggacaaggagatcttccgcggcaagggccgggacgccgtcctcgtcggcatgaagaagacgctcgtcttctacaccggccgcgcccccagcggcgggaagacgccgtgggtgatgcacgagtaccgcctcgagggcgagctgccccatcgccttccccgcaccgccaaggacgattgggctgtntgccgggtgttcaacaaagacttggcggcgaggaatgcgccccagatggcggcggcggccgacggtggcatggaggacccgctcgcctccctcgatgacttgctcatcgacaccgacctgttcgacgacgcggaccttccgatgctcatggaatccccgtctggcggtgacaacttcggcggggctttgaagctccaccttgaagggcggcccctcccgtttgagcccggaagcggagcctccgggtggctgcatccgcaggagcaagcaatgaccccaaattacttttttattcccggggaacgggcaacggtgaatttttggggggggccgggggaactcccccctacccggggttatgggggtgcccaagagggccgcgaaacttaaaannttttnnnncccccgccncggggcgggttnccttctttcctctggggccgggt

SEQ ID NO: 7044 - DNA, 547 bp, Triticum aestivum
  misc_feature (8)..(8): n is a, c, g, or t
  misc_feature (522)..(522): n is a, c, g, or t
  Predicted polypeptide sequence is orthologous to G559
gcctgttnttttccctaaatgccaacgggcaaaccatcagtgtctgagtttagttaacaacaacaacaacaacaacaacaacaacatggagtatgcccataactggacgcaacaatgcatcttctaccggaccaaaaccaaaaggttcaacctagaattcccaaagtgacttccttcaacaactacagacaaacgcttcccacgacactgtcaacacctgtgatcgatcgtcccaactgttcaattgaaactaaaaaagccaacaccaaagccactacacctgcgcattatcatcatcatcatcatctccagacctagttgtttcagatgccgccgcttcccgacgacttcccgtcaccccacatcggctgctgctgctgctggggctgtggatggagctggagctgttgcagctggtgtgtcgctagcagagactgcatggactggttgttgtggaacatctgctggttgcttccgaattggtgtggcgcctgtgacatgccgccatagttcatcagcatncccccaccgttgcccgtctggcctg

SEQ ID NO: 7045 - DNA, 837 bp, Triticum aestivum
  Predicted polypeptide sequence is orthologous to G559
tagggcctatttaggtgactccatagaacaagtttgtacaaaaaagcaggccggtaccggtccggaattcccgggatatcgtcgacccacgcgtccgagcccaaaccaccctcgcctctcgctcccattccccttgcccagctccgtgttcttgcgacccagctcctagatcttcctccccctttccctcgcaagaatttccacccgatttccgcgctctggtcgctcttcttttagccaagaatttcctccgattcttttccagcgtaatcttagttctgagccgtatgtgttgttttcttggctgaagcttgattagctccgtggacttgcaaaaaggcggcgcgtttgaggagattcggcggggccctggtgccgggaagatgaacaaggacaggtcccggatctcggcggacggcggcggcggcgacggcctgccgccgcagccgtcgcgccgctcggcgactcccccgccggagtacgacatcagccgcatgccggacttccccaccaggaaccctggccaccggcgcgcgcactccgagatcctcagcctcccggacgacctcgacctctgcgcgcccgggggcggcgacgggccctcgctgtcggacgagaacgacgaggagctattctccatgttcctcgacgtggacaagctcaactcgtcgtgcgggccgtcgtccgaccaggcggagtcgtcgtcagccgctgctgccggcgggggcgaagcggcccaggcgggccacgtgatgaggccgaagcaccagcacagccagtccatggacgagtcgatgtcgatcaaggccgaagacctggtggggcgcccgggattga

SEQ ID NO: 7046 - DNA, 1123 bp, Triticum aestivum
  misc_feature (675)..(675): n is a, c, g, or t
  Predicted polypeptide sequence is orthologous to G562
tcatgctccaacgcgtccccgagctgaggatatggtcgacctgcaggcggccgcactagtgatttcgagcggccgcccgggcagcatttgatagtgttcttttggtgcaggctgagacagaggaattggccacacaagtagaatcgcttacagctgagaacacgtctctaaaatctgaaatcggcaagctaacgaaaagctccgagaagctcagaatagagaattccgctctagtggtgaaacttaagggcaccgcagcaccgaccagcgcagaaatgcctctggacaaaacagcagttgctgcaccctcctcctctcctcgtgtcgtggagaatttcttgtcgatgattgacgacacaagcaagtcaggtgtaaaaaatcacatggagcacagcgagcccaagctccgccagctcctcggctccagcgcgacaacggatgttgtggctgcaaactgattgatcagcctctctctggcgcagactaataccttgcatgcggcctggggtttcagcaagctcatgctgctcacataacatatcggcgtgacagtgtaggtatttttatttggtgagtatattcaggaactccggcggtcatatctactccgtattccggttcccgacggctactgtactttaggcactgatgctgaagtctcggtgtgtccatgtntacactgtaattttaatgagcagtgttgtaatataggggtgttgcgcttcatgccaacctttctaaaaaccttttgagaactccaaaaacctgcccgggcggccgctcgaaatcccgcggccatggcggccgggagcatgcgacgtcgggcccaattcgccctatagtgagtcgtattacaatccactggccgtcgttttacaacgtcgtgactgggaaaaccctggcgttacccaactttaatcgcctgcagcacatcccctttcgccagctggcgtaataacaaaggggccgcaccgattgcccttccaaacagttgcccacctgaatgcgaatggccccccccgttacggggcataaggcgggggggtgtggtgggtaccccccaggggaccgttaacttgccagggcccatagccccggccctttcggttttttccttccttta

SEQ ID NO: 7047 - DNA, 652 bp, Triticum aestivum
  Predicted polypeptide sequence is orthologous to G568
tttttttttttttttttttttttttgaagtaaaattagattcttatttagaaatacaatacaaaatgtggatgctcgtgtaggcacacatacacttattcggttgaacacacccactcagacaccatccatctaaacagctcgagagagtgtgagtatgatcagaagtcacaggtagctactctcattagtcaagtgctctcagcccgaaggcaacgtacgtacaaggagctgtatcgtacatttgcacatacaatacaaatccctattcgtacgtagtgataaacgtgcatgtgctgtgctgaaaaagattgtgagcgttaatacgccatctgcagggacttgacccagtcccagtcctcgtcggactcgagaaacgacgctaaggctcttacgtcgtccatccagtcgccaccgcccgacgatgccaccaagctgctgccgctgcactcatctgcgtctcctcccacggcccgcgtctccatgaccggcgggggcggcgcatcccggctgaggaagagaccgcctgtgcacctcacgggcttgggcacccacaccgaggccgacgacagcagccccgcagccttggcacttgtaccatccccgcagttagaggaaagccatgctgtcgacgccccgggtggaggagccgg

SEQ ID NO: 7048 - DNA, 1045 bp, Triticum aestivum
  misc_feature (33)..(33): n is a, c, g, or t
  Predicted polypeptide sequence is orthologous to G591, G793
tacgccagagcggccgccctttttttttttttntgtagctctccgcatccctcacatacataggggtattgaaagatgtaggagcatgatcaggttattgcttaccatatccttgaaaattaaaagtacctttgaacaaaagatggaaaaggggtagtaggtgacatcatataccgtcgatacaacttccagtggagaggatcctttaggtcttttcctgcctccttgtagttagtggatcagaaccagcagtttttatcttaacactttgataacaggttcatgcatgcctactagcagctgcggggatgggtgttgcagctgctgttactatactaggcagtgttgttgggttcaggcttcactggttggccgtcctgtgaatgttgtgtgtcatagatagccatggcaagggagactggcatcatgcagagagcctttgattggagaaattgcattgcggcaccgatgtcctcgtccatcagcttcgcaacctgtttttccgtgccatccgttgaccacttttcccatatctgctgtttgctcccaccatcgcctgcttcccccttaactgaaagtggaatgtcagaaaccagctgtgcaacagcaccagcaccacccaatctgctcatgcttaacacctttacttgaagcctaaggaacttcacataatccaggatctcatctagcataactgccctatctgtcttgttcgtattggggacaattcctgtagggccctcatcctttccggtatcctctctcttcttagcctctccgcgatgctgtggggatcagtcgcctgaacgggacgcgcccgcaccttcgggctcggggccgggggctgggggccctcaagccggcccgccctgcttcgggttgtggggcgtggaacaatctttgggggaaggttgcttgggccaaaggttcggcggctggaagcccccccccaaaacccgggggaaaaaacgccgggaaattgacacccccccccttccccgggggtttcccggggtttctccccatatccgccccctttgcggga

SEQ ID NO: 7049 - DNA, 841 bp, Triticum aestivum
  misc_feature (21)..(21): n is a, c, g, or t
  Predicted polypeptide sequence is orthologous to G598
gaccccacgtttagttagtancttatcatacgactttgtattgggaccactttgtacaagaaagctgggtacgcgtaagcttgggcccctcgagggatactctagagcggccgcccttttttttttttttttttgtcacatatgaacaaatgctctgaatgtttgcaggtttgtggcaaacacactattcattccatcttcacaccagttttgcgtgcatatacaagccaaacaaaaaagcgccaccgtgtgatccgtgatcgccaccggcggccagtatacaacggaggcagcagcagcaggtttcaaatcctttttacaattaggtttcccggccgatcggatgcagcagcacacgccctttacgacctataggcaaaaacacatacgtaggattctccagttgaggaggccggcgggctagaagaatgagcgcttggtgggcaccctgcccacggccttcatgaagttggccagctccagcaccttggccagcttgagcccccgcttggcctccgccgacgcccgcttctcctccgccttgtgccgcgccttggccacgtcgttctgcgtcttctccaccgccttggcgcgctgctcgtccagcttcctctcaatcttcttgagccaggcggacgccttgtcgacctgctccgtctcccagccgttgatgaccacctcctccctcttgaaccggtttgttgatctttgcgatctcccgcgtctggcacgccgaccaccttggtctccaactcctccttcttcaccttgggtcgcttccaccggcgggccggccggggggacgacctcaaggtcaaaccgggccccccttccggttttg

SEQ ID NO: 7050 - DNA, 1049 bp, Triticum aestivum
  misc_feature (761)..(761): n is a, c, g, or t
  misc_feature (826)..(826): n is a, c, g, or t
  misc_feature (832)..(832): n is a, c, g, or t
  misc_feature (839)..(839): n is a, c, g, or t
  misc_feature (847)..(847): n is a, c, g, or t
  misc_feature (851)..(851): n is a, c, g, or t
  misc_feature (1006)..(1006): n is a, c, g, or t
  Predicted polypeptide sequence is orthologous to G598
ccacgcttccggacacagcaagaacgagtcagtcaagagggcgaggcgtccactgctgattcgcctcctcccgcgcgtggtgccccgtccccgccggccggcgccgacacatgttgcatgagcggcacgcaccaccctccgcgtccgacgacgaggacgatgccctaggggccaacgacgaggagggcactctggtgaccaccaccgccagcaccaccaacaccaccttccacgacgtcgacgaggtgatcgaggtgcgcgaggtccaccccctgtcgccgccgcacccgcccttcacgccgcccacgcgcaccctgtccgccgcctccaccgcctgggacagcgccagcagccaccgctccgtcacctccgaggagcagttcatgacgatgagccgcgagttcaccgccatggtcgccgccggcgccggcaccggggcggccaacagcaaccccaacagtaacaacagcaacagcaaccaccacccaggcggcccctacgacggcggccccgaccagctgaccagcatcggcgaggacgagctggaggagcacaacccgctggccatcgtgccggacagcggccgccccttcgccacgccgcccagcaggagcggcggcagcagcggcagggcggcgcggctcgaccttgaggtcgtccccgcggccggcccgccggtggaggcgagccaggtgaagaaggaggaggtggagaccaaggtgtcggcgtggcagacggcggagatcgccaagatcaacaanccggttcagagggaggaggtggtcatcaacggctgggagacggagcaggtcgacaaggcgtccgnctggcntcagaangatgagcntcantcatgcactttctgcgccaaaagggagactgtgtacctgtgagaatatcatgggacgttagcacgttcatctcacggcgataggactgttctatgagagtggcggcccttgttcggggagaaccactagtagtgcaggtgaaaatcatgcctgcntgctggccagttagtgtattctatctggaagttcatcccggca

SEQ ID NO: 7051 - DNA, 1146 bp, Triticum aestivum
  Predicted polypeptide sequence is orthologous to G598
gcggccgccctttttttttttttttacttcccattctcacaccagtttcttcgtgcacatacaagccaaacaagaaagcgccgccgtgtgatcaccaccggcggctagtatacgacggaggcagcagcagcagcagcaagttttcaaatccctttttacaattaggtttcccgaccgatcggatgcagcagcagcagcacacgcccttactttttacgtactacccataggcaaaaacacataggatttctcccctcctccggctgggggaggctagaagaaggagcgcttggtgggcaccctgccgacggccttcatgaagttggccagctccagcaccttggccagcttgagcccccgcttggcctccgccgacgcccgcttctcctccgccttgtgccgcgccttggccacgtcgttctgcgtcttctccaccgccttggcgcgctgctcgtccagcttcctctcaatcttcttgagccaggcggaggccttgtcgacctgctccgtctcccagccgttgatgaccacctcctcccgcttgaaccggttgttgatcttggcgatctccgccgtctgccacgccgacaccttggtctccacctcctccttcttcacctggctcgcctccaccggcgggccggcggcggggaccacctccaggtcgagccgcgccgccctgccgctgctgccgccgctcctgctgggcggcgtggcgaaggggcggccgctgtccggcacgatggccagcgggttgtgctcctccagctcgtcctcgccgatgttggtcagctggtcggcccgccgtcgtagggccgaaggggtggtgctggtgctgttgttgccgtggccttgttgttggccgccccggcgccggcgccgggggggaccatggccgttaacctcgcgggtcatcgtcatgaactggtcctcggaagggaaggaacgggtggttgctgggcccgtcccaggcgggtgaccccgcggaaaacgttccctgtggcgggttaaagggggggtctgcccggcgggaaaaggggggggacactgcgccctccaataacgggcccaacctccggaaaggggtgttggtgggtctggcaccacaaaggccctcccgttggttgtccccgggggaatgccctc

SEQ ID NO: 7052 - DNA, 691 bp, Triticum aestivum
  Predicted polypeptide sequence is orthologous to G634
cgcggcaccaacaggcggcggctcggcaaggggccgtacggccgtgggtccaccgccccaggcaccccaacggctgtcgccggcggcggggccgacgccatcggagccgccgtcgcaccggacgtgctgttcatcgcctcgagctgccggaagaagcggtacgtcttgccgtcgttgcggccggcgcggctgtccttggtgcgcttgtagtacttgtgaacgttctcgaacttctccttgcacttcttggcgttccgcctgtacccctcctcggccagcttcctggagacctcttcccagagtgggcccttgagggtggcgtcccggaaggcggcgtccatgtccgaccggatcttgagcagcgccagggtctcctgccgcggccaccggtttcctccagcgccgccgcccaagccttcctcgccggccgcgagcgcctcttcgtcgcagcccacagcgccggcacctgctagctcgttgttgagctgctgctgctgaggcggcggcggcccaggcgccggcgggcggctgctgatgggcgagggcgcctcggccatcgagatccgctgctggccggtgctcctggacggcgagaatggcggcatctctgggggatgcaggccgaactgctgtcccgggcctccaccctgatgctgcggttgctgctgctgctgctagtacacactgggtg

SEQ ID NO: 7053 - DNA, 596 bp, Triticum aestivum
  misc_feature (233)..(233): n is a, c, g, or t
  misc_feature (251)..(251): n is a, c, g, or t
  Predicted polypeptide sequence is orthologous to G635
ttttttttttttttttttttaaacaataaaatttgtaagatgggccagggcttatatgaacatagaagcaacagtcttacagcctagatgactgattacagagatgagaggtggttagaagtaatagctagcactgtccaaaagttgtgaactaatagaaggtcggttcatgccaaaagcaaattgagattccatgacccgcaatggacagcaatataatacatgtttcctanaagcatacagaggagtanaatcatggcaggcgcaaattgagaccccgatatatcacttcattcacaaagtgagcaagcaggaacattgatggaagctacagtttgtaataaaatctcaatgtgaatgtgccacaacagaacccaaagcatcttgtatttcgtcaacggtagccatcacactagttagatatatctactcattatcaagaatgtctgagaaactttgtgcttcatatcaaagatcatgcctcggctcatccagatggttgtcgtcaccagcctgatctgccccagtggcagagccagaaacttggattagggaagccaagtgctgtcaaaatagcttatggagggccaaaccat

SEQ ID NO: 7054 - DNA, 1635 bp, Triticum aestivum
  Predicted polypeptide sequence is orthologous to G635
ctggtgccgaattcggcacgagatcacgatgaactggaggaagttctacagattgttaaaccgcagcatttcttgcctgttcatggggaactcttgtttctcaaagaacatgaattgctaggaaggtcaactggcataaagcacactactgtaattaaaaatggggagatgcttggtgtatctcatctaagaaacagaaaggttttgtcaaatgggtttgtttctttagggaagcaggactttaagctaatgtatagtgacggagacaaagcttttggaacgtccactgatctctgcatcgatgagagattcaggatcgcatctgatggcattatctttgtcagcatggagatcttccgacctaaacctgcttcaccacagtctggcttgaaagggaaatttaaaataacaacacggtgtctatggcttgataatgggaggctacttgatgcactttacaaggctgcgcatgcagcattgtcaagctgtcctttgaattgcccacttagtcacatggagcgaatggtatctgaaatcttgaggaaaatggttagaaagtacagtggaaagagacctgacgtcattgtagttgcttcagagaacactacagtaggtttctcagaagaggtaataaataggcatatgagtctagactatgagaaaacacggccagagaacccagagcgtgaggctgaagagagcatccctgaggtcatgagaacaacacctgacgatgcaaccactagctccaatggtgaatcattcttctctcctgatttacatcagcctaaaacattggatcatttttgggagtcgttcaagtcccctacagcagtaaaaattgcaagaattgtcaatgcttcagctcaagggaacaaaccaaagctcggcaagatcagcataatagataaggattccagcacgtcagctcctgctgcagctaaatcttcaagaaagaacaagtggaagcccgaggaaattaagagcttgatacagctgcgtggagaaatgaatgagaaattccaaaccgtcaaaggaagaatggttctgtgggaagagatatctggtagcctgttgaagcaggggataactcgtacaccagcacagtgcaaatctgtgtggacatcattgcttcagaaatacgaggagagcaagaaggatgaagaaaacatgcagacatggcaatatttttcggccatggatagttttttatcatgcgaaggggaaatggcaaccaaatgaaacagatctgtaataaattgcttagcgatagttatttggagatcagtgtattgtaggtagcccgtgaatcgacgacaagatcaacagcctctccaggaagtaatcctatcacgtcattctttgccattgcatgagatgcttggggtagttaagtgaaactaggtttaccaatccaccatgttgtattagtttttgtgggatcagcaactagatctatcaattgattagtcagttaagttgcaacattagcatgtaaaaaggcgcactcgttacggaatggattaattctggcctcacatttaggctgtaacaaggtggagattgagtccgatcgtgttcctgtgattgaagctacaaaactactactccctctatctcaaaaaaaaaaaaaaa

SEQ ID NO: 7055 - DNA, 838 bp, Triticum aestivum
  misc_feature (579)..(579): n is a, c, g, or t
  Predicted polypeptide sequence is orthologous to G653
ggcctgccagctgttctacgtaccagctatactacgcgacggatgggcaatccaagtttttgatccttcagtcggtcccaaaggatgcagccaggatcagcaggctcgacacgagcttattgcgtcgtgcttacataatgcattgttcgggtgcctgcatgctgggtggccaacacgaaaggataactggtctaccatttcccctgttttatggataccacaattaccagggaggaaactggtaatttcgtcatgcacatcattaggtaccacgatggagagagtataccgatcaccaagaacaaccttgtgaaaactaaaagtacattctgcaagaagttatgaagctccaggggaacagttcatcattgccagccgatgcactatggtcagttcatgcccctaccgatggttatgaagctccaggggaacatttcatgcgacccatttagcgtgcccactacggacattcaatgaatattcattgtgtcaatccatgttgtatcgctatacatgactaagtgtgtatcgtacatttcctccaaaaccatctacctaaatggacaacctattatattnttcatgcgttatcattctaaaaaaaaaaaaaaaaaaatcggcacgaggagagagagagagaactagtctcgagttttttttttttttttttttttaaccgcacatactaattgaaagccgaaacacgtcgggaaccaggaacgatcgtcaccttaaacaacatgcattaatgcctgcttgaaaaatgaagagggaaaaacccgtgggactaccttattttttgggcattcttaaggtaaagaagtcccgtttcgaataa

SEQ ID NO: 7056 - DNA, 692 bp, Triticum aestivum
  Predicted polypeptide sequence is orthologous to G653
tttttttttttttttttttttttttttgcacaacgatttctttgaaagggacatgatattcatggttcaccaatgtgatcgagtctagcacagcagaggacacgaaattgataggtcccggtatcctcagaactggaacatggcatacaagcaggttgtaaaacagagggcttccgaattttcgccctcaagcctcactggagatatggtacattcagggagggaattcttgcagcggccggtggtggtgccggctgtgcttcggcgcgcttgactgatgcgcatttgatcagatggttgtagctccctttctccttgaaaagttgggagaaatggtgcttgcagtataggataccttccaaagctgcataattggatggcgaaatggcacagccaccgtgagaacatttgaagcaggacttgtggtaggcctgtccttcaactgtcaccttctctagaggatacgctgttttactgcaagtggcacacttctcctgtgtccctgaaaacatgcgtgcggctttgctaggtgatcttgtcagctcaggagtcaacttctccgatgcgggtttcgcgggtgattggaagctcttgttgtagctcccggtctccttgaacagttgctcgaaatggggcttgcagtatggcactccttcaatcgaggagtagttgccaagggagagggtggactt

SEQ ID NO: 7057 - DNA, 1160 bp, Triticum aestivum
  misc_feature (14)..(14): n is a, c, g, or t
  misc_feature (981)..(981): n is a, c, g, or t
  Predicted polypeptide sequence is orthologous to G653
cctcgtgcttactncgacccacgcgtccgtgcaaggtgtgcaccaagacggtgtaccccatggaccagctctccaccgacggcgccgtcttccaccgcgcctgcttcaagtgccaccactgcaagtccaccctctcctttagcagctactcctcgtttgaaggggtgccctactgcaagccccatttcgcgcagctgttcaaggagaccgggagctacaacaagagcttccagtcacaatcacccgcgaaatctgcgacggagaagctgactcctgagctgaccagatcgccaagcaaagctgcgggcatgttttcgggaacacaggacaagtgcgccacttgtggtaaaacagcataccctcttgagaaggtgactgttgaagagaagtcctaccacaagtcctgcttcaaatgctctcatggaggctgcgccctctcgccgtccaactacgcggctttggaaggcatcctctactgcaagcaccatttctcccagcttttcaaggagaaggggagctacaaccatctgatcaagtgcgcatcggtcaagcgcgcagcagaggcgcaaacagcacaggcggcggcacaggcagcgccggcggcagctgaatcctcctgattatgctgtcatctttaaagtgggctttgagggcgaaagtttggaaagccttgctctttttttacgattgtaacctgctgtgtgctgtgttctagctctggggataccaggaccatatttcgtgtccccttatgtgctagctcgatcacgttgttgaaccatggagttggatgtcatttcggaagaaattgttgtgcatcaaaaaaaaaaaaaaagggcggccgctctagagtatccctcgagggggcccagccttacgcgtacccaagctttcttgtacaaagtggtccctatagtgagtcgtattataagctaggcactggccgtcgtttacaacgtcgtgactgggaaaactggtagnctgggattcttgtaaggaaccttacttctggggggtgaataatgggacaactacctacgaaatttaagttctagggtaatttaaattttaagtgtttaaggtgtaaacaaccggatatgctgccgcttgaaagtttggtttctgagtttatttttgaaattttaaccgggagctgtgtt

SEQ ID NO: 7058 - DNA, 232 bp, Triticum aestivum
  misc_feature (120)..(120): n is a, c, g, or t
  misc_feature (129)..(129): n is a, c, g, or t
  misc_feature (191)..(191): n is a, c, g, or t
  Predicted polypeptide sequence is orthologous to G664
aaaatctccggcttaccatttgtgtgaaggccataacccggcgtgacgtcattccctggactccgggtaatccgccgtgacgtcatcttccattaagcccgttttttactccaccagatncgcaacggntcttatctttactaccatcccgaaaatcgaggcgtttcatggggagataaccacgccgtggnctcctcgttttgcgccatgcattacattcaaaaaaaaaaaa

SEQ ID NO: 7059 - DNA, 371 bp, Triticum aestivum
  misc_feature (292)..(292): n is a, c, g, or t
  misc_feature (325)..(325): n is a, c, g, or t
  Predicted polypeptide sequence is orthologous to G664
gcagatggccggcgagtgctgcagtatacgagtattctgttagcccaatgagccaattttatctacctgtgtcgacttataggcaaactgataatgaggacgttgagatcagatacatacctaaagggaattctaagatgggcgttatttctatcgaaaaaacatctcatttacaaagttcccttcaattcaaacttttccgtcgatggtgaagaatttgggtcaaacattatctttaagcccacccacaaaagaagacgacctaaaccaatgttatttaacaagatagagnttccgcaaattggacaagaactcaaaaactccnggcttaatggggataaatataaatatattaattcaaaaaaaaaaaa

SEQ ID NO: 7060 - DNA, 1336 bp, Triticum aestivum
  Predicted polypeptide sequence is orthologous to G666
gcacgagagcgggcgagacgtgagcatggggaggccgccgtgctgcgacaaggagggcgtcaagaagggcccctggacgccggaggaggacctcgtgctcgtctcctacgtccaggagcacggccccggcaactggcgcgccgtccccaccaggaccggcctgatgcggtgtagcaagagctgccggctccggtggaccaactacctgcgcccagggatcaagcgcggcaacttcaccgaccaggaggagaagctcatcgtccacctccaggcgctgctcggcaacaggtgggccgcgatcgcctcctacctccccgagcgcaccgacaacgacatcaagaactactggaacacgcacctcaagcgcaagctgcaggcggggggcgacgccgcggccaagccggcggcgcagaggcctgcctcctcctccaagggccagtgggagaggcggctgcagacggacatcaacatggcgcgccgcgcgctgcgcgaggcgctcaccacgctcgacgacatcaagccgcagcagcccgacgcggccgacggcgtcaatgggcctgccgcagccggcgccgacagcggcagcccggcggcctccagctcgtcggccgcgtcgctgtcccagtgctcgccctccgcggctgggccgtacgtgctcaccaccgcgaacatctcgcggatgctcgacgggtgggccagcaagggtcgcagcgccggggccgcggcggacagcccctctggctcgtcggcgtccgaggtttcctacggcagcggcgcggccgcccgtgcgctggggtccgcgttcgagtacgacaggaagccggccgttctggcgccggatcagacgcagctgaacgcgatcgagacgtggctcttcgccgacgacaacagcaacaacgaccaccatggccacggaggcggcggcagcggcctgctcggcgtcgccgccatgggttaccctttctagctagctccaccgtgccaagttatgaaggtcgatgttcccctagctcttgcgttactgatgcgaggagtgtgttcactgcatgcccacctaacgaaaactacatagatcctctagtagtagtacctcggtggctatggcaatcagcttccttggtctcgtgtttacttaggatctgcatagttttcatttagggaaaagaagggaggttgtggtagcttagtgctcctgttatttactgctgtaactgtgacttggtactatgttatgttcatgggttttgggttttgtactttgaagtagatccgctgtttgcaagctgcaaaatgtggacgaataaagtcagtatgtcaattagtaaaaaaaaaaaaa

SEQ ID NO: 7061 - DNA, 675 bp, Triticum aestivum
  Predicted polypeptide sequence is orthologous to G666
ggagtatatatggaggactcgcttttatgttgtgtttgtgaaagatcttgaccgtgcctattttgagatttggaagcgggtcaagggtcagacaagtttcagagatgctctgcaggaagtttgcactgagaatttggtaccatcgcgccagcaaactttgaaggccgagctgcagcggcccggaggctttttgcaactggagcggcaattccgccggtgcacagagggcattagtaaggaagtgaagcttccggattggagagtccaagagttgattgcgcaggaaattaattacaagcgtgcattgccaaagacgtatgcacactacgccaggaagaagctccagattgcagaagtcttaggaatgattcccaaggccgagataccagcgtagatgtgtttgttgctggcgtccatggtgatcgtttggcattagatgcccaagtacacctgggcttatatatgacgtaccctttgagcaaattcttcatatgttacccaacataagatgtgcctcaagatcttatatgatgatgtctaacttatttctattctctgttcacaaatataatatgttctaacttattcctgactcggatgtgtgtagacacatttaagtgtgttgggtcctcattttggtccgcctgttgtcctaaagatcttatatttgtgttg

SEQ ID NO: 7062 - DNA, 1218 bp, Triticum aestivum
  misc_feature (822)..(822): n is a, c, g, or t
  Predicted polypeptide sequence is orthologous to G675
aaccaacgcgttggcgagctctctctatggtcgacctgcaggcggccgcactagtgattagcgtggtcgcggccgaggttagggaggagaggcagatagctttgtctccctccttcccacctgcaccatcctaccccaattctacctcaatcctatcaatggggaggtccccttgctgcgacgagaatggcctcaagaaggggccttggacacccgaagaggaccagaagctcacggactacatcgagaagcatggccatgggagctggagagcactgcctaagcttgcaggactcaacaggtgtggcaagagctgcagactgagatggaccaactacctgaggccagatatcaagagaggaaagttcacacccgaggaagagcagaccatcctccagctccactccgtccttggcaacaagtggtcagccatcgcgaagcacctccccggacggactgacaacgagatcaagaacttctggaacacccacctgaagaagaagctgatccagatgggcttcgacccgatgacacaccgaccgaggaccgacttcttcgccgcgctgccacagctcatcgcgctcgccaacctccgccagcttgtggagcagcgcccgtgggacgatcaaagcgccagccagctgcaagccgatgcagtgcaggcagcaaagctcgagtacttacagtgcctgcttcagtccgcagcagccattgcaactagtcccagctccagcagcatcaacaccatccccactgacctagagcaaatcggcctcctgagtccttcgcagatgtcttccttgtcttcgctgtcatctccanggatcctggagggtatcaatggccaagacttagtatccgggcaagtgcctgacatccaggtacctagtagctcattctttgaacatgaacagcctatcatcaatggtaccaaccagaactcagattacagttgcaacagcggtgaaggggagaatggcacccagaaacgctgctcctgtcagaggactcccttcggcacttaccgactttcctatttcaaactcggggatgctgcagcacctcagctgtgacgctagggcacaacacccagttcttaattggtcgattcatttatgattagttatgacccagttggatgattctgaccgcaagggttggcaccttgggttgcttttcaatttggtttcccaaattaaccctattgggaatgggtca

SEQ ID NO: 7063 - DNA, 767 bp, Triticum aestivum
  misc_feature (349)..(349): n is a, c, g, or t
  misc_feature (372)..(372): n is a, c, g, or t
  misc_feature (384)..(384): n is a, c, g, or t
  misc_feature (424)..(424): n is a, c, g, or t
  misc_feature (462)..(462): n is a, c, g, or t
  misc_feature (475)..(475): n is a, c, g, or t
  misc_feature (506)..(507): n is a, c, g, or t
  misc_feature (512)..(513): n is a, c, g, or t
  misc_feature (535)..(535): n is a, c, g, or t
  misc_feature (539)..(539): n is a, c, g, or t
  misc_feature (580)..(580): n is a, c, g, or t
  misc_feature (594)..(594): n is a, c, g, or t
  misc_feature (596)..(597): n is a, c, g, or t
  misc_feature (602)..(602): n is a, c, g, or t
  misc_feature (622)..(622): n is a, c, g, or t
  misc_feature (630)..(630): n is a, c, g, or t
  misc_feature (641)..(642): n is a, c, g, or t
  misc_feature (647)..(647): n is a, c, g, or t
  misc_feature (663)..(663): n is a, c, g, or t
  misc_feature (667)..(667): n is a, c, g, or t
  misc_feature (681)..(681): n is a, c, g, or t
  misc_feature (685)..(685): n is a, c, g, or t
  misc_feature (690)..(690): n is a, c, g, or t
  misc_feature (693)..(695): n is a, c, g, or t
  misc_feature (697)..(698): n is a, c, g, or t
  misc_feature (701)..(701): n is a, c, g, or t
  misc_feature (705)..(705): n is a, c, g, or t
  misc_feature (710)..(710): n is a, c, g, or t
  misc_feature (713)..(713): n is a, c, g, or t
  misc_feature (722)..(722): n is a, c, g, or t
  misc_feature (725)..(725): n is a, c, g, or t
  misc_feature (728)..(728): n is a, c, g, or t
  misc_feature (732)..(732): n is a, c, g, or t
  misc_feature (735)..(735): n is a, c, g, or t
  misc_feature (737)..(738): n is a, c, g, or t
  misc_feature (749)..(749): n is a, c, g, or t
  misc_feature (751)..(751): n is a, c, g, or t
  misc_feature (755)..(755): n is a, c, g, or t
  misc_feature (759)..(759): n is a, c, g, or t
  misc_feature (762)..(762): n is a, c, g, or t
  misc_feature (766)..(767): n is a, c, g, or t
  Predicted polypeptide sequence is orthologous to G707
gcacggctcaaggacgaactcaaccgtgtctgcaccctcgccaccaagttcctcggcaagcccgtgtcccttctgtcgccactccagctgcagccacacctgtcgatgcccctgccgaactcgtcactggagctagcagtcgggggaatcggtggcatagggtctatgcagccttcgatgcacggtatgatgagtgagtatgccgggggtgcctcaagctcgatgggcaccgtgatcacaccagcacgggcaactgggtctgctttagcatcgatggtggacattgacaggtctgtgttcttggagcttgcaatcagtgcaatggatgaacttgtcaagatggcacagncgatgatcctttgtggggttacnggattgcctggntttccggacaagggagtcactcaactttggggagtatctncactcctccaacatttgcattggcatgaaacctgccgnttttgtgtctgangccttagggaagtccggctgggcatcatcgnnataanngtgcccttggagaacccttatngacnaaggggggggtccacatgttttatgtttgattgttaaggcncaatcttgggaggngnntacgnattgggggaacaaaaatggncatttttntaagaagggtnnctaangggctttactttgggnccanagggaggttttttntaanttttnaannntnnttngggnccggncanggggatgtnccnttntggntgngnnaaaaaaatttntnccantccnggnccann

SEQ ID NO: 7064 - DNA, 467 bp, Triticum aestivum
  Predicted polypeptide sequence is orthologous to G707
gtcgttccatctgccggtgccgctcaggtgacgtttgatctgctcaagaacaacctgttacgcccaaagtgggatgtgctggtgaacggtaattcggtgagggaggaagtcgctgtttgcaaaggcgtaggagcaggaattgatgatgttgtctccatactgcatctcaaggatccgcccaccggggagaacagggacaacatcatgatcctccagaacagcggctacgacgtgtcgggcgcgttcatggtctactgcccagtcaacatccaagtgatgaacgagatcatgagccctagcaacacggcggagagcaacaatgtgtccctctaccccaccggcttccacctcctccccgtcgaggacactgcccttggcctcggcgagggtggagcaactcttgtgaccgcggggttccagattatgctcaagctcgctcgtggcaccggcctgtatcctaggtccgc

SEQ ID NO: 7065 - DNA, 552 bp, Triticum aestivum
  misc_feature (68)..(68): n is a, c, g, or t
  Predicted polypeptide sequence is orthologous to G707
tttttttttttttttttttaaagaaaagacatatccagagaaaaaaaagtgattcataaattcatttnggaaaacaaacaacccaccgggtgcagttcaatgtctacaatgtagtaattattgaaataaaaattataacgaagtccacaaatttattctcagtctctcatctgagtgattattctgattatgaaacggaaatgatagaaggcgcatcagacggtgataaccctcttggcatggacggcgtccttgatcttcatgatggaaccgtagacattattcccgacgttgtcgacggtctgtgcggtgaggttccctccaatcaggcgtgtctgccacaggacagagacgagagatccgcggttcttctggtggtctatggggtcggccgcggaggggttggcatcaagcggatcaatctgcatgtcgccgacgccgtcaggaaggatggcgaacccggagggcggcagggggagagaggcacggctgcccccatgcatcacgtccttgagctctcccgcgtcaatcggagcgtacgccaccacatgc

SEQ ID NO: 7066 - DNA, 694 bp, Triticum aestivum
  misc_feature (637)..(637): n is a, c, g, or t
  Predicted polypeptide sequence is orthologous to G707
cgcatgaagcccttgtcgtactccgcgttcacgatcattgccaccttgcagtagccattgttcatgtccttgataagacacccacttggcagcacccggcaggcccccggtaggccagtgttccatgctctgagctcagatgtgccattggcatcaagagacacgtccaccacggcccaaacgccttgctctatcatctggcattgcctcacgaacttcacatcgcaactcgacacccctggcgacagcacccgaaggcctgccttcatcagtatcactcccccttggcagatacaaccgtggccgatgttgtcggcggaaacacttgccacgatatcggggaacgtctcagaccaacagttctcgtccatgaagatgcggacaaggtcggctccagtgcacataaccaagccagtgtcccgagtgccattcgccgtgaaccccggcgggggaagctcgagtaagcctgggagcgtggtcgcacgatacagctggtggtcgagcacctcgccgcccagggctgccggctgccacattggctcgccctgcttcatcagcatcatgagctcgcggagtgcagcgaggacgtgcctctcaagcgcggcgtgctccgggccgccggcggcggatgcgcagncgccgggagcacagtgaaccatggtgtccgccatgagatcgtcggacgcgtgggtcg

SEQ ID NO: 7067 - DNA, 740 bp, Triticum aestivum
  Predicted polypeptide sequence is orthologous to G707
ccacgcgtccgcatgttctcatgtatgattgctaaggccacaatccttgaggaggtgtctaacggcattggtggaagcagaaatggagcatgtgctgctaatgaaggctgagctacaggtgctctcacctctggtacccataagggaggttatttttctcaggttttgcaagcagctggctgagggtgcctgggcagtggtggatgtgtccattgatggattgttgagcaatcaaaattctgctaccacatccgcaggcgcaaacctgaagtgtaggaggctaccttccggctgtgtgatgcaagatactcccaatggctactgcaaggtcacatgggttgagcatactgaatacgatgaggcatctgtccatcagttctaccgaccacttctccgatctggtcttgcctttggcgccagccgttggctcgccactctgcagcgccagtgtgaatgcctggccatcctcatgtcctctgctacagtgtcacctaatgaaccaacagctatatcgcaagagggtaagcgtagcatgctgaagctcgcacgcaggatgacggagaacttctgtgcgggggtgagcgcatcatctgcgcgtgaatggagtaagctggatggtgcaacaggtagcatcggtgaggatgtgcgtgtcatggcacgaaagagcgtgagcgagcctggggagccaccaggggtggtgctgagtgccgccacatctgtatgggtgcctattgcccctg

SEQ ID NO: 7068 - DNA, 1114 bp, Triticum aestivum
  misc_feature (17)..(17): n is a, c, g, or t
  Predicted polypeptide sequence is orthologous to G707
gattcctcgggttacgncgacccacgcgtccggtggaagcagctgcaacaagaagctcatcctgcagcaggcttgcggcgacgcgccgtgcatggtggtggcgtacgctccgattgacacggcagacctgaaggacgtgatgcatgggggcagacgtgcctctctctccctgctgccctccgggttctccatccttcctgacggcgtcggcgacatacagacggatccgcttgatgccaacccctccgcggtcgaccccatagaccaccagaggagctgcggatctctcgtctctgtcctgcggcagactcacctgattggagggaacctcaccgcacagaccgtcgacaacttcgggaataatgtctccggttccatcatgaagatcaaggatgcggtccatgccaagagggttatgaccgtctgatgcgccttctaccatttccggttcataataagaataagcactcagaagagaaactgagaataaatttgtggacttcgttgcaaattttatttcaataattgctacattgtagacattgaactgcaccaatgggttgtttgttttccaaatgaatttatgaatcactttgtttttctcttgaaaaaaaaaaaaaaaaaaaaaaaaaaaaaaggggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaggtgtataatgtgtaaaactagctgcatatgcttgctgcttgagagttttgcttactgagttatgatttatgaaattatatacccgggaagccagggatcctaatggttgggtttttaaagatccaagtcccaagggtccatttaggcccttcaatcctaaagtcttgtcatgattataattggccaatccaatttgtagaggttttacttggtttaaaaacccccccccccc

SEQ ID NO: 7069 - DNA, 490 bp, Triticum aestivum
  Predicted polypeptide sequence is orthologous to G707
ggagatggctcgaattgcaaaggggcatcagaatggaaatcggtatcccttctcagagccagtgccatgagtgccaaccagagcagcatgctgatccttcaggaaacgtgcactgatgcatctgggtcgattgttgtatacgctcctgtggacatcccgggcgaattccagtccgtcttgaacggcggggactccacctatgttgctctgctgccatctggatttgccattcttgcccgatggtcctagcatcggcagcgagcacaagaccggcggctctctgctgaccgtggcattccagattcttgtgaacagccagcccaccgcctagctcaccgtggaatccgtcgagaccgtgaacaatcttatctcctgcactatcaagaagatcaagacggcgctgcaatgtgcaacgcctgagtgttagggtggattttgccttggggaggaccggtgacgccgagcctgagtcaagaacgaaccgcgcaat

SEQ ID NO: 7070 - DNA, 653 bp, Triticum aestivum
  Predicted polypeptide sequence is orthologous to G720
acgcagaatgggtacggatttcattgttctagcaccatggataacagaagtggcatgcctcaaaattctatccaacatcagccggctgaggaggtaattgacgaggttgtgaaagaagcaataaacaagccatggttacccttgcccttaggcctcaagccaccttctactgatagtgtgctagctgagctctctagacaaggcatctccaccatccctcctcgcaatcaacgcctctaaatcctgctgatgtggctccacatcacccggaactgacatgtctggagtttggaccacccaccttcgctgcacctgcatgcacttcccccattaattgaccgatcaacgtttggagctacgcgccttttgggagcgcgtagctttttgttttgtatcgcggacatcatgccaaacgaagaaacaaaagaaagaaaactgatccagtttatcgccacagtgaaaaggatcaagtgcggtcgctttcattggtgacaaaaattgtatggactagaaatagccgcgtagatttgaatgccaccgcagtttcgatatgtggttgtaaatagtttctaacatgagacatggaacccttttgcttattttgtttttgttcaaatattttgtttgaattttgaaaaaaaaaaaaaaaaaaa

SEQ ID NO: 7071 - DNA, 793 bp, Triticum aestivum
  misc_feature (354)..(354): n is a, c, g, or t
  Predicted polypeptide sequence is orthologous to G720
aacagctaggtagatgattacgccacgctatttgtgtgacactatagaatactcaagctatgcatccaacgcgttgggagctctcccatatggtcgacctgcaggcggccgcactagtgattagcgtggtcgcggccgaggtgggcaggtcaaagaactctttacatgatcatctcagactgatacacaggttgtacctcaaatgatgtcgacaagtgccttggcatggccatctcagaatagccaacgaaattacgaccccactgtatgatgatcggttaagccactccccacggaaaacagaacgtatctctcagcttaggtacatttctggtacatgactacatgatgcanactgcttcgacgacaagcagatacttgaactgcacacacatggggcgatatccatctgacagtgtgcaaatgacactactcagaagctccaccgtcaccattgaagacatttgtaagtgttcgaatgtgtccagtcgctgcccgtatcagacctgtaaatgggagggagggttttcgaaggcccccacttgaattctgggtgggaactgaaaccctatttaaaaggggggggacttttgtacccttaaaccccccatccaatttccccattttctctcccaaccaaaaaaaggggggccccccaattctccaacctttggggaaaaaagcgggggggtggcccccttttttttggacaaaggggggccccatcttacatgtgggggggggtctccccccacggttgctacttgtaaaaacacctgtgttttttcggaaa

SEQ ID NO: 7072 - DNA, 748 bp, Triticum aestivum
  misc_feature (583)..(584): n is a, c, g, or t
  Predicted polypeptide sequence is orthologous to G732
attcggacgagcccggacctccgggcccagatggagaagaggaggaagaggaggaaggagtccaaccgggagtcggcacgccgatctagggtgcgaagcaacaacacctcgacgacctctcctcgcaggtggatcagctgaagaaccagagccagcaactgagcatggtgctgggcatgaccacccaaaaccttgtggcactgcaagcacagaactcggtgatgcagacacagaagatggagctggagagcaggctgtgcgccctgggcgagatcatctgctgcatgaactcaatcaccaacgccgcgaaccccgccgccgccatgggcgccacggcaagcggtgcctacgacatttttggcgccggcagcacatggagccagcccatagacttgtaccagtgcttctagggaagaagaagaatggatggttgatgttgtcatagctggtagggcctctgtgaaggcatcaggttctgtatcaatcatgtagggccttcgtgtcaccattgatgcgtgcccccctctctcttgattgtttattttgtgaggttgggttgtaatggttggtgagggaagggtanngagggaattgatgggccattttgtcaaagagagagagaggctagggattttctactggctcctgatggtgatgtctagctagtaagatgtggaattggtacctcttgatatatagtatatgcaaagtgcttctccatcttcatgtactccctgactttgtacta

SEQ ID NO: 7073 - DNA, 645 bp, Triticum aestivum
  Predicted polypeptide sequence is orthologous to G732
ttttttttttttttttttttctccgtcgatgtcacactataaatcagtcgaaacaggtacagccactctttaatttccttgcccctgcccacccaatagcactactctacttgggaggaaaagcataagcacatactactactagacgcatcgacaacacagagctgcacggaaccagcatgatgcgatctgctagcagtagtaggggtagttgcagtacaactccgtttgcaggatcggctgctggggcaaggcggtgccgttgacgccggcgagcgggatggaggaagcacccatggcggcggccgcgtcgatgtactggatcagctcggcgagcgactcgaggcgcgcgcccagctccagcgcccgcgcatgcaggagctcgttctcggcctggacgaccgcgcaccggcgcgcggcctcctgtgccgccgctgccacggcgcagttccgggcgcgcagtgctgccgcctccgcctccagctcgtccacctgcagcagcttgcgcgcgcgcgaccgctgcgcggacagccggttcgactccttgcgcttccgcttcctctcctcggtcagcgccgcaggcggcgcccgtgtcgcctccgagccgttcaacgacgacgtgacgggaccctgcagcccggggga

SEQ ID NO: 7074 - DNA, 1131 bp, Triticum aestivum
  misc_feature (787)..(787): n is a, c, g, or t
  misc_feature (924)..(924): n is a, c, g, or t
  misc_feature (1029)..(1029): n is a, c, g, or t
  Predicted polypeptide sequence is orthologous to G732
gacgtaccgatataacctgcttatgcttaagagcccccggagttgcctctcgattcgcatctaagtcctgctttctcccttccccttcttatttcagtccctgtagtttggttttccttaagagtctactccctgttccgttgcaaataagcccctgagctctgtcctattctagcctcaactccttggtctcgggaggagttcgtcgcagattcgatctagagagcctccccgcaccacccatgtttaccctccccttcctctgacggccgccgtcccccgatgaagctgcgcgtccgctgccgctcccactccttctccgtcgccttcctctactggttctacgacttctcatgaactcctcgccccccgacaacgccgcatccatccagcctctagttgattagatccagcctcgtttcttccactttcttgccttcttcctccccaccatcaaagaaaagagatctcttttctggttcttggatcaagaacccgaccgaccatgtcgtcgccgtcgcgccggagctccagccccgagagcaacatcgacggcggcagcggcagcggctccgccggtgacgagcgcaagcgcaagaggatgctgtccaacagggagtcggcgaggcggtcccgcgctcgcaagcagcagcggatggaggagctcatcgccgaggccagccgcctccaggccgagaacaagcgcgtggaggcccagatcggcgcctacacgaccgagctgaccaaggtggacggcgagaacgccgtgctccgcgcgcgccacggngagctcgccggccggctgcaggcgctcggcggcgttctggagatcttcaggtggccggcgcgcccgtggacatcccggagatcctgacccgctgctccgcccatggcagtccccgttcgcgccccagctggccacgncggcggcatgctgacgcgttccagtctgagccaagaaagtcatgcacggcgacattgcgccacgtggatagggtgatgatactggtgcgctgctgaagatgctanaccactagttggttgctcagtgttaatatgggaacctagacaccataagactaatttggggatggaacctccaatgcccaccagtgaattggtaaaaaagga

SEQ ID NO: 7075 - DNA, 1129 bp, Triticum aestivum
  Predicted polypeptide sequence is orthologous to G748
tcgacccacgcttccgccgccatggccgcgcttagggaccggggggacgcccccattaagctcttcggccgcaccatcccgctcctcgacgccgcggccgaggttgtcaccaagcttggaaatgatgcaaacagcaatgatgtcatgccttgtgtctcaaacaagcttttgaatgtcgaagcaactcctttctgttccaagaatagagagcagaatgatcaagctatcagcaaacatggggtggaagtgagaactggtttcaaatctgaggagattaaaactgggtctgatggatctggccaagacaaggtactcaagaagcctgatataatcgtgccatgccctcgctgcaatagcatggaaacaaagttctgctacttcaacaattacaatgttagccagcctaggcacttctgcaggaattgccagaggtattggaccgctggtggaaatattaggaatgtccctgtaggttctggaagacgcagaaataagcatgcctctcacttccgccatgctatgatgtcgtgtgatgctaacatagctgctcctggagatgtttccaatgagatccaccatctagctcttccacttttaccgcaggttcttccagggccaattaaagaaaataaaacagtaaaggagttcggatctcaagtgccagtttgtaagcctatgtcctcaatccataatattgaagaacagaaggatacttaccttgttgccttggcctctggtgataatagcgaagaacaatcatgtccatctccagcgacagtgtcgggttgctcagaaaatcagacgccggatagcgcagtttaaaaagaaccaagcaatgtgttaggatactataatggcatcacattgcctcaccctcacggacctgctttggtgtttccctggaagtctggatggaacagtattgctgtcatgccagctgctcagtgctcaccagagcccattcaagggttggaaaatgtaagccaggcctgccccgggggccctccttgattatggcagtcccagaattgccccctgttgtcccttcctattatgccccaccatttgggactgattccggttgcccaagggaagtgaattcaccagtccggaaaaagggccccaaaaa

SEQ ID NO: 7076 - DNA, 1085 bp, Triticum aestivum
  misc_feature (8)..(8): n is a, c, g, or t
  misc_feature (17)..(17): n is a, c, g, or t
  misc_feature (29)..(29): n is a, c, g, or t
  misc_feature (514)..(514): n is a, c, g, or t
  misc_feature (662)..(662): n is a, c, g, or t
  Predicted polypeptide sequence is orthologous to G783
gtatactncgacccagncgtccgctcccnccctccccccttcccctcgagcgatcacggacaggagaaccataggtagaccaaaccctcgaagagcagctcttaggctcgcgctccatagcctcagcccttccccgcttcaattggagggtgaggtaccggatcgagcttctcggtcagcatggtgcccagggacatggtgaatgcccccgccgagaggctgcacgtccaggggtctgtcgtgaacaggaagtgcgagaagaaggtgccaaagaaaatccataagtcggagagggagaaacggaagcgaggcacacagaatgacctctttaatgagttgggagccatgctagaaccagacaggcagaacaacgggaaggcatgtgtattgggtgacactacacggatactgaaggatatagtttcacaagtggaatctcttcggaaggagaatagcacactgaagaatgaatctcactatgtagtgttggagagaaatgaactgcgtgatgacnacagcatgcttcgcaatgaaatcctggagcttcagatcaagcttagagtgcgtctgcaaaggcatcctatttggagccaggatactaccagatcagccgttgcagtaacttaatccacaagcgggattgtcaccagtacagcattcgncacactcatcagtcatcacctcgagcgcactttcactgccacctgtaatcactgagcaatgctatgccgccccaccacgagagctgcagctctacccggaagcttcatctgcatccactgaagacagcgaactgtcacaagaacaggtggatttccagtagtgtgacacggccccaggcacggtacccaaacacagcggtgatgttcgcagtaaacgaattcccaatccttcccacgatgggggaggagccacaatattgtagtgcccctagcgaggacaccgtgtgcacagggtttaagtacattacacattttgtttcacgggctgaaatgtttctagggtgagtggagtgactgcaacaaaacctatttagcttttattgtaaccccaactgtttcccaccttggcctaacgggtaatta

SEQ ID NO: 7077 - DNA, 779 bp, Triticum aestivum
  Predicted polypeptide sequence is orthologous to G8
gaggggcgcgcatgcgccagttcctcggcaagaaggcttacgacaaggcggcgatcaaatgcaacggtagggaggccgtgacgaacttcgagccgagcacctatgatgcggagctgctcagtgaggttgctgctgaaggcgcagatgtcgacctcaacttgagcatatctcaaccaacttcacaaagtcccaaaagggataagagcagccttggcctgcaactccaccatggatcatatgaaggctctgaactaaagagaccaaaggtcgatgcgccccctgagatggtcgcaatccctcatcgatacccccttctgaccgagcatccaccaatctggcatggccaatcatatcccatctttttaaataatgaggatgcagccagagatcatagcaggaggccagaggtggccacagggggtgttccaacctgggcatggagtgtgagccaccctcctccaacacaacccatgccactcttctcgtcgtcatcgtccgctgcagcatcatcaggattctccaaaaccgccgcggcagctgcccccggcgccccatcggcctcattccggttcgacccgatggcgccatcatcatcgtcaagcaaccaacaccaccaccacccccgctgaaaaagaagccatactgtaaattttctgggaagccagtatctttttgcccctccggcgtttcagcgttttcggtcttgcgccggggcggtttcaggtagtggattggattcatgactgtatttcccatgctgcccaaagtgaaatgtcact

SEQ ID NO: 7078 - DNA, 632 bp, Triticum aestivum
  Predicted polypeptide sequence is orthologous to G8
gttgatctgaacttgagcatatctcaaccggcatctcagagccccaaaagagataagagctgcctaggcctgcagctccaccatggatcatttgagggctccgaatcgaaaaaaaacaaagattgatactccctctgagctgtcgggccaccctcatcggttccctcttatgactgagcatccaccggcctggcctgctcaatctcaccccttcttcacaaatcatgagagtacatcatcgagagaccttaacaggaggcctgaggggggtgctcctagctgggcatggaaggtgacagcagctcctcctcacaccctgccattgccgctgttctcttcgtcatcgtcatccgctgcagcatcatcaggattctccaataccgccacgacagctgccccatcggcctccctccggttcgatgcaccgccatcgtcgtcatcgagccatcatcatcgccgctgagaatcaagaagccacactgtaaatctgctgggaagctggcatttttcccccctctgggcgttgcaactttttcggttttgcgccggctggggtggtttcttgtagtggatcgattggattcttcataactgtatttgcacactgtcatactgccccaaaaaaaaaaaaa

SEQ ID NO: 7079 - DNA, 492 bp, Triticum aestivum
  Predicted polypeptide sequence is orthologous to G8
tttttttttttatggtgaattgtacttatccgcgcttatcttttggtctgaacagagcttggcgatccagagggtgctggtctctgtcggtggacattcgatgacaaatgaaaaaaacagaggcaaccaattcagcgaggccgcccacccagcaaaacgcaccaaagaaccaattctttctttaccagagaagaagaaggcgaggcccaatctcagccgccgtccgtccttacctgcctacgtccggcgggccgatggggggcccgacctgaggcgacatggccctcccaagagagaagcaggcgtcggggctgtgcaggccgtccatggcgatggagacgcccgggcaggaagggctcaatccggatgaaccagcccgcaccgagcccggccgcctcaagaggagctcgtctctctgcctgcctgcggcttaaccggagctgccaatcgccggcgaccgcctccctcaccttgtgccccttcttcttcgct

SEQ ID NO: 7080 - DNA, 1730 bp, Triticum aestivum
  Predicted polypeptide sequence is orthologous to G8
gcggccaccgcgctcccatgccatagacgcgaccccactcatcggtccaggtcggtcgctcggagccgagcggcggcgggcgggcgaggagtgcgttttattcggtcccggcgggcctcggatcggagatggtgctggatctcaatgtggagtcgccggcggactcgggcacgtccagctcctccgtgctcaactccgcggacgccggtggcggcggcttccggttcggcctgctcgggagccctgatgatgacgactgctccggcgagccggcgccggtcgggcccgggttcgtcacgaggcagctcttccccgcgtcgccgcccgggcacgcgggcgcgcccggggtgacgatggggcagcaggccccggcgcctgcgccgatggcgcccgtgtggcagccgcggcgcgccgaggagctcctcgtggcgcagcggatggcgcccgcgaagaagacgcggcggggcccgaggtcgcgcagctcgcagtacaggggcgtcaccttctaccgcaggaccggccggtgggagtcgcacatctgggattgcgggaagcaggtctacttgggtggtttcgacactgcgcacgcggccgcaagggcctacgatcgcgcggcgatcaagttccgggggctggaggccgacatcaacttcaatctgagcgactacgaggaggatttgaagcagatgaggaactggaccaaggaggagttcgtgcacatcctccgccgccagagcacggggttcgccagggggagctccaagtaccgcggcgtcacgctccacaagtgcggccgctgggaggcaaggatgggccagctgctcggcaagaagtacatatatctgggcctctttgacagcgaagttgaagctgcaagggcgtacgacagggcggcgattcgcttcaatgggagggaagctgtgactaactttgagagcagctcctacaatggggatgctccacccgacgccgaaaatgaggcaattgttgatgctgatgctcttgacttggatctgcggatgtcgcaacccaccgcgcacgatcccaagagggacaacatcatcgccggccttcagttaacttttgattcccctgaatcgtcaaccacaatgatctcttctcagccaatgagctcatcttcgtcccagtggcctgtgcatcaacatggcacggcagtagcacctcagcagcaccagcgtttgtacccatctgcttgtcatggcttctacccgaacgtacaggtgcaggtgcaggagaggcccatggaggcaaggccccctgagcagccgtcgtccttccccggctgggggtggcaagcgcaagccatgccgccgggctcctcccactcgccgttgctttacgctgcagcatcatcaggattttctaccgccgccgccggcgcgaacctcgccccgccgccgccgtacccggaccaccaccggttctacttcccccgcccgccggacaactgaagctggccgttgtgaccagacggcggtgggtgcgcgcggtcgaggtgttcgctcctcgtcgtcggtaacgcttgttgtgaaactataatcggagagagatgacattgccaggccatgtgtggtgacactactggctggtctctcgccgcctcgccatgatcgggatcacgcggatcatggctgttcattagattctcatgtatccaatgttcaagtttcccaaacggttgaaaaaactttgaaatttgtgatggcaaa

SEQ ID NO: 7081 - DNA, 788 bp, Triticum aestivum
  misc_feature (649)..(649): n is a, c, g, or t
  misc_feature (680)..(680): n is a, c, g, or t
  misc_feature (744)..(744): n is a, c, g, or t
  misc_feature (747)..(747): n is a, c, g, or t
  misc_feature (767)..(767): n is a, c, g, or t
  misc_feature (781)..(781): n is a, c, g, or t
  misc_feature (785)..(785): n is a, c, g, or t
  Predicted polypeptide sequence is orthologous to G811
ggccacgagccacagagaacaacaagcccacaccgagcagagcaggaacagcgagcggcttccttatccggttgtagactcttcgtccatgggaagcgagtgcaagggccaccagccgcaggacgacggcggcgtggcgccgttcgtggcgaagacgtttcacatggtcagcgacccggccacggacgccgtggtgtgctggggcggcgccagcaacacgttcctcgtcctcgaccccgccgccttctccgacttcctcctcccctcctacttcaagcaccgcaacttcggcagcttcgtccggcagctcaacacctacggttttcgcaaggttgacccggacgtgtgggagttcgcgcacgagtcgttcctgcgcggccaggcgaagctgctgccgctgatcgtgcgcaagaagaagagagccggcgccggcgcggccgggagggagctgtgcgtggaggaagaggaggtgcggggaacgatccaggcggtgcagaggctgcgggacgagcggaggggcatggaggaggagctgcaggccatggaccgcaggctctgtgcggcggagaaccggccgggccagatgatggccttcttggcaaagctcgcggacgacccgggcgtggtgctttccgccatggtcgccaanaaagaggagctggcttgcggccggtgccggnggcaaggattcaaagcccaaataaaagcggcggatcgggccgacccggatcaggcgggccaaancanggccggccgttccctttttntaatctgggaaggngttntct

SEQ ID NO: 7082 - DNA, 643 bp, Triticum aestivum
  Predicted polypeptide sequence is orthologous to G811
tttttttttttttttttttagtagtttgtagctttccttgttcacatactgtttgccacaaagtactcctaccacgtcgtctaaaaaacaacctcctactaagtacagtacacacatgtgtcggtgaaacaccctctaatcgaaccgaactcagtagccggtgtccacacggaaagcgtacggcgggtcgtccaccggcacctcgctaaagccatcgcctccggtgtagaaaccagtgaagtcgaccctgggttcccgcacgaaagcctcctgccggttgatgccgcacaacatcccgtcgccgtcgatgcgcatcttcttgccgacctgggcttccccatcgagaagcagccgcggcctcttggcctccgcgccctcgccggggaacaatccgccgccgccacccgagttgcctacgaggcggcgcagcacgtcggggtctccgacgaccttgaggaggaaggcgagcatgagcttgggccggcgctcggcgtcctgcacccggcgccacatcgccgccaggcggtccttggtggccctctgctcctccttcaggcgggccacctccatggccaacatcttgctgctgatgtcttcatcctcctcctcgtcgtggctgtccttggcgcgcctgccgccgccg

SEQ ID NO: 7083 - DNA, 1078 bp, Triticum aestivum
  misc_feature (28)..(28): n is a, c, g, or t
  Predicted polypeptide sequence is orthologous to G811
tacagcggccggcctttttttttttttntacacacagtaaagacgaaccctatactcccaaaaaatgtcacgcatacacagttgtacgcacacgcacacaagaacttgtacagaaatccctctctctgtgaatcaagataagcagagcgcgcgcggcttaacatggagaaggaattgacaacagaaccaacagaacgagtagggatcaactgactgacataggtgttgagctggcggacgaagctggagaagttgttgtgcttgaagtgcgcgggcagcatggtctgcgagattattaaggggtcggcgacgacgaagctgttgttccccttcccccacccgatgaccccgtccgtcccggggtcctccaccatccggtacgtcttccacacgaacggcgccgctccgccgccgacgctcgccgccgccatcggtctctctctaactaaagtcccgcaggatttgtcctgagatttcttgataaagtaatgggagcagagcataaagctcaaaggtgctacagaaaaagggaaggggggcgcgtcgccaaagaaggcaagatccgccggtctgttttctactccttcagtccatgtcagtgtcctcgtgctccagtcgcggacgcgtgggtcgacgatatcccgggaattccggaccggtaccagcctgcttttttgtacaaacttgttctatagtgtcacctaaataggcctaatggtcatagctgttccctgtgtgaaattgttatccgtcccgcggcctaagctagattctggaggctggatcggtcccggtgtcttttatggaggtcaaacagggtggatggcgtctcaggcgatctgacgggtcactaaacgagctctgcttatataaacctcccacggaaaagccctacggcccattggcgtcaatgggggggggttgttacaaatttgggaaagccccgtgaatttgggtcccaaaaaacacccattggactccacggggtgggaactgggaatccccgtgagtaaacggggtttccccccccttggaggtctgccaaaacgcctctccggggggagggggggccacatca

SEQ ID NO: 7084 - DNA, 1036 bp, Triticum aestivum
  misc_feature (652)..(652): n is a, c, g, or t
  misc_feature (655)..(655): n is a, c, g, or t
  Predicted polypeptide sequence is orthologous to G811
gttaaccagaccggccgcccttttttttttttttaaacacgaatttgcaacctgtgtcataccttggaacaaggcaaagtgggaacatatagcggtcaaaatggcagagtcacgcaatgccaataattcggccataatccaagcagttagcacacgcgggcggcacaatttctgtcgggcgtcactactcagtacccactgtccactccaaacgcaaacgtgcagccggcaccagcaccgcccgacccggcggccgcctccaccggcaccggcacattggcgaacgcgtcgtcggtgtagaacccggcgaagtcgacggcgtccggcccaaacgcggatacgttgccgaagtcgccgtcaagcagcagcctcgccctcttctcgccgccctccaccggctcctgatcgccgccggctgcgttgccgctgttgccgaccaggcgctgcagcgtgtcgcggtcgccgacgatggtgaggaggaacgcgagcatctgcttgggcttccgctccgtctcctgcacgcggcgccacatggcggccaccctgtcgtcgatggtgctctgctccttcttcagcctcaccacctccgtggcgaccatggtcatgtcgtcgtcggtgaggccagccgccgccgcgtccttacgcttgccgncgncgccgcccgcggcggcggcggtgccgcggcggacgatgttgcgcaggaggtgcgtctggccccggaggaaggagccgtgggcgaactcccaccggtccggatccaccttgcggaagccataggtgttgagctggcggacgaagctggagaagttgttgtgcttgaagtgcgcgggcagcatggtctgcgagaagacgagggggtcggcgacgaccaagctgttgttcccctttccccacccgatgacccggtccgtcccggggtcctccacatccggtaggtcttcacacgaccggggccgttccgcggcgaaagctcgccgccgccattggtctctttctaactaaagtcccgcaggaattgtcctgaaattctttgata

SEQ ID NO: 7085 - DNA, 1105 bp, Triticum aestivum
  Predicted polypeptide sequence is orthologous to G811
tcccagaccggccgcccttttttttttttttttttgggcgccaatcagcccgtctgaaattcaactatgccgagggggagtacactgtacatacataaacaccaaaacatcacacgtgtacacctatctatcaactctcgactcccaaggtctatcagtagaacacctgtcccagattacagaaggggaacggcacggccctgctctgggccgcctgatccggcgtcggccccgatccgccgcctcttatctgggcttgaatccttgccaccggggccggggggagccagctcctccttcttggcgaccatggcgcgaagcaccacgcccgggtcgtccgcgagcttgccgaggaaggccatcatctggcccggccggttctccgccgcacagagcctgcggtccatggcctgcagctcctcctccatgcccctccgctcgtcccgcagcctctgcatcgcctggatcgttccccgcacctcctcttcctccacgcacagctccctcccggccgcgccggcgccggctctcttcttcttgcgcacgatcagcggcagcagcttcgcctggccgcgcaggaacgactcgtgcgcgaactcccacacgtccgggtcaaccttgcgaaaaccgtaggttttgagctgccggacgaagctggcgaagtggcggtgctcgaagtacggaggggaggaggaagtcggaaaaggcggggggggtcgaggacgaggaacgttttgctgggccccgccccagcaaaccacggggttcggtggccgggtcgctgaccatgtgaaaagttctctggcaacaaacgggggccagcccgcccgtcttcctgggggctggtggcccgttgcaccgcgttcccaggggacgaagagcttacaaccgggatcaaggaacccgcgtgcgggtccccccacgtctcgggtggtggcttggttggtcctcgtggggggagtcccccccttactaaccaagctcttgtcgcgccgcgtttcttacctccttcaggaccagggtaggtgttcttcgtgccccacgtcgcgggcccggttggtccagggaattttccgggaaattccggaaagggtgtacgcccggc

SEQ ID NO: 7086 - DNA, 883 bp, Triticum aestivum
  misc_feature (858)..(858): n is a, c, g, or t
  misc_feature (879)..(879): n is a, c, g, or t
  Predicted polypeptide sequence is orthologous to G811
aagcttgaccttaggcctatttaggtgactctatagaacaagtttgtacaaaaaagcaggctggtaccggtccggaattcccgggatatcgtcgacccacgcgtccggtggcactagaccattcgctagtgaaagatgagcggcgccggcggcatggagtgctcagggagcggcggcacggtggcgccgttcgtggcaaagacgttcgcgatggtggacgacccggccaccgacgcggttgtcaggtgggggccggccagcaatagcttcgtcgtcgccgaccccttcaccttctcgcacgcgctgctcccggcccacttcaagcacgccaacttctccagcttcgtccggcagctcaacacctacggctttcgcaaggttgaccccgaccgctgggagttcgcgcacgcctccttcctccggggacagacgcacctcctgccccgcatcgtccggcgccggagcggcggaaagggtggcaaggaagacgccgacggggaggaggatgaagacctcaccagccagatgttggccctggagggggttcccctgaagaggaccagaggggctccgaggaccgcttgggcgccaatgcgggccccgggttgcaggaccccccagcgtcggccccaggctgattgctccactttcctccccccagggcccccgggaaacccccgacctggtttgggtccgctcccatttagctcctctaagcttgccgcgcctcccattttttcccccggccaatcctccgcgatattctcattaggtcctctgcgttctctctctcctcgccgcctcccccccctcgcctgcgcccctcaactcatattttgtcttcagtccctctactgnccaagtgtcttctctctctcncgtg

SEQ ID NO: 7087 - DNA, 950 bp, Triticum aestivum
  misc_feature (5)..(11): n is a, c, g, or t
  Predicted polypeptide sequence is orthologous to G811
ttttnnnnnnntttctttccttttaaagctatgacattaggcctatttaggtgactcatagaacaagtttgtacaaaaaagcttgccggtaccggtccggaattcccgggatatcgtcgacccacgcgtccgcactataccacccgcgagtgaaagatgagcaccggcggcgccggcaaggggtgctcggggagcgacggcggcatggtggcgccgttcgtggccaagacgtacgcgatggtggacgacccggcgaccgacgccgtggtcgcgtgggggccggccagcaacagctttgtcgtcgccgaccccttcgccttctcgggcgcgctgctcccggcctatttcaagcacgccaacttctccagcttcgtccggcagctcaacacctaccgcttccgcaaggtcgacccggaccggtgggagttcgcgcacgcctgcttcctccgcggccagacgcacgttcctgccccgcatcgtccggcgccgcatcgagcggaggcatggctcttcaaggacagccacgaccgaggaggaggatgaaagacatctgctgtcaagatggttggccatggaggtggccccgccttggaaggaggattcatagggtccttcaagggaacgctttggacggccaaaggcggtgtcgaccggggtgcgaggtaaggtcccaggcggccgggccccaaggatctatggttaggcccattcccctccccaaagggacgtacgtgagaaaccacggaagaggaatgggggactaacttgatgagggaatattctgatttgacctgtaacctctgaattgttctccacgcggtaagaaatgtgaaatagtcctaaaaaggtcgggctggtattatttatcacgaagggggagagtcgcggttttgtgatacgaaagaatagcgcttttcgtttaaatcaaaaaggaattttgggacaggcaa

SEQ ID NO: 7088 - DNA, 670 bp, Triticum aestivum
  misc_feature (244)..(244): n is a, c, g, or t
  misc_feature (266)..(266): n is a, c, g, or t
  misc_feature (280)..(280): n is a, c, g, or t
  misc_feature (294)..(294): n is a, c, g, or t
  misc_feature (297)..(297): n is a, c, g, or t
  misc_feature (309)..(309): n is a, c, g, or t
  misc_feature (354)..(355): n is a, c, g, or t
  misc_feature (359)..(359): n is a, c, g, or t
  misc_feature (393)..(393): n is a, c, g, or t
  misc_feature (415)..(415): n is a, c, g, or t
  misc_feature (426)..(426): n is a, c, g, or t
  misc_feature (438)..(438): n is a, c, g, or t
  misc_feature (443)..(443): n is a, c, g, or t
  misc_feature (476)..(476): n is a, c, g, or t
  misc_feature (485)..(485): n is a, c, g, or t
  misc_feature (511)..(511): n is a, c, g, or t
  misc_feature (517)..(517): n is a, c, g, or t
  misc_feature (519)..(519): n is a, c, g, or t
  misc_feature (560)..(560): n is a, c, g, or t
  misc_feature (572)..(572): n is a, c, g, or t
  misc_feature (580)..(580): n is a, c, g, or t
  misc_feature (586)..(586): n is a, c, g, or t
  misc_feature (590)..(590): n is a, c, g, or t
  misc_feature (605)..(605): n is a, c, g, or t
  misc_feature (612)..(612): n is a, c, g, or t
  misc_feature (633)..(633): n is a, c, g, or t
  misc_feature (643)..(644): n is a, c, g, or t
  misc_feature (649)..(649): n is a, c, g, or t
  misc_feature (669)..(669): n is a, c, g, or t
  Predicted polypeptide sequence is orthologous to G812
cgttcctgacgaagacgtacgacatggtcgatgaccccaacaccgacatcatcatgtcgtggagcgccggcaacaatagcttcgtggtgtgggatccgcacgccttcgccacggtgctgctgcccaaggcacttcaagcacagcaacttctccagcttccgtcaaggcagctcaaacacctatgggcttcaagaaaggtgggttcctgacaagatgggattccccaaatgagggttccctaacngggacaagagcacctttcttgnaaaacatccaagcnccgttaactccccntcnatactgcctccnaacaacatcccttgggtttttacctttaaggtggggcactttccnntatnatgccaaaattttacccgcttaaaaaggacaacnactgtttttatggaaaatttgngaaacctaagnaaggacagcaanacacnaagccgttttaaccatgggaggatagtacttgnaccaacaanacacaacaaatgatcatcatggaacntctgcngnacctgaatctgaacaatgatgcaagaatggatgagaaggantcatgaccttcncaaaaagnggcccncatnacgtgcctaacttancgtggtntagacacacctgacaaaattnccgttttttnncaggncaggattttcgggccggcgng

SEQ ID NO: 7089 - DNA, 721 bp, Triticum aestivum
  Predicted polypeptide sequence is orthologous to G881
cacagaaaggggtttttttacacggaggtgcagagaagcgcggaggacagctcggtggtagaggcgacatacgagggtgagcacaaccacctgcgccccatgggggcggtgagccgagctgcgcaacgcgtgcggaggcttggtgttgtgctccatctccatcaactcctccggcccaaccactatgctggacctcaccaagaacctgggaggcgtgcaggttgtcgaggcaggggaggcgcaaccggacctgaataaggtacagatcttggtgttgattctgcctcacttttacagccggcagtggttcggtttgctgcaggaactgtgcagagcatgaggatgatgtaggccgctgcgccacctctcttgtcatcctggtcactgcttagccaatttctttgattcagaggcttgtgcccctacaggcgttgcatggcaatccgcgcttctgcgagcaacaacaaaaacagggcgaaacaaagcaagcacaaaagaagaattgagatgctacatacaaccaatggtatccttttaacgccgccgccgggggtccttccgcctgagccaggatctcttctaccctgcaccgctgctgtgaactcatccatgctgacagtcggctccatgctacaactgctgcagcctgcagacatgtacaggaacaagcaagaaatcagaaatggttagggccgctatgccttgaaaagagccaaaagga

SEQ ID NO: 7090 - DNA, 515 bp, Triticum aestivum
  misc_feature (212)..(212): n is a, c, g, or t
  Predicted polypeptide sequence is orthologous to G896
caggtccaatttttcattgttgttatccactgacggggagcagtgcagcttgctatcgttgcaggtcagttgggcgttggtgcagtacgcaagcacttgagaggacgattggcacgcacttcagtttcagccgtgcgacgctgcagtatggatgcacgcggcaggaggttcgttgctgcagtttgcttggtgtgggcgaggaggttcttcanctggcccatgtagtttacctggtgcagggggggcggttgatggttgcggttaaaaggaaaattgggtggggtccactttctttgggatgaaaaaataagtgcaaatgtggttcactaattattttctcagggttcagttaactatattttgtgtgatgagagccgctccgacgtctgatgtagttaactgaaccctgagaaaagttatatggactcgtttgaaaattgtttaccaaagaagttcatttagaattgtgttgcggctcatttctctcgaccatgcggtttgcttcttcgcacgtg

SEQ ID NO: 7091 - DNA, 551 bp, Triticum aestivum
  Predicted polypeptide sequence is orthologous to G896
ttttttttttttttttttgattttaatcagtgatattgattctactgcagtacaactgaaatgtcccgttcagtttgctcacaagtgcagtgcagaacaggaccacagcatcattggtaaggcaaacgagccaattacatgactcggaacaactccggcgcggaagaagtcacaggagaaagggcttccggtagatgtcgaacatctcagaagagcagagctggggctcctgcacggcgctggaagtgatcatcttgcggacgaaggagccgatcctcccggggaggcggcggccggtcccctggctgtcgcggatcgtcgccctcatcgcgctcagcagccgcccgtacgtcgtccccggctcggactccacggccctgatgaagctgtccgtcatggcgccaatagcagcggtatcggagaacccctggacgctcgattccgtcgacttctggtcgtcgttgcagccgctgatggagatggcgaggcctccgttggtgcctttcggcttgcccggacggacgtggttctcccactgccacctgcagccc

SEQ ID NO: 7092 - DNA, 638 bp, Triticum aestivum
  Predicted polypeptide sequence is orthologous to G896
gaggaaacaacctccgaatcagatcaacttctcctcttctcgtcgcacaagatcaacggcgcacgcgatgacgctgagcaacagccgcccttctcggttcctctgcctcctcgtgctgctgctcctcctcaccgtcttcgcgcggcgctccggcgccaccaggcccctgcggcaaccggcagctggcggcggtgggggtgtggccgccgcggccgtgcggacgatcgccctccccgccgcggccttgacgagggacgcggaggaggtcgtgccggtcgggaagcgggtcgaggcgctgctcggcatgaagcccaggtcgagagcgccgccgtcgggccccagcaaacgaaccaacgacatcaagagctgacgatccggcggcctgctctgctcggctcttctctgatgccggtcgatcttttcttcttcttcttcttctcttgtgctagctcgtttaggctctgagcaaccgactggttgaccagtcgtatactagattgtttcatttgttctttgtagctaggtctagcgtgcctccacaatgattttctctcgggtatgctagtgtaaattattgtaacatatattgctgatatactcctgcttgtaatgtgatgtaaaaaaaaaaaaaaaaaaaa

SEQ ID NO: 7093 - DNA, 586 bp, Triticum aestivum
  misc_feature (372)..(372): n is a, c, g, or t
  misc_feature (374)..(374): n is a, c, g, or t
  misc_feature (390)..(390): n is a, c, g, or t
  misc_feature (453)..(453): n is a, c, g, or t
  misc_feature (461)..(461): n is a, c, g, or t
  misc_feature (495)..(495): n is a, c, g, or t
  misc_feature (500)..(500): n is a, c, g, or t
  misc_feature (518)..(518): n is a, c, g, or t
  misc_feature (520)..(520): n is a, c, g, or t
  misc_feature (527)..(527): n is a, c, g, or t
  misc_feature (529)..(529): n is a, c, g, or t
  misc_feature (562)..(562): n is a, c, g, or t
  misc_feature (585)..(585): n is a, c, g, or t
  Predicted polypeptide sequence is orthologous to G896
gctaacgaacccgaccaccccccagtagctcggcagccatgaactgcggaaggggtcccgctccggccaccatggtgcgctgcaggcagtgcagcgccagcgtcgccgcgccggccggcgcccgtgccgtccagtgcgcgcagtgctgctgcgtgacccgcgtgggcggggctggccgacagctcagtgtggtgcgccccatcccgaacttcggcggtggccgcggcaagaagcgcgccgtgctggtggggatcaagtacaccaagactcgcgcctgcgagctgaggggccccatcaacgacgtcaagtgcatgaggtactcctcaacgagcgcttcggcttcgccaacgactgcgtctcatcctcaacgantnaaggaaaggaaccctncaagcaaccgacaaaggcaacatccgcatggcatcattggctgatcagggtgcaactcccggnaatccctntgtcaatttcccggggcgggccccaagtcctgantggangggacaacggatggatgncnaggcatngnccgttaatcttcaaaagggccatctggccacanttacaagcatttcggccccctgnc

SEQ ID NO: 7094 - DNA, 715 bp, Triticum aestivum
  Predicted polypeptide sequence is orthologous to G896
gcagaggcagaggcagaacaagccgctggccagtggccatggagtgcggccagtgcagcgcgcgcttggctgtcacgcggggcgcgagctccgttcagtgcgcgcactgccgcagggcgacgcgcgtcgaacggcacggcgccgtcgtgcacggggccgtcggcttcgtcaggagcgtgttcacgaacattggccgggcgaggccgcacccggggtacccgccggtgcacggcaacaagcgcgctctcttggtcggcatcaactacaccggaacggcggccgagctgcccggccccatcaacgatgtcaagtgcatgagcttcctgctcaccctcaagtacggcttcccaggcgattgcatccttgtccttaccgatgaagagcgcgacccctacaggaggccaacaagggccaacatcctagtggcgatgcggtggctggtgcatgggtgcagctccggggactcccttgtgttccacttctccggccacggtgatcaggagaaagacaaggacggcgacgagcaggacggccaggacgagagcatctgcccgctggactggcagctgaacggcgccatcctggacgacgagatcaacgaggccatcgtccgcccgctcgtgcagggcgtcaggctccacgccatcatcgacgcctgccgcagcggcaccgtccttgatctccccaacctctgccagatcaaaaagaacgggga

SEQ ID NO: 7095 - DNA, 844 bp, Triticum aestivum
  misc_feature (5)..(5): n is a, c, g, or t
  misc_feature (22)..(22): n is a, c, g, or t
  misc_feature (526)..(533): n is a, c, g, or t
  misc_feature (541)..(546): n is a, c, g, or t
  misc_feature (548)..(549): n is a, c, g, or t
  misc_feature (551)..(551): n is a, c, g, or t
  misc_feature (555)..(556): n is a, c, g, or t
  misc_feature (558)..(558): n is a, c, g, or t
  misc_feature (560)..(562): n is a, c, g, or t
  misc_feature (564)..(564): n is a, c, g, or t
  misc_feature (569)..(569): n is a, c, g, or t
  misc_feature (775)..(775): n is a, c, g, or t
  misc_feature (816)..(816): n is a, c, g, or t
  Predicted polypeptide sequence is orthologous to G896
cacangccgtgcgttagctagnttacaatacggcttagtttagggaccactttgtacaagaaagctgggtacgcgtaagcttgggctcctcgagggatactctagagcggccgccctttttttttttttttttttttttttttttttttagcaccagtttgatgtattcttcaaattcatgcatcaaagtgaacattgatggcacgttcagacactactggtataattacctcattacagaacggatgcaggatgagcttgactactaaatggagagatcacaagtgatttgcctaagatcagtgccaatcagaaccacggttatggttccataattacaagataaacggcttcctgtagatgtcgaatgcttcggacgcgcacagctgaggctcctgtgcgctgctgaaggtgatgacccggcggaaaaaggagccgatgggcccagggatgccggagtcaccgccgttgtccgtgtgccttgtagatgcactatgggcattttccagtcttcctaggtgttttnnnnnnnnaaaatccnnnnnntnnanaaanntntnnntnatggnaccggtggaggttgagcccaagaacgctttctcttttgactctcccccaggtctggtacttccccatccgttaaaggaaattgccaggtccgccgtttatgccttcttcgcccttccgtttaagggttttcattttcccatttctcccacccattttttgtatttcccaaaaattttttgggggtttcagattttttccctctttnacaggtgtttcaaattggggttgaattcaaatcattgcccnagtcgggggaaaatttttcttttttttc

SEQ ID NO: 7096 - DNA, 832 bp, Triticum aestivum
  misc_feature (533)..(533): n is a, c, g, or t
  misc_feature (535)..(537): n is a, c, g, or t
  misc_feature (539)..(539): n is a, c, g, or t
  misc_feature (604)..(604): n is a, c, g, or t
  misc_feature (611)..(611): n is a, c, g, or t
  misc_feature (613)..(613): n is a, c, g, or t
  misc_feature (619)..(619): n is a, c, g, or t
  Predicted polypeptide sequence is orthologous to G896
caccgctagtgcgattaaggcctatctaggtgactatgattgaacaagtttgtacaaaaaagcaggctggtaccggtccggaattcccgggatatcgtcgacccacgcgtccgaagcaagcagcgctcacccagtaagctaacgaacccgaccaccccccggtagctcggcagccatgaactgcggaaggggtcccgctccggcgacgatggtgcgctgcaggcagtgcagcgccagcgtcgccgcgcctgccggcgcccgtgccgtccagtgcgcgcagtgctgctgcgtgacccgcgtgagcggggctggccgacagctcagtgtgatgcgccccatcccgaactttggcggtggccgcggcaagaagcgcgccgtgctcgtcggtatcaagtacaccaagacgcgtgcctgcgagctgaggggcccatcaacgacgtcagtgcatgaggtactcctcacgagcgctcgttcgcaacactgctcctctcacgatagagaggacctgagcgcacagcacatcttgtgcgtgncnnncnaggtgatcgcatcttggtcttactggctgatgcggggtgcagttcgggggaagtctcgtgttcanttttctngngccggngcgcaagtcccctattgtgacagggacaaccgggggggcgtgttggaggactctctttccccgggtcacttctccaggggggcccccttctgggagaagaaaaataaagggggctttggccgccccctttgtgggggggccaaatcccccctctttttaatctttgcaagatggccaccggctccttatccccaatcggggggccctttccaa

SEQ ID NO: 7097 - DNA, 459 bp, Triticum aestivum
  Predicted polypeptide sequence is orthologous to G896
agggaacaacatgctcgtcgcctgcgtgatgctcctcgtggtcctgctgatggcgacgcagatgggggcggcggtggccggcgacgccggcgcgggacgccgtcgcctgctcgatgcgtgccagtacagaaactgcaactgccgcacttgctacattttccactgggcctgttgcggcttgtgctgcccgccggcgtaggggacggcggcacacacggcccgctgcagtttctcacatgcagaggtttgaataatgcacatgtacgtggttacagtaacatgtggctgctcttgtctgtcccaatgctagtcgtggcctttgaaatttgacaaatttaacctgtgatttaatttcgtccataggtcaaatttgtcaattttgccgcaatttactacggtcaagttctgcgtttgcgcgactgtgtatgcacgcttaagtggatgatctgtctggttttg

SEQ ID NO: 7098 - DNA, 779 bp, Triticum aestivum
  Predicted polypeptide sequence is orthologous to G896
gcggccgctctagactagtggatcccccgggctgcagggaagttgatgggatggatgaaaccctctgcccattggattttgagacacagggaatgattgtggatgatgagataaatgctgcgcttgttagaccacttccccatggagctaaacttcatgcactcatagatgcttgccacagtgggactgcacttgatttgccgtttctctgtagaatgagcaggactgggcaatacgtatgggaagatcacagaccgcgatctggtgtctggaaaggaactagtggcggggaagctatttcatttagcggctgtgatgataatcagacatcagcggatacttcagccttgtcaaagatcacttcaactggtgcaatgacattttgcttcatccaagctattgaacaaagccaggccaccacatatgggagtatcctgaattccatgcgttcaacaatacggaatacgggaagtggtgcctcaatggctggaggtggtgcggttacatcactcatttcaatgcttcttacaggggggagtgctagtactggtggattgagacaggagccacagctaactgcgtgtaatacatttgatgtgtatgcgaaaccattttcgctatgatacatttgtggtattctccactgcgttctgtgattctatcacgaggccgggtttaaactatcatgtacagttaacaggtgcaatggctcctctatatatagagctaactttgtatcatttgatgctcatattcaaattaaagtgtttgcccccttt

SEQ ID NO: 7099 - DNA, 1198 bp, Triticum aestivum
  misc_feature (20)..(20): n is a, c, g, or t
  misc_feature (29)..(29): n is a, c, g, or t
  misc_feature (827)..(827): n is a, c, g, or t
  misc_feature (1000)..(1000): n is a, c, g, or t
  misc_feature (1005)..(1005): n is a, c, g, or t
  misc_feature (1010)..(1010): n is a, c, g, or t
  misc_feature (1026)..(1026): n is a, c, g, or t
  misc_feature (1035)..(1035): n is a, c, g, or t
  Predicted polypeptide sequence is orthologous to G896
gcttccgagcaaacgcacgncgtagcgcnagcttaactaagctaaaccaggtagccagccatgaacatgaactacggctccatgggtcctggcgcgatggtgcggtgcaggcagtgcagctcgagcatcacggcgatgcccggcgcccgcgccgtgcagtgcatgcagtgcagctgcgtgacgcgcgtcagcggccgtggccggcagcagcacggctacggccagggttacgggaacggcggcgggatgctgatgccgccgatgcgtcccaccccggccttcggcggcggccgcggcaagaagcgcgccgtgctgatcgggatcaagtacaccaaccggcgctcctgcgagctgcggggccccatcaacgacgtcaagtgcatgcggtacctgctcaccgagcgcttcggcttccccaacgactgcgtcctcatcctcaccgatgaggagaggaacccatgcaggcagccgaccaaggacaacatccgcatggcgatgcactggctggtgcaggggtgcagctacggcgactccctggtgttccagttctccggcctgggcgcgcaggtgcccgacgacgacggcgacgagctggacggcatggacgaggccctctgccccgtggactcgttccagcagggccccatcctggacgacgagatcaacgaggccatcgtccgcccgctggtgcacggcgtcaagctccacgccatcgtcgacgcctgccacagcgccaccgtcctcgacctccccctacaatgcaccgtgtccaagcagaccgggcgctggaggtggagggacgagcgccctatgaccggcgcctgcanggggcacagcgggaggcagggcgtgctcatcagtggcagcagcaccgggaagagcacatgagcgtgctgcctgagccctacgcacgatcggcgcatgacgccagcttatcagagcggtgagtggagcgggcaccactacggcgccgctcactcatgagggcatatgccgcganagggnaatgnactgaaggcccatcgnggtcatccnagtcgaaattcagggttgagagccagggccttgctaaagttagtcacccaacgttgtcttaaccacccaatctgtcaagggggggttgcctcaataactaattttccggagaaaagccgaaaaatagggcaaagtggaattcaacccgcgccaaaaacgaaca

SEQ ID NO: 7100 - DNA, 1182 bp, Triticum aestivum
  misc_feature (722)..(722): n is a, c, g, or t
  Predicted polypeptide sequence is orthologous to G896
cgtgcctttttttttttttttttttttttttttcccttttgtattgtcttttttttttgggggggaaaacttgatttatttaaggggacaacacaacacacaacggccatgttacagtgatttaaagtacaggggaaaacgaggtcctcaaaaccttttgtttgacctatgcagggctcattcttgatggcttggcaacaggtgaggaaatacatcgtcccacatactagtagcaagcatcatatttaattaaccggcccagtatgggggggggtcttttcttgattcggtattaattaattcgtcaactgcagtagcctggggcgcaatgacttcaaaccgggggtacggtcgggttctacatgcaaaagggctccctctcgacgtcaaacttgtaggcaaaggacagttgaggctcccccaccccgttaaattttgcaaccttgcggatggaccccccaatggggccttgcaggttgcatttgcacctgctgtcccccatgatggccctcatggaggtgaccaggcggccctaggtggtgggcggttccaaccccaccgccctgataaacctgtgcgtcatggccccaatcgtggcgtagggctcaggcagcacccccatgttgctcttcccgttgctgctgcccctaataaacaaggcctggcctccgttggtcccccccccggggccggtaatagggggctcgtccctccacctccancgcccggtcttgttgaacacggtccattggtagggagagtccaagaccggggcccttttgcacggctttaaaaaatggcgtggaactgtaacccccgccccaacgggggggacaatggccccttgaatcctctcctccagaatggggcccttgttggacaaatttccaccgggaaaagggccccctccatgccgccacccctttgcccctcatcctggggcccctgcccccccgggcaaaaatgtggccaccaagggattcccctatcttcccccttaaccacaaagggattcccagtgggaattttctctttggccggttgcctcccgggttcccccccccctctgggagacagacaaccactcagggggaacccaacgccctgggacaggtccgacccctctctatcttaaggggcccccactccaggaacgccgtggggtattatcccacaaaagcg

SEQ ID NO: 7101 - DNA, 1106 bp, Triticum aestivum
  misc_feature (24)..(24): n is a, c, g, or t
  Predicted polypeptide sequence is orthologous to G921
ccacgcgtcccgcaagctgccctntaagcttcccggtcttcttcttcttcgcattctttcattcttgagctactgcgaatttaagaaagacatggacgagcagtggatgatggggcagacttccctcagcctcggcctcaacgtcggccggccgacggcgcggcggggtgcccctccggtgaccaagatcctcgtggaggaggacttcatgtcctccaagaagaatcacgaggtcgaggcgctggaggccgagctccggcgcgtgggcgaggagaacaggaggctcagcgacatgctccgcgcgctggtggccaagtactccgaccttcagggcagggtcagcggcatgatggcggcggcggccgcggccaacaaccgccagtcacccacgacgtctgagggcggctccgcggcctcgccgtccaggaagcgcgctcgcagcgacagtcccgacaccgcagtccaggaagcgtaccctgccagcggcggcttcgccgtcagcgtcaacgtcggccccgaccaggcggagtgcacgtccgtccacgagccgggcaacagcaagcgcgtccgcgccgacgagtgcaaggccagccgggtctccaagctctacgtccacgccgaccccgccgacctcagcctcgtggtgaaggatgggtaccaatggcgaaagtacggccagaaggtgaccaaggacaacccatgcccgagggcctacttccggtgctcgttcgcgccgtcgtgccaggtgaagaagaaggtgcagcgcagcgcccaggacaagaacgtcctggtggccacgtacgagggcgagcacaacacgcacagcccgccgagatcgcaggctctggcggccggaagtccgccgacgcagccgccgtccgtgcatcgccagcgccgccgttcgcccagaaaagccgaggcagcaatcaaggaaccgaggcggatcggccgcggacaggaagaacctggcgaacaaatgccagcgaacctaaccagggaccccgggttaaggggggctcggtttcgaaacttcgggggaattcccaatctccgcggccgaatattatcaagcaaccggggcgttccggttgggccccctaaaataa

SEQ ID NO: 7102 - DNA, 1147 bp, Triticum aestivum
  misc_feature (11)..(11): n is a, c, g, or t
  misc_feature (22)..(22): n is a, c, g, or t
  misc_feature (842)..(843): n is a, c, g, or t
  misc_feature (853)..(853): n is a, c, g, or t
  misc_feature (949)..(949): n is a, c, g, or t
  misc_feature (974)..(974): n is a, c, g, or t
  Predicted polypeptide sequence is orthologous to G921
tgcgacccagncttccggtttnagatcgcgagcggccgcccttttttttttttttttcttcgtacaaattcggtactatgttttccgtagagctaatgaaataattatatacaattaatctgctggataagcgagcaattcaaaattaatgaccatgacctaaacttttcagctacaaatgctaattaaatggagacgaagacgaagacgaagccgctcgcttgatcaactatcagacggcgagagctcgaggatccggccggagagcgcggagacgagcgccgccttgaacccagggtccctcgtcagcgtcgcggccatctgctccgccaggttcttcctgtccgcggccgatcctgcctccgttgtcgattgctgcctcggctgttgctgggcgagcggcggcgctggcgatgcacggacggcggctgcgtcggcagacttcctgccgccagagccttgcatcttcggcggctgtgcgtggttgtgctcgccctcgtacgttgccaccaggacggtgttgtcctcggcgctgcgctgcgccttcttcttcacctggcacgacggcgcgaacgagcaccggaagtaggccctcgggcatgggttgtccttggtcaccttttgcccgtatttccgccattggtacccatccttcacgacgaggctgaggtcggaggggtcggcgtggacgtagagcttggagaacctgctggccttgcactcatcggcgcggacgcgcttgctgttgcacggctcatgaacggacgtgcactccacctggtcgcggtcggggacgacgttgatgctgacggccgcggcgagcggcggcaaaggattgcggnncgcggtgtcnaggctgtcgctgcgggcgcgcttcctggagggcgagggcgcggagccgccctcagacgtagacacgactgctggtttgtggccgggggccgcgcgncatcatgccgctgacctggcctggnaggtcgagtactggccacgaccgccggagcatgtcctgaacctctgttctctcgcccaagcgcggaactccgctggaggccctaacctgggggtcttcttggaaaaactaaatcctcctccccaagacctggtcccggaggggcaccccccggcccttggcggccaatttagg

SEQ ID NO: 7103 - DNA, 1120 bp, Triticum aestivum
  misc_feature (1018)..(1018): n is a, c, g, or t
  Predicted polypeptide sequence is orthologous to G921
acgacccacgcgtgccgcggaaatagttctccatcccaagcttctcttctcccttctcttctcctctcgcgcgcgttgcctcgaaccggaaggaacagcgtccattccattacagtagagcttggtgtttgagagacgatcaatccgtcgtcgaccaatggatccatgggtcagcagccagccttcgctgagccttgacctgcacgtcggcctcccgccgatggggcacccgcacagccaccaccaggcggcgccgatggtcgcgctggccaagcccaagatcctcgtcgaggagaacttcatgcagctcaagaaggaccctgaggttgcggttcttgagtcggagctacagcgggtcagcgaggagaaccggcggctgggcgagatgctcagggaggtggcctccaagtacgagaccctgcagggccagttcaccgacatggtcacggccggcgcccacgccggcggcaataaccactacaacaaccagccgtcctccgcgtcggagggcgggtcggtgtcgccgtcgaggaagcgcaagagcgaggagagcaacggcacgccaccgccgtcgcaccagcagcagcagcagcactacgccggcggcctcgcgtacgcggcggcgccggaccaggcggagtgcacgtccggcgagccgtgcaagcgcatccgggaggagtgcaaacccgtcatctccaagcgctacgtccacgccgaccccgccgacctcagcctggtggtgaaggacgggtaccaatggcgcaagtacgggcagaaggtgaccagggacacccctgccccagagcctacttcgggtgctcctttcgccccggctgcccgtcaagaagaagtgcagaggagcgcccgagacagaccatactcgtgggacgtacgagggcgagaacaccacagccagccccgttgtccaagcgcagcagcagacgaaggctccgggcgggcaaaacgccggaagccacccaggggcgggcagcctcacacccggagaggatcacagcanacaaaccgagcgccacggtacccgcagggggattcgcccccgggaacccaattaaccttcgacctgggggacaattgcataccttacagggccccacttcgg

SEQ ID NO: 7104 - DNA, 1378 bp, Triticum aestivum
  Predicted polypeptide sequence is orthologous to G927
gcacgaggagattcccctctccgcggcgcagacgaccacccgccggccgcccctgccgtcgctctgctaggcagcgatgatgagcttcaagggccacgacggattcgggcaggcctccaatggtggtggtggtggtggagcctccgtgccatggtggacggtgtcccagatgctgtacggggagccgggggccgccttgtcgtcgtcgccggaggcggagcctcgccgggacgcccagttccaggtcgtgcccagagctcagggcatcctggatccactgccggcgcccaagagcggggctcctgaggtcctcaagttctcggtgttccaagggaatttggagtcgggaggcaacaaaggagagaagcccatggagcactccgccaccatcgcactgcagtcgccgctcccggaatacaacagtcgcttcgaatttggcccgggtccttccatgatgtcttctggttatccttcagccgagcagtgctatggcctgcttaccacttacgcgatgaaatctacgcctggtggccgattgctcttgccactgaatgcaacagctgacgcgccgatttacgtgaatgcgaagcagtatgaaggcatccttcgccgccgccgtgctcgtgccaaggtggagcgagagaatcagctggtgaaaggaagaaagccgtatcttcacgaatcacgccaccgccacgcgatgcgccgggcgaggggcacgggagggcgcttcctcaacaccaagaaggaggggaatggcaaggacgctggaggaggaggcaagagggcagagtgcgccccgcccacgcgcttcgccacgtctccgagctccgtcatcccgagcaacccgcactcccggagcagcatctcgagcctctccggctcggaggtgtcgagcatgtacgaccacgacgacgtggaccactacaacagcatcgagcacctccggacgcccttcttcaccccgctgccgatcatcatggacggcgagcacggggcatccgcccccttcaagtgggccacggccgccgacggctgctgtgagctcctcaaggcgtgacttgaggggggtacacgcaggcacccagatcaagagccggccatggccggctctggctccgtctggttgtctgcaggcaaatcattcttggctctactgcattggggtgtccttccacgtcgcattacctcttccctgagaactccggtgctggttctcagggatcttgtgatgatggggctccccatatgcctgtaaaatagtatcggaagcactagcagtgtactacgggtatgaactctgtggtactatcaggtatctgtgtcagaactcagaataagtatcaaacttcagggtctaaaaaaaaaaaaaaaaaaa

SEQ ID NO: 7105 - DNA, 696 bp, Triticum aestivum
  Predicted polypeptide sequence is orthologous to G937
caatgccgccgccggcggctccccagtatttcggcagggacgacaagattgttggcacacaaggcctgcctgctctgcccatgatttctccggctgcgaacaggcagttttctccccctgccgacgaccgtcatcaggccttcgccgcaaaatttgcatccgccatgccgcctccggggcctggcttgcagactcatgagcagcagtcgaggaagacaaggcggtgctggtcgccggagcttcaccggcactttgttgcctgccttgcaccaactcggtggccctcaagttgccactccaaagcaaatcagggaggtgatgaaagttgatggcctcaccaacgatgaagtgaaaagccacctccagaaataccgcctgcacaaccagaggtgccctagctcttcttcagcaagccatccggttatgctggtgggcgatctctgggctcatcaggagcaaagcagctcgcagtcccggtcccctgaaggcccccttcagctctctgtttcaggggtggccgtctcggcactcaccggcagcgacagttccgaggaagatgacaggtcggtaggctatagccggaggtgatctgaaggcttcgggactaccgtcggagattttcatgagagaggtagagatagctttgcggcatggatgacaataacggcatgcactctcgatccagagggtgtggtg

SEQ ID NO: 7106 - DNA, 1169 bp, Triticum aestivum
  Predicted polypeptide sequence is orthologous to G938
gcggccgcccttttttttttttttccggtgtgatttggtgaaaaaaccccagtgtactttacatggcctggatgggagggatccttacagttgcaagacgccatggactgatcgagaatggaagccttatgaattctaatggcctagagctactgcatgctaatcatgggtggttcctccttgggtgttcagtagaaccagttgggcccaacgtgcttctgctgctgcggctgctgcatggcgccggcgtagtccgccgctgacaggtcgaaccccggagggaaggtgcccagctccggcgccgccatgccgaacggcgcgtcgtcgcccatgaagaacgccgcgctctgctgctgctgctgctgcatcacgttgttcgcgccagaaagcgaacgcggcgccagaaggttgccgctgccgagctgcatgctgggatcggcggcgtcgttgactgcgcctgcacctctgtgcgcggccacgccggtctcgtacatgctcatcagcccggcgaggcatctctggtcggccgcgggcaggccgaagtcgaacccgccgagcgcctggctctgcgggctgtagggcgcccccgggaagaaggccgacggcggcttgatctgtattatggcggcggcggggtggttgtacctgcaggcgtactggtgggcggtgcgcgcgttgcggtcgaggaagccgagcgcgtggcccgggtgcgggcactgcacgttctcgcaggtgaaaacgcgggtcgttccgttcagcatcatctccggctcggggtccgcggcgctcgtgttctgggcgcgggtgaagttggcgtttgtggtttcttccttcatcagcgcaggcggcatgatcatgaactcgttgctcgaaggaacttccatggtaaggtccacaaacgggggctgcctcggagcgcgccttcatctggttcgcggccctcctcgcaaagaattgaagttcttatccccggagctgggttcaaacaaaccccccccgccgaaggcccgcgggggaaggaaggcccgggggtgcaatttgtggctaaccccttcccccccttttagcaggggaacccagttaaaaattcccgtgggggctatttgttccgggagcctttggatgtcccacaagaggggggaccctgtttaaattggggcgacagttct

SEQ ID NO: 7107 - DNA, 1159 bp, Triticum aestivum
  Predicted polypeptide sequence is orthologous to G938
tcgacccacccttccgcggcggcgagcaaggggcggccgaggcggccggcgtcgcagcaggaccagcaggcgcggcgcaagaagatgtcgcgcgcgcaggacgggatcctcaagtacatgctcaagatgatggaggcgtgcagcgcgcagggcttcgtctacggcatcgtccccgagaacggcaagcccgtgggcggcgcctccgacaacctccgcgcctggtggaaggagaaggtccgcttcgaccgcaacgcccccgcggccatcgccaagcaccggtccgacaacgccgcgccgctctgcggcggggaagatggggcggccgcggcggccggcccgcgctccctgcacgagctgcaggacaccacgctcggctccctgctctcctcgctcatgcagcactgcgacccgccgcagcgccggttcccgctcgagaagggcgtgccgccgccgtggtggccgcaggggccgtccgaggcgtggtggcccgaggcgggcgtgcccgacgacctcggcccgccgccgtacaagaagccgcacgacctcaagaaggcgtggaaggtcgccgtgctcaccgccgtcatcaagcacatgtcgcccgacgtcgacaaggtccgccgcctcgtgcggcagtccaagtgcctccaggacaagatgaccgccagggagatcgtcacgtggctcgccgtgctcaaggcggaggaggagctcagccacgagctgcaccccgggcgcctgcctccccccgcgggcctctcgcggggcgccgtcgttcgacgccagctcccggggagtacaacgtcaacttcttcggcgaggaggccgcgaaccaaattaaggcgcgcctcgagggcagccccgttcgtcgaccttaccatggacgcttcctcgagcaaggattccatgaccatgccgcctgccctgaggaaggaagaaaccccgagcccatttccacccgggacccaaacggagcgccgcgaccccccgcctgaaccgattcttacggaaaaccccgcgttttccagccgagacggtcgtggccacccgcggccaggggccggttctttaccgtaggggccccgcccaccaacagcgtccgtgtcaaccacctcccgcgccgccccagaacagcgcgcaggcatcttccggggccccaaac

SEQ ID NO: 7108 - DNA, 1072 bp, Triticum aestivum
  misc_feature (32)..(32): n is a, c, g, or t
  misc_feature (768)..(768): n is a, c, g, or t
  misc_feature (818)..(818): n is a, c, g, or t
  Predicted polypeptide sequence is orthologous to G938
gggttccggcgacccacccgtccggtttttcncttcctcgctctccccggtcatggcaacggttgcaaagcggataaaactagcaagtgggagatcgacgcaggtgaacaccaccacagctacaagtagtagtggaaggaagtggaatttcttgtgtggagaaaaagagctgcttgagtgaccatgatgggaggtgggctgctgatggatcagggcatggcgttctccggcgtgcacaacttcgtggatctgctccagcagaacggcgccgacaagaacctcggcttcggctcccttatgccgcagacatcctccggcgaccagtgcgtcatgggcgagggcgacctcgtggacccccccacgaacaacttcccggacgccggtgaggacgacagcgacgacgatgtggatgacatcgaggagctggagcgccgcatgtggcgcgaccgcatgaagctcaagcgcctcaaggagctgcagcagagccgcggcaaggagcaggccgccggcggcggcggggctggcgacggactgaagccgcggcagtcgcaggagcaggcgcgccgcaagaagatgtcgcgcgcgcaggacggcatcctcaagtacatgctcaagatgatggaggtgtgccgcgcccaggggttcgtctacggcatcattccggagaagggcaagcccgtgagcggcgcctctgacaacctccgtgcctggtggaaggagaaggtccgcttcgaccggaacggcccggccgccatcgccaagtaccangccgacaacgccgtgccgggctccgagagcgagctggcttccggcaccgncagcccgcactcgctgcaggagctgcaggacaccacgctgggctcgctgctctcggcgctcatgcagcactgcgatccaccgcagcgaaggtccccgctcgagaagggcatctctcctccatggtggccgtccggcaacaaggagtggtggcccgaccttggcattcccaagggacagggcccgcccccgtacagaaagccccatacctgaaaaaggcctggaaggccacgttccccccgctgtcatcaaccca

SEQ ID NO: 7109 - DNA, 1129 bp, Triticum aestivum
  misc_feature (31)..(31): n is a, c, g, or t
  misc_feature (1039)..(1039): n is a, c, g, or t
  Predicted polypeptide sequence is orthologous to G975
caatgctccaacgcgtccggagcgtacccanatggtcgacctgcaggcggccgcactagtgattagcgtggtcgcggccgaggtttctaacacaaaaccacattctatttatttcctttatatatactacataacggacattgatgtgtaataaagtatcttgacggtgactgtgtatgtaataacaaatataagtacatatagctgcacacagttgcaaacttatgctttttgtaacttggattgagtaatagacatatatctatcttcctgaaacaacctgaactgcttgcgtaccaaccagtgtacgggatcctgatctcggatggcgacgttgccatgctgtttcgtccatgctttttcagacgacgaagctaccttcttctccatgcgatggcgaagctggaccgctactgctcagcagctcctcaatcatctgcagcgtgagcctctcctcgtcatccattgtactcgccggtgaagaagccgtggttgctgacactgtggactgcgctgccaccgcatcgccggatggcccggcccctttgttgagctccacggtcatgacccagttggagtcggcgcgggcccctgcgcgcttctgccagacgccaatgtgggacttctcggtgtcgaggcgaaggcaggtcagggacggagacggcgctttgcagcacttgcgaagcttggcactgagaacctgggacaggttgctcgtcgaggaggaggagctgccgccacggacgtcccgggttgcagctggggcaggatcgccggtgctgctcctctgcacggggaaagtggtcttggcattgcggccgctcatcagaacggcggcctcgtcgtaggcccgtgcagcttcttcggcgggttcaaaggtaccaagccacaccctccttttaagggaggggtgtctgatctcagagacccaggagccccagtggcgctgcctgactccagggaacttcttctggggttgcaccatttgggtctgtctgtctggccttcacagacgagggaacgagccctctgagtccgnacctcggccgggaacacgcttatcccggggccatggcgggccgggaacatgcaacgtcgggcccaatccgcccaataagtggtccaatta

SEQ ID NO: 7110 - DNA, 600 bp, Triticum aestivum
  misc_feature (554)..(554): n is a, c, g, or t
  Predicted polypeptide sequence is orthologous to G979
ttttagattaaattgcaatgtttgtaaccgcagttgtatggttctatctagctccgagcttcatctatgatgcgccaagaaaaacaaacagagaaaagattacataaaaacagagaaaacatggagctacccagcatccacgactagagctagtagtaggaacacatggtacagtagtagagccgcaggacaactagtggtcttgtctgtcaaccgacaaggcatgcgttgtgctacctactcatggttcagagagccatctcgctgaacctgaatggtcttgacaatccttgactgaacctaaactatcagatgcgcatgattgggactagtggcaagtacaccaggatgttgagcggtaggcccctgtcggcaaagttgttgttgttggtactcctcccgtgtcacccgctgcatcctctcatgctcctgcatgtacgtgtccacctgcacttattgggaagttgaggagcccgaagtgtgagccccagcacttgagtgtcgcctgagccccagcacttgagcgccacgagatcatgggtgcgagctacttnctcctctgtcttgtaagatcacaaataaacaggtggtgaagaactt

SEQ ID NO: 7111 - DNA, 673 bp, Triticum aestivum
  Predicted polypeptide sequence is orthologous to G993
tttttttttttttttttgctagaattgctcttagtttcgtccaaaagagcccaaagtagctaatacgcactacatttcgaaataatgccaaaaaacctatgcgcattacatagaggaacggagggagtaactgcttggggaatacacaataccaattggtgtagcaaaaccaatcatactcgccaatgtcattgcctcttgaacaactccagctccgctggcgccgctagccccctcatctctccggcgaggtcgacgccgaacagcctcacgacacgggcttgttctcctttgcccgtctccaccaccggcggcggcggtgacgccgacgcgccgctgttcaccgtcgtggtcttcttgtagtcgatgtagaactgcttctcgtggccgtactctgagcaggagaacacgacgacgtcgccggcgacgaggcccttctcccggacgaagcggctccagcccttggtgagcacgtagctctggctgctgttccagtacgagtacctgaaccgccacaccttcccctggccatcctcgaagttcagcagcacggccttgtcagcggtggtcgttgtctccggcgcgcgcttcagggggatgtgcttctcggcgtgctgcttcggcaacacgatgcgattcagcttgccgacgtcgctcggcgtcagcaccttct

SEQ ID NO: 7112 - DNA, 746 bp, Triticum aestivum
  Predicted polypeptide sequence is orthologous to G993
cgcagccgacgccgtcgtgggcacgggagcccctcttcgagaaggccgtgaccccaagcgatgtcggcaagctcaatcggctcgtggtaccgaagcaacacgccgagaagcactttcccctgaagcgcaccccggagacgacgaccaccaccggcaacggcgtgctgctcaactttgaggacggtgaggggaaggtgtggaggttccggtactcgtattggaacagcagtcagagctacgtgctcacaaagggctggagtcgcttcgtccgtgagaaggacctcgctgccggcgactccatcgtgttctcgtgctccgcgtacgggcaggagaagcagttcttcatcgactgcaagaagaacacgaccgtagacggcggcaaatctgcgtcgccgctgccggtggtggagactgtcaaaggagaacaagtccgcgtcgttaggctgttcggtgtcgacatcgccggagtaaagagggtgcgagcggcgatggcggagcaaggcccgccggagttattccagaggcaatgcgtgacacacggtcggcactctcctgccctaggttccttcgtcttatagcatctgcacatacacctatatatttatacttttcctcccttttcttcttgttgttaaatgatatatgttgatcctgttcatgaattagataaattctctgtagaactcaattttcaagtcggattgcaaaatgagttgtaataaaaaaaaaaaaaaaaaaaaaaaaaa

SEQ ID NO: 7113 - DNA, 1470 bp, Triticum aestivum
  Predicted polypeptide sequence is orthologous to G993
gcacgaggctagcttcagcttttagctaagctctacttccctcccgagctaagcatcttcttgatttctcggtgatcggattcggatggacagcgcaagaagctgcctcgtggacgacgtgagcagcggcgcgtccacgggcaagaaggcctctccgtccccggccgcgccggcgaccaagccgctgcagcgcgtgggcagcggggccagcgcggtcatggacgcgccggagcccggcgccgaggcggactccggccgcgtcggcaggctgccgtcctccaagtacaagggcgtggtgccgcagcccaacgggcgctggggcgcgcagatctacgagcgccaccagcgcgtctggctcggcaccttcacgggggaggccgaggctgcgcgcgcctacgacgcggcggcgcagcgcttccgcggccgcgacgcagtcaccaacttccgcccgctcaccgagtccgacccggaggacgccgccgagctccgcttcctcgctgcccgctccaaggccgaggtcgtcgacatgctgcgcaagcacacctatcccgacgagctcgctcagtacaagcgcgcctacttcgccgccgctgcggcgtcctcccctacatcgtcctcggtgcctcccgcctcgtcgccctcttcggcggcttcgccctcgccggcggcgcggcgcgagcacctgttcgacaagacggtcacgcccagcgacgtggggaagctgaaccggcttgtgataccgaagcagcacgccgagaagcactttcctctccagcttccttccgccggcgccgccgtgtccggcgagtgcaagggcatgcttctcaacttcgacgactcggccggcaaggtgtggaggttccggtactcgtactggaacagcagccagagctacgtgctcaccaagggctggagccgctttgtcaaggagaagggcctgcacgccggcgacgccgtcgggttctaccgctctgcctcaggcagcaaccagctcttcatcgactgcaagctccggtccaagaccacgacgatgacgacgactttcgtcaacgcggcggccgccccgtcgccggcacccgtgatgaggaccgtgcgactcttcggcgtcgaccttctcacggcgccggcgccgagtcacgcgcccgagcacgaggactgcagcatggtgcccaagacaagcaagagatccatggacgccaacgcagcggccactccggcgcacgcggtctggaagaagcggtgcatagacttcgcgctgacctagccagctagcgtttttcctccatggttgctttgcttgcctccaaatttccatgttagtagcttagagctcttgatcggtccaagtgtttgccttttttttcctcttcttctcatacacaagttagctctaaatccagtcttctttaattaatctactgtaaattaagcccgttctcgaaaaaaaaaaaaaaaaaaaaaaaaaaaaaa

SEQ ID NO: 7114 - DNA, 939 bp, Lycopersicon esculentum
  Predicted polypeptide sequence is orthologous to G1006, G22, G28
caaatactcataatgtatcaacttcccacttctactgagttaactttttttccggcagaattcccggtgtattgccggagttcaagtttcagtagtctcatgccatgtttaaccgaatcatggggtgacttgccgttaaaagttaacgattccgaagatatggtaatttatgggtttctacaagacgcttttagtatcggatggacgccgtcaaatttaacgtccgaggaagtgaaactcgagccgagggaggagattgagccagctatgagtacttctgtttctccgccgacagtggctccagcggctttgcagcctaaaggaaggcattacaggggcgttagacaaaggccatggggaaaatttgcagcggaaataagagatccggctaaaaacggcgcacgggtttggcttggaacttacgagtcggctgaggaagccgcactcgcttatgataaagccgcttttaggatgcgcggtactaaggctctattgaatttcccgcatagaattggtttaaatgagccggagccggttagagtgacggttaagagacgattatctgaatcggctagttcatcggtatcatcagcttcggaaagtggctcgcctaagaggaggagaaagggtgtagcggctaagcaagccgaattagaagttgagagccggggaccaaatgttatgaaagttggttgccaaatggaacaatttccagttggcgagcagctattggttagttaaaatatggagctaagaactcaatggctagggcttgtttggctttgaagtggacagaaaatagcaaatcattccactaggtgagaagtggaccaaagaggccatttggattatgtgtatctaacgtgtaaagtgcactttttagtttgtgcttttatgaaaaaaaacacacattttcataaaaaaaaaaaaaaaaaaaaa

SEQ ID NO: 7115 - DNA, 482 bp, Lycopersicon esculentum
  Predicted polypeptide sequence is orthologous to G1006, G22, G28
tattattcatccaaaacaagaatgagtattgtaattgatgatgatgaaatcttctctttacctagccttgatgaacttgaatccatcacacatcttctttatgacgacgattccgattttttcgaaactctttccccaatgagtttagatgttacaacattattgcctaatattcctacctccaattcaattgaatcccccgtaacaccggaggaaacaaaagaaccatctgtggcgtgtgaggacgcgccacaagattggaggcggttcataggggtgaggcggaggcagtggggcacgttttcagccgaaataagagatccaaataggagaggagcgaggctgtggctcggaacttatgagtccccgagggatgcagcattagcttatgaccaagccgcttacaagattcggggaaccaaagttcggcttaattttcctgacctgattggctcggacgtacctatgccacctagagtaac

SEQ ID NO: 7116 - DNA, 478 bp, Lycopersicon esculentum
  Predicted polypeptide sequence is orthologous to G1006, G22, G28
ttcataaccaaaattcaaaatgtattcaaattgtgaactagaaaatgatttttcagtactcgaatcaattagaagatacttacttgaagattgggaagctccattaacgagctctgaaaactcaacatcctcagagttcagccggagcaacagcattgaatccaatatgtttagtaattcatttgattatacacctgaaatttttcaaaatgatattcttaatgaaggatttggatttggatttgaattcgagacttctgattttataatccctaaattagagtcacaaatgtcaatcgaatcacctgaaatgtggaatttaccggaatttgtggctccattagagacggcggcggaggtgaaagttgaaacaccggttgagatgacaactacgacgacgaagccaaaggcaaagcattatagaggtgtgagagtgaggccatgggggaaattcgcggcggaaattagagatccggcg

SEQ ID NO: 7117 - DNA, 704 bp, Lycopersicon esculentum
  Predicted polypeptide sequence is orthologous to G1006, G22, G28
atggatcaacagttaccaccgacgaacttcccggtagattttccggtgtatcgccggaattcaagcttcagtcgtctaattccctgtttaactgaaaaatggggagatttaccactaaaagtcgacgattccgaagatatggtaatttacggtctattaaaagacgctctaagcgtcggatggtcgccgtttaatttcaccgccggcgaagtaaaatcggagccgagagaagaaattgaatcgtcgcctgaattttcaccttctccggcggagaccacggcagctccggcggctgaaacaccgaaaggaagacattatagaggcgttagacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttggatgtcaaattgaacaattgacaggtgtccatcaactattggtcattta

SEQ ID NO: 7118 - DNA, 725 bp, Lycopersicon esculentum
  Predicted polypeptide sequence is orthologous to G1033
caacgcaccaaatccacacaaacgaataatatccaattctctctagaggtttcatcatgaaaggagctaaatcaaaggctaaagctgataccaagcttggtgtaaggaagaaggctactgagagtaagaaggcgaagaacgctgctaaggatccaaacaagcctaagaggcctccaagtgccttcttcgttttcatggaggagtttaggaagacctacaaggagaagcacccaaacaacaaatctgttgctgttgttggcaaagctggtggagacaagtggaaacagttgtcagatgaagagaaagctccttaccaagccaaggctgagaagaggaaggctgagtaccaaaagagcatggatgcatataacaagaaactggctgctggtgatgctgatgatgagtctgacaagtccaagtctgaggtacatgatgatgatgaggacgatgatggaagtgaagaggaggatgatgattaaacaatcagtaggctgttgaaattcagagaatgatggataagttcatgtaggaattgctcagtccttccttgataaatagatgccctctttttttacattttttgtctagtttttgttctttgagggtttagtttggacagaaaggtgaaattcagatgacttgccttgaaagctcaagtagtttatgtaatttctctattttgctgatgttaatgaaaatttagcttggaaaaaaaaaaaaaaaaa

SEQ ID NO: 7119 - DNA, 993 bp, Lycopersicon esculentum
  Predicted polypeptide sequence is orthologous to G1033
ccaaagccccttcttatcctctcttcacaacacacacacaatacacaattcatctcaaagggcaaaaaaatatctctttgtttttttctctctcaaccctagaagtttttttttaatcatgaaaggaggtaaatccaaggggaaagcagataacaagctgggagtgaagaagagtgctgcccagactaaaaaagagaagaatgctgccaaggatccaaacaagcctaagaggccagcaagtgctttcttcgttttcatggaggacttcaggaagcagtacaaggaaaagcatccaggcaacaaatctgttgctgctgttggcaaagctggtggtgacaagtggaaacacttgactgatgctgagaaggctccttacatcgctaaggctgagaaacgaaaggctgattatgagaagctaatggacgcttacaacagaaaacaggctggtgaagctgaggaagatgaggaatctgacaagtcaaagtctgaggttgatgaggaagatggaagcgatgaggaagaagaggatgatgactgaagtgctaatgggagggagtaaattggtggggaagctgtgtaataccttagatatttctctatatgatgactccttacttttccccgttaaatacttggctcttttttttagtttattttggggtttcttaggtatgggaaaaagatgaattagatgagagctatctttaaagctcagtggcttatgtactttttattctgatgctggtgttgcttaatgataatgcaactttttaggcaatttgtctttctttttctatatttgtgtagagcttattgtttgtttctattagaacgctcttttttttagtttattttggggtttcttaggtatgggaaaaagatgaattagatgagagctatctttaaagctcagtggcttatgtactttttattctgatgctggtgttgcttaatgataatgcaactttttaggcaaaaaaaaaaaaaaaaaaa

SEQ ID NO: 7120 - DNA, 714 bp, Lycopersicon esculentum
  Predicted polypeptide sequence is orthologous to G1033
gaggcaacgcaccaaatccacacaaacgaataatatccaattctctctagaggtttcatcatgaaaggagctaaatcaaaggctaaagctgataccaagcttggtgtaaggaagaaggctactgagagtaagaaggcgaagaacgctgctaaggatccaaacaagcctaagaggcctccaagtgccttcttcgttttcatggaggagtttaggaagacctacaaggagaagcacccaaacaacaaatctgttgctgttgttggcaaagctggtggagacaagtggaaacagttgtcagatgaagagaaagctccttaccaagccaaggctgagaagaggaaggctgagtaccaaaagagcatggatgcatataacaagaaactggctgctggtgatgctgatgatgagtctgacaagtccaagtctgaggtacatgatgatgatgaggacgatgatggaagtgaagaggaggatgatgattaaacaatcagtaggctgttgaaattcagagaatgatggataagttcatgtaggaattgctcagtccttccttgataaatagatgccctctttttttacattttttgtctagtttttgttctttgaaggtttagtttggacagaaaggtgaaaatcagatgacttgccttgaaagctcaagtagtttatgtaatttctctattttgctgatgttaatgaaaattagcttgaaaa

SEQ ID NO: 7121 - DNA, 651 bp, Lycopersicon esculentum
  Predicted polypeptide sequence is orthologous to G1033
gccaacaccttcttatcttcctcttctgttttaagtttcaatgaagggtggaaaaggaaaaggtgcattgagaaaagaaacaaggtcggcgttgaagcctgttgaggaccgaaagatggggaagagaaaagccacgttgaatgttttccaaaaagaaggtcacaaaggataaaaaggcaaagaaagatcccaataagcctaagaggcctcccagtgcctttttcgtattccttgaggaattcaggaagacatttaaaaaggagaatcctaatgtgaaggctgtttctgctgtcgggaaagctggaggagaaaagtggaaatctttgagtgcagctgaaaaatcaccatatgaagccaaagctgcaaaaaggaaggcagagtatggaaaactcatgaatgcttataacaataagcaggtggaaagctcagatgatgaggacgaagaagaaaaagaagaagaaaaagagaaaaggtcaaagcctgaggtacatgatgaagatgcggaggacagtggacagggcgaggaagaggacgatgaagacgaagaggatgaagatgaggaagatgattgaagctatgtaatttctggcttgcaccgtttccttggtccatcacatgcacacttcaaacataataagtttcgtaattctg

SEQ ID NO: 7122 - DNA, 785 bp, Lycopersicon esculentum
  Predicted polypeptide sequence is orthologous to G1048
tcgagactaggagcagcttcttatgaacgatgacgatttcggtcttgtctctgatcctcagtttgctgccgaatctctttctgacttcctcgtcgattctcctcttcactccgatcattctcactctcctgctgaacaagccattggattctccgatcccaaggtttcaagtgccgatcaggacaaacacaaggtttcccagtcgccttctgacggcgacgacgaactaaacaaccatgaccccgtcgataagaagcgcaagaggcaattgaggaatagagatgcagctgtgaggtcacgagagaggaagaagttgtacgttagggatcttgagttgaagagtagatactttgaatcagaatgcaaaaggctggggtttgttctccagtgctgtcttgctgaaaatcaagctttacgcttttctttgcataatagcagtgctaatggtgtttctatgaccaagcaggagtctgccgtgctctttttggaatccctgctgttgggttccctgctttggttcctgggcatcacatgcctgctcattctacccagccaaacctggtcagttccagaagaaagtcagggaagcagaaaccacgggcttctggttccaataaaggagggaaaaaagactagtcggattttgttgttcctgtccttcatgatgagcaaaagatgcaaagcttcaagatcgaggatgaagctcaacccccatcccttgggaagttgtgatgtggactcgttgtgatcaaatcttttcccataggtggatcatgggtcctttt

SEQ ID NO: 7123 - DNA, 1968 bp, Lycopersicon esculentum
  Predicted polypeptide sequence is orthologous to G1062
gagaaagtttagtagtaataatagtgatagcagagttgagttttctctctctgtgttaagttgtcttctctctcatataaagggaaaaaaaagaaaaaatgataactggagtgaatgatatgggttggattgatggtaaggaggatggaggaactggttcttgggttaatcagaacaatgaaaatcatcaacagaacaatggtggttttcccaatgaaaatcatcagctgaacaatggtggttttactaatttccaaggtatggttgatgatggaggtgtggattggtttatgggtggtggtgatagtaacaatcatcacatcaacaacaacaacaacaatggtggtggtggtggtggtggtagcaacatgcagagccacatttcttactctacaagtttcactgaagctgaaaacagtttgcttctgcaacctgttgattcttcagcttcctgctcgcctgtttctggtaacgttttcaacaacattgacccttctcaggtgaacttcttcatgccccaaaaatctactattccttcttcactcactgggttatccaacaacccaatggataacagcttcaatttgggtatgttgaatcaagctgggaacgggatgatgaatactgggtatcatcatctgggttcaccaaaccaaatggggacgaacaacctgagttcttatactcagttttcttctcccaatctgctccagctacctcaggtagctggtgggtacagttcgatgggatttggggctaacaattctgctaatgggaacactttgtttctcaatcggtctagaactcataaacctttagacaattttgcttccattggagcacagccaactcttttccagaaaaggattgcaaagaacttggttagtaatggtgaaaatttaggtacagaaatcggtcaaccttccagtaatctgactgataaaaaaaggaagtccagcatgaatgatgagtttgaagatgttagcatggatggaacattgaattacgactcggatgagttcatggatatctctaacaaaatggaagatgggatcaagattggggacagctctaatgcagccagcactgtcagtggcgctgatcaaaagggaaaaaagaagggacctccagctaagaacctgatggcggagcgacgccgcagaaagaagctgaatgacaggctttacatgctgcgatcggttgtcccaaagataaccaagatggacagggcttcaatcttaggagatgcaattaagtacttgaaggagcttctgcatgacatcaatgagctgcataatgagttggagtccacaccagctaacaactcttcattgagtcccgcaaccagcttccatcctctgacaccgactgcatcagctctgccaagtcgtataaaggaggaacttgttccaagccccctgtccagccctactggacaacctgctaggattgaagtgagggtcagggaaggaaaagcggtgaacattcatatgatctgcagccgcaaaccaggggttttactctcaacaatgaaggctctggacagtcttggactggacattcaacaagctgttatcagctgcttcaatgggtttgtgttggatgtgttccgagctgagcaatcgaacgaaggtcaagagatgcatccagatcagatcaaagctgtgttgatggagactgctggctttcaaggggggacgatataagctgctcgatctagtatacgaaggagaggctctatcgaagattttggacctcagggtgctatagcttttagacctcaagactttattagtttacttgtgttttcatgttattagatggttacagaccatggtggtccgaaccgggttttgtcctttttcttttttagtcagttatattggtgttttctttaggagaaacattgagcttatgaagctccaaaactgaatgctatgaaattcctttcagaaaaaaaaaaaaaaa

SEQ ID NO: 7124 - DNA, 753 bp, Lycopersicon esculentum
  Predicted polypeptide sequence is orthologous to G1062
gggaagagaaagtggggtagtggggaagaacttgatgatgtgagctttgatgggtgcacattgagttatgattcagatgaccttactgaaaatgttactaataaggtggatgatactgttaagaatggtggaaatagctcaaatgcaactagcactgtcacctgtgggaatcagaaaggaaagaaaaagggacttccggctaagaatttgatggctgaacgacgacgtaggaagaagctaaacgataggctttacatgttgaggtctgttgtaccaaggattagcaagatggacagggcttcaatcttaggggatgcaattgagtacttaaaggagcttttacagaaaatcaatgacctgcataatgaactggagtccacgccacctagctcttcactgacccaaacaacaagcttctatcctctaacaccaactggaccagctctgccaggccgcatcaaggaagaactctatccgagttcatttgcaagcccactgtctagcccgactggacaacctggcaagggttgaagtaaaggcaagagaaggaagagctgtgaatatccatattgttttgcagccgcagaccaggcctcttactctcaacaatgagggcactcgacaacctcggactggacatccaacaagctgttatcagctgcttcaatggatttgccttagatatctttagagctgagcatgcaaagaagtcaagactttcatcctgatcaatcaaagcagtactgctggatt

SEQ ID NO: 7125 - DNA, 1082 bp, Lycopersicon esculentum
  Predicted polypeptide sequence is orthologous to G1076
gaaatttcttgtgtgtttttttttttttaatatatacctattttcttactcatgctcattaattaatttcccttataattaatcatatatcatagtttattataccttagttttctgttcactacttttgttattgttatcgttatcgttatggctggtttggacttaggttccgcttctcatcatcgttttctccctcgtcatctccacgatcctcaagacgatgaaatcaatcgcaacaacactcaattttccgatgatgacaacaacaacaacgataacaataacaataatagccccggggtagcacgtagacctagaggtcgtcccgcggggtccaaaaataagcctaagcctcccgtgatcataacacgggagagcgctaacgcgctccgtgcgcatattttagaagtgagtagcggacatgatgtctttgaatcagttgctacttatgctagaaaaagacaaagaggaatttgcatactgagcgggagcggtacggtgaataacgtcaccatacggcagccacaggctgccggttctgtggtgacgttacacggaagattcgagatattatctttatccggatctttcctaccaccacccgctccccctggggccaccagcttaacgatttatttagcgggtggtcaaggtcaagttgttggtggaaacgttgtgggtgcgctaattgcatcaggaccggttattgttattgcttcgtcatttactaatgttgcttatgagagattgcctttggatgaagaaaatgagtcaattcagatgcagcaacaaggacaaagtggtaattttgctgatccatctaatattggattaccttttcttaatttgccattaaacatgccaaatggtggtggtcaactacaattggaaagtggaggaggtgaaggttggaatggaaacacaacaaacaggccacaatattaggtcaggttttattaagaaattaattttctacttttttttttttacttgaaaaaaaaaaaattctctcaatggattaatattatcatttgtacattattaagcttggtttaaatttttctaaaaaaaaaaaaaaa

SEQ ID NO: 7126 - DNA, 466 bp, Lycopersicon esculentum
  Predicted polypeptide sequence is orthologous to G1078
gtatctctaactcactgtgtgtaaaaacactttcatggcattttttcttcttcttcaccgtctccgcccatcgccgtcgcaacttctttagctccatagcaacaccagtaactgcgccgccggaatagccaccgtcaacggcggagacccatttgatttttttttttgatatttaacgatgggttgcgcggcgtcaaagctagataatgaagatactgtccggcggtgtaaagaccgccggcgattgatgaaagaagctgtttatgctcgtcatcacttaacagcagctcattctgattactgtcgttcacttcgtgttacgggttctgctttatctacctttgccgccggtgaaccactttctgtttctgatcatactcctgctgttctcctccgtacgtctttttcgactactgctgctactaacatcaaaacccctccacccccaccccctattcatatccca

SEQ ID NO: 7127 - DNA, 620 bp, Lycopersicon esculentum
  Predicted polypeptide sequence is orthologous to G1078
cttcgatgagttgggggaacggaaatgggaaagtggagatggtatctgatagaagtatagtggtgaggcacaaggatctagcagagattgttgctgccattaaggaacactttgataagactgcttctgctggtgagcaggtgtctgagatgttggagacaggtcgagctcagcttgaccggagctttaagcagttaaagaaaactgtgtatcattccggtggagtttttagcaccataagctccacctggtcttcaaaacctccattggcggtcaagtatcgttttgaacctagttctattgatgaaggtgggcaaaagagtctttgttccaccttggagcgactcttggcatgggaaaagaaactgtatcaggaagtgaaggcgagggaaggagttaaaattgagcatgaaaagaagttggcaacattacagagtcaggaaagcagaagtgatgacatagccaagttggacaaaaccaaggcctcaataacaaggttgcagtcactgatggtggtcacatcgcaagctgtttccactacgtcctctgccattattggcctaagggactctgaccttgtcccgcagcttggtgaactttgtcatggatttatgtaccat

SEQ ID NO: 7128 - DNA, 728 bp, Lycopersicon esculentum
  Predicted polypeptide sequence is orthologous to G1089
cacatctttccccccctttcatcaacaagcaaacccctcattcaggacgtgtctgaagtctgcctgtcatggtgatgtgtattagttctctgtagacgctgcttaacagttaaagaattgcacactacgttaacgttggcctcaagcgctgcattgcacatgaggttattgttttgtagtattttgcctattggggtttttaagggggaatagttctctttagccatcatatcactatgttttgcaagatgaatggcttaatctgtattgacgtgtctgcggaaatgataattttcagttgagtataactaggtattcctctgagggtatttattcagggtccctaggagattctgtcgttttatgctgaatagcagataagattgccaaatacagctttctcctgcagaccatgaacccgaaactcctgtactctccttggagtagataaattcagggtttccccgagttaaattgatgtcaaagtaagcactttgttgtctgattcactatctgagatggttaagacatcatatatttgtactgttctgtgaggttcttccttggaataaacaagtattttaccgtgtgaagaagtttgtctgcaaatgctggtttcttgttagtttgaaccgataattgaaacttcagaatggatgttcctgtgaagaacctcaggataatgggccgaaaaccttagtcagtgatgacattttggctaagaggct

SEQ ID NO: 7129 - DNA, 481 bp, Lycopersicon esculentum
  Predicted polypeptide sequence is orthologous to G1134, G2555
aaacataaaaacaacaaaaaattcacctgaagagaaaggttagagttaacttttgctagaaaaaatttcaccgatgcaacgtggaactaccggtgacgggggtggtggactttcccgtttccggtcagctccggcgacatggttagaagctctacttgaatccgacactgagaacgaagttattcttaacccttcttctcccattttacacactcccaataaaccaccacctcacccatcaactccgaagcttaagctggaaaccggcggagctactaggttcactggcgatccgggtctgtttgaatccggtggtagtagcaattttctcaggcagaatagttctccggcggagtttctttcacatatcagctctgatggttacttctcaaactatggaattccgtccagtttggactatctttctccatccgttgatgtttcgcagtccgctaagcgaacccgagacgatgattccgaa

SEQ ID NO: 7130 - DNA, 555 bp, Lycopersicon esculentum
  Predicted polypeptide sequence is orthologous to G1134, G2555
ccagtttggactatctttctccatccgttgatgtttcgcagtccgctaagcgaacccgagacgatgattccgaaagttcccccagaaaattagtatcccagttgaaaggagagtcaagtgggcagttacatggttctggtgggtcactggatgctgaaatggagaatctcatggatgatttggtgccttgtaaggttcgagcaaagcgtggctgtgctacccatcctcgcagcatagcggagcgggttcgtcgaacgcgtataagtgacagaattaggaagcttcaggaactggtgccaaatatggacaagcaaaccaacacagccgacatgttggaagaagcagtcgaatacgtcaagtttctgcagaggcagattcaggaacttacggagcatcagaagaaatgcacgtgctcaatgaaagatcaataatgagaagaagagagctccactagagtatataggcaatagtttggttagttgcatgcagtttagaaatggtaattcactcctatatatcctattcttcttcatgtgtagatattaatggaaattt

SEQ ID NO: 7131 - DNA, 1325 bp, Lycopersicon esculentum
  Predicted polypeptide sequence is orthologous to G1136
agtggaaatggtcagagttgttacaatcagcaacaacagaagaatcctcctcagcaacaaacacaaggattcttcacgagggagttgaatttttcggaattcggtttcgatggaagtagtaataggaatggaaattcatcggtttcttgcaagcctgaatcaggagaaatcttgaattttggtgatagtactaaaaaaagtgcttccagtgccaatgtgaacttgtttacaggtcagtcccaattttggggcctgggggaggagaataataacaagaaccaagaaaagatcagctacttcaggggaagcaatgaagaaggaatgctttcatttgtttcaggtacagtttgcttcttcgggcatgaagtcaggtggaggcggaggcaagactctgaacattcagatctcgaggcttcagtggtgaaagaagctgatagtagtagagtggtagagcctgaaaagaggccaaggaagcgaggtagaaagccagcgaatggacgggaggagccattgaatcacgtcgaggcagagaggcaaaggagggagaaattgaaccaaagattcttctctcttagagctgttgtaccaaatgtgtctaagatggacaaggcatcactccttggagatgctatttcctatataaacgagttgaaatcgaagcttcaaaatacagagtcagataaagaagacttgaagagccaaatagaagatttaaagaaagaatcaaggcgccccggtcctcctccaccaccaaatcaagatctcaagatgtctagccacactggaggcaagattgtagacgtggatatagacgttaagatcatcggatgggatgcaatgattcgtatacaatgtaataaaaagaatcatccagcgaaggctaatggcagcgctcatggaattagacctagacgtgcatcatgccagtgtttcagttgtcaacgatttgatgatccaacaagccacagtgaaaatgggtagcagacattacactgaagagcagcttagggtagcgttgacatcgaaaattgctgaaacacactaaaccccttagaaaatagatagaaatcgtcgagggccatgtttaaattaaaatctctggtttctgctagctctaagtaatgtttttgtaatgaagtttgagatattaagacggaagactatcttcgtgttattttttcaacttgtacctcggtggttgttgaaaatattcttgtacataaatgttaagcccgattaactcaacttaatcgggctttagttcatgtaattaaagataaatttgcctccgaaacaaaaaaaaaaaaaaaaaaaaaaaaaaaaaa

SEQ ID NO: 7132 - DNA, 673 bp, Lycopersicon esculentum
  Predicted polypeptide sequence is orthologous to G1140
ttggatcaaccatcactttaacttcagcttgtagaaaatagcaactactccagattaagcaaggaaatttccgaaaaaagtcatcgattaaggcaaatgaggggagaagaacttcaaggactaaatattgaagagttgcaacaattggagagatctcttgaaactggattgagccgcgtcatagagagaaagggtgataaaataatgagagagatcaaccaactccaacaaaagggtatgcatctaatggaagaaaatgaaaaattaaggcaacaggtgatggagatatctaataataataataataataataatggatatagagaggcaggagtagtaatatttgaaccagaaaatggatttaataataataataatgaagatggccaatcatctgaatcagtaacaaatccatgtaactcaattgatcctcctcctcaagatgatgatagttctgatacttctctcaaattggggctaccttactcaggctgaagagatcaaaagcaaggtgtggctatttttgtatgttattagaagaaggagaaaaaaaaaagtaactactaattattataattaattaatgtctgattaatgtaaaagctaaccccaaaaatttcatattatggatgtaattggtgtattaatctcatgtattcgtctcccattagtt

SEQ ID NO: 7133 - DNA, 644 bp, Lycopersicon esculentum
  misc_feature (302)..(302): n is a, c, g, or t
  Predicted polypeptide sequence is orthologous to G1140
ggcacgagtccatctccaaaattaggtcttacatatttctatactcaattattggcccatttttgtataggttttctaactagatctaaagttttcctcttttattagggtttcttacaatttcttactatttatatcttttgtgagatttcttagaaagtttgaggaaagataattagcttcttcgacctgttaaggatggcaagggaaaagataaaaataaaaaagatagataatataacagcaagacaagtaacattttcaaagaggagaagagggctttttaagaaagctgaagagcnttctgttctttgtgatgctgatgttgctcttatcattttttctgctactggaaagctatttgattttgccagcaccagcatgaaggatattcttggaaagtataaattgcaatcagctagccttgagaaagttgaccaaccttcccttgatttacagctagagaatagcctcaacatgagattaagcaagcaggtagctgataaaactcgtgagctcaggcagatgagaggtgaggaacttgaaggattgagtttagaagaattacaacaaattgagaaaagacttgaagctggtttcaaccgtgtgcttgagattagggtaaacgaataatggatgaaatt

SEQ ID NO: 7134 - DNA, 726 bp, Lycopersicon esculentum
  Predicted polypeptide sequence is orthologous to G1146
gacgcagatgggattatccctgaatattgatatgtcttccacagcattcattgagccactgccggtcattgaatttgtgagccagcttctgaatcgggatatctcttctagaccattgtctgatgctgatcgggttaagataaagaaggccctgagaggtgtaaaggtggaggtcactcatcgtgggaatatgaggaggaagtaccgcatatctggtttgacatctcaagcaacaagagaagttgactttccctgtagatgaaagaggtaccatgaaagctgttgtggaatactttcgagaaacgtatggttttgttattcagcatactcagttgccttgtcttcaagttggaaatacacaaaggccaaattatttgcctatggaggtctgcaagattgtggaggggcagaggtactccaaacgcttgaatgagaggcagataacagcacttctgaaagtgacctgccagcgtcctcaagagagagagaatgatattcttcagactgttcgtcacaatgcttattcagatgacccatatgcgagggaatttggtattaagattagcgagaagcttgctcaagttgaggctcgcattttgcctgcaccttggcttaataccatgatacaggtcgagaaaaagactgtctaccacaagtgggccaatggaatatgatgaataagaaatgggtaatggaggaacagtgaacaacctggatctgtataaa

SEQ ID NO: 7135 - DNA, 544 bp, Lycopersicon esculentum
  Predicted polypeptide sequence is orthologous to G1146
gaccagaaatcaccacctgaccaggagtgggaacatcctacctggtacctgtggtggatacaaaaatatgtcatccaactgaattcgatttttatttatgtagtcatgctggaattcagggaactagtcgtcctgcacattatcacgttctctgggatgaaaataatttctccgcggatgaaatgcagtctttgacaaacaacctttgttatacatatgctcgttgcactcgttctgtttcagtagttcctcctgcatattatgctcacttggcggcctatggagcgcgtttctacgtagaaccagactcacgtgacaacggttctatacgtggcacacgtgcaacgaatggttctgtcaacgtccggccgctaccagcattgaaagagaaggtgaagaatgtgatgttctattgctagagggtgaatgttgagtttatgttatatagtagtagtgagtagataaaatgtatgaaattaggatatgaaatgttatgggtatgatatacatcataattagagtcaataaattataatttaatttt

SEQ ID NO: 7136 - DNA, 801 bp, Lycopersicon esculentum
  Predicted polypeptide sequence is orthologous to G1146
ggtgtgaaggtggaggttactcatcgtggaaatatgcggcggaagtaccgcatcgccaatttaacatctcaagcaacaagagagttaactttccctgttgatgaaaagggcactttgaaatctgtaattgaatattttcgagaaacttatgggtttgttattcagcatacccagtggccttgtctgcaagttggaaatcagcagagacctaattacttaccaatggaagtctgcaagattgtagagggacaaaggtactcaaagcgcttgaatgagaaacagataactgcacttctgaaagtgacctgccagcgcccccaagaaagggagcgtgatattcttgagactgtgaagcataatgcctatgctgaggacaaatatgcgaaggagtttggcattaagattagcgacaagttggcacaagttgaggctcgtattttgcctccaccttggcttaaatatcacgataatggccgagaaaaagattgtctgccacaagttggccaatggaacatgatgaacaagaaaatggttaatggaggaactgttgccaattggatctgcataaacttttctcgcaatgtgcaagacactgttgcacatgggttttgttctgagcttgcacaaatgtgtggaatatctggaatgaacttcaacccgaatcctgttctgcctcctgttagtgcacgccctgatcaggttgagagaagtttgaaactcgattcatgatgccatgacaaactgcagccgctatcgaaggagcttgatctcctggtcgctatcttggcagacattatggct

SEQ ID NO: 7137 - DNA, 413 bp, Lycopersicon esculentum
  Predicted polypeptide sequence is orthologous to G1146
tttttttttttttttttaaataactagccatgctcttcaatagcaattgttcaagccacaatgtacaaacatcacttgcgaataaactactgtttaactgacaactgaactttcataaacatcaaggtgagataatcacatacaatttgaaaagaaattactccagcatgtccatatcatatagcctggttagagaggacttctaacaatagaacatcacccttttgacattctccttgagagcaggaaggggccttacagcagcaccaacacctggcgcccttgtgctccttccaacagctcctacaccacctttgtacggagcagctccgcttgtgacagatccaccgtcagatgtctctggttccatgtaaaaacgagcacggaaagctgccaaatgtgcataatatgct

SEQ ID NO: 7138 - DNA, 611 bp, Lycopersicon esculentum
  Predicted polypeptide sequence is orthologous to G1146
aaaatataattgaacatttactgtcagctgtgatcataacttcgtcacacaacgtgcagttgcaaaaagcataaccatgatctgtaaagcccacagaccaacttaaaaaaaaatagtttaacataaaagaagatttctactgaatacttcttcagcagtaaaacatgacctccgacacattttcatgaatcttaggaagttgcctgaattgtgctgctgctcctccctcaccaccttcattagcagctcttacatccacgtcattctccatgtaatagcgtgcacgaaaggcagctagatgtgcatagtaggcaggtggtactaaggaaactgatcgtgtacacctaacgtacgtgtagcacaggtagttcgttacattctgaatgccatctgcggtgaaattgttctcatcatacagtacatggtaatgcgcaggacgactggtacccttgatcccagcgtggctacataagtaaaaatcaaactcagttgggtggcatatgttggtgtctaccacagtacctggcaaaatatttccactcctgtctgtcaaagtacgatcatcatgattggaagggaatagacgtgtatgatgtcgcttctgcactacc

SEQ ID NO: 7139 - DNA, 666 bp, Lycopersicon esculentum
  Predicted polypeptide sequence is orthologous to G1146
catagtgaaagccaatcacttctttgctgagctgcctgacaaagacttgcatcagtatgatgtcaccattactccagaagtatcttcacgaggggtcaaccgtgctgtcatggcacagctggtgcttctttaccaagaatctcatcttggaaagagacttccagcttatgatggaagaaaaagtctatacactgcagggccccttccatttgttcaaaaagagttcaaaatcactcttactgatgatgaggatgggcctggtggtgccaggagggatagggaattcaaagttgtgatcaaattcgcttcccgagccgatcttcatcacttagggatgtttttagaagggaggcaggctgatgcaccccaggaggcgctgcaggttctggatattgtgctgcgtgagttgccaacatctaagtattgtccagtaggtcgttctttctattctcctaatttagggagacgacaaccattgggagagggtttagagagctggcggggtttctatcaaagtattcgccctacacaaatgggattatcattgaacatcgacatgtcttccacttccttcattgagccattgctggtcgttgattttgtggcacagcttctgaaccgggatgtgtcatctagaccactgtctgatgctgaccgtgtaagatc

SEQ ID NO: 7140 - DNA, 1642 bp, Lycopersicon esculentum
  Predicted polypeptide sequence is orthologous to G1198, G1806, G558
atgttatttgtgtgaacattttgtcatatcataatacatgggcaacaataacagttgacagcaagcagtcaacttctttgagtacttagttgtatttcttttgtcattttgcttctctgcctttatccttctttatagctatggagattatttttttaactctctttactcttttagtttaaaggtttctttaaatacctaagaaggtcagtaattgcttctaatttgcaaggagagtatcttcactgtactgatgaacaggcagaaattctgatttacaggccatgaacatgacttctccaacaactcaatttgcccccacaagaaggatgggcatatatgaaccatttcaccagatgagcgtgtgggaagacgcgtttagaggtgacattatgcctagtgctgatgcatgtatggtttcacacccaaacgataggccagatgacaagtcggggtatacatccggtgaacaacatatgccctctggctctggagataatcaagggccgaggagttcttcagacaaggtacaacgacgtttagcgcaaaatcgtgaagctgctcgtaaaagccgtatgcggaaaaaggcctatgtacagcagctggaaaccagccgtttgaagctggcacaactcgaattggagctcgagagagctagacagcagggattatacatgttaggttcaaatagcaatatgggactattaggaacaattaatccaggaatagctgcattcgagatagaatacagtcactgggtggaagagcaacaaaaaaagaacgcagaattgcggagtatattgcagtctcctgtaagcgatatggagcttcagttgctagtagaaaatgtcttaagccactatttcaatctctttcgcatgaaagctgatgccgccaaagctgacgtgttttacttaatgtctggggtgtggagaacttccgtcgagcgctttttcctctggattggaggattcaagccatcagaactcataaatgtggtgatgccacaactcgagcccttggccgatcagcaaatcattaaagtgtgtaatctgcgacactgttgccagcaagctgaagatgctctcacacagggaatggataaacttcagcagactctggctcagagcatcctaaatacgaacacgggagctggaaattacacttcccaaatggtttcttctatggaaaatttagaagcattggagagctttgttaaccaggcagatcaccttcgacagcaaacactacaacaaatgtctattattttgacaacacaccaagcagctaggggcttgcttgcttttggggagtatgttcaacgtcttcgtgctctgagttcactctgggcagcgcgtcctcgtgaacctacctaaatgatctgttcatcagacaactgggatagatgagcttaactagattatgtttgaatgctcgagctgtaaatgggaatgtacgttatcatagttttgcttgcttaggcggatttagctatttactagtatttgaaatacatatttgaaatttgtgtaaatatatttggatgttgtatataggctataaagcaatgaaataattttgttggatgtttttgaagatttatgtgaggctagaaaacttataactaaaaaaaaaaaaaaaa

SEQ ID NO: 7141 - DNA, 719 bp, Lycopersicon esculentum
  Predicted polypeptide sequence is orthologous to G1198, G1806, G558
ttgaagtcacaagctataatttgattaagcataaaactttctaaaaatatctattacacttcttaaaaatccctaaactttttccttgtaaaactaaaaacacaggtacattattggttcctaagtcacaaagtaaaattttggcattctataaacctaaggagaaagaaaacaaattctgcacttccacaagcacatacaataccactttatacataagagtaactttgctggatctcatataccggccagtgtatcgaagtagtatatctgagtttcagtagaatatcgcaatgcatgtcatacttattgctctcgtggtctggcaagccaaagagagctgagagctcgaagacgtgagaagtattcacttattgcaagaagagcacgggctgattgtctggttgtcaatatgcgatgcatttgttgcaatgtctgttgacgcaggttgtccgcctgacggagaaaaccttcaagagtccctaatttccccatagccattgccatctgacccatataattagctacatctcctgatgacccttcagtagcaggagatccgttagctaatgtctctgccaaggattgctgcaacgcctccataccttgtgaaagggcatcttctgcttgatgggatgactgctgcaagttgtaaatgccagctaactgttgctcggtcagaggctccaactgattgactagaagcttaagaaagtccg

SEQ ID NO: 7142 - DNA, 741 bp, Lycopersicon esculentum
  Predicted polypeptide sequence is orthologous to G1198, G1806, G558
gattttagcaactttcacctgcttctcatctgggtacttccggcactgcttgatttattgatttggtgattctaaacttcagttgatttctcactgattcactgaaaagctgagggacacagaagggctaaagaaattgaagggggaaaaaaccccaacagaaaattacaagatttgatgattctattgtcttattttagctttctggcaaagcttgagccttttgctatagacccttttcgtttcttgaactaagatactacatctgatttgtgttccaatttcaattgattatccacaaagttggctatagtccacgatggctgatatcagtcctagtacatcaacagatgccgatactgaagataagaacaggttcctaaatcaacaacttgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggaacagggaatatttatttcaggttcaggagatcaatcgcagtcgatgagtggaaatggagccttggcatttgatgtagaatatgcccgatggttggaagagcagaaccgacgaattaatgaattaaggggagctgttaattctatggcttggtgatgctgaacttcgca

SEQ ID NO: 7143 - DNA, 684 bp, Lycopersicon esculentum
  Predicted polypeptide sequence is orthologous to G1198, G1806, G558
gatggatgcaatgggtgatagcgaaggccataggattgtgagctctactgcgttgtggaggggtgaccgccggccagcccaaattgtccaggtatcgcagttggagcaggacattgaacgagcacctcaacagggagaaagtgggcccgtagcatttgatacagattatattcgatggttagaagaacacgacaaacacatcaatgagttaaggaacgctgtcaaatcacatgcacgtgatcctgaactgcgaagaattgcggataatgtcactgcacattacgatgaggtctttaggatgaaaggaaatgcagccaaggcggacgtagtccatgtcttgtcaggcatgtggaaaacccctgctgagcgttgttgtatgtggattggtggtttccgcccctcgttactgcttaagcttctagtcaatcagttagatcctctgagtgagcaacaagtagctgactttaacaacttgcagctgtcatcccatcatgctgaagttgctctctcacaaggtatggaggcgctgcagctatcattgggggagacattagccatgggatctccatttactgaatcagggaatgtagctactacttatatgtgtcaaatggcaatggctatggggaaattaatgactcttgaagattttctccgtcaggcggacagcctgcgtcaactagt

SEQ ID NO: 7144 - DNA, 713 bp, Lycopersicon esculentum
  Predicted polypeptide sequence is orthologous to G1198, G1806, G558
cctttcttctttgtataatttcataattcagttttaattattttgaaaaactccaatttgtagaagagtttctttgtacttatgaacagtcaatgaacatgagttctacatcaactcagtttgcccccacgagaaggatgggcatattcgaaccattccaccatatgagtatgtgggaagacgcgtttagaggtgatattatgcccagtgttggtgcgtgtatgatcacaccggcaaatgacagggcagatgacaagtcgggatatacttctagtgaccaacttataccatctggctctgaggataatcaagcaggaaagagtatttcagacaaggtaccaacggcgtctagcacagaatcgtgaagctgcacgtaaaagccgtatgaggaaaaaggcttatgttcagcagcttgaaaaaagcaatttgaagctagcacaacttgaaatggaacttgagagagctcgacagcagggacctatacattttaggttcaaatgggtaatatggggctaagttcaacaattaatccaggaatagctgcatttgaaatggaatatagtctctgggttgaagagcaaccaaaaaagacggtagagttgaggaacatattgcaatcccatgtaagcgaatggagcttcagttgctggtagaaacccgtctaaaccactactacatctattccgaatcaaagctgatgctgcgaaagctga

SEQ ID NO: 7145 - DNA, 1363 bp, Lycopersicon esculentum
  Predicted polypeptide sequence is orthologous to G1198, G1806, G558
gaattccgggcttttagagttttgaagtgggaaaaaaaaggtttcttgaagacttagctgttgttggctttaagtcggaaggcaatgaattcttcaacatatactcaatttgttgcttctaaaaggatgggtatatgtgatccaatccatcagattggcatgtggggagatttcaaaggtagcagtttcccagatagcttgattcttgaagtcgagaattgcctcgagaatgagatgcctattatggagaaaagactagagaatgagatagaggaaccatcacaagtgacagttggaacgtctaacagatatgaacctgaaacaactaaacgtattgataaggtgcgtagacgccttgcacaaaaccgcgaggctgctcgtaaaagtcgtttacggaagaaggcctatgtccagcagttggaaaatagtaaactgaagctgcttcagctggaacaagaactagaacgtaatagacaacagggtttgtatgtaggtgatggtttagatgctagtcagataggttgctctggaaccgcaaattcaggaatagcttcttttgaaatggagtacggccattgggtggaagagcaagatagacaaacagatgatttaaggaatgctctgaactcccaaatgggtgaaatagaattgcgcattcttgtcgaggattgcttgaatcactattttgatctctttcgcttgaaagctacagccgcaaatgccgatgttctctaccttatgtctggcacatggaagacatcagctgagcgcttcttcttgtggattggggggtttcgcccctccgaacttctaaaggttctcacgccacatgtggaaccattgtcagatcaacaaatccaggaggttagcaacctcacccagtcttgtcagcaggcagaagatgcgttgtcccaaggaatggtaaaactccatcagattcttgctgaggctgttgcagctggtacactaggagaaggagttatccttccacagatgactgctaccattgagaagttggaagctctagttagatttgtaaatcaggcagatcatctccgccaagaaacccttctacagatgtcctgcatactggctccgcaccaatcagctcagggtctccttgccttaggagattactttaaacgtcttcgtgctcttagctcactttgggctggacgtctttctgaacctgcttaaagaggtaagaaagaacctgtgggttttcaactttgccaatcaaagctgtgtgagctaagtaacaagtatgagttggcgctcatttgaaatgtgtatataagttctggtatgctgtaattgaaacattttcttttgttatcacattggttttgatgattgtaaatca

SEQ ID NO: 7146 - DNA, 776 bp, Lycopersicon esculentum
  Predicted polypeptide sequence is orthologous to G1228
gaagatgagcatctcactgtatacaccagtttctcccaaaaaccaattacaagtatttttgaaaccaaatcagaatccccttctactaggtgattctgttcttccaaaacgtgtttcatttgctagaagaaaatgtaccacaagggctctgctttcacattccaaagatgctgttttgaaagagtttcacgagaaaaaagcactaaagattatcgcaggattgcaaaatctggacaaagagaatgtggcttctgttgttactgctgcagataagggaggagcaacacatgtagatatagcttgtgaccctgagctggtgaaacttgctataagcctgacttcccttccggtttgtgtttcttctgtggatccttcagcatttccagctgctgtggaagcaggagccttgatggttgagatcggaaactatgactcgttctatgagaaggattggtgttctctcctgaacagattttgaacctaacgaaggagacaaagaagttacttccatcagtgatattatcagtcactgtgcctcacacgctaagccttcctgatcaggtcaagctggccgagcaattagaaactggaaggtgttgacatcatccaaacagaaggaggaaaatgctctactccatcaaaaggctgtattcttggattaatcgagaggcaacaccaacactagcagctgcttattcgatttcaggggctgtcatatccccgtcatgtgttcatctgggattgagtgcagtcacagcaccaatggcaatcgtagc

SEQ ID NO: 7147 - DNA, 458 bp, Lycopersicon esculentum
  Predicted polypeptide sequence is orthologous to G1266
ttttttttttttttttttttaattctctgatagagagcgcttttgtctttattaagcttcagaataatcgaatcgatgaattccgaacactacatgaactatacacatgtagtgagtgagtgagaatgaaaacaaaatagaagcattttttatgtacaaacaagtagaagaatataattctaattagaggaagtactcgtcaaaagttcctctaacaattcagcacccaaatcttcaaaaaccaaaacatttctcttcttcctatttctcttatgtttaacacgtctcattttatttgttgcctttaaaacagcagctggtgaaatcccatcttcacaaatatacttaatattttcaagtgattctcttactttgtccattggaaaatttaaaagtgccaatggacctctcattgtaagtgcagcttgatcatacgctaaagcagcttcttcacaagt

SEQ ID NO: 7148 - DNA, 1022 bp, Lycopersicon esculentum; identical to SEQ ID NO: 2501
  Predicted polypeptide sequence is orthologous to G1266

SEQ ID NO: 7149 - DNA, 782 bp, Lycopersicon esculentum
  Predicted polypeptide sequence is orthologous to G1266
aaaattccctctaataaaagctatggttccaactcctcaaagtgatttacctcttaatgagaatgactcacaagagatggtattatatgaagttcttaatgaagctaatgctctaaatattccttatttaccccaacgaaatcaattactccctagaaataatattcttcgtccattacagtgcataggcaagaaatacagaggagtacgacgtcgtccgtgggggaaatacgctgcggaaattcgcgattcggctagacatggtgcgagagtatggctaggtacgttcgaaactgctgaagaagctgcgttagcttatgatagagcggcttttagaatgcgaggtgctaaggcactacttaattttccatctgaaatagtgaacgcctctgtttcagtagacaaattaagtttgtgctcaaatagttacactacgaataataattcagattcaagtttaaatgaagtttcaagtggaactaatgatgtatttgaatcaagatgttaaaacagagctgtgcatggagaatttcttggcactctaagcgaataatgtgtggacacgtagaaaatatttctatttatgtaagaatcaactgaactattaaaatttcgttgttgtatttatattatgtgcttgcctcttctcttattttccttatggaattgtttgcagcgacgcacgctataatctcatgtaaaaagattgcttaggatactttagtagtatgtttataagttgtaatatacaccttctattttctaaaaaaaaaaaaaaaaaa

SEQ ID NO: 7150 - DNA, 1018 bp, Lycopersicon esculentum
  misc_feature (866)..(866): n is a, c, g, or t
  misc_feature (877)..(877): n is a, c, g, or t
  misc_feature (887)..(887): n is a, c, g, or t
  misc_feature (901)..(901): n is a, c, g, or t
  misc_feature (910)..(910): n is a, c, g, or t
  misc_feature (918)..(918): n is a, c, g, or t
  misc_feature (925)..(925): n is a, c, g, or t
  misc_feature (948)..(948): n is a, c, g, or t
  misc_feature (957)..(958): n is a, c, g, or t
  misc_feature (962)..(962): n is a, c, g, or t
  Predicted polypeptide sequence is orthologous to G1266
gataacttgaaaaagaaaaaaaaaacagagcatcccccaaaaaaaaacaaacagagcattcattttttttttccaaaaaaataaatggattcttcttcttcttcatctcaattcttctactcaatgaattctgatttaaattcatcagattcttcatacgaatggtccaatttcaacacacaatcttatctccctttcaacgtgaacgactccgaagagatgcttctcttcggagttcttaacgctgctcatgaagaaacaacatccgaaacagtcacatcgcatcgcgttaaagaagaagaagttacctcagaatccgaggttattgaagcaataccggcgaaggagaagtcgtaccgaggtgttaggaggcgtccatggggtaaattcgcagcggagataagagattctacgagaaatggggttcgagtatggttagggacatttgatagcgcggaagatgctgctttagcttatgatcaagctgcgttttcaatgaggggtaattctgccattttgaattttccagtggagaccgttagggattcgctacgtgacatgaaatgtcacgtagacgatgattgctcccctgtagtggcgcttaaaaagcgccactccatgaggaaaaggagcacgaattccaaaaaagttaatagtattagtaaagtagtgagggaagttaaaatggaaaatgtaaataatgtagttgtgtttgaagatttgggggctgattatttagaacaacttttaagtacatcttgtcaagtgatcaaagtagttgtgatgcaactcatttcagtccatggtaaaatcaaagattagcccatgggtgttcttttttattaactaattttatttttggtacntttttggggtnggggtgggtngggggagggttacntctctttgntctttacntgaaggnccctatattgtaaaaattttggngatggatgnntttnaatttctaagcgaatgattttgctttaaaaaaaaaaaaaaaaaaaaaaaaaaaaaa

SEQ ID NO: 7151 - DNA, 3104 bp, Lycopersicon esculentum
  Predicted polypeptide sequence is orthologous to G1272
gactctctcataaatttgtcactctccctccttctcctctcttccatttagggttttgttcttgattttggtgcttcatctgcctcttttgagcagaagataggatcctgatatggctgaagaagaaacaaatggagcagcagcagagggtctgccacctcctccccctgttccaccagatttcactcctgctaaaactgaaattgagcctgtgaagaaaaagatcttgcgcgttcccatggccaggcgtggtgttggaaataagggacaaaagattcaaatacttactaatcactttaaagtgaatgtaaacaatgtggatggacacttcttccactacagtgttgccttattctatgaagatggtcgaccagttgatgggaagggagttggaaggaaggtgttagacacagtgcacgaaacttatgatacagaattagctggaaaggactttgcctatgatggtgaaaaaagcttgtttaccattggagcactccctaggaataaaatggagttcactgttgtccttgatgacgtgatatcaaataggaacaatggtaacagcagccccggtgggcatggtagtcctaatgaagctgacaggaagaggttacgtcgtccttaccagtcaaaaactttcaaggtggagatcagttttgctgccaaaatcccgatgcaggcgattgcaaatgctctgcgtggtcaagagtcagagaactctcaagaagccttgtgagtcttggatattattttgaggcagcatgctgcaaagcagggttgcctgcttgttcgacaatcctttttccacaatgatcccaagaactttgttgatgtcggcgctggtgtgcttggttgtcgaggattccattccagcttccggactacccagagtggcttgtctttgaacattgatgtgtctacaacaatgattatccagcctgggcctgtcgtggacttcttgattgcaaatcaaaatgcaaaggatcccttttcactggattgggcaaaggcaaaacgtgtgctcaagaatttgagggtgaagacaacccccactaatcaagagtacaagattactggactgagtgaccgtccttgtcgtgagcaactatttaccctgaagcagaaaggaaaagatgcagatggtgaggtccaaactactgaagttactgtgttcgattactttgtcaaccaccgcaacatagagttgcgttattctgctgatttaccctgcataaatgttgggaaaccaaagcgtcccacctttttcccaattgagctatgttccttggtgtctttgcaaagatacacaaaatccttgtccacattccagaggtcttcactagttgagaaatcaaggcgaaagcctcaggagaggatgcaagtcttaagcaatgctctcaaaatcaaccaatatgatgctgagcctctgcttcgttcctgtggaatatccattagcaataacttcactcagattgaaggacgtgttcttcctcccccaaagctgaagacgggcggtgatgactttgtccctcgtaatggcagatggaatttcaataataagagactagttgatcccactaagatagaacgctgggccgttgtcaatttttctgcacgctgcaatgtacaagggctagtcagtgatctgatcaaatgtggaaaacagaaaggaattatggtggaagacccatttgatgtctttgaggagtctccacaagtcaggagggctccaccacttgtgagggttgagaagatgtttgagcaggttcaatccaagctacccggggcacctaaattcctgctttgtttgcttcctgagaggaaaaactgtgatgtatacggaccatggaagcgaaagaatcttgctgagtatggcattgttacccagtgtatagctccaacaagagtcaatgatcaatatatcaccaatgtgctcctgaagataaacgcgaagcttggaggtttgaactctatgttaactgttgaacattctcctgcaatccctatggtgtctaaggtccctaccattattcttgggatggatgtgtcccatggctctcctggccaatctgatgtcccttcaattgcagcggttgtcagttcaaggcagtggccatcaatatctcgttacagagcttcagttcgtactcagtctcctaaagtggagatgatagacaacttgtttaaacgtacctctgatactgaagatgatggaataatgagggaggcgttgctagatttttatgtgagctctggaaaaaggaagcccgagcatataataatattcagggatggtgtcagtgaatctcagtttagtcaagttctgaatgttgagctggaccagattattgaggcttgtaagtttcttgatgagaagtggtcacccaagtttgtggtgatagttgcccagaagaaccatcataccaagtttttccagcctaatgatcctaacaatgttcctccaggcacaatcatagacaacaaagtctgtcacccaaggaattatgacttttacctgtgtgctcatgctggaatgattggtacaactcgtcctactcactatcacgtcttgtatgatgagctgggtttctctgctgatgatcttcaagagcttgttcataatctctcttatgtgtaccagagaagcaccactgcaatatctgttgttgctcctatctgttatgcccatcttgctgctactcaaatgggacagtggatgaagtttgaagatgcatcagagacttcctcaagtcataatggagtaaccaatgctggaccagtctccgttcctcagcttccaaagctcgaggagaaagtttccagttctatgttcttttgctaaggcgcgtaacgccttcatgcttttcttttttatgtgtggtttgtgaatagtttctggttcaaaactcttttgagaagacggtggtagttaaatattttgtctagacttaaataggtaaatcactctgctaaaagatttcacatcttttggctctgtggtttgctatctcttttaacttatcctggatcatgtacttatgttttggtggtgtttttaagttatggacatgactagtagtttctctcaaaaaaaaaaaaaaaaa

SEQ ID NO: 7152 - DNA, 551 bp, Lycopersicon esculentum
  Predicted polypeptide sequence is orthologous to G1272
gagctttagaagattgtggtaatggctgaagaagagaatggtggatccacagaggctctgcctcctcctccccctgttccacttaatttctctcctgcacaagctgaaccagagccagtgaagaagaaggttttacgtgttcccatggcaaggcgtggccttggaagcaagggacaaaagattccgatccttaccaatcactttaaagtgaacgtgtctaatgttgatggacacttctttcattacagtgttgccttattttatgaggatggtcgacctgtcgagggaaaaggcattggcagaaaagttctggatagagtgcatgaaacatatgatacagaattggctgggaaggattttgcatatgatggggagaagagtttgttcaccatcggttcactacctagaaataaactagagttcacagttgtactagatgacataacatctaatcggaacaacggtaccaatggcaactctagccctggcagacatggaagccctcctaatgaaactgataggaaaagattaaggcggccataccaatctaa

SEQ ID NO: 7153 - DNA, 489 bp, Lycopersicon esculentum
  Predicted polypeptide sequence is orthologous to G1272
ccttgtcgtgagcagatgtttactctaaagcagaagagcaaagatgaggatggtgaagtgcaaacttcagaagtgactgtttatgattactttgttaatcatcgtaacatagacttgcgatattctgccgatttgccgtgcctcaatgttggaaagcctaaacgtcctacctatttccccattgagctctgcactttggtctcattgcaaaggtacacaaaagccttgtccacctttcagagggcttccttggtggagaagtccaggcaaaagcctcaggagagaatgcaaattttgagcaatgctctcaaaatcaacaattatgatgctgagcctctgcttcgttcttctggtgtctcaatcagtagcaacttcacccaggttgacgggcgcgtactgcctgctcctaagttgaaggctggaaatggagatgaccttttcacccggaatgggaggtggaactttaataataagagattctttgagcca

SEQ ID NO: 7154 - DNA, 736 bp, Lycopersicon esculentum
  Predicted polypeptide sequence is orthologous to G1272
aacgaaaaatgatatttgatgccttactttcctatgtaaactgaatgttgagaagccctttgaattacatatgtgtatacaaacaagagaagagtaaattgagtggtggaaatacaaattgtgagatttgttccaccttattctcattttagtttacaaatatttagattggagaaaacagtaaattaaataagagcaacatatttacaactgttggacatcaaacgcagttgtgagttcaaggcagtggccgtcaatatctcgttatagagcttcagtgcgcactcaatctcctaaagtggagatgattgataacatatttaaaaaagtttcagacactgatgatgatgggattatgagggaacttttgctagatttttatgtgagttccgggaaaaggaagcctgagcacattatagtattcagggatggtgtcagtgaatctcaatttaatcaagttctaaacatagaactggaccagctcattgaggcctgcaattttctagatgagaagtggtcgcccaagtttgttatcattgttgctcagaaaaatcatcatacaaagtttttccagtctggatctccctgatatgttccaccagggacattatagataacaagtttgtcatccagggaacatgacttctatctgtgcgcccatgctggaatgattggtacgactcgacctacacattaccatgtggtgttggatgaaagtggtttctcacctgatgaa

SEQ ID NO: 7155 - DNA, 782 bp, Lycopersicon esculentum
  Predicted polypeptide sequence is orthologous to G1335
ggcgattggcggccaatcggccgaattgacggtgactttcccaagataacacaatcaaagggttttagggtttctttttctttgtgagcgaaaaaaatggctgatgagggttgtgagaggctcaagggaactgtcaagtggtttagtgaccagaaggggtttgggttcatcacccccgccgatggctctgaagatctgtttgtacaccagtctggtatcagatctgaaggattcaaaagcctagctgaaggtgaggatgttgagtatcagattgagtctggctcaaatggtagggctaaggcttccgatgttactggacctaatgaagcggctgttaaaggaggttcccgcagcggtggaggacgtgatggaggtggttacggcggaggcggtggttacggtggaggcggaggttacggtggtggccgaggaggaaatcgtggttatggaggtggtgacagtggctacggaggaggtagccaaggtggtggcggctacggaggcggtggaggctatggaggaggtggcggaggcggcggaggctgcttcaaatgtggggaatctgggcatttcgctagagaatgtccacaggatggtggcagtggcggaggcggtggaggtagatattctggtggtggaggtggtaggtactccggtggcggcggcggcggcggcggaggctgctacaaatgcggcgaagaaggtcatttcgcccgcgagtgcaccagcggcggccattgatcgttatctctatgtttgtttttgctgtttttatgtttccg

SEQ ID NO: 7156 - DNA, 1051 bp, Lycopersicon esculentum
  Predicted polypeptide sequence is orthologous to G1364, G481, G482, G485
tttttctccctgacatattgtttattattagtttcataaaaaaaattataaaaattttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgcagaggtttagggatttggaagggcaaaaaagtggtgtctctggagagaaggatcatagtggatcagtgggttatgttgaggactaccatggcatgatgatgatggggagtcaacatcatcaaggacacgggtatggcaccggtgtatacaatcatcatacgggggagaatgctgcaggggttggtacaggagggtcgcggtttcctgacgttgggaggcaaaggtgaagctgtgacatccgcggactacaaagatgtatcaggacgcgatgtatcaactgtcaacaggttgaagtatggacactgaaagacaggaacagactttgtagtttgtattctacagagatgtaaattggtaaacatgtgtgtacattacaatgtgggtgtaaacatggattgtaattgtctattacatcattgtttctctaatagttgatgtttgaataagccttttttagtgtaccaaaaaaaaaaaaaaa

SEQ ID NO: 7157 - DNA, 485 bp, Lycopersicon esculentum
  Predicted polypeptide sequence is orthologous to G1364, G481, G482, G485
accagcaaaagactaaccactgttctatgtattcagcttttttttgggtatgcatccaaagttctttgttcatcttaaaattcataattgggagtttccatagtctaagccttgtgcaaaagaaccttcatacatgaactgcgtattggacccaagctgacttccaactacatcttttctaacagatgcatcaccaacccttgcagatcccttggcatctccctccatctctctgtatcgagtcaaatagaccttcagtggttcaatgtagtcctcaaatcccaaggtagccagggctgatagtaaatcatctccgttgatcgtctttctcttctctttctgacacttgtcactagcctcgctagtaataaaactgatgaactcagatacgcattcctgaaccgtgtctttagaatccttagcgatcttcccattagcaggcaatgccttcttcattatgcgtccaatattagcgatcggtaggt

SEQ ID NO: 7158 - DNA, 806 bp, Lycopersicon esculentum
  Predicted polypeptide sequence is orthologous to G1364, G481, G482, G485
cggccgaattggtaaaacgaacggtgttgatagggcaaaatccaaaactctgcctcatctcagtcgtctccctttctcccttcttctccaacgtccgatcttccagttccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgatgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatggttcttctgctgtaacctctgtaacatggtttattaattctagtgctctctagtgagtgccgtgtcatatttaaagtttgtaaattga

SEQ ID NO: 7159 - DNA, 963 bp, Lycopersicon esculentum
  Predicted polypeptide sequence is orthologous to G137, G145
ttttcgggggttttgtgcttttgtaagtttgagaaagaggaaaaagaaaaatgggaaggggtagggttgagctaaagagaatagagaacaagatcaacaggcaagtgacctttgctaagagaagaaatgggcttttgaagaaagcttatgagctttcagttctttgtgatgctgaggttgctctaatcatcttctctaataggggaaaactctatgagttctgcagtagttctagcatgctaaagacgttggagaggtaccagaagtgcaactatggagcacctgaaccgaatatatcaacacgagaagcactggaaattagtagccagcaggagtacttgaagcttaaaggacgttacgaagcattgcagcgatcacagaggaatcttcttggtgaagatcttggtcctttgaacagcaaagaacttgaatcacttgagagacaacttgatatgtcgctcaaacagatcagatcaactcggactcagttaatgttggatcaacttacagattatcagagaaaggaacatgcattgaacgaagccaacagaaccttgaaacaaaggttgatggaaggaagccaactaaatctgcagtggcagccaaatgcacaagatgtgggctatggccggcaaacaactcaaactcagggcgatggcttctttcatcctttggattgtgaacctactttgcaaattgggtatcagaatgatccaattacagtaggaggagcagggcctagtgtgaataactacatggctggctggttgccttgaaggctcacgattctgatcataacattattataaatatgctcaatggttttcctatcatcataaacattgaatatctcctaatttctgtatgttgtttgagaaaatgtttcatcctggacctaacggggatccataagacaatcccgttattgttagtaaatcataaactagatttctttgagtgctt

SEQ ID NO: 7160 - DNA, 1042 bp, Lycopersicon esculentum
  Predicted polypeptide sequence is orthologous to G137, G145
caaatctctgaaaaaattgaagattgatttctcaatgggaagaggaagagttgagcttaagagaatagaaaataaaataaataggcaagtcacttttgctaagagaagaaatggacttcttaaaaaagcttatgaactttctgttctttgtgatgctgaagttgcccttataatcttctctaataggggtaaactctatgaattttgcagcacttcaagcatggtgaaaacaattgaaaagtaccaacgttgcagctatgctactttggaagccaaccaatcagttactgatactcagaataactaccacgaatatctgaggctaaaagctagagttgagctcctccaacgatctcagagaaactttcttggtgaagatttgggcacgttaagctcgaaggaccttgagcagcttgagaatcaattagagtcttccttaaagcaaatcaggtcaaggaagacacaattcatgctggatcagcttgcagatcttcaacaaaaggagcaaatgcttgcagaatctaatagattactccgtagaaagttagaagaaagtgtagctggatttccacttcgattgtgttgggaagatggaggtgatcatcaacttatgcatcaacaaaatcgtctccctaacacagagggtttctttcagcctcttggattgcattcttcttctccacattttgggtacaatcctgttaatacagatgaggtgaatgcagcggcaactgcacacaatatgaatggatttattcatggatggatgctttaatctgataattcgaacaagctaatccatgtttggttaaacagttatacagtaataatgtattgcatgtattatcatccttttttgttttgttgcaaattttatttcgaaactctcttcaggaattatggcggcgatcgattaatcgaggacagtaaatgtaatgtatgcataagttgctactttaacatttgaaacctcctgaccatgcatttctgattgtatcacaatgtgtaattaaatggaattgttgtattttttgtatcattg

SEQ ID NO: 7161 - DNA, 842 bp, Lycopersicon esculentum
  Predicted polypeptide sequence is orthologous to G137, G145
atcggccgaattggggtaaactctatgaattttgcagcacttcaagcatggtgaaaacaattgaaaagtaccaacgttgcagctatgctactttggaagccaaccaatcagttactgatactcagaataactaccacgaatatctgaggctaaaagctagagttgagctcctccaacgatctcagagaaactttcttggtgaagatttgggcacgttaagctcgaaggaccttgagcagcttgagaatcaattagagtcttccttaaagcaaatcaggtcaaggaagacacaattcatgctggatcagcttgcagatcttcaacaaaagttagaagaaagtgtagctggatttccacttcgattgtgttgggaagatggaggtgatcatcaacttatgcatcaacaaaatcgtctccctaacacagagggtttctttcagcctcttggattgcattcttcttctccacattttgggtacaatcctgttaatacagatgaggtgaatgcagcggcaactgcacacaatatgaatggatttattcatggatggatgctttaatctgataattcgaacaagctaatccatgtttggttaaacagttatacagtaataatgtattgcatgtattatcatccttttttgttttgttgcaaattttatttcgaaactctcttcaggaattatggcggcgatcgattaatcgaggacagtaaatgtaatgtatgcataagttgctactttaacatttgaaacctcctgaccatgcatttctgattgtatcacaatgtgtaattaaatggaattgttgtattttttgtatcattgaatcatatgcttatc

SEQ ID NO: 7162 - DNA, 729 bp, Lycopersicon esculentum
  Predicted polypeptide sequence is orthologous to G137, G145
atgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcatggcattgtggtgagcaaagtgtacaatatagacatgaacagccttctcatcatgagggattttttcaacatgtaaattgcaataatacattgcctataagttacggatacgataacgtacaacccgaaaatgcagcaccatcaacacatgatgctactggagtcgtacctggatggatgctttga

SEQ ID NO: 7163 - DNA, 943 bp, Lycopersicon esculentum
  Predicted polypeptide sequence is orthologous to G137, G145
atgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcttggcattgtggtgagcaaagtgtacaatatagacatgaacagccttctcatcatgagggattttttcaacatgtaaattgcaataatacattgcctataagttacggatacgataatgtacaacccgaaaatgcagcaccatcaacacatgatgctactggagttgtacctggatggatgctttgaatttggagtatatggagagaaaaaatccttttagttatacgagttatttatttttattaaaaaaataagttagatggagaattatatatatcatactttaaagaactcatattgtttgaatgttttagctagcaaacactttggattatatataatattgtgatatatttattggcccaaaaataaaaaaaaaaaaaaaaaaaaaaaaaaaaaa

SEQ ID NO: 7164 - DNA, 1697 bp, Lycopersicon esculentum
  Predicted polypeptide sequence is orthologous to G137, G145
gtcgacgggaaccattagattttaaagacattaaatctattacccttaccctaagaataagaagatgtaaagtagaagagaaaacaaccaaaaccatatatatacatatatataattacattatattgtcttataacatatagtcttttaaggaaaaacaaatttagaaaaaaaataatattattttacatttttttttcttcatacaatatgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcatggcattgtggtgagcaaagtgtacaatatagacatgaacagccttctcatcatgagggattttttcaacatgtaaattgcaataatacattgcctataagtatggaacaaattcttgaacgatatgaaagatactcatatgcagagagacgtttgcttgcaaataattctgaatcaccggtgcaggaaaactggagcttggaatatactaaactcaaggctaggattgatctccttcaaaggaaccacaagcattatatgggagaagatcttgattcaatgagcttgaaggacttgcaaaacttggaacaacagcttgattctgctcttaagctaattcgatcgagaaagaaccaactcatgcatgaatcaatctctgaactgcagaaaaaggaaagagctatcctagaggagaataacatgctaaccaagaagattaaggagaaggataagatagtagaacagcaaggtgaatggcaccagcaaactaatcaagtttctacttcaacatctttcctcttacaaccacatcaatgcctaaatatgggaggtaattaccaagatgaagtagcagaagcaaggaggaataatgagcttgacctaaatcttgattcattatatccactttacaacatgaataaacatctatgaataatttcactctttgctaatcgcttgaaacgttgaaaggagctcactatcaggacagacaaatgagtataagcgattagcgataaaaactctatgcgagaggaaattatatatgatgttaattaatctatgcttgagaaattcttaattatatatattgagtgtctttatattgatatgcatgtatagaaccttattattatgaatttctatgtattaatgttttaagtatgttaaaacttaattgtaaatggaatcaagtccattctctttgtatcaaaaaaaaaaaaaaa

SEQ ID NO: 7165 - DNA, 1191 bp, Lycopersicon esculentum
  Predicted polypeptide sequence is orthologous to G137, G145
gtcgacgggaaccattagattttaaagacattaaatctattacccttaccctaagaataagaagatgtaaagtagaagagaaaacaaccaaaaccatatatatacatatatataattacattatattgtcttataacatatagtcttttaaggaaaaacaaatttagaaaaaaaataatattattttacatttttttttcttcatacaatatgggtagagggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcatggcattgtggtgagcaaagtgtacaatatagacatgaacagccttctcatcatgagggattttttcaacatgtaaattgcaataatacattgcctataagttacggatacgataatgtacaacccgaaaatgcagcaccatcaacacatgatgctactggagttgtacctggatggatgctttgaatttggagtatatggagagaagaaatcctcttagttatacaagttatttatttttattaaaaaaataagttagatggagaattatatatatcatactttaaagaacttatattgtttgaatgttttagctagcaaacactttggattatatataatattgtgatatatttattgtcaagaagagtatggcaatattgataacactaaaaaaaaaaaaaaaaaaaaaaaaaaaaaaaaaaaggaaaaaaaaaa

SEQ ID NO: 7166 - DNA, 1231 bp, Lycopersicon esculentum
  Predicted polypeptide sequence is orthologous to G137, G145
ctaaagttaaaacaatgaatccctaaagaagataggaagaaatgccatagataaaaacaacccatgttcactttttctctctctaaacattgaaattcaaccaaaacaaaaaacaaaagttgataagaatcctttctttctttctttgtgtgtgtgtgtgtctagctagggtttgcatttctttcacaattttggttgtttcagtaggagagaaaagaggatctaagagttagccaagagaagaaattagtgagaaaataaagtagaaaaagatcatcagaggaaggagggatgggtagaggaagagttgagctgaagaggatagaaaacaagataaatagacaagtcacttttgcaaagaggagaaatggattgctcaaaaaagcttatgaactatctgtgctttgtgatgctgaagttgctctactcgttttctctaatcgtggaaaactctatgaattctgcagcacaaacaatatgctcaaaacacttgataggtaccaaaagtgcagctatggaacattggaagtcaatcgatcaatcaaagataatgagcaaagcagctatagggaatacttgaaactcaaagccaaatatgagtcgctgcagcgatatcaaagacaccttcttggagatgagttggggcctctgactatagatgatcttgagcatcttgaagtccaactagatacttccctcaaacacattaggtccaccaggacacaaatgatgcttgatcagctttctgatcttcaaactaaggagaaattgtggaatgaggctaacaaggttcttgaaagaaagatggaagaaatatatgctgaaaacaacatgcaacaagcatggggtggtggtgagcaaagtctcaattatggtcagcagcaacatcctcaatctcagggtttcttccaacctctagagtgcaactcttccttgcaaattgggtacgatccaataacaacttcaagccaaataacagcagtaacaaatgcccaaaacgtgaatggtatgatacctggttggatgctgtgaatgaaaaagtcctttatcttcagctttgcataaaagcatatgaagtatatttctataataataaaggaaaactccagtacctttattttcagcaaaataccctaattaaggtgaacgttgtgaaccattttctttgcataaaaacaaacttgtttgcttggaaatgttttattttattcaaaaaaaaaaaaaaaaaaaa

SEQ ID NO: 7167 - DNA, 1081 bp, Lycopersicon esculentum
  Predicted polypeptide sequence is orthologous to G137, G145
ctttcacaattttggttgtttcagtaggagagaaaagaggatctaagagttagccaagagaagaaattagtgagaaaataaagtagaaaaagatcatcagaggaaggagggatgggtagaggaagagttgagctgaagaggatagaaaacaagataaatagacaagtcacttttgcaaagaggagaaatggattgctcaaaaaagcttatgaactatctgtgctctgtgatgctgaagttgctctactcgttttctccaatcgtggaaaactctatgaattctgcagcacgagcaatatgctcaaaacacttgataggtaccaaaagtgcagctatggaacattggaagtcaatcgatcaatcaaagataatgagcaaagcagctatagggaatacttgaaactcaaagccaaatatgagtcgctgcagcgatatcaaagacaccttcttggagatgagttggggcctctgactatagatgatcttgagcatcttgaagtccaactagatacttccctcaaacacattaggtccaccaggacacaaatgatgcttgatcagctttctgatcttcaaactaaggagaaattgtggaatgaggctaacaaggttcttgaaagaaagatggaagaaatatatgctgaaaacaacatgcaacaagcatggggtggtggtgagcaaagtctcaattatggtcagcagcaacatcctcaatctcagggtttcttccaacctctagagtgcaactcttccttgcaaattgggtacgatccaataacaacttcaagccaaataacagcagtaacaaatgcccaaaacgtgaatggtatgatacctggttggatgctgtgaatgaaaaagtcctctattttcagctttgcataaaagcatatgaagtatatttctataataataaaggaaaactccagtacctttattttcagcaaaataccctaattaaggtgaacgttgtgaaccattttctttgcataaaaacaaacttgtttgcttggaaatgttttattttattcaaatcataatgtggatgatgatgaaaaaaaaaaaaaaaaaaaaaaaaaaa

SEQ ID NO: 7168 - DNA, 441 bp, Lycopersicon esculentum
  Predicted polypeptide sequence is orthologous to G138
tttttttttttttttttttttaaacaaaaatattagatacatatatatatcataaattccaagatgtcatagtgcatagttgagatggggccggcagttgttatttttataacaagttgagtgaattattctcctcactacttcaacaataattgtaagttgctaaatacagattagtggccaccacaaaaacaacattaattatattagttcatacaatacaagagaacaaatattactatgttaatccattagagcatccaccctggaataaatccattaatattatgagcagttgttgctgcattaacctcatgatcatttgcacccatatttggattgtatccgaattgaggcgatgaagaattcaaacggagaggttgaaagaaaggttgtgcagtagtttgtggagggagtcgattgtattccattgtttgtcct

SEQ ID NO: 7169 - DNA, 2140 bp, Lycopersicon esculentum
  Predicted polypeptide sequence is orthologous to G1382
ggaatccgtcaatggaagattctcagtctcactcccactctcaccctaaccaatacaaccactcagctccactcctttccatcaatgaatcttcacagcaacttaaatttgcaagctccgatgctgctttctctcacaccgtctcctccgccgttggatccaacaccggtgctaggtacaagctaatgtcacctgctaagctcccgatctctcgctcctccgcatgtatcaccatccctcctggtctcagtccttcatcctttctcgaatctcccgttcttctatcgaacatcaaagctgagccgtctcctaccacaggttccttctccaaatttcaagtaatgcaaggctctagtgggagtgctgctttttcatatttgagaagctgttcaagtggaaatgtatatggtgaaacgaccggcgaatttgagttcaaatttgctattgcatctaattctacatcaggatcactggcgaatgaagctgcagtgatttctgcaggttccaaccaacagcaaagtgaacctctgattcaagttcaagatcgatatctttctcaatcattagcaccttcagttcttgttgaaaccgagatgcctgattcaaaagagctgagtctacctgcacctgttagtttagaagcctcgtcaattagtacttctgctgctgcaactgataatgaagaaacaaatcagagaggtcaatcaaatacaagctcgcaagggtcacatgctgataataaagatgtatcatcgataactgctgagagatcatcagaagatgggtataactggagaaagtatggccagaaacttgttaaaggaagtgaattcccaaggagctactacaaatgtacatacccaaactgtgaagttaaaaagatatttgagcgctctcctgatggacaaataacagagattgtgtataaaggttcccatgatcatcctaaaccccagcccagccgtaggtttactcctggtgtgcttacttccatccaagaagacagaggtgagagagatgcatgcctcactggtcaagaagacaaattcaacactaatgcccagactagtaacactgagcccggcggtaatccactatcacctcgacaagcaggtgatgatggtcttgaaggtacagtgtctcagttgcatagtgctaatgatcaaatggacgaggatgatccatttgcaaaaagaaggaaaatggatggtggcatggatattacaccaattgttaagcctatccgtgaaccacgtgttgttgttcaaactgtgagtgaagttgatatattggatgatggatacaggtggcggaaatatggtcaaaaggtggtccgtggtaatcctaatcccaggagttattacaagtgcaccaatgctggatgccctgtcaggaaacacgtggagagggcatcccatgatcccaaatctgtaattactacatatgaggggaaacacaatcacgatgtaccagcagctaggactaataaccatgaaatggcaggatcagcatctgtaactgggggttcaagggtcaggacggaagagaatggctcagttagcttgaatctaggtgttggtattggttatggtatggagaataggcgcaatggacaactgcacacactgcctgcagaaactgcacatagccaagttcaggtttcaagttctagtatgatgttagtacagccagctacagttgcagcatgctacaacattgtaaatggtggaatgagccggtttggaactatggaaaatcgtgttcagggcactggctttgagactctgcccttgcaatcatctgctcaatgtcctcaaaactatggaaggatacttttgggcccgtgaatgtttcttccctcaggcaaaaacttaaaaataagaagcttccatccgttttctttttcagcttctcggtgggattacagagggctgcatctcttattggcgtaacctcgcttcaggattaagtacccagcatgttgtatgatacagtttcaccaaatgttcattatgtaattagctttaatatcactgttgctttatactgacagtatgctacaaaatgtaacaactatggatgttctgagtagatgtgaacgtcaatatattccctaaaagtaggcaaaaaaaaaaaaaaa

SEQ ID NO: 7170 - DNA, 754 bp, Lycopersicon esculentum
  Predicted polypeptide sequence is orthologous to G1382
cctgaagccacttaaaccaggagatgagggtgataataatggtggtcgcaactcaaagagacggaagaaagaagtacctacgagtgatgacatgactccacctatgaagtctcctagtgaatcacgacacattgttcaaactagcagtgaagtggatgtagtcaatgatggttaccggtggcgtaaatacgggcaaaaatttgtgaaaggaaatccaaatcctaggagttactaccgatgctcgagtgctggttgccctgcaaagaagcatgtggagaggtcatcccataatccaaaatcagtgattacagtatatgaagggcagcatgaccatgacatcccaccttccaaaactgttatccaaaatacagcaaaggctgattctaatacaacaagaataagtggagagtccacatctgaatcaggtgaaaacaaacatgttgtccatattggtgcaagttgagagcataatgccaaacaatcaaactcaatacagatttagataatgttacatcatcaagttatctaatcttatcttttttcttatttgttgtaattggtcaattgttctccacttgtaggagaaaaaagaaaggataaatatatatgtattatagaaacagctgatttaacctcataattggtgtgaattcctatacttaaatgtataagttgtgttaataataaatttaagagagttcagatcgatataaaataattaaaaaaaacaaaaattaaaccatgtcggccgcct

SEQ ID NO: 7171 - DNA, 634 bp, Lycopersicon esculentum
  Predicted polypeptide sequence is orthologous to G1382
gtaaaactgagcctagtagtactcccgtatcacctcagcaagcggacactgatggtcttgaaggagcagggtcacagatgcatggcactaatgatgatatggatgaggatgatcaatttgcgaaaagaaggaaaatggatggtgggatggatataacaccagtgattaagcctatccgtgaaccacgcgttgttgttcaaacagtcagtgaagttgatatattggatgatgggtacaagtggcgcaaatatggacagaaggtggtccgaggcaatcctaatcctaggagctattacaagtgcaccaatgctggatgccctgtcaggaaacatgtggagagggcttctcatgatccaaaagctgttatcaccacatatgaaggaaaacataaccacgatgtacccgctgcaaaaaataataaccatgaaatgacaggatcctcgcctgtaaccggcagttcaaggatcagggcaggagagaccaactcacttagtctggatctaggcgttagtactggatatcgtcttgataatgggaacaacgggcaacttcacaccctccatcaccaagttcaagtttcacgttctggtatgatgctagtacagccagctgcagttgcagcgcgctatggtat

SEQ ID NO: 7172 - DNA, 618 bp, Lycopersicon esculentum
  Predicted polypeptide sequence is orthologous to G140, G146
gcacgagctttggaagttgtgtgagttttcagaaagcctttgaagttcgccggaaaatagcaatattttcaattcaagccaatcagatgggaagaggaaagatagagataaagaggatagagaacaacacaaacaggcaggttacattttgcaagagaagaaatggattgttgaagaaagcctatgaactctctgttctatgtgaagctgagattgctcttattgttttctccacacgtggacgcgtctatgaatactctaacaacaacattaaggcaactattgaacgatacaagaaggcaactgctgaaacctctaatgcttgcaccactcaagagctcaatgctcagttttatcaacaagaatcaaaaaagctgcgccaacagatacaaatgatgcagaattcaaacaggcatctggttggtgaaagattaagttgtttgaacgtaagagagctgaagcagttggaaaatatacttgaacgaggcatcagcagaatcagatcaaaaaagcatgagatgatactggctgaaactgagaatttgcagaagagggaaattctactggaacaggagaatgcattccttagatcaaagatagcagaaaatgagaggcttc

SEQ ID NO: 7173 - DNA, 761 bp, Lycopersicon esculentum
  Predicted polypeptide sequence is orthologous to G140, G146
gaaaaatcatttgaagaatggggagaggaaaagttgaattgaagagaatagagaatcaaacaaataggcaagttaccttctccaagagaagaaatggtttacttaaaaaagcttatgaactctctattctatgtgatgctgaagttgcccttctccttttctctccttctggcaaagcttatcatttcgcgagccacgacatcgaaaggactattttaaggtacaagaatgaagttggattgtccaaaaatagtgatcaaggtcccagagctatggaggtttggagaactaagattgatgacatgacaagaacaatacatgaacttgaagctagagataagcatttttgctggagaagagttatcaaatcttggtatgaaagattgaagcagttggagcgtcaactcagagttggagttgaacgcattcgatctaaaaagcataaaatccttcatgaggagaacatccatcttcaaaagcaagtaaaattatatgaagtagaaggagctcaaggattctcgatacaaatccaaggatgaggattatatgatttacagagcttcaattgctaccttaagtggacgtatacgtagcatatattataaatagtgtgtatgatatatttaggatgataatttttttgtgttgtttgaatatatttattgactatctagaattttcattccaagttaatgttaggtaaaagaaaaatatgaagttactatgttaatattataatttgaaatatgaattttatgctc

SEQ ID NO: 7174 - DNA, 1084 bp, Lycopersicon esculentum
  Predicted polypeptide sequence is orthologous to G140, G146
cattatatactaatttgcaaccaaaaaacttaaaaatcttctctttcctttccttacaaggtgaagtaatggacttccaaagtgatctaaccagagagatctcaccacaaaggaaactaggaagggggaaaattgagatcaaaaggatcgaaaacacgacgaatcgacaagtaacattctgcaagaggcgcaatggtttgcttaaaaaggcttatgaattgtctgtgctctgtgatgctgaggttgctttggttgtcttctcaaacagaggcagactctatgagtatgccaacaacagtgtgaaagcaacaatcgagaggtacaagaaagcatgctcagattcctcaaacactggttcagtatccgaggccaatgctcagtattaccagcaagaagcctccaaactgcgcgcacaaattggaaatctgatgaaccaaaacaggaacatgatgggtgaagctcttgctggaatgaaactcaaagaactgaagaatctggagcaaagaattgaaaaagggattagcaaaatccgatccaaaaagaatgagctgttgtttgctgaaattgagtatatgcagaagagggaagttgatttacacaacaacaatcagtacctgagagcaaagattgctgaaactgagagagctcagcatcagcatcagcagatgaacttgatgccagggagttcatcaaactatcatgagcttgtgcctccacctcagcaattcgatactcgaaactatctacaagttaatggattgcaaaccaacaaccattaccctagacaagaccaaccccctattcaactagtctaatgtgcttgagagattgtcttctttctgatgtgatctacatataatccacaaaagaagactgctattaagcttgaagattaatggaacttaagtatgtataccatattattaattacttgttgcatgagctaagactcttgaatattgtatgttaattaagtggacatgtattttttttgcttggtgtacttccttttctgccagtgaactatgaagaattaagcttgttatattaagttcacaactgtttttctgtccaaaaaaaaaaa

SEQ ID NO: 7175 - DNA, 916 bp, Lycopersicon esculentum
  Predicted polypeptide sequence is orthologous to G140, G146
gcatatcttatccattcaactcactcagatcgatcgattcgatcgatgggtcgaggaaagatagagataaagaggattgaaaacaacacaaatcggcaggtgacgttctgcaagagaagaaatggattactgaaaaaggcatatgaactttcagttctatgtgatgctgagattgctctcattgttttctctactcgtggtcgactctatgaatactctaacaacaatgtaaaggcaactatagaacgatacaaaaaggcaacagcagaaacgtctagtgcgtacactactcaagagctcaatgcacagttttaccaacaagaatcaaagaagttgcggcaacagatacaaatgatgcagaacacaaataggcatctggtgggtgaagggctgagctctttgaatgtgagggaactgaagcaattggagaacagacttgaacgaggcattacaagaattaggtccaaaaagcatgaagcaatactagctgagactgaggatttgcacaagagggaaattcaacttgaacaggaaaatgcattccttagatcaaagatagcagaaaatgagaggttgcaggaactaagcatgatgccatctggtggggaagagtataatgcatttcaacaatatttagcaagaaatatgctacagctcaacatgatggaaactgcactaccatcttatgatccattgtctcctgatcacaaaaggtaaatccatttctactgaggaggaaggaatacgcacttttcaaacatataaataatctttactacatgtttgctattagtatactctggacatctcaactttttttccaatagaccctgcatcatttcctaaaatttggggcttagttatgaaatttaattgaatttgggtaaaagatcgtcacaaaaaaaaaaaaaaaaaa

SEQ ID NO: 7176 - DNA, 1116 bp, Lycopersicon esculentum
  Predicted polypeptide sequence is orthologous to G140, G146
gttttttttttcttcttttcgatacaagacgatatggtttttcctattaatcaggaattacttgtcgatgagtcgtcttctcagttgagaaaaacaagtggaggaactggtggaggaggtagagggaagattgaaattaaaaggatcgaaaatacgacaaatcgacaagttacgttctgcaagcgtagaaatgggctattgaaaaaagcttatgaactttctgtcttgtgcgacgctgaagtttcactaattgtattttccagccgcggccgtctctatgaatatgccaataacagtgttagggcaactattgataggtacaagaaacaccatgctgattccactagtactggatctgtttctgaagctaacactcagtactaccagcaagaagcatccaaactgcgacgacaaattcgagatatacagacttataacaggcaaatagttggagaggcattgggcagtttaagccctagagacctcaagaatttggaagggaaacttgaaaaggccattggtagagtccgttccaaaaagaatgaattgcttttctcagaaatagagctcatgcaaaagagggagattgagctgcagaacgccaacatgtatctacgcgcaaagatagcagaggtagagagagcacaagagcaaatgaacttgatgcctggaggcggaggcggaggcggaggcggaggaggaggaggatctgatcatcaataccatcatcagccaaattacgaagatgctcgcaataactccctgcctgtaaatctcctggaaccaaatcctcattactctcgtcgcgacaatggtgaccaaactcctctccagcttgtctgataataatggagcaggtattctgaaatttggggtcaaggctcttcatcttcagaaaaatgtgtactacaatttttaacctatagtgttgtaaatcataatcataattattgccactgagatttaaactgtttatttttaagcaatattattcagtcatctgttaattaaggaatgaaaaatcttgtttgttatattatgactacttctatatacttttacagccttatataaataatatgctattgaactataaaaaaaaaaaaaaaaaaaaaa

SEQ ID NO: 7177 - DNA, 819 bp, Lycopersicon esculentum; identical to SEQ ID NO: 2175
  Predicted polypeptide sequence is orthologous to G1419, G43

SEQ ID NO: 7178 - DNA, 1347 bp, Lycopersicon esculentum
  Predicted polypeptide sequence is orthologous to G1419, G43
aaaatgggttctccacaagagacttgtacttcacttgatttgattaggcaacatctttttgatgaatctctggaccagacttgtttctcttttgaaacaactcaaacttcaaatcttgatgacatcgcaagcttctttaatgctacttcaaaaacagagtatgatggttttttcgaatttgaggcaaaacgacatgttatccattcaaattctccgaaacagagtaacttgagagaacggaagccatctctgaacgtagcaataccggcgaagcctgttgttgttgtagagaacgttgagattgagaagaagcattacaggggagttagacagaggccatgggggaagtttgcagcggagattcgtgacccaaatagaaaggggactcgagtttggttaggaacatttgatactgctgtggatgcggcaaaggcatatgacagggcagcgtttaagcttagaggaagcaaagcaatattgaatttcccactcgaagttgcaaactttaagcaacaaaatgatgagactaaaacagagacgaagtcgtcaggcagtaaaagggtgagaggagaaacagaggaattagtaatcaagaaggaaaggaaaatagaagaagaaagagtactcccaacggcggcggctccattaacaccgtcaagttggtcgacgatttgggatgaaaagggtatttttgaggtgccaccattgtcaccattatctcagcttgttatgatataattttggattataagtatttgatgaatatgcacctgactataaactaagtctgaggtgaattaggattataattatgtgtctctttggatctttaatctttaataatttctttcattaaaaaaaaacctcgtgccgaattcggcacgagggcaaaagcttcttctggttccatgcagcagaactcacaacacatgaaaacttccgcaactgatgatgttcctcaaacattcttctcaagatccccatctagcacgtctgttgcagggaaggcttctgaccaacctaaaagaacaccggtgtctcaggaggaaattgagtccattttgttaggtggctgcaactaattttgaggcgaagatgtgcagacagaggacatagtttttcgacgtctggcttacatttgggtgatttcttttgcatgtatggtataactgacacagttttctggaattataagtgtattctgcaaatgacatctttaattaatgatcattagacattggaggctaatgcgtggattggcttactaccttgatactgaatgtaaacatttgcagactatgcattataaaattttggtccatctgaaaaaaaaaaaaaaaaaaaaaa

SEQ ID NO: 7179 - DNA, 1105 bp, Lycopersicon esculentum
  Predicted polypeptide sequence is orthologous to G1419, G43
gcggcaggtcgaaaaccttcgttaaacatttcgattccttctgttaagaaaacagaggaaccaaaaacaggggaagtaaaaacaggggaaccaaaaacagaggagccaaaaacaggggaagtgaaaacagagtactctgttaaggagaaaatggtagaaaattcggagaaaaagcgatacagaggagtgagacaaaggccatgggggaaatttgcagcggagattcgtgacccaactagaaaggggacacgagtttggttaggaacattcgatactgcaatggatgcagccatggcatatgacagagcagcatttaggctcagagggagtaaagcaatcttgaattttccacttgaggtaagcaatttcaagcaagaaaatcatgagattgagaaaaatgttgtgaatttgaattcgaatacgaattcttgtgggaaaagggtgagaagggaaatggagaatgatgacggaattgtaatgaagaaagaggtgaaaagagaacaaatggtggcaactccattaacaccttcaaattggtcttcaatttgggattgtggaaatggaaaaggtatttttgaagtgccacctttgtcaccattatcaccacattcaaattttggttattctcaacttttggtatcatagtgaaatccccaaaagatccattgagtatgttatggaatattatatagcggaattatactgccatcacgatcccatgagatttagtcttttgttatgttgagagttttaaaatgttatggcagaatatattactgtcacaatccactgagatttagacctttattgtgtcgatccactgaaatttagtcgagagttttaaaatgaaatattttgaacaagtatgaagtgatttcaagttgtaataaggaatttactttggaaattttggataaaaatagcacatgtacaaatgaagaaacatggaatgatggagggagaatggaagtgttttgaatcatggatatttttaattattttttgatttcattgattaagcttttttttttccatgtaaatatgaattttaatttggttggtttattttgaaggaaaaggttcaaaaaaaaaaaaaaaaaaaaaa

SEQ ID NO: 7180 - DNA, 1405 bp, Lycopersicon esculentum; identical to SEQ ID NO: 2307
  Predicted polypeptide sequence is orthologous to G1421, G1750, G440

SEQ ID NO: 7181 - DNA, 641 bp, Lycopersicon esculentum
  Predicted polypeptide sequence is orthologous to G1435
cttcattcaacggcatctctctcaaattcgccggaatatactccaccagcggaagaagattgtagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcacttaggtatcaaaggggctgtgccgaaaacaattatgcagcttatgaatg

SEQ ID NO: 7182 - DNA, 675 bp, Lycopersicon esculentum
  Predicted polypeptide sequence is orthologous to G1451
ctggtgagctaggacatcattcaatgaatcttcagtcttttggcatgcttccttggatgcaacagagagtcgattcaacaattctcccaaatgatattaatcagcactatcaagctatgctggctactggcttgcaaagttttgggagtggagatttactgaaacagcaattaatgcagtttcagcagcctgtccaatatctgcaacatgcaagtactgagaattcaattttgcatcagcagcagcagcagcagcagcaaataatgcagcaagcagttcatcagcatatgctgcctgctcaaacccaaatgctgtcagagaaccttcaaaggcaatcccagcatcaatccaataatcagtcagaagaacaggctcaccaacacacttaccaagaagcattccaactcccgcacgaccagctccagcagaggcaaccatcaaatgttacctctccatttttgaaagcagattttgcagatttgacctctaagttttcagcatctgttgccccttcaggcgtgcaaaatatgcttggttcgttgtgttctgaaggaagtaataattcattgaatatcaacagaactggtcagtccgtgatcatagagcagtcgcctcaacagtcctggatgtcaaaatttacagagtcacaactaaatacgtgctccaactcatcat

SEQ ID NO: 7183 - DNA, 515 bp, Lycopersicon esculentum
  Predicted polypeptide sequence is orthologous to G1451
cgaaaaaagggaatttactcacaaaagttcaactgcattaacaagtttacaaatcaagattcttagtctacatcacatatgtcctgatcctcagtacagcgatcaagattaactaatacaaatagcattgtaatacaaatgacagatggggattaagtctttactacataaagaacagtgtcttagaaacgagaccggattaattaggcgaaagcaaaagaacgccaagctcttgtgaagcagagccacacttggtttatcgaacaacgacagcagtcagtaatcaagtgatcctatagatggaagtccggacatgaaatctcgaccatcagcactattattactgctcatcctttcaggtggaccgcggtttagggatccaacctcctctttccccagtttctgcacatcctcgggtgaaagaattttgatgtaccaaacattattgacaaattcctcccacggatcgtctccaaggagaaggacatcattctccctggagagagagaactagt

SEQ ID NO: 7184 - DNA, 780 bp, Lycopersicon esculentum
  Predicted polypeptide sequence is orthologous to G1451
gtatcttcatcctcatcatctaagcgaattgctctagaatctcagctcccttctcgggttactccatttgtggtgtcccagcctgaggatgtgatagcgcacaatacaaaggtctcggatctttcctctttactgccaccttttcctagtagagaatcgttttctgattatagaggagtagacgatagccaaagcaatgcactctatggatttacagactttttgaacatactgcagaccggtatgtccaacatgaagggtagtagtggtgataatggatctttatctattcattatgctacctctaccttcacaagtactgcgggcaatgagtacccccttaactcagacatgacagcttcaagttgtgtagatgaatcaggtttcttgcagtcctccgaaaatggggaccaagcaaacccaactaatagaatctttgtgaaggttcaaaaatcagggtcctttggacggtcactcgatatctccaaatttagcagctatcacgaacttcgaagtgagcttgctcgcatgtttgggctagaaggcttgttggaggaccctgagagatcaggttggcagcttgtaattgttgaccgagagaatgatgtcctcctcctcggtgacgatccttggcaggagtttgtgaacaatgtttggtacatcaagaatactttctccatgaagtgcaacagatagggaaagagggacttgatcttccaaatggtgtccaagcgcagacgcttcctggcaatgtcaatggatgtgatgattatatgaaac

SEQ ID NO: 7185 - DNA, 643 bp, Lycopersicon esculentum
  Predicted polypeptide sequence is orthologous to G1451
ctaagcttgcaaatcagccacttatgcagttccaacatatccctagtacttcagcatcttcgattcagagccagcttttgcatccatccaatttgcaacatactttcctccaaggcctcccggagaaccaactaatatctcaggcacagatgctgcagcagcaattgcagtgccaccaatcttataatactcagcagcaacagttgcagcgccagcaattgtatcatgatcaacaacttcaggaaccccatcaagtacagcgtcaagatcagcagcaaaccaaggctcaattgtgttcagctactcagtcacagctttctcatttacaggtcctaggttcaacgggttctcaacaaacattttctgatttagttggtcatcatattaatacatctaacaacagttccaccatgcaaagtctcctgagctcattttcccataatggagcatccacttccctgaacatgtctgagaccaactccctagtgtctccttcctcatcatcaaagcgaattgctctagaatctcagatcccttcacaagctccatacatggtgacacaggctgaagttattacagtgcctaatactaaggtctcagatttttcactttggtttcaccaatcctggcagaaagttttgga

SEQ ID NO: 7186 - DNA, 651 bp, Lycopersicon esculentum
  Predicted polypeptide sequence is orthologous to G148
cagagctggtaccaagaggtctctaaattaaaggccaagtttgaagcacttcaacgaactcaaaggcacttgcttggtgaagatcttggagcactaagtgtgaaggagttgcaaaatcttgaaaaacaacttgaaggtgcacttgcacaagctagacaaagaaagacacaaataatgatggaacagatggaggagcttcgtagaaaggagcgtcatcttggtgatgtgaacaagcagttgaagattaaggtttctcttgaactatcatcgtttgagggtgaaggacaaggtgttccttttccatggagtaattgtaatgcatctttagatgaagcaggaagcagcacctttcatgtccaccattctcaatcaaatcacatggactgtgatttacctgatccagttcttcaaatagggtatcatcagtatatggctgcagatggagcctcagggtcaaggaacatggctgttgagagtaacattatccatggttggggtctttaatttctaattctaattatggattatactagtacaagttttttgcttttaagtttttcagattaaaaaactcaagtgacatataattatgatttgaaatgcatgttatatagtaatgtataattttagcaagtgtcatatacactcctg

SEQ ID NO: 7187 - DNA, 1345 bp, Lycopersicon esculentum
  Predicted polypeptide sequence is orthologous to G1480
aaaaaataaaaagcaaatcaatttttgattctctcacttaacacagaaagaaaaaactaatcgaaataatgggaacggagaattggagtttaacggcgaagttatgtgactcatgcaaaacgtcgccggcgacggtgttctgccgggcagattcagcatttctctgcttaggatgtgactgcaaaatccacgcagcgaacaagttagcgtcacgtcacgcgcgtgtctgggtttgtgaagtgtgtgagcaagctccggcgagtgtcacgtgtaaagcggatgccgctgctctctgcgttacgtgtgaccgtgatattcattcagcaaatccgttagctcgtcgccatgagcgttttccggtagttccgttctatgatttcgccgtcgcgaaatctcacggcggtggtgataccgatgccgatgctgttgatgatgagaagtactttgatagtactaatgagaatccttctcaaccagaggaagaagctgaagcagcgtcgtggatacttccgacgccgaaagaaggaactgatcagtataaatctgctgattacttgtttaatgatatggattcatatttagatatagatctaatgtcatgtgagcaaaaaccacatattcttcatcatcaacagcatcaacacaaccattacagctccgacggagttgtaccagtacagaacaacaacgaaactactcatttacccggtccagtcgttgatggattccctacatacgaactcgatttcactggatctaaaccttatatgtacaatttcacctctcaatcgatcagccaaagtgtttcatcatcatctcttgacgtcggagttgtaccagaccacagcacaatgacggatgtatcaaacacttttgtgatgaactcatcttccggtgctattgccggcgccggcgccgacgttgtaccgaatgcagtttccggtttagacagagaagcaagggtaatgaggtacagagagaagaggaagaatagaaagttcgagaagacgattcgatatgcttctagaaaagcttatgctgagactcggcccagaatcaaagggagattcgctaaacgtactgaaactgaaatcgattcactcatcaccgtcgatgcatcatacggtgtcgttccatcgttttaattattttttatatatatatttattatctctaattattaaaaaaaaaaattgatattttgcttttttcctctttatgttgttagtgaggaggatcgtaactacgtgtatatatatctaattttgtttctctttttttgtatcaaaaagctattaaaaaaatagaaatttgtaatggataaaaaaaaaaaaaaaaaaaaaaa

SEQ ID NO: 7188 - DNA, 704 bp, Lycopersicon esculentum
  Predicted polypeptide sequence is orthologous to G1480
atacttgtattggacaccatgaaaacaacaatgatccatggattccaccaaacacaatcacatcaaagcttccattaaacacagaaatgaaagggatggatttcatatttacagattcagaaaactttcttgattttgattatcctgcttgtgtagacacacaatctcaacctcattacaattcatccaatgatagagttgtaccagtacaagctaatactccaattaaatcattgccatttcatcatcaagaaaaacattttgagattgatttcactcaatcacacatcaaatcttacaacaccccatcactcagtgtttcttcgtcttctttagatgttggaattgtaccagatggaagttcaatttccgaaatatcatacccatatataagaactatgaataacagcaacagcagtattgatttatcgaattctgcgaatcatcaaggtgaaaaattactgggtttagatagagaagcaagagttttgcgatacagagagaagaaaaaaaacagaaaatttgagaaaactattcgttatgcttcaagaaaagcttatgctgaaacaaggccaagaattaaaggtcgatttgctaaaagaacagacggaagcgccggcgccggcgagtttgatgacgttgacgggattttctccggcaccgatttcattgcggctgagtcgcgatacggcgtcgttccttcg

SEQ ID NO: 7189 - DNA, 278 bp, Lycopersicon esculentum
  Predicted polypeptide sequence is orthologous to G1488
ttttttttttttttttttaattcaaactttttttttaaaacgagaaaagtgcaaagtagttatcccctacactaggtgactgatactagatgaggtgcctgaaatttggaccacaattttggtgatgatgaagcagaaattcatcaccgccgtttgatacaccgaaaatagtgggttgactaagcaattgatgctggtggtgatgtgcttggtgtctctggagatccttttgcctccggagttccagaactttccgatgagaattcgagtctggtgcc

SEQ ID NO: 7190 - DNA, 644 bp, Lycopersicon esculentum
  Predicted polypeptide sequence is orthologous to G1488
cttcacactcaattccttcattctctcttcctttttatcagcttccgattctccatataaagaattagtctcaaacctaccgttactttgcgttttacactccaccattcttctcttacactacacaccaacaacttcttcttctaaacaatggaagcgtcggatttattcgtcagcggttttttctcgcatgccggagacgaacaaattccgaataacatcaacaataactgtaacaatttttctgtggatgatcttttggttatcccaaaggacgatgaagttatggcagacgcatttttcaacagtattacaggaaattctgctgattcttccaacgttaccgtcgttgacagctgtaattcctctgtttctggtggagatggacaatttaacggaaacctgagcggccgcagcttcaccgatgctcccttccctaacagcgaactctgtgttccgtttgatgacttggctgagcttgaatggctctcaaattttgtggaggaatcgttctcaagtgacgacgttcaaaacttgcaattcatccctgtagcaaacattaattcctcctccaccgtcaccaccgacagttcctcttccgcaacacattttcccacgggactaactttcgcactgccttcccc

SEQ ID NO: 7191 - DNA, 2139 bp, Lycopersicon esculentum
  Predicted polypeptide sequence is orthologous to G1494, G789
gatgatcaagaaattcactttttcttgatatagaaaaatcattttttttaaaacccccttttgactattaagtattgaatttgatgattttgagattgccttttactgtgtgcctaaacatactgttttttttcttgatatgcagtagttttagccatgaatccatatcttcctgaatggaatattgagactgaacttcctgctccacatcaaaagaagcctatggggtaaataatatatgtgtttgattacataaccaaagtaaactaaatttgttttttaaacaatgatcttgaattggtttcaattggatggtcttttctgtagatttgatcatgagctagtggagttgttgtggcgaaacggggaggtagtattacatagccaaacacataaaaaacagccaggttatgatcctaatgaatgcagacagtttaacaaacatgatcaaccaacaataagagttgctggaaatcagactaatttgattcaagatgatgaaactgtcgcgtggctaaactgccctatcgatgattcgtttgacaaagaattttgttcccctttcttatctgatatttcaacaaatcctcacctgggggaggagcctgataagtcaattaggcaatcagaggacaataacaaggttttcaagtttgatcctttagagatcaaccatgttcttccgcaatcacatcattctggtttcgatccaaatccaatgccacctccaagatttcacaactttggatcagcgcaacagaaacatcatatagtagggggggatcagaaaggtgttaactttcctccaccgataaggtcatccaatgtgcagcttggtggcaaagaagctagaagcaatctgatgctgcaagatattaaagaggggtctgtgatgacagttggttcaagccactgtggcagcaatcaagttgatactagccggttttcaagtagtgcaaatagagggctgtctgcagcaatgatcactgattataccggaaaaatcagtccacaaagtgatacaatggaccgagacacatttgaaccagctaatacatcttcgtcttcaggaagatcgggtagtagttatgcaagagcatgcaatcaatctacagcgaccaatagccagggccacaaaaggaagagtagagatggtgaagaaccagaatgccagagtaaagctgatgagctagaatcagctggaggaaacaagtcagcccaaaaatctggaactgcccgaaggagccgtgctgcagaagtgcataatctctctgaaaggagacggagggatagaatcaatgagaaaatgaaggccttgcaagagcttcttcctcactctactaagacagacaaagcatcaatgctggatgaggctattgaatacttgaaatcacttcagatgcaactgcagatgatgtggatgggaagtggcatggcatcaatgatgttccctggtgtccaacactacatttccagaatgggaatggggatgggtccgccttcggtgccttccatgcacaatgctatgcatttagctaggcttcctttggttgatccagcaatccctttgacacaagctgcccctaataatcaagcagctgcaatgtgccagaattcaatgttgaatcaagttaactatcaacgccatttgcagaatcccaattttccagatcaatatgctagttacatggggttccatccacttcaaggcgcttctcagcctataaacatttttggcttaggttcacatacagcacagcaaactcagcagttaccgcatccaactaatagtaatgcacctgccacttgaagagttatcactgaggatactatcagtgtaaaattaggacagtgaaattgcttcattttgcgtaatgtttatcatggtactagactctagcaatcactactggaagatcttaagattttgggagctaacgttcaaatatgtaagagacaacgacaccatcataatgaaatacatgaacttcattgtatgagactcttcttcatatagcaaagctacaagttttattctgtaggagcacattagtagttggcatatgtaacttactgtatatgaaaaaatttactgaggaataagaattcattaagtctttacacaaaaaaaaaaaaaaa

SEQ ID NO: 7192 - DNA, 616 bp, Lycopersicon esculentum
  Predicted polypeptide sequence is orthologous to G1506
caaatgggaagcaatggtgccttcaaggaagagaacctgcataagtcgttcaaagcattcttcagttgaaaagctcactaaagacctgtgtacgatcctacatgaacaacaatcttcatacttctctggatcttctgaagaggatttgctttttgagagtgacaagcctatggtctctgttgagattggacatggaagtgtgcttattcgacatccaaactcaataggtagagaagaagaatcagaaggcagttccctgtcggttaataacaagcgacattatgtaaatgaggcttattcacgattgtctgccccacctgtaaatattaataggggtgtcaatttaccaaatctgggcacggagataaccaagaagcctaacagtcagggaatggaacaacacccgattaaaagggataaggatcaccttgaaaaattgcacattcttggacatcatacttcaccactgtgccatatagacctgaaggatgtacttaattatgaagagttcgtgacacatttctcaagcgatgaacagaagcaactactaaaatacttagctcctggtgattcttttgcacccccagatagtctcaaaagcatgttccatagctct

SEQ ID NO: 7193 - DNA, 619 bp, Lycopersicon esculentum
  Predicted polypeptide sequence is orthologous to G1521
ggcacgagcagatttaaggaaattgccgctgccgttgcccggcaatcatgtccgatatgcctctgccagatacaccatcggagcgcggcggttgttatcccatgtatgcacgcctactgcatcgtttgcatccgcagatggagcgatgtgaagagaaaatgccctctctgcaacgccgactttgattcatggttctccagaatcagcttctcctcccggaccttccagaaagagcaattatcagctcgtaacgagactaagaagttacactcaggttttgttccctctaggctgagagaccgattggcggaccgaagagtgattaggagaaggagagaagagttgaatacttttggctccagaacgaggccgttcccaaggcggcgatcctttgatcacaaaggagctttgaatccagatgatattactaggagaatcattctctggcgttccagcatttatgaagagagattgcaggctgttcctttttcatctaaaaattgccttatgcagcacatggataataggagtaccaaagaaaagatgttacagagaatagaaccttggataagaagagagctgcaggctatactgggtgatccagatccatccattatcg

SEQ ID NO: 7194 - DNA, 582 bp, Lycopersicon esculentum
  Predicted polypeptide sequence is orthologous to G1538
cccttcaaaataaataaataaaagtcttctccatttcacttttacaccacaaaaaataaataaaaatataaacaccatgaaccatcaggttatagaagatgataatatggtacttatttcccagtactatcctgatatttacacccaacttgtaccacaacaaggagagtcaaagccgcggagaagacgtaagaagaacaaattaggagaagggagtgggaatgatcaaatgatgatgatgaggaagaggaagttaagtgaagaacaagttaatttacttgagcaaagttttggggacgagcacaaactagagtcagagagaaaggacaagctagccgctgagctagggctcgaccctagacaagttgcggtgtggttccaaaacaggagggctcgttggaagagcaagaagctagaggaggaatattcaaagttgaaatctgaacatgacaataatgttgttgagaagtgtcgtctggaaactgaggtgttgaagttgaaagaacaattgaatgaatcagagaaggagatacaaaggctattattagaacgatgtgatggggtatcgagtaattacacaag

SEQ ID NO: 7195 - DNA, 1359 bp, Lycopersicon esculentum
  Predicted polypeptide sequence is orthologous to G154, G1797
tgcatacatcaaacccataaataaagatccttcatatatatatattcttgtttcttcttctgtttatatatatatatatattttctaggaatctaattccttaattattttcttttccatcctctttcctttttcccggaaaatcggaataaaaatggtgagaggaaaagtagaaatgaaaagaatagaaaattcaacgagcaggcaagtgacgttttcgaaaagacggaatggacttacgaagaaagcttatgaattatcagttctttgtgatgctgaagttgctttcattattttctcacataaaggaagactttttgaatttgctagctccaacatgcagaagataattgagagataccgtggacgtacaagagaaacaacgacggtggataaaagcactgaactcgagcactacatggagaacttgaagcatgaaacagctaatatggcgaagaagatagagattctcgaaatttctaaacggaaactaatggggcaaggattagggtcatgttcaatggatgaactagaagacattgacagccaactggagaggaccctcaaaattatcagggctagaaaggctcaattgttcaaagaggaaatagaaagtctaaagcaaaggagagattattgctccaacaaaatgcaagtttacgtgaaaagtgcgggcttaggccaatgcaatcagagtcagcacccgcacctgcacccgaacccataccagcaccaccatcaacaccaccggctcaatcgaaagaaaggggaaattgtagccaaagtacaaagagttgggaagtggagactgaattgtttattggccttcctcaaacgcgctgcttatagtagcttggatcagtggttgagccaggttttttttttttatcaaaggaattcaaacctcgaagaagtacacagagaaggcaaaattgggttcaatctctactctatatacactacattaaaagataaattttaactatatatgttataatgttatttttcgctgtaggagaatcagttaaacaaccccaccaatcctacgtggctccgccccgaccgggacaatgggaccatttgttcatattttgtttatggttctcctcagttatttagattaagaggttaggatttctcagttatttacaaccataaggagttgcaaaattcaataaataataccttacaataagagtgtaatatttctttctatttttcatgtatttatagtatactttctatttttcaaacattctaaacagctcaattgttttgagtgtatcacaagtttgtttttggtttataatggattataaaatttataggtgaattcaaaatttgaaaaaaaaaaaaaaa

SEQ ID NO: 7196 - DNA, 585 bp, Lycopersicon esculentum
  Predicted polypeptide sequence is orthologous to G154, G1797
gtgtctttccattttagctccaaatagtccttttgcaaccaaaatcttgtctgagatttttctatatttgggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcatacctgaggtaattgaacgatataagaggcatactaaagataaagttaaatctgatgaaaatcaatctgtggatattcagcatactaagcaagagacagcaagtttgatgaagaagatagaactccttgaatcatctaaaaggaaactcttgggagaaggtttaggatcatgcagccttgaagaagttcaacaattagagaagcaattggagcagagtgtcattactattacggctcgaaagatgcaagtctttatggaacaaatggaaagattgaaagaaagggagagagcccttacagctgaaaatatgatgc

SEQ ID NO: 7197 - DNA, 573 bp, Lycopersicon esculentum
  Predicted polypeptide sequence is orthologous to G154, G1797
gatttttttaaatcaatttctatgtgattaattccttcttcaatattaagtttttttttttttttttttttaattaaggggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcacgcaggagataataagaggcaataagaggcatactaaagacagagttcaacctgaaaaccaagctgggccacagtatctacagtatatgcagcatgaggcagcaaatttaatgaagaagatagagctccttgaaacagcgaaaaggaagttcttgggagaaggtctgcagtcctgtacccttcaagaagtacaacagatagaaaaacagttggaacggagtgttggcaccatccgggcacgaaagcttcaagttttcaaggaacaggttgagcgactaaaaaaaaaaaaaaaaa

SEQ ID NO: 7198 - DNA, 1035 bp, Lycopersicon esculentum
  Predicted polypeptide sequence is orthologous to G1540
ggcttacatacatacatttgtagagttgttgttgttttatgatggaacatcaacacaacatagaagatggtggtaaaaatagtaacaacagtttcctgtgcaggcaaagtagtagccgttggacgccaacgagcgatcagataagaatattgaaggatctctactacaacaatggagttaggtctccaactgctgaacagattcagaggatatctgctaagttgagacagtacggtaagattgaaggcaaaaatgtgttttattggtttcagaaccataaagctcgtgaaagacaaaagaagaggctcattgctgccgcctctgccactgataataataatatctcttccatgcaaatgattccacatctttggagatctcctgatgatcaccacaagtacaacactgctactactaatccaggtgtccagtgtccatcaccatcttcacatggggtattaccagtggtacagactggaaactatggttatggaactttggctatggagaagagctttagggagtgttcaatatcaccaccaggtggtagttatcatcaaaatttgacatgggttggtgttgatccttacaacaatatgagtactacttctccagcaacttacccttttcttgaaaaaagcaacaacaaacactatgaagaaaccctagatgaagagcaagaagaagaaaattaccaaaggggtaactctgctttagaaactctgtcacttttccccatgcatgaagagaacatcatctcaaatttctgcatcaaacatcatgaatcttctggaggatggtaccattctgataataacaatttggctgctcttgaacttactctcaactctttcccctaaattatgaactagtctatcttatgtttgtagtaagtaagtactaatctaatttggtatgtgccaagctatttggaccttatggtaatgttaattaatcttaatctaagttgtactaatattattaattaaagtatggataagtttagcaaaaaaaaaaaaaaaaaaaaaaaaaaaa

SEQ ID NO: 7199 - DNA, 828 bp, Lycopersicon esculentum
  Predicted polypeptide sequence is orthologous to G157, G1759, G1842, G1843, G1844
ttactcttcacaaaaaaatcataacaataatgtgtagggtaatcaatttcaagtactccattatacaacttaaaaagagggaaaaataggcatataagtcaccctctagtaaatatgtcaaagtagagaagttaactttaatcatcatccattagaaacaagaacaaggatgaataattattagttttattgaaactaattttgcaggttcctctggtgcagaagcaaggcttttcgacgaatacgacgataatcactagaagaaattcagggtaactttttgttgtccacaaatcatgtggggtgctggaaggtcagacatttcattcacttttgtgtttttcttgatactagctatattgtcctccagatgtttcttttcctctagcagcagtttttccttctcatgaagaaccttagcagattcaagcatcaaatgtgtctttctagctctgagatgtattagagcagtttgaagttcgttttccaaatggataaggtcagtcaaagtgagaccatcagcatttgtttcctcgagttgcctttctgttgtttgtagcagttctcccattgttgtgaaccccgacacctctgcgacctggatttctgcattgatctctttttctgctccaacatggctttcatatcgtcgaagcatcgctgtcatactgttattgctggagaattcatggagtctaccacgatttgagatgataacaacagcaacatcgacatcgcagagaatagaaaattctttagctttcttcaataaaaccttcctccggttacagaacgcaacttgcctgcatttttatcttgaattcgctt

SEQ ID NO: 7200 - DNA, 667 bp, Lycopersicon esculentum
  Predicted polypeptide sequence is orthologous to G157, G1759, G1842, G1843, G1844
atttattaccctgttatcactgtttggcacaaaggcaagacttcttatttccccaaaagaaccaactcttccaacgacacttcaagatagaaaaccaacttttgggttattatgctcaaatagccaactaaaatttcagtggctttaataacctgtattttgtttatgactgggtttacagtgtaaaatgttgagttgtgttatttcttcatgcaatctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcgaagaaaatgagatggcaatgaatctaaataacatcgcaccaacccatatggattgtggacaacagagggagaccctgaattttctctagagtctagacacactaatggca

SEQ ID NO: 7201 - DNA, 700 bp, Lycopersicon esculentum
  misc_feature (625)..(625): n is a, c, g, or t
  misc_feature (653)..(653): n is a, c, g, or t
  Predicted polypeptide sequence is orthologous to G157, G1759, G1842, G1843, G1844
gctgggtaggtgtaacgccgatgatagaagaatcttctagacatctgaaatttgtggattagggcttttcatcggcgaaaaaaaaaatggggcgaaggaaggtagaaattaagcgaattcaagataaaaattgcaggcaagttgcgttctgtaaacggaggaaaggtttattgaagaaagctaaagaaatttccgttctctgcgatgtcgatgttgctgttgttatcatctcaaatcgaggcaggctccatgaattctccagcaataacagtctgacagaaatgcttcaacgatacaaaagccacgtcgaagcagaaaaagagatctctacagaaatccaggtggcagagcactctaaatactcagggttcataacaatgggaaaactgctacaaacaacagaaaggcaactcgaggaaactaatgatgatgttctcactgtgactgaccttatccatttggagaacgaacttcaaactgctctaatacaactcagatctagaaagacacatttgttgcttgaatctgctaagggtcttcatgagaaggaaaaactgctgcaagaggaaaagaaacatctggaggacaatatactagtatcaagaaaaacacaaaagtgaatganatgtctacggatttcgctgactttccancccccattcgatttctggacacagaaaataccctgaatttcctctat

SEQ ID NO: 7202 - DNA, 694 bp, Lycopersicon esculentum
  Predicted polypeptide sequence is orthologous to G1635
attggtctagggattgctgaatattcagttgctgagcagcagaactctcgcttttcaccagtctcttgtactacggatgcacacactgcaaatataatttctacggagaatgatgatgagagtatgagctcaaactccaacaatgtggatgcaatccacgtcacgttaaaaccagtagctgctagtatcagtctgattaccaattcagagttcatggaatgtaatatagttcatatggagaattcttgtaatggtgaaaagctagctgttgaaccaccttctgcaagtatcaagctgtttggaaagactgttttcgtaccagatgccaataaccttgctccgccagctccatacaacacagaaaaggaaaaggagatcagctatgaagatgtacttcatggattccaagctaaccaagcaaattcaccatttgtacttgccatggttccaggcaatatgattccaccagcatcttggttgtcacaaaacatgcttgaaaacaatcgtgagagtactgcggccttccctgcagctacaatttcttggtggtcctggtaccaagatctcttatatcggtccatctcatcgtgtggccaaacaaccgtggaggctgcttctcattgtcagggactaaaagatgaagaacctcaaagagagggatcatcgactggttcaagcattggctcaactagtg

SEQ ID NO: 7203 - DNA, 672 bp, Lycopersicon esculentum
  Predicted polypeptide sequence is orthologous to G1635
taaaagtgaacagggtgtgaagagctacagttctgtatgtgggggttgttagatcgtgtgattttttggaattaacggttgatatttctgggttttggaactgaagagaatttaattgggtaaaactgggtttcttctattttaggactcaacgagtactgattcagcagaaatgactataggggatcaaagcgagtcggactcgatacttccttgtaggaataggatgtcagttgatgttggagctccttctccaaggagtatccagatggatgagcaagttaatccaggagaagaatatgctcctaagataagaaaaccatacaccatttcaaagcaaagggagaggtggtctgaggaagagcacaaaaagttccttgaagcattaaagcttcatggtagggcatggcgacgaatagaagagcatgtgggaactaaaactgcagttcagattagaagccatgctcagaagttcttttcaaaggttgttcgtgaatcgagtaatggtgatgcaagctctgtgaaatccattgagatccctcctcctcggcctaaaagaaagccgatgcacccttatccaagaaaaatggcaactccacttaaaagtggaaccctggcttcagagaaattgaacagatctggttcacctgatctctgtctctctgagccaga

SEQ ID NO: 7204 - DNA, 499 bp, Lycopersicon esculentum
  Predicted polypeptide sequence is orthologous to G1646, G715
tggaaaacagccctcagcaatcggcggcgaatgcagcggcggcggctgcagcggctcagtccgctgggtacccgactcagccaccttaccaccatctccttcagcaacagcagcagcagttacaggtgttttggacctaccaacgcaaggaaatcgaacaggttaacgattttaagaaccatcaacttccccttgcccgaatcaagaagatcatgaaagctgacgaagatgtccgtatgatctccgctgaagcacccattttgtttgccaaggcatgtgagcttttcattctggaactcactattcgttcctggcttcacgctgaggagaacaagcgacggactctgcagaagaatgacatcgctgcggccattacgcggactgatatttttgatttccttgttgacattgttcccagggatgagatcaaggaagagggtgctggtctggggcccggaattgtgggttccacagcaagtggtgttccgtactattatcc

SEQ ID NO: 7205 - DNA, 614 bp, Lycopersicon esculentum
  Predicted polypeptide sequence is orthologous to G1646, G715
caacaaccctcaccaatctccgactgaggccgctgcggcggccgcagcagcggcagcggcggctcagtcagccacgtatccgtcgcagactccataccaccatctccttcagcagcaacagcagcagctacagatgttttggacttaccagcgtcaagaaatcgagcaagtcaatgatttcaaaaaccaccaacttccccttgctcgtatcaaaaagatcatgaaagctgatgaagatgttcgtatgatctctgctgaagctccagttctgttcgcgaaagcttgtgagcttttcattctggagctcaccatccgttcgtggcttcacgctgagggaaaacaagcgcaggactttacagaagaatgacatcgctgcggcgattactcgtactgatatttttgattttctggttgacatcgttcctagggatgaaattaaggatgagggtgttgggcttggacccggaattgtgggttctactgctagtggtgtgccgtactattaccctccgatgggccagccggctccgggtggagtgatgcttggtaggcctgctgttcctggggttgatccatcaatgtatgtgcaccctccaccgtcacaggcgtggcaa

SEQ ID NO: 7206 - DNA, 2126 bp, Lycopersicon esculentum
  Predicted polypeptide sequence is orthologous to G1660
ggagtagaaagtgtagggactacacactcttcatttctctttttgtccatttggatgttgacaagattcatcactacaatttcactcttttctcagagatactgtcacacccacaagcttgaaatcatcctttatggagtatgaaagaatcgacaagagaaatttacagctgtctcctagaaaactgaggtctatgctactgggagcagaaaagaagaggaaacaagaagggaaggatgacgtagtagaagatcaagagcttgaatctgctactgtgtccttgagatcccatttgcctgagatccatgaatccggttgtaatttggagaattacaaagatgtaaatgttgtaagtgttgttcctgagagttcgacttccttagcacttgattcatcaatgtcattggagatgattaatgacacgagaatcaaagatcaatctttggttagtacaagaattaggtctcaagatgacagtagtttggactgtgatggtggaatcgatagtgttggtactgtatctcctctctttgaatttcaaaaggctgaacgggcagcacagagagtgcccctagctcatttctcaaaacctgccccgtccaaatgggatgatgcgcaaaaatggatagcaagcccaacatctaacaggccgaagactgggcagagcagtcaagttgttggatctcgcaagactagtcattctggatatggctatcgacaacaatctacaaaagttgtagttgaggttcctgatcaaaaattggttccttatgaggagcctgttgacacaaaacagatagactcaggccaaccaaaggacagcggtgttcagaagttcgtgagttgggaggctgagccacacccaattgctgaatcatatgttaagccaatgctcatgattgaaacatccatcggacaatcagcaataaatctgagccgtcatgattcgtctgtttctatacatagtgcgactgttatccccccaccatcaactgcaaggtcagtctcgatgagagatatgggcaccgaaatgactccaattgcaagccaggaaccttccagaactgggacacctgtgagagcaactacacctactcgcagcccaacttcttctcggccatcaactccgggagctgcaccagcttcctcaccttttcgtccttcaaatgataatttggatgctcatacaaatgcattgtctgaccaggaattacagttgaaaactcgaagagaaatcatggcacttggaactaaacttggtaaaatgaatatagctgcctgggctagcaaagatggtgaggatagaaatgcatccagcttgctgaaaactgataagcaagaccaaccaaataccactgttactgagacacgcgcagctgcttgggaggatgcagagaaagcgaagcacttagccaggtttaaacgagaagaaatcaagatacaagcatgggaaaatcatcaacaagcaaagacagaagccgagatgaggaaaactgaggtggaggtggaaaagatgaaggcacgagcacaagacaagctaatgaacaagatagctgcggttaggtacaaagctgaagagaaactggcagcagcagaagccaggagaaacaaacatgctgtaaaaatagagaagcaagcagaatacattcgtaaaactggtcgtttaccacactcattctcctgctgccgctggtgcttctgaagagcttcaaatcactatctaatgcgctgtatatttttgcttttccactaagctagtattgtgaagttggagactgcctttgtgtatgcttgaagctcttgtacaaactcaactggttggccactttacatgtaattgttgatcaatggaagttgaagttcaggcagtctcctgtaaccaattgtgatttgatgattaatgaagggttcctccaagcttattaatttcaagttcttgtacatgaatttagtagtcgcgtagtctcttattatgtaatgtgtagtaatatttgttgcttcgtttattgtgtactttgctatattgttatcatattttcttgaaagcaagatgacttctcttttgagcggagtagcaaaacaatctctctgtctcacaaagaaagggatggaaaaaaaaaaaaaaa

SEQ ID NO: 7207 - DNA, 616 bp, Lycopersicon esculentum
  Predicted polypeptide sequence is orthologous to G1777
caaacattgcccaaactgtcaccaatgccgtggagaagaatgggggatgccaaccttgtaagatgtagatgtggacagccgttttgttggttgtgccggtggagctactggcttagaccacaccatggagtagcattcgaggtcacacttgtggcatttataaggaaggggaagaggataagtcgacgactgtcagaaatgatctcttgcgctatactcattattatgagcgctatatggttcatcgtgattcgttggaggctgaagcaaacatgaagcaaaaactaaagtttgaagtgttgaaactcgaagcaagggaattgctatcaaaggacttcagctgggtagaaaatggatgtaatagactccttgaattgaggcgaattctctcctgttcctatccagtttcattttacgtttttgatcagaccctgttcaaggatgaaatgacacaaaaagatagggaaataaagaagaacctttttgaaaacctgcagcagcaacttgaaataaacgttgagagactttcgatgttcttggaagaaccatttgctaaatatcctgaagataaacttttggagactagaacgaagatcatcactctctccgtactaac

SEQ ID NO: 7208 - DNA, 612 bp, Lycopersicon esculentum
  Predicted polypeptide sequence is orthologous to G1789
ctgcttagtactctcttcttctttgtatctctttttctacatttttcacaacttgtgatacttaacaaaagatcatcatgagctcgatgtcgtctcaacatggttcttctggatcatggactgcgaaacaaaacaaggcgtttgagaaggcattggctgtgtatgacaaggaaactcgcgatcgttggtccaatgttgctaaagcagttggaggcaaaacagcagaagaagtgaaaagacactatgaaatccttttgagggatgttttctttattgacaatggtatggtgcccttccccaaatacaaaactactggaggatcccataattccacctctgattaacattatttttactaaaggagcaaaacctaacacttcatcgaagtaacaaacgtcaataagcagactagaaaagtgcaaataatttgccttggaacctgccttttaaaatatttaattttcaagttgtatatttaatttctttgtccaattaaattttaaacgctgagtttatttagtattaattacctacggaaggaatcatttgaattctgtctgctcttgtactcgtcatgtccccctctaatattaattaattatattgttcctt

SEQ ID NO: 7209 - DNA, 630 bp, Lycopersicon esculentum
  Predicted polypeptide sequence is orthologous to G1808
tttccggccatgttgtccactttcccggccactactctgtccgccgacggacttttttccaatttatttccggcatttgatggaggattcactccttgggaatgtatcgaaccggcttttctattttcacaacaagtggaatcggttgtttcacccaaggaatccccaccacctgaaccggttatttcaaactccgattcaggttctgatgactccaaacctaattctgttcactctagttccggttcagatgacccgaaccggaataataacaataataataagtcgaaccggtgtcctgacgagagaaagcggcagcgcacgacatcgaaccgtgacatggatgagaggaagcgtcgacgtatggtatcgaaccgggaatcagcaaggcggtctcgcatgcgaaagcaaaagcatctggaaaacctgcggaaccaagcgaaccggcttaaagtagggaaccgggaaataatgaaccggttacggttaatcactcaccagtgccaagtggtccagtgtgagaacgagcggctgaggaccgaatcggctatccttcggcaaagacttgagggtatacgtcaaatatggatcaaccggcaatttaattcttattctgcatgggcatgcaat

SEQ ID NO: 7210 - DNA, 752 bp, Lycopersicon esculentum
  Predicted polypeptide sequence is orthologous to G1850
ctcacctctatgtggcgccggaaacttccagaatcaccgaaaattccgacggtcgtcctctctgtagttttggctccagatctgtgagaatagcttcatcgatcttcactcaattcgtcaggtaataagaagagatgactccacagccaatagaccggaacaaaggagagacgacagccggtgaaacgccgaggtctgtgccgacaccgtttttaacaaagacctaccagctcatcgaggatcaatctattgacgatgtgatctcttggaatgaagacggatctacttttatagtgtggaatccaacggagttcgctagggatttgcttcctaaatattttaaacataataatttttctagcttcgttaggcagctcaacacctatggatttcggaaagtagtacctgatcgatgggaattcgcaaacgacagcttccggagaggtgagagaagtcagttagttgatatccagcgtcgaaaggttgccacgccgattgctactccttccgcagctgcaacagcggtggcgattgtggcttctccgcctcagcctccacctccacctccgtctccgtctccgcctccgcctccgcctgctcaacaccggtggctgtatctacctctgattcctgtgaagagcaagttctatcgtcgaactcatctgcaggtagcacagcggagcttttaggagaaaacgaacggttaaagattggagaaattacagctcagcaaagagttgaaccaaatgaaa

SEQ ID NO: 7211 - DNA, 359 bp, Lycopersicon esculentum
  Predicted polypeptide sequence is orthologous to G1855
gggaatcgcttttttttttttttttttttttgagcatgaattgatcttctatcctattgatctgcaaatgaagttaataattccaactataagcaataacaagaaagaaacttaataaccatacacgacgatattgaatggttgattatctattctcgttttggttcaccggtccagtaagtttttacagcaataagaatcttctctgggttgaatggtccgctctcatgatccacgatacgactctgccatctcataccgtctgcaatacttttgattttcactaatgcttctactccgtctctgaatataactgtaccttcaggcctcaatattctatccatctcaagtagaatata

SEQ ID NO: 7212 - DNA, 1521 bp, Lycopersicon esculentum
  Predicted polypeptide sequence is orthologous to G1863, G2334
gatgataagaaacacacaaatgacttaactttgcaggtttcaccgcactcgacactgcaaaaaagatacatataaaaaaaaaggtccactcaactctctgcaaaaataaaaaaaattaaaaacttttgtccaagacttaactttctcttcagaaataaatttgccttcacattaatattttgttgttagtaacaaaaatcattctcaatcgaaacatggacttcaatatgaagcaatggagtaatcaacatgagtcagaaaatcaagaatcaccaacaaagttaccaagacttcttcttgacttccactctgtttcttctgattctgcttctgctgctgctctaccattgtttgtatctgaaccaacaacatcaacaacaacttgtaccaaattaatgtcagattcagcaaccactgtcaccaccaaatttccaaggattggaagtggtggtggttacttcagcttggctcaatggcaagaacttgaactacacagtttgatttttaggcattttgtagctggtgcccctgttccttctgaactacttcatcttgttaagaaaagtattattgcttctcctcctcctcctccttcatattactttgctcatccatatcaacagtatcctcattatcaacaagctttgatgcagtcagggtactggggtagagccgccatggatccagaaccaggaaggtgtaggaggactgatggcaagaaatggaggtgctcaagggatgtagtggctggccagaaatactgcgagcgccacgttcatcgtggccgcagccgttcaagaaagcctgtggaaattcccacacctgccaacaatggcagtaaaaacaacaacactgtttctcatcatcaagcctttggaaaaatgactggacatgctcatgctggtggtggtgctcctcagttttctctttcgggacattcaccttccactaatgcgccttttcatctcaatcaaaggccaattaagggtccaccacaagaagtacttcaaaaagatgtatctattggtgatggtaaatcatctagtggccaaatcctacgccatttcttcgacgattggcctagacaacaacttcaagaaggcgacaatgctgcaaccagcctgtccatttcgatgcccggtgtagggggtaacccctcgtcagacttctcgttgaagctttcaactgggaattactatgattcaggtactcaagttagtaatgttgaacggtctacatgggggacgagtcaccaccacgtagcctcaatgggtggtccacttgccgaggccttaaggtcatcaacaactaactcgtcccctactagcgtgttgcatcaattggcacgaggtagcgcgtccgaggccagctatattagcacttgatttctgcaagtgttcttgttaaatgtttttttcttttggactttattgttttttaacttggttgtgttgttgttcattgttctttattggtattgatatacctaactgtcacctgtacaaaaaaaaaaaaaaaaaa

SEQ ID NO: 7213 - DNA, 803 bp, Lycopersicon esculentum
  Predicted polypeptide sequence is orthologous to G1888
ctcttgttcaaccttctcctaaacaagctcctatgtgtgacatctgtcaggaaaggaggggtttcttgttttgtcaacaagacagggctattatgtgtagagagtgtgatattccaatacacaaagcaaatgaacacactcaaaaacacaataggtaccttcttactggtataaaactctcagcaaactctgctctctactctgctccatcacaatcacaatcacaatcacaatcagcaatctcctccgcggattcgtgtgtttcaaatttgaagtctaaggattccactagtaagcctgttgctggttctgtgtttgtttctcccgcgattattagcaacagtactaagggaggagcagtatcatccgctgtggaatcagtgaaagttgttaaagagaaagttggtggatgtaataataatgtgcaatttgtgaatggagggggaaataacttaacaagtagtatatcagagtatttagagatgttgcctggttggcatgttgaagattttcttgattgttcaactcctaatgtttactccaagaatattggtgatgaggatatgttgtcattttgggatactgatcttgagagtcaatttagttcatttccaccacaaaatgttgggtatttggggtcccctcagcccctcctctttcagagtcaaagcaagagactcagatccaatttttcccttcacaaattttgaactttggtgggcaaattggtctaaagaatcaagagaagtactaatatcaagtccagtagaaagtgacagatgacaattcatttgctgtcccac

SEQ ID NO: 7214 - DNA, 819 bp, Lycopersicon esculentum
  Predicted polypeptide sequence is orthologous to G19
aaaaaagagttagaaaagatgtgtggaggtgccataatctccgattatgatcccgccggaagcttctaccggaaactttctgctcgtgacctctgggctgagctggaccctatctccgactactggtcctcttcttcctcatcctcaaccgtcggaaaacctgattccgctctgtcgccggtgactcactccgtcgataagcctaataaatcagattccggcaaaaaaggtaataagactgtgaaggttgagaaggagaagagtagtggaccaaggccaaggaagaacaagtacagaggaataagacagaggccatggggaaaatgggctgctgagattcgcgatccacagaagggtgtacgcgtttggcttggtacattcaacacagcagaagatgctgctagagcctatgatgaggctgctaagcgcattcgtggtgataaggctaaactcaactttccagccccatcaccaccagctaagcgacagtgcactagcactgtcgctgctgctgatacaccaccagcactactccttgagagttctgacaactctcctttgatgaactttggatatgatgtccagtatcagagccaaactccctactaccccatggaaatgcccatagttagtgaagattatgaactgaaggaacagatttccaatttggaatcgttcctggaattggagccatctgatcaattttcagggatcgtcgattctgatcctcttaatgtttttctgatggaggactttgctttcactcatcatcagttctactgaacatgatcaaagtgttatttcgggagtattttatgg

SEQ ID NO: 7215 - DNA, 980 bp, Lycopersicon esculentum
  Predicted polypeptide sequence is orthologous to G194
ggagttcggacccacgcgtccggaaaaaatggaaagctacaaagacattaaaatggaagatcatcatccaatgtatttcattgacaacaacggttttggagttactaataaccactcattcatctcagattacagcattaacccatcatctctgggtttcatggagttattgggttttcatcaagacttttgttcagtttttgagttacctaaagaagaaaatcactatcctgctgtttgtgtatctgaagaagaactaaagccgccatcatcatcatctgtagcagcagctgagaaacaaaaaagtagtactactactgtagttgctacaggtaacgtattgaatacgccatctacccctaattgctcctccatttcctctgaaggacatggagatgctgatggggaagtagaaaatcatgaccaaaaaaacacaaacgctaaacaacagttgaaagcgaagaaaacagtgagtcagaagaaacagaaagagccgagatttgcgtttatgacaaaaagtgaggttgattttcttgaagatggttatagatggagaaaatacggtcaaaaagctgtcaaaaacagtcctttcccaaggaactattatcgctgcacaaatgcaacatgtaacgtcaagaagagagttgagcgatgtttcagtgacccaagcattgtggtgactacctacgaaggaaaacatactcatccaagtcccatgaatacgatgatctcccgtcctaactgctatccaataaatccagtactcccttcacttggaacctacactctgccaatgcagttcaacgccaatcagtcctttcaacgacaacttaacgagttctaatttagccatcaatcatcagcttgatcatgctgcttttgttgctcaaggaagcgtttttgcagtactaacgaaattctggaagaccaggagaatgatctacagaatcttaatgccttccgcgggtgctaaaacatga

SEQ ID NO: 7216 - DNA, 744 bp, Lycopersicon esculentum
  Predicted polypeptide sequence is orthologous to G1944
ggagcagtttgcaaagcattaatatctgctgaaaaaaatggagtcaagggaagctatagctccagaagctccatcaaactatcatatggtatctagaacagaatctactcctataccacctggtacattggcggtgattccccctccggtggctaccgcctttccaattagctcagagaagaagaaaaggggacgtcctaggaagtatgggcctgatggagcagttgcaaggacaatttcacctacgcctatttcagcagacttcttgtcgaagaaagtgagtgttgcccgtcctgaatcggagaaaaaggctcgaaacaaagtgggagctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcagggggaactctaacttatgagggtcgatttgaaatcctttctttgtctggatcctttactccaacagagtttggggggttctcgtactactagcagaaccggaggaatgagcatttctttgggcagtccggatggaccgtgtgtcgggagaacacttgcaggactgctaatagctgctagtcctgtccaggttgtagtggggaagttttctaccaagcaactac

SEQ ID NO: 7217 - DNA, 480 bp, Lycopersicon esculentum
  Predicted polypeptide sequence is orthologous to G1950
ctaaaaccctactgataccctaccgtccgtacaaatcccggcgtaaatggaaccggaaaaatcctcagctcaaatcaaagacaaagatttgttcaaagccgctgaatctggtgattcatcgctcttcaaatcacttcctgaagaacaactcctcaaatccctctctctccgtaatgaagatgatcgttctctccttcacgttgccgtctctttcggacactctgaggtggtgaagattcttgcagctgctgatccgtcagtgagtggtataaatagtggtgatgaagaaggttgggtgccgttgcattctgccgcaagcagtggtaatgtggaaattgtggagattttgcttagcagaggggctgatgtaaatctgaaaaatgatggtggccgcactgctcttcattatgctgctagcaagggtcaagtgaaaatagctgaacttttgatttcacgtggtgctaagatcaatgcaaaaga

SEQ ID NO: 7218 - DNA, 739 bp, Lycopersicon esculentum
  Predicted polypeptide sequence is orthologous to G1957
cttttaagccctaaaatcattaattttgtctatttttttttttcgattgaaaatatcaattcattactagatctgtttgatcatgaatttctttggtagtgttgtaggagaagaagaagcatcttcttcgtcttataacagccaacaacttaaaaggcctagtagtagtactactacggagcttatgttgatggattcatcgtctacttgtgatgcgttggttgaaagggaacatatgttcgataaggtagttactcctagcgatgttggtaagctcaatcgtttagttatacctaaacaacacgcggagaagtatttccctcttgattcgtctagtaacaataaggggggacttctattgaattttgaagatagtaatgggaagccatggaggtttaggtattcgtattggaatagtagtcagagctatgtaatgactaaaggatggagtcgttttgttaaggagaagaaacttgatgctggtgatgttgtttcatttcagcgcggtgctggtgagttgtctaagcaccgtctcttcattgactggcgccgtcgccctcatcatgagaatggaaataatcaatttatgttaccgcatcaattttctgatgggcggctcttttattacccaacaacattttcgagtaatttgttgctggaaggaggtagcaatatcgttcatccacctaattattattatcctcaaaagtacatgtatgaaatttggtaccgctcttat

SEQ ID NO: 7219 - DNA, 746 bp, Lycopersicon esculentum
  Predicted polypeptide sequence is orthologous to G1990
gagaagccttcactaagccaaaagaaaatggcggtcttctctatgatgctttggcaagacctacaaagctttgattgtttaggtgtgtaaagaagacaacccatttgcccaaaaggagaataaattagcatgtgagctgaagtttctgaagaaattggcttcgcttgcctttataaccctctttcccattgtcaatttcaagatatttactacagttgtcttcttctcttcatttaatgagatatcagtgatgcctcatcagaaccagggacaaaatgggcagcagggtatgtggatgtaccaatgcatccattgtaaaaaaaacttcccttcaagccaggccatagcaggccatacaaagggtcatttcagagatggctgggttaaaggaaccccccagagcaaagtatttgtactattttctgagtatcagcaacagcagggttctatcactgactcttcaattcccgagaaacagattttttctgcagcaacttctgacactgacttagcagatgctcatcaattgcaaataggtgatgtgcagaattccagaagccctggtcgtgcggcctccatctccagcttcgtctagcagagaaccacgaatccctaggcatcatttgaggcttcgtgatctgaagatactagctaggctaagggctcgtcttaccagagaggagccagaagtcatttttgcgtcttcttgatagtgctatggaacagggcaaacaattcaagcagaa

SEQ ID NO: 7220 - DNA, 1783 bp, Lycopersicon esculentum
  Predicted polypeptide sequence is orthologous to G2
gaggaaaaaaaaagtgaataaaactagttaacatacaaaagcaaaagtatattaatgaatgattgaacaagagtaaaaagccaagttactagggacaaagaataaagaaagagagaaaaatgtgggatctaaatgaatcagaagaaggttgttcttcaccgatagagtttgaaggcgatgatgagaaaggtaaacgggtcggatccgtttcgaattcaagttcatcagctgtagctgttgatgatatatctgaagaggaattagatggagaaagagggaagaaaaagagaggtaaaattttcggcttctctatggtgggtctgggtaacggcgatgaagaacagccggtgacccgacagttttttccggttgatgagtcggaaatgggtggtgttgctgctgaaaatggatgcccgaattttcccagagctcactgggttggagttaaattttaccaaacggagacacttggcaacacgggattggccaggcctgtagatatggttcagcagcaacagcagcctattaagaagagccgccgtggaccaaggtctagaagctcacagtaccgtggggttaccttctaccggagaactggccggtgggaatctcatatatgggattgtggaaaacaagtttatctaggtggatttgatactgctcatgcagcagctcgggcatacgatagggcagccataaaattccggggagtagaagccgacataaactttagcttagaagattatgagtccgatttaaaacagatgacaagtttaacaaaggaagaatttgtgcatgtgcttcgaagacaaagtactggttttccgaggggaagctccaagtatagaggggtgactttgcacaaatgtggtagatgggaagctagaatgggacagttcttaggcaaaaagtacgtttatttgggactctttgatactgagattgaagctgccagagcgtatgataaagctgccatcaagtgtaacgggaaggatgcagttacaaattttgatccaagcatttatgagaatgaactaaactcaattgaatctaccgataacgtggctgatcataatctggatttaagtttgggtggttcaagctcaaagcaaggaagtcaagaattgggggataatagaggtcaaaattcttcatcaataatgcaattggatattgattggcagcgccatggtttaaggcctgagaagcaatctgccttaattgatgctcgaagaagagaaaacaggtacaatgaaacagaaacgttgcaacttttaagccagacgcacttgcattctccagcctccttgaagcataacaataataataatagtcaagtgcaacggtttggccaatttatgagacctggtgatcaatcccatatgattcaaatgtttccacagcaatttggctcatcaaattatcaaattcaatttccaagtggcagcaatggtggaagaattggagctacaaatgtaagagatctatcgcttgcggcgacgagtaatggttcttcacaatggcaatccaattttcctcctcagatatttgtagctgctgcagcatcatcaggattccctcagcagatagtaagacctcagaattggtcctcagaaaatggtttccatcattcactcatgagaccttcttgactcatttaataacttgccatatttctatttgtgttttttttaagataatgtgtagattaaagggttgatattcttaatactccatatatattacctaaggctcttggtttgaaatcaaaaaaaaaaaaaaa

SEQ ID NO: 7221 - DNA, 827 bp, Lycopersicon esculentum
  Predicted polypeptide sequence is orthologous to G2
cttgcaaccaaatatcgaaaaatacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccaggtaaaatattcggattttcgattaaagaccacaatttggaatcgccggtagttacccggcaattttttccggtagataacgagtctaccaattttccaagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggtttttccaagagggaagttccaagtatagaggagtcactttgcataaatgtgggtagatggggaagctagaatgggacaattctttagggcaaaagtatgtttatttag

SEQ ID NO: 7222 - DNA, 535 bp, Lycopersicon esculentum
  Predicted polypeptide sequence is orthologous to G2
agaccaccaaaaaattaaaaacatttatttagtagctgtacttgtggatggtataaattggcagcttacatgagtaagaaatctagttcaatatctcttcttcagttagctttgtaccaactatatccatagagttggaatctctcaaaagcttttttttaccatcaagattaacccttgtaaatattatattacattatagtttacatcacaaccctccttcaggtgcgtgcggttcgctaactctcttagacgcaaaatattccatgcatcgatcgactgtctcgatagaaaattaattggatggtctggtgagagagtagttaaagccacttttgtgaggccagttttgatgtcttaatatctgctgagggaatcctgatgatgctgcagcagttgcaaataggtgaggaggaggaacagtattgctttgccattgttgagtatctcttctattgctgctgcttggaaactgaacttgataatttgaggaggtgaattgtggtggaatcatttgggagtcaccagctctcat

SEQ ID NO: 7223 - DNA, 696 bp, Lycopersicon esculentum
  Predicted polypeptide sequence is orthologous to G2
ttgtcgcaacaagtgcagccaatgaaaaaaagccggcgtggtccaaggtctagaagctcacagtaccgcggtgttactttttatcggagaactggccgctgggaatcacatatatgggattgtggaaagcaagtttatctaggtggatttgatactgcacatgctgctgctcgtgcgtacgatcgggcagcaataaaatttcgtggaatggaggcggacataaacttcaacctcgaagattatgaggaagatttaaaacagatgaagaatttaacgaaggaagaatttgttcatgtactgaggaggcaaagtactggttttccgaggggaagttctaagtatagaggggtgacattgcacaaatgtggtagatgggaagctagaatgggtcaattgttgggcaaaaagtacgtttatttgggactctttgatactgaaaatgaagctgccagggcttatgataaagctgccatcaaatgtaatggcaaggatgcagtcactaacttcgatccttgcatttatgaaaatgaacttaattcatctgaatgtagtaataaagcagcagatcacagccttgacttaagcttaggtagttcgagctcaaagcaaaacagccgtgaaatggaggatactaataagaatcaaaattatccttctatccaatttgatggtgattggcgacaccaagggtcgaaa

SEQ ID NO: 7224 - DNA, 600 bp, Lycopersicon esculentum
  Predicted polypeptide sequence is orthologous to G20
ggcttcaaatgctactctgtttactttaatttcagcttccttaaattctttctgctccaggactgtgttgcttatggcttccctttcctctgagcctactgccaagactgagggtagcagtggcaatgatgctggtggtggagaaacatcagaagctatggggcatatagggactgatcaactgttattatatagaggactgaaaaaagcgaaaaaagaaaggggttatacagccaaggagcgcataagcaaaatgcccccatgtactgcagggaagcgcagctccatctatcgtggtgtcactaggcatagatggactggtcgttatgaagctcatctttgggataaaagtacctggaatcaaaaccaaaataagaaaggaaagcaagtttatttaggagcatatgatgatgaggaggctgcagcaagagcatatgatcttgccgctttgaaatattggggtcctggaaccctcattaatttcccagtgacagattacacaagggaccttgaagagatgcaaaatgtctcaagagaagattatcttgcatcattaagaagaaagagtggtggtttctccagagggatctctaaatatcg

SEQ ID NO: 7225 - DNA, 790 bp, Lycopersicon esculentum
  Predicted polypeptide sequence is orthologous to G2011
cagagttgtttacaggagatatttcttggtttgtatgtcggcgttacctatataaacctcccttcaaccccttttaccgactttttatctatcacccttatcgaaattttgaatcttttgatcacaaaaactattaaagtttcaatctttgatccataaaaaccacaaatctctttgtatgatatgaacccatttgataaaaaacaagaatctgatactgatacaaaaaccccatttttgactgaaatggactctgaatttgctgcgttttcaccaatttcactcccttttgctgacccatcttctccttttatcaattttggatcttttgccactcctttgagccaacatccagttggagaaggggaaggagaaggagaagggggagaaattgaacagccagctgagggaggattgggtgtgccgcagcctatggagtgtttacatgggatacaaattccgccatttttgtcaaagacttttgatttggttgaggaccctttattggatacgattatttcttggggtagaaatggagaaagctttgtagtttgggatccagtggagttttcaagattggttcttcctaggaatttcaagcacagtaatttctccagctttgttcgacagcttaatacatatgtttgcagcactgaaggcgagtatgggacttctttagagatttcggacttgaatgagtgaatgacattgctcgctcaagctttttccagtcgattcttctgtattggcttggctggatcttgtaccctcgcctagggcaagcaatgat

SEQ ID NO: 7226 - DNA, 2873 bp, Lycopersicon esculentum
  Predicted polypeptide sequence is orthologous to G2057
gaattcggcacgagcaaaaaacagtatcttttatcatatatttgatttgctctctgcaaactctattttgaataattaaataactagaattgttagatgaaagggaatgatgggttaggggtatttgttttgatttaaagttatggaatttgggaagttgaatggcagagagtttgagatttcagtgtaaacgatcaaaaactggaaagagaaattgcaaacaagggtttgagtctggatcctcagaggaatcagcagcaacattatcatctcaatcaaaatcaaaaccaaaatcaagattcagttggcaaagaagaagaagaaaatcaacaacaatcagaaaacgaacctcagctttatcttcatcctcacaaccagcaacaacagccatttttcaatcaacatcacttgatttatggaaggttagattcacagcaattgcttccaccacagccaacaccgaagaaacgttcgtatttgccttcgacgtcttcattggggcaaaacgtcgaacatgcagcagcattgcgtgggaaaatggcagaaacgtcaagattgggtataaggaatactgtaggagagattgtagaagtacaaggaggtcacattgtgaggtctacggggcggaaagaccgccacagcaaggtttgcacagccaaaggccccagagatcgccgtgtgcgtctctctgctcatactgctattcagttttacgatgtgcaagaccgccttggttatgatagacctagtaaagctgtggattggcttatcaaaaaggcaaaacccgccattgatgagctagctgagttacctgcctggaaacctacaattggtactgcatctgctgctgctgctactaacaccaatcttgaacaggaacaggctcaaaaacagcaagaagataacaactttgcatttcaacaaggaaatgttagtttgtttgataatgttgctggcccttcaagtaaaagagcaatcgaaagtaatactgctagctttctgcctccatctttagaatctgatgctattgctgatactatcaaatcttttttcccaatgggttcttcaacctcagctaactcttcagctatgcagttccatagcttccaagaaccccatatgttatcaagagccaatagccagaaccaagatttgagtctctctttacagtttcaagatcctattttgcttcaccatcaaaaccagcaagctcaacaccataaccaaactaaccataagggaacaaagagcaagtgcagggtcaagcaccagcccactttggaggaaacaccccacttggttttgacacctctggctggtctatgcatcagagacttcgttcttggagtgacagtagagaaattggccctggtggtagtggtggagcagtaacaggacctggtgggtacttgttcaattcgccaccagcaccggccgtgctgcagcagctattcggtcaaaatcagtttttttctcagaggggaccccttcagtccagtaacacatcttcggttcgcgcatggatggatccgtcagcgatagcaattgcctcaggtgatccaagtaatcaccatcaagctgcattatcaatgtatccatcaacaattcctggctatggatttgcctctgaagtaggcggattctctgggtttcgtattcctgctcgaatccaaggtgaagaagaggagcacgatggcatttccgataagccatcctctgcttcctctgattctcgccattgaattagctccaaaaagtttgatctttctcaatccctgacagggaaatgctctacttgaatgcaattagaacttacagaagtaatgctgtcaaaagagcctggagatggagaatgagagacagaaccaagatttgagtctctctttacagtttcaagatcctattttgcttcaccatcaaaaccagcaagctcaacaccataaccaaactaaccataagggaacaaagagcaagtgcagggtcaagcaccagcccactttggaggaaacaccccacttggttttgacacctctggctggtctatgcatcagagacttcgttcttggagtgacagtagagaaattggccctggtggtagtggtggagcagtaacaggacctggtgggtacttgttcaattcgccaccagcaccggccgtgctgcagcagctattcggtcaaaatcagtttttttctcagaggggaccccttcagtccagtaacacatcttcggttcgcgcatggatggatccgtcagcgatagcaattgcctcaggtgatccaagtaatcaccatcaagctgcattatcaatgtatccatcaacaattcctggctatggatttgcctctgaagtaggcggattctctgggtttcgtattcctgctcgaatccaaggtgaagaagaggagcacgatggcatttccgataagccatcctctgcttcctctgattctcgccattgaattagctccaaaaagtttgatctttctcaatccctgacagggaaatgctctacttgaatgcaattagaacttacagaagtaatgctgtcaaaagagcctggagatggagaatgagagagttcaaaatagagtctgattcaatggcatacaccgagtcgaaaagaatcctgatccttgtttcaggttcttcgatccggtctaatataattagttattcaccgttcttgattttccagttcttgtgtaattgagcttttctagctcaacaagctacattaggagtgttatgtgtttggccagacttgtcatattgctgctgtttgctttatttcatgattttggagactttcaacctagaattggtaatgttttgttagttatttttaagtcttgaaaaaaaaaaaaaaaaaa

SEQ ID NO: 7227 - DNA, 741 bp, Lycopersicon esculentum
  Predicted polypeptide sequence is orthologous to G206
ccaagtgaaaaatcaaaacaaagtatagagagagaaaaaataaaatggggagatctccttgctgtgagaaattggggttgaaaagaggtccatggagcaaagaagaagattatttactcatcaattacattaaaaagaatggtcatcctaattggcgtgcacttccaaaacttgcaggtctattaaggtgcggaaaaagttgtaggcttcgatggactaattacttgagacctgatattaagcgaggcaattttactcatcaagaagaagatacaattatcaagttgcatcaagttcttggaaacagttggtctgctattgcagcaagattacccggaagaacagataacgaaataaaaaacatttggcatactcgtctgaagaaaaaaaggaatgaatctcaacttaaagaaacccaatcggagcctgaaaatactaatgtagatgtacatttggaggaggccaacaattctaatgataaacattccgaaatatcgaatcttaaaataaacatcgaaatccaacaacaaccaagtccatcatcgtcagtatcatcatcaagtgaagattcatgttcaaatacaactgcaacgagttcagagtcgagaaatcaaataatgtccgataatttgttagaaattgatgacgatatttggtcccgagtagtatggggcacagtcgatgacaattatggtgatttgtcattaatggaggatattacccacattattctagctttga

SEQ ID NO: 7228 - DNA, 701 bp, Lycopersicon esculentum
  Predicted polypeptide sequence is orthologous to G2071
cggccaaatcggccgaattgaaagtttgtgaaattataaggagcaatttgtgtatttttagagtaagaaaaggaaagggagaaacgagatccctacgaagtcggcaactatggcgtcaaaggtgatgccgtcagcatcaacaacgcctaattcggatcgttcattacatccccaaaacccatcttcttctctaaatcactctcatccttctagaaacttcgattctatgaacatggatgaaattctgaagaacatttactctgattccgacccttttgcttgttctgtatctgcaaccgccgcagtccatacaccttctgctaccgcagccggtgttggggatgtggggcctactaagactgtggatgaggtgtggagggaaattgtagcaggaggagggggagggggagggagtagggagccggagatgactctggaggattttttgaccaaagctggggcggttactgaggaggatgttagagttccggtgatcgctcctccaccacctccgccaccgcctccagccacgggggctccgtctgccaaagggtttgtggtggataacatgatgggtactgggaattgtcagtttccggtggccatgcagaatggaccaggagggtatggtatggaaccccaaccccacatgggatttggaaatggggtggtggctattacagggagtggaagtgggagtg

SEQ ID NO: 7229 - DNA, 520 bp, Lycopersicon esculentum
  Predicted polypeptide sequence is orthologous to G2071
gcttgtacctgccaaaacggattttgtttgtcgtaaccatgggatcttacctgaacttcaagaactttgctgacacatcacaaccagagagcagtgggaataatagtaattcttttttggcccaacaatcttccatatactcgtttacctttgatgagctgcaaaatacatgtggacttggaaaagattttgggtcgatgaatatggatgacctcttgaagaacattgaagagtctcaagcgttgtcatcttctgctgctttagggggtaatttgcagagacagggttctttgacactgcctaggacacttagtcagaaaactgtagatgaagtatggagagactttcagaaagagagtgttgttgctaatgatgcaagtgggactggaggatcaaactttgggcagcgggaatctaccttgtgagaaatgacattagaagagtttttggttagagcatgggccgtgcaagaagatatgcaaccagctggatactcaaatgatgttacatttgctagtgg

SEQ ID NO: 7230 - DNA, 684 bp, Lycopersicon esculentum
  Predicted polypeptide sequence is orthologous to G2071
taagcacatgaggaaactttatgcaagaacattgtttacataacgtacaggtacacagcacctgtcctgtactatagtcgatacataaagttatctatcctgtgaccaacatatgtgaattagaacatattttaattcacaggctgggaggagggtcgaggagcaggctctgaacttgtttgttgaaacaaaaaagaggaaggaaaagctatttcacttcaatctcctgtctaccaattctccgagtgtttactcgggaatttgctcttctactgactaccaaggtcccgtcactgtccttcgcaagcatattagtttattttcccatggcacattcatcttttccaataactgatttttctgcttctcgataaattcagcctgtttcttctgcaactcttgcttaatttctttaagctttgctacttcagcttccaactctaaagtatatgcctgcttccgatcccttgatctggccgcagactccctgttctttatcatcctcttacgccttctctcaacaactttttcaaaagaggtgcatgatctccttcctcttccaccttcaccacatgcataaggtgaaggtgaaagagaagatgtatcaagatttccaggggatactccttttactggcatggtcataacaccaccctgcatgacactactagtatttgcagacgg

SEQ ID NO: 7231 - DNA, 888 bp, Lycopersicon esculentum
  Predicted polypeptide sequence is orthologous to G2107
ctatttttagctctcaacaacaatgaatatctttgaaacctattattcagactcgttaattttaaccgaatcatcttcttcttcatcgtcatcgtcgttttctgaagaggaagttattttagcttcgaataacccgaaaaagccagctggcaggaagaagtttcgagaaacacggcatccgatatacaggggaatcaggaagaggaattcaggaaaatgggtttgtgaagtcagagaaccaaataagaagacaaggatttggcttggtacttttcctacggctgaaatggcggctagagctcatgacgtggcggctttagcattaagaggccgttctgcttgtttgaatttctctgattctgcttggaggctgcctatccctgcttcctccaactctaaagatattcaaaaggcggccgctcaggccgtcgaaatcttccgatcggaagaagtttcaggagaatctcctgaaacgtcagaaaatgtgcaagagagtagtgacttcgtggatgaggaggcgatctttttcatgccaggattacttgcaaatatggcagaaggacttatgctacctccacctcaatgtgcagaaatgggagatcattgtgtggaaactgatgcctacatgataactttatggaattattctatctaaaatagtagtacaatttatcaaattactaggatttagaagattttgttagtttttggtattcagtatttagatactaagaatgtatattattagtatttttattttggccaaatacatgaacatgaacagaaacttgttgggtttttttactcaggtacctcaactacatcatttttctattgattattgaactacacataatttgtttctttaaaaaaaaaaaaaaaaaaaaa

SEQ ID NO: 7232 - DNA, 716 bp, Lycopersicon esculentum
  misc_feature (636)..(636): n is a, c, g, or t
  Predicted polypeptide sequence is orthologous to G2107
cgtccatccatcgtacactactatattttactctctcgtcaaaatagtattatcatatcatggatatctttgaatcctattattcaaattctttcgttgaatcattattatcatcgtcattatcaatatctgatactaataatctcaatcactactcccctaatgaggaagttattattttagcttcgaataacccgaaaaagccagctggcaggaagaagtttcgagaaactcgacatccagtatacaggggaatcaggaagaggaattcaggaaaatgggtttgtgaagtcagagaaccaaataagaagacaaggatttggcttggtacttttcctacggctgaaatggcggctagagctcatgacgtggcggctatagcattaagaggccgttctgcttgtttgaatttcgctgattcagtttggaggttgcctatccctgcttcctccaactctaaagatattcaaaaggcggccgctgaggccgccgaaatctttcgatcggaagaagtttcaggagaatctcctgaaacgtcagaaaatgtgcaagagagtagtgacttcgtggatgaggaagcgctgttttccatgccaggattacttgcaaatatggcagaaggactcatgctacctnctccccaatgtttagagatcggagaccattacgttgaattagctgatgtgcacgcttatatgcccttatgggattattct

SEQ ID NO: 7233 - DNA, 647 bp, Lycopersicon esculentum
  Predicted polypeptide sequence is orthologous to G2107
gagagaactcgccacccggtttataggggagtgaggaggaggaataataacaagtgggtttgtgagctacgtgagcctagtcaacagaaaagaatatggctagggacttactctactcctgaaatggcggctcgagctcatgatgttgctgcattagctcttagaggcaatctagccactctgaactttgctgactctcgatggggattgccagtgccggcatcaaaggaccccaaggacatacgacaggcagcagttatggctgcacaagctttttctcaggatactgaattagtcggagttgactatatgaatgaggaagttaattccaataccatcgatgaaataaagtatcaagagatagatattgcgagggctaatgatgggagtagtagtgattttggcgcaaaggaattgtgtatagatatggagaacattttatgttgtaactggggagaagataacgacatgttggagatggaaggatggcaagaaaagatggcaaaggggcttttgttttcaccaactccgcgtttaggtagttgtttcagttgggatgatgtagaaagcgacgtggaggtgtctttgtggagttatagtatttgatactaagtagccaggtagttaccagctaggagtagcatttt

SEQ ID NO: 7234 - DNA, 661 bp, Lycopersicon esculentum
  Predicted polypeptide sequence is orthologous to G2108
atcggccgaattgactcctcctctctgaaaagcagaagtgccacacctctttctcctcatctcctctctccctctgttgttctcttacaacgagaaccactagagaataatcatgtagatagtggccaagtaaactcaactgctcgaccactgccaaccctttttcccaaacaccgccgacttggaaaaacctacagaaacaacaccagctccagcggcttcgaccaacaagcggtgaataatgactctgggcgacgagaataacaacgctccagccagtggctacgaggtctacaacaatgacggccagaatatcgatccaacacggtagctcaagtttttcagtcggcttaaagacaaatctgttaagggaatcagaagtcttgatgtgccatggaggatggataggttttcaaggcttgaagatgaagtattagtgagtcctcatcaattcgaggataatatccacatgtcccttatgtcatactcttcatcttattgtcttttatgggattagtcccaagtgttgtatactctaaagtttagatggttcaagtagatgttgtaaagatttaaatgtttcaatgaaagtcttctgcttgtgtaatatttatgaaagagttcaacatgtgaaaaaagttttacatttttaaaaaaaaaa

SEQ ID NO: 7235 - DNA, 801 bp, Lycopersicon esculentum
  Predicted polypeptide sequence is orthologous to G2141
aaataacaacaaaaaagacattgtataacatttaaaaaaaaagaaaaaaagtgtgtactgtgtacagactacagagtaacagcaaaataaggcacaaaactataatcttgttccttcaatttctctacctgtatggatgtgtaatgaagtggaggcatttcaccagctgaacaatcgatccctctcgtcggatctttgaaagtggccaattgtttgatgtgtatcttatagattgttaatcttgaggcaaggggattttttttttttagtttaagtttgattcatttcccaaataatggatatgggtagcaagaatgatactcaaggacaaaagaggaacaaggatgctactaattttcagtcaccaaacatatcgttggactggcaattaagtggaagcaacttgacaaatgcatcaatggggatgatccctaatagcaatcctttagtagattcagtttttcccactatttgggatcggcctcccaattcgtcacacttaggtttctatggtaataataatgctaatgctcaaatcagtccttgcattatgaatcagcacgagactgcagcaattggctcggtccctacgagaggtagtatgagttggaatccactgaattcgatgctgaaaggggctatgtttgtaccacctattcctggaatgattcctcaaagcttagctcagcttccagctgatttgggtttcattgagagagctgcaaggttttcgtgcttcagtggaggaaacttcaatgatatgatgaaccggcctttaagcgtccctgagtctactaagcc

SEQ ID NO: 7236 - DNA, 783 bp, Lycopersicon esculentum
  Predicted polypeptide sequence is orthologous to G2144
cattaacgaaattcgagaaactgtagaaattgagcttggggttgtcttgttgagtctcattctggaattgggttagctgtgttgtatcaaagttgggtttggtttgttttttctgtgaaatggataatctgatagagtgtattgaagcaggagaagctagatccgagaattgcggagctagaatgggagaaattaaagatgggtttcatcaatttggtgaggaaattttgtctgttacgtcggaaggtggaagttctttcactgctttacttgggcttccgccgaatcaagcggtggagcttttggttcagtcaccggaaactgacaaaatagcatcagataagcttgctatcagtgaacctcactatcgttatcctcctcctcctccgatttttccttcagatatcgctttgatcgatagagcttctaagttctccgtcttcgccgccgccggtaactccccggagtccaattcaaccctttcgaattccgggtcgaaatcactgttcgtcaagcaagaacccctagattccgaatgtaaccacaactcatctccggcgacttccaatccactagtccatcagaaatcaacaaagagaaaggaacgcgagaaaaaggtaaaagaaacttctaaaaaggggaaaaaatcagctaacgatacctcagaagacggcggcgagaagctaccatatggtcacgtccgagcgcgtcgaggccaagccactgatagccatagtttagcagaaagagcaaggagagagaagattatgctaggatgaagct

SEQ ID NO: 7237 - DNA, 1992 bp, Lycopersicon esculentum
  Predicted polypeptide sequence is orthologous to G217
ggattccgaaatatcttctcgtcggagcggaaaaacgccgccgcggcctgaatctactctaccggagaccgtcatttctcgccggcgtatagatttcagctcatttacaggcaaaatctgaggtatacttatccaaaaccctagatttctcggagtctcccttgggagactgaaatagttagcaaacatgaggattatgataaagggaggagtatggaagaacacggaggatgagattctaaaggcggcggtgatgaagtatgggaagaatcagtgggctcgtatttcttctttacttgttcgtaaatctgctaagcagtgtaaagctcgctggtatgaatggctcgatccttcaattaagaagactgaatggactagagaggaggatgaaaaactacttcaccttgcaaaactcatgcctacccaatggaggacaattgcgccaatcgttggccgtacaccatcacaatgccttgaacgttatgagaagcttctcgatgcagcatgtactaaggatgagaactatgatcctaatgatgatccaagaaaattgaagcccggagagattgatcctaacccggaatcaaagcctgctcgtcctgatcctgttgatatggatgaggacgagaaagaaatgctttctgaagcacgggctaggttggccaacacaagaggcaagaaggctaaaaggaaagccagagaaaagcagcttgaagaggcgcggaggcttgcttctttacagaagaggagagaactgaaggctgctggaatagatgtccgtcaaaggaagagaaaaaggagaggtattgattacaatgctgaaattccctttgaaaagaagcctcctccaggtttctatgatgtcactgaggaagaccgtccagttgatcaacctaagtttccaactaccattgaggaactagaaggtgaaaggagagtcgataaggaagctcgcctaaggaagcaggatattgcgaggaacaaaattgcagagagacaggatgcccctacatccatattgcatgcgaacaaacttaatgatccagaagcagtgaggaagaggtcgaaactgaatcttccagcaccacagattccagatcatgaattggaggccatagcaaagataggtattgccagtgatctaattgggggagatgaactgtccgaagggaatgctgcaacgcgtgctcttcttgcaaattatgcccagacaccacaacatgctatgactcctatgcgaacacctcaaagaaccccttcaactaagcaagacgccattatgatggaagcagaaaatcaacgaagattgactcaatctcaaacaccattacttggaggagataatcctttgttgcacccctcagatttctcgggtgtcactcctaagaaaagggaggttcaaactccaaacccacttttaactccttcagcgactcctggagccacgagccttactcctagaattggcatgacaccttcgagagattcttatgggatgacacccaaaggaactcctatgagggacgagctacgcattaatgaagaaatggatatgcatagtaatgctaaactggggcaatttaattcaaaaaaagaattgctttctggtttgaaaagccttcctcagcccaagaatgagtaccagattgtcatccaacaacctcctgaagaaaatgaagaaccagaagagaagatcgaagaagacatgtctgataggattgccagggagaaggctgaagaagaagcaaagcgacaagcattactccgtaaaaggtcaaaagtattgcaaagggagctccctagacctcccattgcttctctagaactaataaagagttccttgatgagagctgatgaggacaagagctcctttgttcctcctacactaattgagcaggctgatgaaatgattagaaaggaacttgtgtccttgctagaacatgataataccaagtaccctctagatgagaagccaaaaaaaaaaaaaaaaaa

SEQ ID NO: 7238 - DNA, 577 bp, Lycopersicon esculentum
  Predicted polypeptide sequence is orthologous to G2226
caataaatttctctcccaattctcttaatatttcaaatttcaaagaattttctaacatcttctagctcctactacacctataggcaataatataaagtccagttcagtcagctgttccagaagttgttgctagtagaaatctctaagttacagcctagattccaatccagtatgggactctcacagtatccaactccagcagatgcaggagtgctctgtgttattctagtgaacacagccatatccatctccattgtcaaggagatgggccgatcgatccttcatgtgattggcatccacattgcatcatgggacgattattccatcgaaggctccttggactcgtttgaatgtcgcagaagcccatcagagtcatatatggaggaattcagaagccagacccctgcaattcgttatgattccatctgtgtctctaaccacgctgagaaagagtgctcactctgcctgacggattatgagccggacgcacagataaaccatctgtcatgtggccatgttttccacaagcattgattagagaagtggctcaagtactgccaatgtaacttgtccactt

SEQ ID NO: 7239 - DNA, 610 bp, Lycopersicon esculentum
  Predicted polypeptide sequence is orthologous to G2226
caagaatgctctgtgtgcctgacaaaatttgagcctgatgcaggggtaaacagcctctcatgtggtcatgttttccataagctgtgtctagagaagtggctcaggtattggcatgtaacttgtcctctttgtagaaattacttgatgcctcaacaagaagaggacgatacatgtccaatgtgagattaaacgttttacggtgccacttcatccatttgctgatgttattatgtacagcttagtagtgtacaggctgagtatgtgtatgcttgatctttgatgtgatatagtctgttagcttgtcatatttgtgatggtttgcgtcctctcagagtgacgggtctctttcgtgtgaccaaaaaacttatactatgttgtacatgatttagtcctgtagcttcttgtgtttgtaatgctttgcgtcctctcagagtgacgggtctctttcgtgtgaccaaaaacttgtacattatagtacatggtgtagtcgtgtagcttattaatgcttttcgtcctctccaagtgacgagtctcctttggcatcaccaagaacttctacattgttgtacattgttgtacatataacctaaaactttctcttatgttactt

SEQ ID NO: 7240 - DNA, 719 bp, Lycopersicon esculentum
  Predicted polypeptide sequence is orthologous to G2226
ggttataggaaacaaaagttcgcttcttttttatggggtcttgataaaaaatccagtgcattgagttcttccaaaagtttggcttgaagaagaaattcctcacatctacactaggttcctattcataatgggactctcaccatatacgactccagcagatgcaggagtgttctgtgtgattctggttaatacagccatatccatctctattgtcaagggaatggttcgatctatccttcatgtgattggcatcaactttgcatcatgggaagaatattctattgaaggccctttggacccatttgagtgtcgtgggagcccctcggtatcatacatggaggagttccgaagcagaacccctgctgttcgttacgattcattgtgttctaatcaccctacacaagaatgcgcggtatgtctggcagagttcaaacatgacgaggagataaactgcctctcatgtggccacgtttttcataagctgtgtctcgagaaatggctaaagaattggaatgtcacctgtcctctctgcaggaattacattatgcctaaagaaggtgaggaagatacttgtccaatgtgaattttgtagtttgtcaggcctgtttgatatgttctgatgtacagcttagttgggtaaaaatttattgatgactgcctgatctttgacactgcataattctgtaaccttttatactgtaatacttttgcgtcctatc

SEQ ID NO: 7241 - DNA, 1778 bp, Lycopersicon esculentum
  Predicted polypeptide sequence is orthologous to G2239
ggagcttccttttttcaattctgtctgccaagtaggatccttctgcaccatccaccatttttgttttaatacccccaaacgaatcgaaccacagttatttcaatttctttgatattcaaaattataaagcttacttccccagattagtatgagatatgggcaattctatgaagcaagaatctcctcttcttagttatcttctctttgtgtttctcttcacatgttcttctttaattgacgaatcagtcgcacagccaccaactactggaaataaatttcaatatgcaaggctcagtcatcctttggcaattatcataattgttcttattgctgcgctctttttcatggctgctttttctatttacattcgacactgcactcaggcttctggattgagcggcagtgtccggcgagctctatccatgcgccgccgtgctgcggcggctcgtggattagatgcagcggttattgagacttttccgacttttacttatgctgaagtgaaggatcatcaaattggtaaaggagctttggagtgtgctgtttgtttgaatgaatttgaagatgatgaaacgctgcgtttaattccaaagtgtgatcacgtttttcatcctgagtgtattgatgcttggttggaatcacatgatacttgccctgtttgccgtgctgatctcaaccctcaaccggatgaaccgccggttcaagttccagaagatgaaccggcaacggaacagcaacagcaacagcaaaacgatgaagtttcaattcgcatagtgagcgacgacgaacaaagggaacaagtacagcaacagcaacaagaagaaggttctgttaattcgacggtgaagcggaatttgagcttcaacgtgccgaaccgggttcccaagcaagaagaaggcggttcagttaaatcaggagtaaagagaaacttgagtttcaacgtgccgattcaaccaccgagatcaatttccatgaggccaaagatgttcagcaaattcagatcacattcaaccggtcattcactagtactaccaggtgagaatttagaccggtacactctcagattgccggagggcgttcggaaagaggtaatgaaccgtgcactattgaaccgggctaaaagctttggaggcaccttaccaagagatacaagctccagaaaaggatacagaaccggtaccggagatggaagcaaccggggttctagatctaacaaaaggatggagtggtctgaaccggaaccgaaatcggaccggtggattttcaccatgacaccaccattcttttcaagaggttcatcaatgaaatcacccagagttggagctgaagccggcgagggttccacctcagggagtatgagaaccgccgtcaaattgccgtcgtttaaatgcttggaaccaaaaggcgatgaagcctcattgatgtcgactgactcggctcgaccgccggtttaataatccggttcgaagtcaaaccgtaatgattcgcaaggacttttcatgggctataggaaaggggaacgtgtttttcatgatagattgggcccccgctttgaattaacaagcccaaacttgactctaaatttattttttcgagaaaagcatttttgtttttatttttttgttatataattgaaaaatctttaagtttttcctttttctcgttttaaagatatagtgcatatcaatagttgatgtaagtgtaaccaaaaaatcacttgtaattttatttatttttccttattggataatgtcctatgacaaaaaaaaaaaaaaaaa

SEQ ID NO: 7242 - DNA, 649 bp, Lycopersicon esculentum
  Predicted polypeptide sequence is orthologous to G2239
gggagctttggagtgtgccgtgtgtctgaacgaatttgaagatgatgaaatgttgcgtttgatccctaagtgtgatcacgtttttcatcctgaatgcatcgatgcttggctcaaatctcatgtaacttgccctgtttgccgagctgatcttactcctaaacctgatgaaccggtgccggttcaaactcctgaggtgaaccgggaattggggcaagaacaggagaatacacagcaaaataacgaagttacgattcaaatagatgtagatgagaatttgatgtcacagcaagaggagacctctgtaaaaccagaagttaaacgaaatttgagtttcaacgcggtgaaccggccgccgaggtctttttctctgaagagaccaaagatgttaagcaaattcaggtcacattcgaccggtcactcattagtggtaccaggggagaatttagaccggtatactcttagattgccggagaaggtgaggaaagatgtaatggaccgggctctactaaaccggacaaggagctgtgcagtcacgctaccaagacacggtggcaccacaagaggatacagagccggtccaggagagggaagcaacagaggtgcaaggtcattcaagcgaatcgaccggttcgatccggaaacaaaatca

SEQ ID NO: 7243 - DNA, 534 bp, Lycopersicon esculentum
  Predicted polypeptide sequence is orthologous to G227, G242
ttttagtgctgcacccaaatcaggagagaaacagttttttactccagagttcttatcagttctgcaagatatgattagaaaggaagttaagagttacatgtctgggtttgaacaaaatggtctctgcatgcagactgatgcaataaggaatgcagtcattaagcgtattggcatcagcaagattgagtaatccatctatgattactgttgaactgttctatagtcatcaacaatggctgccgctgctcagcgaaatgacaccggagaagaaacaatggaagatcggagcagtcttcctcccccttttttttattgcttaattacttccttagaattccaatcaaaaaaaataattttgcagtaatgtacagatgaatgagaggatgagagaagaaaactaaatttaaaaatgcccgaaaagatgaaaaaattgagaaaaatctcattctcttgtctaatgtcgcatgatgatctcgcttcgatagcgttgcaagaacaggctcatgaaaattaatctatgaattaggaaatttt

SEQ ID NO: 7244 - DNA, 727 bp, Lycopersicon esculentum
  Predicted polypeptide sequence is orthologous to G227, G242
tatggatcgggttaaaggtccatggagccctgaagaagatgagcttttacagcaacttgttcagaaacatggcccgagaaattggtctctaataagcaaatcgattccggggagatccggaaaatcttgccgcttgcggtggtgtaatcagttatctccacaggtggagcatcgggcttttacgcctgaagaagatgagactattattcgggctcatgcccgattcggtaacaaatgggctactatagcccgacttcttaatgggcggactgataacgctattaagaatcactggaactctaccttgaagaggaagtgttcatcgcttagtgccgatgaagggaacgaactcgccgatcaactttttgagaatcagcagccgccgttgaagagatctgttagtgccggatccgctatgccggttactggttttcatttcagtccgggtagcccgtcgggttctgatagcgattcgagccttcatgttacgtcgtcgtcccaatctcaagtgtttaagcctgttgccagaaccggcggcgtatttccgccgtcgattgatatttcatctccgcctgttgatcctcccacttctctaagcctttcgcttcctggtgttgacttggctgaatcctctaatcgttcggccgattcgactcagtcgaaaatccttttcagtggctgcttcccacgatgcagatttcttcacggcaacaccacgggccgctcg

SEQ ID NO: 7245 - DNA, 802 bp, Lycopersicon esculentum
  Predicted polypeptide sequence is orthologous to G227, G242
ccgcctcccaccaccgtctaatttgtaaatatattcgccggaaacttctctatccacgctttctctatatctatcataccctttttcttaattaatcggttgctattcctttgatggcagcgattacgcagagaaaagattcggatcggatcaaaggtccatggagtcctgaagaggacgagttgttgcagacgcttgttgagaaacatggacctagaaactggactttgataagcaaatcggtgccgggtcgatctggtaaatcctgtcgtctccggtggtgtaatcagctttcacctcaagtggaacatcgtgcttttactcctgaagaagatgatacgatcatcagggctcatgccaagtttggtaataaatgggcgactattgcccgtttgttatcgggtcggactgataacgctataaagaaccattggaactctactcttaaacgtaagtgtccttccatgtccgaagatttaagctttgaaacccctcaaccgcctttgaaaagatcgtctagtgttggtccctgtaccaatttttcttctgttatgaatccgggtagtccgtctggatccgacttgagtgattctagtcctttcgggttttccccatcgcatgtttacagacctgttccccgtaccggcgggattttcccctctcctcctccctctcggggtaagcagatcgaaattccctcatctgtacccgaccccacacatctctctgcctttcgttacccggatccggatccggatcatcgaaaagccacccagtcccctaatcacaccactaccacgcc

SEQ ID NO: 7246 - DNA, 714 bp, Lycopersicon esculentum
  Predicted polypeptide sequence is orthologous to G229
taataataataatgggaagaacaccttgttgtgaaaaagtgggcatcaagagaggcagatggactgcagaagaagatcaaattctcactaattatattatttctaatggagaaggctcttggaggtcgttacctaaaaatgccggattattgagatgcggaaagagttgtagactacgatggattaattatttgaggtctgatctcaagagagggaacattacttctcaagaggaagatataattataaagttacatgcaactttgggtaacagatggtctcttatagcagaacatttatcaggtagaacagacaatgagataaaaaactattggaactctcatctaagtcgaaaagttgatagcttaaggataccaagcgatgagaagttacctaaagccgtagttgatttggctaaaaaaggtataccgaagccaattaaaaaatcatcgattagtcgaccaaaaaataaaaagtcaaacttattagaaaaagaagcattgtgttgtacaaatatgccagcttgtgatagtgccatggaattaatgcaagaagatctagcaaagatagaggtgccaaattcttgggcaggacctatagaggccaagggaagccttagttcagatagtgatatcgaatggccaagactcgaggagattatgccagacgtggtgattgatgatgaagataagaacacaatttcatattgaattg

SEQ ID NO: 7247 - DNA, 1154 bp, Lycopersicon esculentum
  Predicted polypeptide sequence is orthologous to G2290
ggcgtaaaattcactctgtaactatggatgaaaacgataagcaggttgataatgatccattacctggtggtggtggtggtggtgcagcggagttcaccggcgctactactgaatcaagctggtcactcggtggtggagatgatgaatcggataatgtttacttcttcggtactagtagtactgatagagagagcagtatattaaccgaattcggctggaattttcaaccgcacggaaatagagatgttcgcgccggtggtgacggtagtcgatttgatcggatcgatgaggatttggcgggaaatagtactacaactactgcttctgtttctgcttctgtttctattactgaaccgacggtgacggagaaaatcaccgacgaacctgtttcatctagctgttctgatgatcccccggagaaatctacagcttccggtagctcctccgcctctcgaccgccgtccgatacagcaagcaaggttaaaaagaagggtcagaaacgaatcaggcagccccgctttgcatttatgaccaaaagtgaagttgatcatcttgaagatggctatagatggaggaaatatggccaaaaagctgttaaaaacagtccatttccaaggagttattatcgttgtacaaatacaaagtgtacagtaaagaaaagagtggagagatcctctgaagattcctcaattgtaatcacaacatatgaaggacaacattgtcaccatacagttggatttcctagaggtggacttatcaatcacgaagcatttacatctcaattaacacctttaccctcacaattctatcatccatccggtgttcaataccctcatgaattagttcctatgagtagccccgctgcaccagaatcacatacaatgcctggtgaaaccggacccgaacctattagattgccagaaacaagtcaaccagatgctacacaacaaccaactgatgaaggattgcttggagatattgtacctcctgggatgcgaagcagataatataaagggtaatatattccgtttcttaatttgcattaatttacatatatttttttatttcatcaatgacatagtatttgaacgttacacgagtgcgcctacacaagtgtaagtgtatgtgttttattcaaaaaaaaaaaaaaaaaa

SEQ ID NO: 7248 - DNA, 1373 bp, Lycopersicon esculentum
  Predicted polypeptide sequence is orthologous to G2343
tttttactaattaattattataatcatagaaagaaaggatattcatacatggggcatcattcatgttgtaatcaacaaaaggtaaagagaggactttggtcaccagaagaagatgaaaagctcataagatatattacttctcatggctatggctgttggagtgaagtccctgaaaaagctgggcttcaaagatgtggaaaaagttgtcgtttgagatggatcaattatttgaggcctgatattagaagaggaagatttaccccagaagaagaaaagttgattataagtctacatggagctgtaggcaacaggtgggcacatatagcgagtcatttacctggaagaaccgataacgaaataaaaaattactggaattcttggataaaaaagaagctaaaaaaaacttcaaagtcatcaacaaacacaacttcaattactgatcatcatcaccaccaacatcaaaatcaaagacctcaattgacaaattataacacaattacaagccaacaagatatattcttcacacaagacattggaacaaaatctcaagtactcctccaagattctaccctattcaattcaccaaaccaattgttcttttttgatggtggttcacttgactcaatgacaaatgttcttattaacgatgccacaaatcgaaatgctactaataacacctcgttatttcaagaaacatcgatattaaattcagagttctgctggcaagtagatcaacaacaagtacagacatcttcttacgcgatagggatgaattcaaattatttgccacctttgatagagagtatggtaccaccaatggaaatacctagtagtaataataacaataatataatattggaaggacaagaaaataataatgaattgaatgaatggaatagtcaagttgacacacaacaatgttgtccaagttatctattttgggatcaagaaaatggatcaattggtggtgatcatgagattatagatccaactacatcaaacaatatgggacaaattttatcttcttttccttctactttatgagatgattgaagattgattattttttttcgaattatttcgggagtttttattttattttattaattgagttgtgaaatagattagagagtgaaatgaaagcatgttaattaattaaaagtgtttctttggacatatttttaaaattaagtgagaggggaaataacattgagtttttatctatgagaaatgtttcacttattctttaattcaccaatcagtatcagagtttaagttatatatatttaccgatgttagtgtaagaaaaatttacatgtatccattgtaatagataatttgatttattttcacaaaaaaaaaaaaaaaaaaaa

SEQ ID NO: 7249 - DNA, 1244 bp, Lycopersicon esculentum
  Predicted polypeptide sequence is orthologous to G2344, G929
aaaagaatagtaacagttacaaacacgtagtaaagctctctctagagaaggaaattcaacagagaacaccaaaattaaagctgcttattggttttcgtatacacgaagctcttcccgaaaggtttgttactttggagattctgtggcaagcagcattatgacgtcctcgcttcattatcattcagatggtagtgagaatgaacagtcagaaaatcaatcagaagcccacagcgagtcttcatcgcctgcagctggaatgtctgtccctggcactgtaacaacaaatatgcactatgttatgcccaatcaacttgggaatggaaatcctatgttgcaggctcaaacagcttatccatatccagacccatactataggagcatctttgcaccgtatgatgcacagccttatcctccacaaccttatccagcacaaccaatggttcacgttcagctaatgggaattcaacaagcgggtgttcctttgccatcagatgcgatagacgaacctgtttttgttaatgcaaaacagtatcatggcatcttgaggcgtcgacaatctcgcgcgaaagctgagtcagaaaagaaacttctgaaagctaggaagccttacttgcatgaatcacgccatttgcatgcattgaaaagagctagaggatgtggaggtcgtttcctgacagcaaaggaaactgataatcagcagaaacaggatgaatctggtgataaatctcaagtcaacattaatctcgagtctggaaaagacaaggtcgcttcttcagagaatgcctcttgatctatgcaatatcaaggactttgtggaccatagtatgttgttactgtttgtagaaacagcagtgcttttgtttaaatagaattgtggtagctgggcaaaatcagggtaattgtggtgttctgtatgtttatctgagtgtagatagatcggaataggcctactcgtttgagagctacaaagtggccgctgggcgtatgttctctaaataccatctctctgagcttgtttgtagacattctttcttgtcctttcgtaattgccttgtgattccttcaaaatgttgttctggtaagtgtatggaatatcgagtcagaaatttgagtaataacgtttggcactacgttttgttagtttaagaagataagcgtgcagcactgttggttgatgaattctaattttccaaggtcaatgcattctgtgtcaatatcttggttatctaaaaaaaaaaaaaaaa

SEQ ID NO: 7250 - DNA, 1929 bp, Lycopersicon esculentum
  Predicted polypeptide sequence is orthologous to G2394
gactttatcgatcatcaaatataatcgctggtaggctttgcttgtgagtataaggtggtagctgaaccagtagcaatattttcttgagatttatggttgaatggctgttacctcggaagaacttaatcaagagaacccaaccgacagatttcctttgctcatggagcaagcagaaagtcatgagaggaatgaacatgttattgatgtagaacaaggaagtagcccctcatcatcaggctcatctgataatgattctcctcatgaattggaaatacccaaccatgaaaatagaccatcaaatcgacattccgtctcttcttcgtccaacgaatcagattctcatagcccttctagtgctaggagagctgatggttctgatcgtcgttggagcccatttaatactctgttgtggctttccattgagctaatattcaccttaggacagattggtgctgccgttgtcgttttatccttgtcaaaagaggaaaacccagaaactccattatttgcttggattgtgggatatgcaactggatgtgcagcaacccttcctttactgtactggcgttatcttctccgttaccaaaccatcagtcagagatcagctcaactgcgtcaagattcaccccaagtcaattccactgcagagccaaattcttatattactatctcattaactcggtcctcggatgaggaagatggaaggaatacacctaccgacatttggaccaggcaaagcaatgcaagacttggttcattggtagatcatttcaagatggccttggattgcttctttgctgtgtggtttgtcgttggcaatgtttggatctttggggggcactcttcttcttctgaggctcccaatctgtacagattatgtatagcttttcttaccattagttgcattggatatgctatgcctttcatcttgtgtgcgatgatatgctgctgcctgccttgtatcatttcaatcctcggtgtgcgtgagaatatgcatggagtgagaggagccacagaagagtccatcaacgctcttcccacactcaagtacagggtcaagacagatggaactggaagtaatgaaagtaaaaatctagaagaggaggaaggtggttgtgtagctgctggcacagagaaggaacgtgccatatcaggtgaagatgcggtgtgttgtatttgcttagcaaaatatgaggacaatgacgaactgagggaattgccttgctcgcatttcttccatacacagtgtgtagataaatggctgaagattaatgcgacttgccccctctgcaaatctgaaattgacgccaagaacagagatctaccttctgtagaagaggaacccctccaacaatcctaaggtgatgcagaaaccaacttcttatggttgaaacacagatcatcgcggctagcttgttgcatggggaaccagtagagtatatcccaactgttacttcttctgctgttgctgctactgctactgctgtttctaccacacgaatttcagtttgtatagttgtagctcataccaggtatccataacaagcttgaaagaagaggtaattccattgttgatacccttacatctctctcctgcctcaccagctatatgttgctcggaacttccaaaaaaaatgtcagctgcactcgtgttggatcttcaaaaaatgcatagcttttggaagatctaaaccgggcgatatttttgaagtgtccatcatctaatgcaaacatagcacactgtataaatagatttaagggtaaagctgggtgtacaccgttctcctcaggcgtcgctattgggattacactagagatgctgttatctcgaactttagtctctactttgttataagcttttttttcttcttataacactaaacaactgtcattattaacagtagtttctttgtgaaaaaaaaaaaaaaa

SEQ ID NO: 7251 - DNA, 639 bp, Lycopersicon esculentum
  Predicted polypeptide sequence is orthologous to G2394
cacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggtgatctttcactgttgttttcattttggggtgtttccttactttctatcatctctaccagcatcatatttgctcatgtttctattcatccgtaggttgtgtatagtatttctgacctttagctgtatcgggtatgccatgccatttattctatgtgcaacaatatgctgctgccctccctgcatttattcagtcatgggcttccgagaagatctgactcaaaacaaaggcgcccacacagaatcaattaatgctc

SEQ ID NO: 7252 - DNA, 1072 bp, Lycopersicon esculentum
  Predicted polypeptide sequence is orthologous to G241
cacaaaccaaaaaaaaaaaaacactactacttctaaagaacaccaatattcaattcattaaacataaaaaaaataaaaaaattcatcaaagtttttttaaaaaaatggttagagctccttgttgtgagaagatggggttaaagaaagggccatggactcccgaagaagatcaaattctcatctcttacattcaatcaaatggtcatggcaattggagagccctccctaaattagccggattattgcgatgtggaaaaagttgcagacttagatggacgaattatttacgtccagatattaaaagaggaaatttcacaagagaagaagaagatagtattattcaattacatgaaatgcttggcaatagatggtctgcgatagcagctagattaccgggacgaacagataatgaaataaaaaatgtatggcacactcacttgaaaaaaaggcttaaaaattatcagcctcctcaaagctccaaaagacactcaaaaaacaaggattccaaagctccttgtacttctcaaattgccttgaaaagttcaaacaattttagcaacatcaaagaagacgggcccgggcttgggtccggcccgaactcgccacaattgtcatctagcgagatgtcgactgtcacggccgattcactagccgtgacaatggacatctcgaacagtaacgaccaaatagactcatctgaaaattttattccagagatcgatgagagtttctggacggacggtttgtccacgagtggtggtggtgaagaattacaagttcaatttccatttcatgacatgaaacaagaaaatgtagagaaggatgttggagcaaaattagaggatgatatggacttttggtacagtgttttcataaagtctggggacttattagagttaccagaattttgaggggttaatttggttgttttcaaaacttgaagtagtggaatgccaactaatttagtggtgtttttttttttgggatcttttgggagtcgacaagtttgaaaattcttgtttgtttattgactttaaagttcttgagaggaccaacaaaaaaaaaaaaaaaa

SEQ ID NO: 7253 - DNA, 605 bp, Lycopersicon esculentum
  Predicted polypeptide sequence is orthologous to G241
gcacgaggagacttctaataatttctctcacccacaaaaatttggagaaaaaaaaagaagttaaaaagttattttttttagtctgtttcaaaaaaatgattgagaaaaaaaaatgggcagagcaccttgttgtgagaaaatgagcttgaagaaagggccatgggatcacgaagaagaccaaattctcatctcttatattaacaaaaatggccatggcaattggcgcgcgctccctagacaagctggattattgagatgtggaaaaagttgcagattgaggtggatgaattatttgagtccacatattaagaggggaaatttcaccaaagaagaagaagataatatcatcaatttacatgaaattcttggcaatagatggtcagcaatagcagcaagattaccgggaagaacggataatgaaataaaaaatatttggcacacccacttgaagaaaaggctaaaaaattgtcagtcttctcgaaacttcaaaagacacaattaaattaatcaaataaataattgcatgcatgctcctaactcaccaaaaatatcgtctagcgagacgtcaatcatgacaaccaattcatcatcaagtggtactttcg

SEQ ID NO: 7254 - DNA, 679 bp, Lycopersicon esculentum
  Predicted polypeptide sequence is orthologous to G241
acccagaatgtaatatattaaacatcttaaatcacattacattctatgtcatcaatcatctccaagtaagagattgaatatgatgatataagataaatcaaacttcattgggagttctttttcccttctaattttttctttttaccaattataatcataatgatctagatcaaaggaggaaagaaattcatgagatataaaaggtgaaggtggacatatgagtccacaataatcaattgaaggagctacaaaatcaattttagtatccacttcaaatggttgtgtccaaaaacttccacttgtaatatcctccaaattagctaattcttcttgaaaaatgtcttgttgataatcaatagaggataagtcttcacttgatgaccattctgaattttccaatattacattttcatgcatagtattattattattattattatcaccaattgcattttgattttccacattactctttcttttagtaatatcactttcactcttcttattattgcatttcttgcttccttcacttgagttataatcagcgcgcttcttcactgttgtgtgccaatgattctttatctcgttatctgatcttcctggcaagtgacttgcaatcgttgaccacttatttccaagttgagcatggaggttcaagatgatttcatcttcttctttt

SEQ ID NO: 7255 - DNA, 713 bp, Lycopersicon esculentum
  Predicted polypeptide sequence is orthologous to G241
gttgcagacttagatggacgaattatttacgtccagatattaaaagaggaaatttcacaagagaagaagaagatagtattattcaattacatgaaatgcttggcaatagatggtctgcgatagcagctagattaccgggacgaacagataatgaaataaaaaatgtatggcacactcacttgaaaaaaaggcttaaaaattatcagcctcctcaaagctccaaaagacactcaaaaaacaaggattccaaagctccttgtacttctcaaattgccttgaaaagttcaaacaattttagcaacatcaaagaagacgggcccgggcttgggtccggcccgaactcgccacaattgtcatctagcgagatgtcgactgtcacggccgattcactagccgtgacaatggacatctcgaacagtaacgaccaaatagactcatctgaaaattttattccagagatcgatgagagtttctggacggacggtttgtccacgagtggtggtggtgaagaattacaagttcaatttccatttcatgacatgaaacaagaaaatgtagagaaggatgttggagcaaaattagaggatgatatggacttttggtacagtgttttcataaagtctggggacttattagagttaccagaattttgaggggttaatttggttgttttcaaaacttgaagtagtggaatgccaactaatttagtggtg

SEQ ID NO: 7256 - DNA, 1032 bp, Lycopersicon esculentum; identical to SEQ ID NO: 2419
  Predicted polypeptide sequence is orthologous to G241

SEQ ID NO: 7257 - DNA, 748 bp, Lycopersicon esculentum
  Predicted polypeptide sequence is orthologous to G2457
attaaccatttcttcttcctttttttctcttcaaataaacaaaaaagataaaatacatcaaaaaatggcaagttgcattgatgttgcttctgatcaactttgctatatcccttgcaacttttgcaatattgttcttgcggtgagtgttccatgcagtagcctatttgatattgtgactgttcgttgtggacattgcacaaatttatggtccgttaatatggcagctgcatttcagtcctcttcttctgcttcgtggcaaaatcatcacgttcaggttccaaactacactgctcctgagtataggatggattttggttcatcaaccaaatgcaacatgaacaggatgtcaatgagaactccaatcacaaacaacgttcacgaggagaggattgttaatcgacctcccgagaagaggcagagagtaccttctgcatataatcagttcataaaagaagaaattcagaggattaaagctaataatccagatatcagtcacagggaagcatttagtactgctgccaaaaattgggcacacttccctcatattcactttggactcatgttggagagcaacaatcaagccaaacttgcttgtgggagcagaaaactataagttactttgcaagacaaataaaagatcttcatttcatgaagctgtgtgtgaacttgaagacaagtgtgacattcaagatgttctatggagtgtggacattctaaactatatattataattatgtctctttttttt

SEQ ID NO: 7258 - DNA, 613 bp, Lycopersicon esculentum
  Predicted polypeptide sequence is orthologous to G2457
cccctacccaataaatatattttgttctttaaaacccccaaaaaaacattttttttcttttctccatctgaaaaaaaaaaaactccatggattatgttcaatcttctgagcatctttgctacgtccgttgcaatttttgtaacactgttttagcggttggaattccatacaagaggctaatggatactgtgacagtgaaatgtggccattgtagcaatctttcatttttaactactagacctccaattcaaggtcaatgctttgatcatcaacccaatattcagggctattgtagtgaattaaaaaataaggggcaagcttcatcatctacctcatcaacttctagtgaacctttatctccaaaggcaccttttgttgtaaaacctcctgagaagaaacacaggcttccatctgcctacaatcgattcatgaaggaagagatacaacgtatcaaatctgaaaatccagagataccacatagagaagctttcagtgcagctgctaaaaattgggctaggtaccttcctaatccaccaaattctggaaataccaacaatgtttagatgttgaattgaagcaaatattgggactatattataagtatgtaataatg

SEQ ID NO: 7259 - DNA, 580 bp, Lycopersicon esculentum
  Predicted polypeptide sequence is orthologous to G255, G664
cttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaa

SEQ ID NO: 7260 - DNA, 704 bp, Lycopersicon esculentum
  Predicted polypeptide sequence is orthologous to G255, G664
caattatatacgtgctcatggggaaggttgctggcgttctcttcctaaagctgcaggattgtcaagatgtggaaagagttgcagattgagatggataaattatttaaggcctgatctcaaaagagggaattttacagaagaagaagatgaattgataatcaaacttcatagtttgcttggaaacaaatggtcagttatagccggaagattacctggaagaacggataacgaaatcaagaactattggaatacacatattaaacgaaaactcattagtcgtggcattgatcctcaaactcaccgtccactcaacaacaacgccactaactcccacaccaccaccaatatcaccaccgcagtcacaaccaaaaacatcaacttggatttcacaaacgttgaccaaaaacaacccaatattatgattgccacgtcatcgtcatatgatgaaacaaaatgcaacagtggtacaactgaggaaacaaagccactagaaattattattccaaaaataccctcacaagttatgattaatcttgaactttcaattgggttgccgttacatactgatcatatttcttcaccagagtcaacggcctcatacaacttcttgaccaccgtagcaccgccgccaactgcggcggtaccggcggcggagatgatggcgaagactgtttgtttgtgttggcaaatggatatcatggtgg

SEQ ID NO: 7261 - DNA, 1152 bp, Lycopersicon esculentum; identical to SEQ ID NO: 1955
  Predicted polypeptide sequence is orthologous to G255, G664

SEQ ID NO: 7262 - DNA, 752 bp, Lycopersicon esculentum
  Predicted polypeptide sequence is orthologous to G2550
aggagaaggaaatggaagcaaatcacatataccgtcatccactgtggtttctcccaactcaggtagtgttggaggcaccaccacggactttgcttcccaattagggtttcaaagaccggggttggtgtcaccaacacaagcgcaccatcaaggtctttctctaagcctttctccacaacaacaaatgaatttcgggtctagtcttccactagaccatcgcgaaatttcaacaaccaatcatcaggttggaatactatcatcatcaccaggagtaaataccagtaatatcgatcatactcgaggatcaggggcattatcgtctttttcgatttctaatgggatgatattgggttctaagtacctaaaagttgcacaagatcttcttgatgaagttgttagtgttggaaaaaacatcaaattatcagaggttggtggtgcaaaggagaaacacaaattggagaatgaattaatatctttggctagtgatgatattgaaagtaacacccaaaaaaatagtggtgttgaacttacaacagctcaaagacaagaacttcaaatgaagaaagcaaagcttgttagcatgcttgatgaggtggatcaaaggtatagacaataccatcaccaaatgcaaatgattgcaacatcatttgagcaaacaacgggaattggatcatcaaaatcatacacacaacttgctttgcacacaatttcaaagcaatttagatgtttaaaagatgcaatttctgggcaaa

SEQ ID NO: 7263 - DNA, 1088 bp, Lycopersicon esculentum
  Predicted polypeptide sequence is orthologous to G2552
ggggaaaaataaaaaaaaaatggagagtggtaatgcatcaatggaaaataataatgttaatgatattgggcttattaatttcttggatgaggataattttgaacaattcattgagcttattaggggtgaaactgctgatcctattgtaaatttttgcccaaactatgattgtgaacatatgacaggttgtttttccgcagccaatgcccaatttgagccaatattatcgtcgatggatttctatgatacaacattgccagatcctatttcgctatataactgcgaaatcaagctggataataatgatgatgaagacgatgatgaatcttctggcacaacggctaccaccaaaatgactccaacaagcaaaggcacgaggactgaccggtccagaactttgatttcggagcgcaaaaggagaggaagaatgaaggaaaagctttacgctttgcgatccttagttcctaatatcacaaagatggataaagcctccatcattggagatgcaatattatacgtacaaggactacaaaccaaagcaaagaaacttaaagttgaaatagcagagtttgagtcatcaagtggaatatttcaaaatgcaaagaaaatgaatttcacaacctattatccagcaatcaagaggataacaaagatggacattaatcaagtagaagaaaaaggattttacgtgagattaatttgcaacaaagggcgacacattgcagcttctcttttcaaagctcttgagtctctcaatggattcaatgttcaaacttccaacttggctacttctaccaatgattacattttcaccttcactctttatgtgagagaatgtcatgaggtggacataaactttggcaatttgaagctatggatagctagtgcttttcttaatcaagggtttgacttcgagacatctccgttggtctaatatcatgttattattgtaactttctaaaatactgaactatatttaatttgtattatcatttagtacattatccaaactaaacgggacttttacttaatgaagagaaaacttgttttgattttaaaaaaaaaaaaaaaaaaaaaaaaaaaaaaaa

SEQ ID NO: 7264 - DNA, 753 bp, Lycopersicon esculentum
  Predicted polypeptide sequence is orthologous to G2574
aagccttgatttaggattggattgcaagttcgaaacaacgccaactgaatgttcaccagtgaattatagtccggagaatagcttagatgatattcaagctaataaggatgaaaatgaagagacgtcgaataaaaatctcaagacgatgagaaataatggagatggagatgatgtttcgcaacaaaaccctactaaaagagctagggtttctgttagagtcagatgtgatgcccctacgatgaatgatggatgccaatggagaaaatatggtcaaaaaatagcaaaaggaaatccatgccctagagcttactatcgttgcaccgtagcaccaaattgcccagttagaaagcaggttcaaagatgtgccgaagacatgtcaatattgatcaccacatatgaaggaacacacaaccatacccttcctctttcagccaccgcaatggcttctaccacctcagcggccgctagcatgctgttatccggttcatctaattcatcagacccaaacccacaagtaactgccaccaccaccactacccctactaccactacttctgccaatatcaacggactcaacttctatctctctgatacctcaaaacatcataaatcgccatattactttcctaattcatccatctcagcatccgcacctaattccctcccctacattacactcgatttgacttccacctcgtcctcgtccccgtcctcctatctcatctaacagaatgactcagaattttcctccta

SEQ ID NO: 7265 - DNA, 770 bp, Lycopersicon esculentum
  Predicted polypeptide sequence is orthologous to G2574
aaggattatcggaatcttcaaatgcaattccatgaagttgcacaaagagatgctgaaaaaactaatactgatgttaaacatgacgaagctgaacttgtttcccttagcctaggaaggacttcaagtgacacaaaaaaggagttatccaaattaattttgagcaaaaaagagaatgatgagaaggaagaagataacctaaccctagcattagattgcaagtttcaatcatcgaccaaatcttcaccatcaaatctcagtccagagaatagtttaggagaagtgaaggacgacgaaaaaggaactgatcaaacatggccacctcacaaagttctcaagacgatgaggaatgaagaagatgatgtgacacaacaaaaccctactaaaagagcaaaggtttccgtcagagttagatgtgacaccccaacgatgaacgatggatgtcaatggagaaaatatggacaaaaaattgcaaaagggaacccatgtcctagagcttactaccgttgcacggtagcaccaaattgccccgtaagaaaacaggtacaaagatgcattcaagacatgtctatattgatcacaacatacgaaggaacacataaccatccacttcctcattcagccacatcaatggctttcaccacttcagcagccgcttccatgctattatccggttcatccagctccggatccggacccacaagtagtacagcctctgccacaacctctgcgctcaactattgcttctctgataactcaaaacaaacccattt

SEQ ID NO: 7266 - DNA, 815 bp, Lycopersicon esculentum
  Predicted polypeptide sequence is orthologous to G2604
atcggccgaattgaccccaacccccacgctccctctctctttacatctgcatatgtaaaggtctgtgtctgcctcactcctaatgcttgactaagctcctcttatgtttcaaatgctcagaggatgaaccagtaacaatcatgagacagtaaagatggaagcagctgctctgttagaagtttttgaagcactaggcttttgagatctcaggagaggactacctctgttagcttcacaatgccagttccgcttgctccatatcctacaccaccaacaccatttacaccaccttctaacggtacgcagagccagcttgtgtgctctggatgcagaaatcttttactctatccagttggagcaacatctgtttgctgtgcagtttgcaatgcagtaacagcagtaccacctccgggcactgagatggctcagttggtttgcggaggctgccacacattacttatgtacattcgtggagcaacaagcgtgcaatgttcgtgctgtcacacagtcaatttagctatggaagcaaatcaggtagcacatgtgaattgtggcaactgccacatgctgctgatgtaccaatacggggcacgatcagtgaaatgtgcagtttgcaattttgtgacatcggtaggggttgcaacgagcacagctgagcaaaagtttaacagctaactttaaagctgctgagccagtgctagaaacttctacaactaaagttgtcgtgttatgtgtcagcggcatttcagctgcatcaactggaggaaatttctagttgctactagtatagagctattacagagctttttttccct

SEQ ID NO: 7267 - DNA, 2019 bp, Lycopersicon esculentum
  Predicted polypeptide sequence is orthologous to G261
gatccaaaaaccattgagaagaagtctttgagaaaagggtcaaagtaaacttcatctttctatgtgcttcttcttgttaaggactattcttgattttttcttacaggaaagttcggaaatttctgagttttagagggtgaaacggctatcttttgaattcaagctagcatttgtttgagcacttgtgggaactcatgatgggccgcaatctcttttaacaattctttagcaaatttgtgtgttttgaaagctatccagagctgggacttgaatggaaatgtgtatttgctaagaatttgtatgatcaggtgggagctgcttcaattgaatttatcgaaggaaatcaaggtgataacacttttggttggttgtatctgtatgttgggaatctgataagttgatcttccctgtcagtaaggatttgtcacttgtagttgagcttcgccttgtgagtttcatttcaaggggttgtgatttggatttgaatttaccatggatgaagctccttgcagcgtcaatgcactgcctccgtttattgcaaagatatatgaaatggtggatgatccttccactgatccaatagtctcatggagtttaaacaataaaagttttattgttcgtaatcctcctgattttgcaagagatttgttgcccagatactttaagcacaataatttttccagctttatccgacagctgaatacttacggattcaagaaaatagatcccgaacaatgggaattcgcaaatgaggattttcttagaggtcagccacaccttttgaagaatatctatagacggaaacctgttcacagtcattctgtacagaatattcatagcctctcatcatctgcattgaccgaatcggaaagacaagggtataaggaagatattgaaaagttgaagcatgagaacgaatcacttcatttagttctacacaggcataaacaggatcatcaaggacttgaaatgcaaatgcaggtccttaaccaacgtgtccaacaagtgaaagaccggcaaaagaacgtgctgtctactttagctcgaaccataaataaaccaggattagctttgagtctcatgccacaactggaaatgaatgaaaggaagagaaggttgccaggaaacagttttctttacaatgaaataggcctggaagataatcaagcgagttcttctgaaaatacgactagggaaaatatggaccatacttctctttcgactctcaacaaggaagtgctagatcagttggaatcttctttgaccttttgggagtatacactgcgtgacattgatcaaactagaatgagacggagctcttcaatagacttggatgaatctatcagttgtgccgatagccctgctatatcttacccacaactaactgttgatgttggatctaaggtttctgatattgacatgaactctgagcctaatggaaacactactcctgatgttactccgccagaaaaccgagtagagactgctagtcacaatgtgccaacaggagtaaatgatgtattctgggaacaattccttactgagaaccctggttctactgatgtaaagccggagagagaagatatggagagcaaaataagtgaatccaaaacagttgaggatgggaaattttggtggaacaggaagactgtaattagccttacagaacagttgggacatcttactccagcagagtgaatgtaatgtggcagggtatgtactatttttgatagtaaatgtttatttgcctgtttcttgttgtaaatttagagaaagtgatttgtctgagtacatagaattttggtatattaaccttctttttttttgtttttgcatgacatgatgtagtgaatgatagagtcgatcagtcttaatgctagtctggcacaatttcatgtattatgtagttatattctttccagccttgcctgtccatgttgccgatttgtgttacataagatgagagtaatttttctagcactatgttaatgcaatccttttgctaaaaaaaaaaaaaaa

SEQ ID NO: 7268 - DNA, 501 bp, Lycopersicon esculentum
  Predicted polypeptide sequence is orthologous to G261
agaggttgaagagagaaaacagtcttcttcagtcgtctgcggagaatcaattgaaattcaatggggagtacgaaagtggaattaagtctatggagcaacgtttacagaacgttgctcatagacaggggaaattgatttctcttttagctcaattactacaaacacctggattttcatctgatttcactcaaagcgcgagcaggaagagacgattgttgatatcaaattacttgattgacgaggaaaactcaccaaaattcgacttggaaatggttaaaaagttggattcatcaatcaatttttgggagcggtttctgtatggtgttcaaacacaagatttcgagcatacacattccccaattgttacacatacatcatctaatgattctgccaaacgaaactctcccatcgatcattcaccatcctcctccgagttagggccattgaatcctgtcatgtcatcaacttatgaaaatttaaaacgtcaacttaagccatctg

SEQ ID NO: 7269 - DNA, 1413 bp, Lycopersicon esculentum
  Predicted polypeptide sequence is orthologous to G2632
gaatcactaatcactcatcacttctctcttctctcttctctctcatacctcctacgtgcaggacactcatattgtggaactctgagagtaaaactacagcagtatgccatcaaattccaaaagcacaaatcgggaggaaaccaatgcatataatgttccacgttccactgtatatcctgaaccttggtggaatggtgctgtttatactcctgtttcccctgggttgatgcgggaaaatgcatcagattcatcatcattggaacaatccgtggatggccaatctcagtctgatggtggaatcaatgaggaagatgatgatgctcctgaaaaatcacaaagtgtcgtacctttgcatgcagatgggagttatgggaaggcggatcagaattttcagccagctgctccagccatacctccaagacttgatggaagcctagcacagccccagcagcttgaacttgttggacactctattgcgtgtgctccaaacccatatgttgatccatactatggcgggatgatgacagcttttggccagcctttggttcctcctcatgtacttgatatgcactatgcaaggatgcccttgccacaagaaatggctcaagaaccagtttatgttaatgctaagcagtatcgaaggatcctgcagcgaagacagtcacgtgctaaagcagaacttgaaaagaagcaaataaagggtagaaagccatatcttcacgagtctcgacatcagcatgcactgaggagggtaagggcctcgggtggacgttttgccaaaaagacagatgcttctaagggtactggttctgtgagttcatcgggttctgaacctttgcagttcaatgctgctgatactcaaaagaggaatgaaaatggaaggttggccgagcttcagcagtcttattcaaatggtagcagttatggcaatcaaagtagctttcaagaatcaaaggatgagtaccagtctgctgaaagcagggaaggaggtttttctgtcaagtaattggagatacgttcatgtctaaactagctcttgcactgcaacgaggctagagtatgaacaagaggagtttacaggtattgtttcatttcttggcttttcaagctaggcggcaattcattcttggctttttactttagtgttaatgggagcaacagaggtgacgagcgtatcagtgttgcagcatttgcttggagattacatcttcccttatgtacagagatggatgaacttagaactaggattagaaagtttttcaagtttatgtttggccagttactgtagttttagtttaggagaccatgtaaaaaggttgttagttttgcatacgtatcttttttctttccctaattgttgcattaatttctgagtttggtttgttttgatgcaaaaaaaaaaaaaaaaaaaaa

SEQ ID NO: 7270 - DNA, 763 bp, Lycopersicon esculentum
  Predicted polypeptide sequence is orthologous to G2632
cttgaaaggggtttttctttaactgctgtcatccccagaaaaagaaagctggagactgggctgcgaattacctcactatcaactacccaaatgcaaccatggtggcacggttatggtgataatactatgcctttggctagtgagaatgccgttgcccaggagaaatctgaaggtggcaaccaggataaagaaacaaaggctctagccatggaatctggatcagatggaaataacgagcaatacaagcagcacctcaagcattttgcacccacaactgctgccatcatggctgagcagcagaaggaactcacaggtcattcagctatgttggcgtcatatccatatccagatatgcagtatgggggaatgatgacttatggcgcacctgtacatccccacttatttgaaattcatcatgcccgaatgcctttgcctctcgacatggaagaggaacctgtctacgtgaatgcaaaacagtaccatggaatattaaggcgaagacagataagagctaaagcagagcttgagaggaaagctattaaagcgagaaagccatatctgcatgaatctcggcatcagcatgctatgagaagggcaaggggaactggaggccgctttctgaatactaaaaagctcaatgacatggactgtacacaacggagactcaaaaatatggggcaaccattgcaactcactctggcaactcttctgggttccgggaagtctgatcaggggggaaaggaaggatctacagttcaagaca

SEQ ID NO: 7271 - DNA, 765 bp, Lycopersicon esculentum
  Predicted polypeptide sequence is orthologous to G264
gaagccttttgcctttaaaagttcattcgtcgtccgtcgccggcgtatttctctcagttcaataaaatggatgtgatttcagcggcggtggcggccggcggcggtggaggtccggcgccgttcttgtcgaagacatatgagatggtggatgattcgcaaactgatgacatcgtatcatggactccgactggtcacagcttcgtcgtttggaatcctccagaattcgctcgaattcttcttcctacttatttcaaacacaacaatttctccagtttcattcgacagctcaatacttacggcttccggaagattgatccagaaagatgggaatttgccaatgaggaattcttgaaggaccagaagcatctacttaagaacatccatcgtagaaaacccattcacagtcatagtcaccctccaggttccacagttgatccagaaagagctgcatttgaggaagagattgataaacttacacgtgagaagtctggactcgaggctaatgtctcaaggttcagacagcaacaatctgctgcaaaactccagctagaagaactgactgggcgggttggcagtatagagcaaagacaagagagtttactgatatttgttgagaaggcaattcaaaatcctgactttgttgagcgtcttgctcagaaactcgagtccatggatatttctgcatttagtaagaagagacgattgcctcaaatcgatagcactcaaccagtccaagaaagtatgtcgggtggacaaccataacag

SEQ ID NO: 7272 - DNA, 638 bp, Lycopersicon esculentum
  Predicted polypeptide sequence is orthologous to G2655
tttcccttttagtcaatttcaaaagaaaacttctgaggctatactcttagacttcatcgatcgataatggctctagaagctataacgcaacaacaacaatatctttatgctttactcggaactacaaattggagtattgattctggctctgattattacaacaataatgaatttgttccgaatcatcaaaatgtaacagcacctcaagagtacgaggactactcaaattggaatttgccagctccattattagtagattcccaaaatgaatttcatcaatggggtcaaaattgttcctctgttttagatcataattttacaattgtggatcaacaggaacagttggagtctccaatcgaaatgtctagtagtacaactagaccacgaagaagaagaacaagaacaaagaagaatgacgaagagattgagaatcaacgaattacacacattgctgttgaacgaaatcgtcgaaaacagatgaatgactacctctctgttctccgtactctcatgcctgaatcttatgtccaaaggggtgatcaagcatcaattgttagtggtgcaattaactatgtgaaagagctagagcaacaacttcaattccttagtggtaagaagcatttgacaagtcaaaatca

SEQ ID NO: 7273 - DNA, 482 bp, Lycopersicon esculentum
  Predicted polypeptide sequence is orthologous to G268
agctgatcagtacttggatcagattcaaaagatgctccctgaaattgcatttggccatcatgtccgagttgctttagatattggctgtggtgttgcgagctttggtgcttatttactatccaggaatgtgctcaccctgtctgtggctccaaaagacgttcatgaaaaccagattcagtttgctcttgaacgtggcgtgcctgcaatggttgctgcaattgcgacacatcgtttacgtcatccaagtcaggcttttgaactaatccattgttcaagatgtaggatcaattggactcgtgatgatgggattttactactggaggttaacaggttgctccgtgctggtggatattttgtttgggctgcacaacctgtttataagcatgaagcagccctggaagaacaatgggaagagatggttaatcttactactcgtctttgctggaatcttgtgaagaaggaaggttacatagctatatggc

SEQ ID NO: 7274 - DNA, 722 bp, Lycopersicon esculentum
  Predicted polypeptide sequence is orthologous to G2699
catgcacgtacataaaacaaaaccttacatatttttttaattccttatatataatacttagtcatacatcactccatcatgaaaaaggaaatcctatttcagtaagacttgatctgatcaatcgtatagtttagattcaagttggtcgttgcttccattttattgtgtttatcattatacatagtagagtcaagtttcaatgaactctacaaccattcccctccaaaaccctagttttttcaacaactctcaaagttctctagcaggagcactacaaggatgcattgggagccttgatggagcatgtttggagaaactattacttcattgtgcaagtgccttagagaacaatgatgtaactttggctcaacaagtcatgtgggtgctcaacaatttggcttcttctaatggagatccaaatcaaagactcacatcatggttccttagggcattaatttcaagggcttctagggtttatcctaatgccacaaatttacatggaagtagtaaccttgaaaggagattaatgagtgtgactgagctagcagggtatgtggatctcatcccatggcatagatttggattttgtgcatcaaatagtgttatttataaggccattgaaaggcaaacaaaagttcacatattagattttagtatcactcattgtatgcaatggccaactctcattgatgcaattgctaagaggcctgagggtcctcctt

SEQ ID NO: 7275 - DNA, 2199 bp, Lycopersicon esculentum
  Predicted polypeptide sequence is orthologous to G274
gatttaaggaattgttggaatattttcatgccattgggctgcaatggcgggcaaaaactcaggggataataggactaggacttctgtatcaatatttataatagctggtctatgctgcttcttctatttacttggagcatggcaaagaagtggttttgggaaaggagatagtatagcagtggctgtcaccaagactgctggtgagaattgcgatgtactaccaaatctcaattttgaaactcgtcatgctggcgaagcaggtggtactgatgagtcggaagaagtcgaggaacttaagccatgtgatcctcagtacactgattatacaccatgtcaagatcaaaagcgtgctatgactttcccaagggaaaatatgaactaccgagaaaggcattgtccacctcaagaagagaagttacattgccttattccagcacctaagggatatgttaccccatttccgtggccaaaaagtcgggattatgttccctatgccaatgctccatataagagcttgactgttgagaaagctattcagaattgggttcaatatgagggtaatgtgtttaggttcccaggaggagggacacaattccctcaaggagcagataagtatattgatcagcttgcttcagtcgtcccaatcgagaatgggacagttcggactgctttggacactggttgtggggttgcaagttggggtgcttatctttggaaaaggaatgtcatagcaatgtcatttgccccaagagactcacatgaagctcaggttcagtttgctctggaaaggggtgtgcctgctgttattggtgtactaggaacaatcaaaatgccatatccatctaaagcctttgatatggcccattgttctcgttgtctaatcccatggggagctgctgatggaatcctcatgatggaagttgaccgagttcttagacctggaggctactgggtgctttctggacctcctatcaactggaaggtcaattttaaggcctggcaacgccccaaggaggatcttgaggaagaacaaaggaagattgaagaggctgctaaacttctttgctgggagaagatatctgagaagggagagactgctatttggcagaaaagaaaggatagtgcctcatgccgttctgcacaagaaaattctgcagccaaagtttgtaaaccttctgatccagatagtgtctggtacaactaaatggaaatgtgcataacaccaaacaatggtaatggtggagacgagagtctaaagccattccctgagagactttatgctgttcctccaagaattgccaatggattagtttctggagtgtctgttgagaaatatcaagaagacagcaagaaatggaagaaacacgtaagtgcttataagaagatcaacaaactcctggacactggaaggtaccgcaacattatggacatgaatgctggactaggaggttttgcagcagcacttcacgatcccaagttttgggttatgaatgttatgccaacaatagctgagaagaatactttgggagttgtattcgaacggggactgattggtatctatcatgactggtgtgaagcattttctacatacccaaggacatatgatctcattcatgctaatggccttttcagtttatataaggacaagtgtgactttcaagacattctcttagagatggaccgtattttgcgtccagaaggagctgtcattctaagagacaatgtagatgtactgatcaaggtgaagaagataataggaggcatgaggtggaacttcaaattgatggatcatgaggacggtccccttgttcccgaaaaaatactggttgctgtcgaacaatattggactctgggtgataccaactccacatcctcacaatgagatgccaccgaagatgttgtctgaccatatgaactcgtatggatcaggaagaccaacatcttatgaatacaaaatccatggttatgcaagacgtttcacccctaggaattttgatcgagcagggtcccttgacaggtgactccacggcacatctttagtctcgatggatccataaattataccagatgatttagcgtttataactgtcttcattttcttctctgttccatgtctcgttagataatgactctaaaaactgagctacatgggattattatgaagctttttgaaagtcctttgtaaaaaaaaaaaaaaaa

SEQ ID NO: 7276 - DNA, 2259 bp, Lycopersicon esculentum
  Predicted polypeptide sequence is orthologous to G274
ggtctagtgaggactgaggaaccttcacttcagatttctcacttgggagcttctggtgttgccgcaagcacataatggcgtccaagtatcatggaccaatcaacagaacacggcgaccgatctctatattaattgtaattggtctttgttgtttctgttatctaataggaatttggcagaaaagtggatccggaaagggagataaattagcactacaagtgactgagcaaactgctgactgcaatgtttttccacaaaccactctggattttgagtcacaccataattatgtggaaacggttgaaacttcagaactaacagttaaaagattcaaatcatgtgaagctaaatacactgactatactccctgccatgaacaagaccgagctatgaaattcccaagggaagatatgatatatagagaaaggcattgccctccagatgatgaaaagcttcgttgtctgattctagcacccaaaggatacacaactccatttccatggcccaaaagccgtgattatgcctactatgctaatgttccttacaaacacttgacagttgagaaggcagtccagaactgggtgcagtttcagggaaacgttttcaaatttccgggaggaggtacaatgttccctagaggagcagatgcatatattgatgaacttgcttccgtggttccaattggaagtggcatgatacgaactgctcttgacactggttgtggggttgctagctggggtgcttacttgctgaagaggaatattctggcgatgtcatttgcacctaaggacaatcatgaagcacaagtgcaatttgctttggagcgaggtgtacctgctgttattggagttcttggttccataagccttccattcccatcaagatcatttgacatgtctcattgttctcggtgtctgattccctgggcatcaaaagagggtatgtacatgatggaagttgatcgagttctgagacctggtggatactggatactgtctggtcctccactcaattggaagacctatcacagagtctggaacaggaccaaggagaattgtagagccgagcaaagaaggatcgaagagcatgctgagcttctttgctgggagaagaagtacgaaaaaggtgatgtggctatatggaggaaaaacataaatggaaagtcatgcagaagagcatccgccaacatatgtcaaacaaaggatgctgataatgtctggtataagaaaatggatgcatgcataaccccctaccccgacgtgaagaattctgatgaagtagctggaggagaattgaagaagtttcctgctaggctttttgcagttcccccacgtatagctaatgacttggtttctggggtaacagttgaatcttatgaagaggataataagctttggaagaaacacgtcacttcttacaagaggagcattagcctacttggcaccactagataccacaacataatggacatgaatgccggacttggaggatttgcagcagcactagactctcctaaactgtgggtgatgaacgttgtgccaactattgctgaaaacactcttggtgtcgtatacgagaggggcttaattggcatataccatgactggtgtgaaggcttctctacatacccgagaacgtatgaccttcttcatgctaatcgcttgttcactctgtaccaggacaagtgtgaatttgaagatattctcctagaaatggaccgtgttctgcgtcctgaaggcgcggtcattcttcgagatggagttgaagtcttgaacaaggttaggaaaatcgccgcgggcttgagatgggacactaaattattagatcatgaagatggacccttggtacctgagaaaatctttgttgctgtcaaacaatatttcgttgaaggcgatgaagaccaaagcacgccaaatgacgattgagtgatgccaatattcgattacatcgagagaaacctgagaattctgaattgggaaggtaagatctccaggcagagatatgaaggttttttttcttctcaaatatggcatacaacaagtagtgcaagttcccatgtagagcaattttagttatttttcctttaatgtgtgatttttggagatcttttttctccaaataatgaagcaaagcaagagttcattagagtgatatgtatgtttgggagcaaatttaatagttgtttccactaattacagagttgaattttgaacaattgtaatccctatttttttttttagcaaaaaaaaaaaaaaaaaa

SEQ ID NO: 7277 - DNA, 2467 bp, Lycopersicon esculentum
  Predicted polypeptide sequence is orthologous to G274
gaccacagaaacaaaaacaaaacgaaaaaaactgagaattgtaaagagagacacagagagttgtaaatttgatgtatatgcttgtagatatccttgaaaaaaattaaaaaaattaggggttttgcagtgtttctgttcttgatttaatttgaaaggcatatctgagttgtggacttacaaagcaaaaataaagcaggaaagccagtaaaaggaagtattgattttttttttcatgccactggacagcaatggcaaacaaaagcatgggggacaataggaccaggacttctgtgtcaatatttattgtagctggtctctgtttcttcttctatttgcttggatcatggcagagaagtggcgtcgggaagggagatagtatagctttggcagtcaccaggagtggtgagaactgcaatatcctaccaaatctcaattttgagactcgtcatggtggccaagcaggtagtattgatgattcaggaacggaagtcaaaaaatttaagccatgccgtcctcgttacactgatcatacaccatgtcaagatcaaaagcgtgctatgcacctcccaagggaaaatatgatctatcgagaaaggcattgtccgcctccagaaaagaagttgaattgccttattccagcacctaaggggtatgtcgccccatttccatggccaaagagtcgggattacgttccatatgtgaatgccccctataagagcttgacagtcgagaaggccattcagaactggattcagtatgaaggtaatgtgtttaggttccctggaggagggacacagtttcctcaaggagcagataaatatattgatcagcttgcttctgtaatcccaattcaaaatggaactgttcggactgctctggacactggttgcggggttgcaagttggggtgcttatctttggaaaaggaatgtcatcgcaatgtcatttgctccacgagactcacatgaagctcaagttcagtttgctcttgaaaggggtgtacctgctgtaattggcgtcctaggaacagtcaaaatgccatatccatctagggcctttgatatggctcattgttctcgctgtctaatcccatggggagctgctgatggaatcctcatgatggaagttgatagagttcttcgacctggtggctactgggtgctttctggccctccgatcaattggaagactaattacaaggcctggcaacgccccatggaggaccttcaggaagaacaaaggaaaattgaagagattgccaaacttctttgctgggagaagaaatctgagaagggtgagactgctatttggcagaaaaggatggatgccgactcatgccgttctacgcaagaagagtctgaagctacactttgtaaatcgacagatccagatgatgtctggtacaacaaaatggaagcatgcataacaccaagcaaaggcaatggtgatgatgaaggtctaaaaccattccctgagagactttttgctgttcctccaagaattgctaatggactagtttctggagtccccgttgaggcatatctggaagacaacaggaaatggaagaagcatgttagtgcttataagaaaattaacaaactcatagacacaggaaggtaccgtaatatcatggacatgaattctggacttggaggttttgctgcagctcttcaatctcccaagttgtgggttatgaatgttatgcctacgatagccaagaaaaataccttgggagtcatttatgaacgtgggcttatcggaatttatcatgactggtgtgaagcgttctctacatacccaaggacttatgatctcattcatgctcatggtcttttcagtttatacaaggacaagtgcaactttgaagacattctcttagagatggaccgtattttgcggccagaaggcgctgttattctgagagatgatatagatgttctaattaaggtaaagaagataataggaggtataagatgggactccaaattgatagatcatgaagacggtccccttgttcccgaaaaaatactggtagcagtaaaacaatactggactgtgggggatgataattccacatccacacgataagatgccagtgaagacagtgatggtttaatggatcccaaggaccaattcttccataatcgaagttcagtgagtagcttattacagaaccttcaacacaagaaatttttggtcgatgagacgaggctatatggtgtctgtgtgtttaaccttttctattgatggatccatacattatattgtatgatattatgctttgtaaaacttgcattcatttatttttctttcttctctttgaagccccacactacatgatggatcttttctgaaacttttgatgtattcttaggagcattttcatctctgatgaaaaaaacagatgttgtaatgtgttcaattcaagtggggagaaaccacttagctttcctgaaaaaaaaaaaaaa

SEQ ID NO: 7278 - DNA, 693 bp, Lycopersicon esculentum
  Predicted polypeptide sequence is orthologous to G2766
gaaaaacatcagttcatcctcccacaagtaataaaaatgcagttttcatcaatttttgtgtgagttacacacgagaaacatgattgagtatgccaacatggattattttgtctattttattttacatacttctgcagaaagaaaagaaacacatacacagaatgtagttgtaaggttgttaaggggaaaaatgtaaaggaagtatatctatcgccgtttacatgttgaaaacacagatgtcaaacggtgaaggtttatgtgttttctgatagtgaccttcaagttcatattagctgagtttccccgtcatcgagcccattgacaatgtcattgctaatctgcttggatcgtttgctaggtgtgacagagaacattatagagttgttatcttcccaagaacccatcgcgaaactacttgcactggcataagaatgtgttgactttctgtggccattggctatactggtcccttcaatatcctcattttcctctgctatttgagaaagagcttcttgcgttgtgaagctgagctgagagttcagccttgttattccccggccactatctccaccgccttttgggttatagcttcctctccccattgaaacagtatcacctgcagcagtagcaagttgattaaggaacctcgccggtgagctactatgtcgaaccaacggcgtcgttgaagtcgtc

SEQ ID NO: 7279 - DNA, 512 bp, Lycopersicon esculentum
  Predicted polypeptide sequence is orthologous to G280
gtttcaatggctactgaatttgtcaacaagattcatcctgaatacccggagatgatttatgaagcccttgatgcattgcaacaaaaagaaggctcaaacaagtcatcaatatcaaagtacattgaatctaagtatggaaacatgaatgatgcacactcaaagttgataacttaccatttggatagaatgaaacaaactggtgaacttattttcctaaaaaacaactacattaaacctggtccagatgcaccccctaagcggggccgcggccgaccacctaaacccaaacctatattgccacaaggaacagatattgcagctccaaagccaagaggtcgcccgaaaaaagaccccaatgcaccacctactcccaagaaaccaaaaccaacaagtgtccctagggacttagctcctgtttcgaaaaccggaaggcctagaggtaggcctaggaagattaggccggagccaccacaaaatgggttagagtgaagctgaaaatccgcagacttggt

SEQ ID NO: 7280 - DNA, 745 bp, Lycopersicon esculentum
  Predicted polypeptide sequence is orthologous to G280
gctgaagaacataatctaactttgcctagttatcctgatatgattatggaagctatagatgcgttgaatgaagaagaagggtcgaataaatcagctatatggaagcaaattgaagcgactcatggtacactaccaccagcgcatggtacactccttgcacatcatttgaatcaaatgaagcaagctgggcaattagttatgttgaagaacaactacatgaagccaaatccaaacgcgccgccgcgccgtggtagaggccgtccgccgaagccgaaaagttcagttccggtaccggatgggtatcctagaccacgtggaaggccaccgaaggagcgggatccgtacgcgccgataacggtacctatgaagaagacgagtgagggtagctctgggggaagtgggaagaagcgtggaaggccaaggaagtatccgatgacggaggatacgccggtggtgaagccaattggtgctccgagaggaagaggaaggccgccgaaggtgaaaactccggtagctgcaactgtaggggcttaattgaagaaagacgaattaaattagggacttgtatggcaaaatatgctaacttgttgtttttcactttttatctgttttgaattttcatgtttagtccctgtagttttgttttaattacaatttgtaggaagaattgtgtgactttgtgagtgatttttatcatgtaattgggccaatgtaaatccaaattgagggctttttatttatatat

SEQ ID NO: 7281 - DNA, 785 bp, Lycopersicon esculentum
  Predicted polypeptide sequence is orthologous to G280
gcatctctagaacacacacacacactctctctctatccatggctactcaaagcttcaaccagttcccttcataccctgagatgatttatgaagctcttgatgaactaaatcaagaagggggtgcaaacaagtcatcaataagcaagtacattgaaacaaagtatggagatctgaatgaagatctttcaaagatgctacctttacatttggacaacatgaagcaaaatggagatctgattttcctcaagaacaattacatcaaacctggtccagatgttccagcaaagaggggtcgtggtaggccaccaaaacccaaagctccattgcctcctggtgctgttgaatctgttgaacctgcatcaccaaggccaagagggcgcccaagaaaagaccctaatgcaccaacctagttccaagaagccaaagccagaatctgttgctggaggtcccaattcaacaaatcttggttctactactggaaggcctaggggtaggcctaggaaagttaggccacagcctgctcatgatgatgatgatgatgatattgaggaatgctgaaaacttttaagacttgttattggactcttgctgatggtgatgactctaatgacttagttgtcttaatatcctctttttttttaagtgttagtagtattatcttatgtaatagtttcagtttgagttgccctagtgtgactagggggtcatggtttcaaagttaagactgcgtagaatagactaattgtcgttatgcgactagggtcatggtttacagtgtgcaatag

SEQ ID NO: 7282 - DNA, 755 bp, Lycopersicon esculentum
  Predicted polypeptide sequence is orthologous to G2826, G2838, G362
gcttcttttacacatggagaaaaccaaagataaagaaactcaagatttcatgaatgttgaatctttttctcaacttcctttcatgagaccaacgaaagaaaaagccgcgattaggctttttggtaaagaattactaggtactactattcgtcatgaagatcaatcaattgagattcatgatagtgttggagatactacagaaatcaacaataacaacagaaaatttgaatgccaatattgttgtaggaacttcccaacatcacaagccctaggaggacatcaaaacgcacataaaagagaacgtcaacatgctaagagagctcaatatgcaaaatatcagtacaacgcttattttaattcagcgttgtacaatactagtagtacaagtagtactactagtggtggtttgtatgtgaataataacggccatagccattattattcacaacaaattaatcgcgatataaatgaaaatcaccgttcattgtcagcgttatggagagtacctcatgttcatcatagtagtattagtagtagtagtaattcttactctcctaataatgtttctaattttgttaggccaatagtttataataatgttaatggagatttgaagaagattaacacaaagagtagctcaatttctttaaccagatttgggtatgaattgaaggaaggagtacatcaagatcatgtaagttttagatctacacttgtaaagagtacaatccaagctatagtatcgactctgtttc

SEQ ID NO: 7283 - DNA, 2257 bp, Lycopersicon esculentum
  Predicted polypeptide sequence is orthologous to G2887
gacttctagctctcctccgccttccccttcgcttcccccaccaccccatcatcgttttttcgccttctccggttcggtcggtatctgggtttttgattgtgcaccagatgtctgttggctccagcaagaagcaccatttctttgtttggagcgcattccttttcatgaaccgcagaaggttgtggtgctcagggaagatactgtttcggcattggacttgacagcagttgagattttttttgttttaggggtcggttggaggctctggtgtgttgtgcagatagctcgtttagtctagatttcgtcaggcgcaccccttttgggctgctttgaatttagttcctttttttttttgggatcatttgatggcaaggcttccgcctgggtttcgttttcaccctactgatgttgagctgattatgtactatctcaaacgtaagatcacaggaaaaaaacttcattttgaaggcataacggaactcaacatctacaagttctccccatgggaccttccagacaaatgttgctataaaagtaaagatctagagtggtacttcttttgcccaagggagagaaagtatgcaagtggagccagaatgaatcgcgctactgatactggatactggaaaactactgggaaagatagacctgttacttactgtgagaagattgttggatcagttaaaacacttgtttttcacctaggtcatcccccgcgagggaaaagaactgattgggtaattcatgaatataagtttgaagataaagaatcaattgatgcaggatttgctcaggattcatatgtgctttgtaaagtattccagaagagtgggccaggtccaaaaaatggtgcacagtacggagcaccttttaaggaggaagattgggaagatgacaagattcctgctgagccttgtacttcagatgtttttccagctccacctggtaggactgataaacccagcggctcaaatgcaatcagaatggttgacccaagaagcacatctgactggacttcaagtgaacagagtccatctcctattcaaccttctgttcaaaaactgcctttggatgagccagatgacgaggagttacctggtgaaccaaatctgtccaatgtatcttctatcaattggaggccttcagatcagctaaaagcgaaaccgtctaatactttttctgctctgcctatactacctgaggagcagagttgttcagtagataccggcctggtcaaccctggtccaggtccatccaatgctcagatgtgtactaatgagatggctcttgatgatatagacgacgagatgattggtctatttgccccattcacggaagatacttcattgctttctggtggcagtgagcctaatcagaagctagataactttcaccaagaagtaaatgctccacctgctgcttgtactgatgggaatgatatatttgacggccttggagacatcgaattctgggcaggagtagggcagctggaacccgatctcactgcaagtggtggagctaatcatagtcttaaccctgtgatcctgccacaagaagcaccacaagacgctgcctatatggagctcaatgatcttgatatccctttaaatcaccctgctgaaaccattggaactggacaactggtgccgggctatttctgtacgccatataactccaacaatggcatgcagcagctttgttttggaagcaattccttgggcatagttcaagatttcggcgaacatcatctcccggcgcttcctgaaagttacactcaacaagtgaatcatcctgacatggcttacaattttctgaataacccaaatcagggttataatgctgcgactaatttcagtgttagctcttacaagcaaccagaggaccgtaggctcgatacccaaaacctggaaagaggtagatctcatttttctgatgacaattctgcttggtggtaaagcattcatgttagatctgattgtctacgcaaatgcgattgtggacagcaaaatgagatataggatataaatattgtgactggtcgtcagaccatgtaatcttatgtagccatgtggcctgtcttggctgttagagggtaggggaaaagattccttttctctgtattttctattttaggtgatttgatcttacaatgtagacgctgtgccgcatctatgatgaggttacataaacctctaatttatggtcagtggggctgcaggtactcgctgcagtctttgatggaaaaaaaaaaaaaaaa

SEQ ID NO: 7284 - DNA, 729 bp, Lycopersicon esculentum
  Predicted polypeptide sequence is orthologous to G2887
tccgccttctccttcgtttgccatcttcggttttgtattgcacaccagatgtctgttagcatcaaccagaagcatcactattttgtttgggctgcgttgaatcgaagaagacattggtgctctgggaagatattgtttaggcattggacttgactcttgtgtgactttcttttgttagaatttgcttcactgagacctactagtgctgtggtcttttcattttatttgtctgtgcggttttttactatttccaatggcgaagcttccaccagggtttcgctttcaccctactgatgttgagctgataatgtactatctaaagcggaagatcatggtgaaaaagatcctttttgaagtcatatcagaactcaacatttataagttctccccatcagatcttccagacaaatgttgctacaaaagtaaagatcttgaatggtatttcttttgcccaagtgagagaaagtatgcaagtggattcaagatgaatcgcactactgatattggattctggaaaattactggcagggatagacgtgttctttatgatgaaaagtttgttggatctgttaagactttggtttttcaccaaggtaaagcaccacgagtgcagagaactgattgggttattcacgagtatagatttgaagtaaagatacggcagatgcaggattttcgctggacgcgtacgggctttgcaaagtatttaagaaaagcgggacaggtccc

SEQ ID NO: 7285 - DNA, 523 bp, Lycopersicon esculentum
  misc_feature (285)..(285): n is a, c, g, or t
  Predicted polypeptide sequence is orthologous to G2898
taattctgaacgcctgaatatccctgaggccgacgagctcgaccccgtctcgtcgtctatcaacttacgtcaccgttcatagcttctggaaccctagtataatcgacatggtcgaggttgaggcttctacacctgatctcaacgacaaagcctcatctcctcaccacacaatgacaatggtgcctactgaaggagaattttcaataggaaagaggaaggatcaaggtattagtgaacctgaagggagtagaaaaaagaagaaaaaacaagtagccactcctcgtnctgcttgctcttgggtgcacttcagccgtgactttattaaagagtatagtgctacacatcctgaatcttcaggcctgaaagttgccacaaaggcagcatcagatgcatggaagctgatgggtcctgaggagaaggcaaagtacactactcgtgctcgtgaagtgtgggataagtacctgagctcagcacctgcccgtgcctctaagccaagaagacagaccaaactagtcactaggtg

SEQ ID NO: 7286 - DNA, 681 bp, Lycopersicon esculentum
  Predicted polypeptide sequence is orthologous to G2979
ccaatttcatctatttccctctctctttcttcaaagcttgagcggtttatctcgaattttccgtagggttcttctctgatcgctttcaactttcgataacagagaaacctagcaatgtcatcgtcactccatactgaagattctcaatggaaaaaccctagcatttatagccgcaaggacaaatcgctcggtcttctttgctccaatttcttgaagctatgtgatcgggaaggggtggactccaccattggtttggacaatgctgcagatcaattaggtgtcgagaggcgtcgcatttatgatattgtcaatattttggaaagtgttggggttttgtcaagaaaagctaagaatcagtatagatggaatgggtataatgcaatttctaaggctgtagatttgcttaagaaagaaggactaaaagatctgtccactgtctcctccacttgccacaatgtttcaaatgtcatagcttgtaacaattcagatgttaaggaaaaaggagaaggcaagactgctggatcacataaaattgaacaaccggaaggagaagtctttgatgattctagcacaaaattttgtaaagcttttccactggtctgatgttgacttgatatctcttgaccaggctgcatcagctttgcttggtgatgtccacgatccgatggctatgaagacaag

SEQ ID NO: 7287 - DNA, 789 bp, Lycopersicon esculentum
  Predicted polypeptide sequence is orthologous to G2982
gaagaacatcagacgacgagtctacgatgctctgaacgtacttatggctatggatatcatttctaaagataaaaaggaaatacagtggaagggattaccacgcactgatgcaaatgatattgaggagctaaagactgagcgtcttaacttgagaaataggattgaaaagaaagcagcttatttagaagaacttgaagatcaatatgtagggcttcaaaacctcataaaacgcaatgatcagttgtatggctcaggcaatgctcctagtggtggtgtggctttaccgtttattttagtgcagactcgtcctcatgctacagtcgaagtggaaatatcagaagatatgcagctggtgcatttcgacttcaacagcactccgtttgagctgcatgacgataattatatcctcaaagcaatgaatttttgcggaagatcaaatgacggttctgtcccacagaatgtatctgctgatggaggtgaaggtccgagttccagtatggccaacatgtttcagcatcatatccctaatccatctgccccaaactcatctggcaggcttccgacctcacctcctctccccggaatactaaaggctcgtgtcaagcatgagcattagtcttctggcttctttcttgatcgattactgtactcattaacgcatagtatttctgtacattatgtaaagtatttttactggaagcagcctcctctggtgactaaatacttctcttgacccttgtctcaatttgagggaggttactagttgagcttttaaatttttttgctaag

SEQ ID NO: 7288 - DNA, 627 bp, Lycopersicon esculentum
  Predicted polypeptide sequence is orthologous to G2983
cttacaatgaagacaagaaagactcctctcaggtggaatcacacccaggaggaacaagatggaatccaacacaagaacagatagggatacttgaaatgttgtatagaggtgggatgcgtacacccaacgcacaacaaatagagcaaatcacagcacaactaggaaaatatgggaaaatagaaggcaaaaatgtgttctactggtttcaaaaccataaagcccgtgaaagacaaaagcaaaagaggaatagtcttggccttagccaaagtccaagaacaccatcagccatagtcactagtcctttgtcatttgacactaggggagaagtagtgagggatgaagatagtccatacaagagaaagtgtaggggatggacatttgaatacatggaggaagaacaacaacaacaagatgaagaagaaattataaattgtagagaaaatggtgataggactcttcaactcttcccattgcatccagaaggcatgagatgatgaatttattataagaatattcttttttcctttttaattatgatctgactagcttccttttttttttttacttattttcgtcatctttaatttttactttcttcatttgcatgctttggttccttttctttta

SEQ ID NO: 7289 - DNA, 653 bp, Lycopersicon esculentum
  Predicted polypeptide sequence is orthologous to G2989, G2990
cacacatgcttttggctctaagcgctgggttttccggggagaaaaatcagaacctccccacatcgactacgccaatggcggtagcaaattctaacgggaggaagcgtttcaggacaaaattcactccagatcagaagattaaaatgctggaattcgccgaaaaagttgaatggaaaatgcagaagagagatgaagatctggtgaacaatttctgcaacgaaattggagttgaaaaaggggttttaaaggtatggatgcacaataacaaaaccacctctatctccggcaagaaattagatcaaccgaacaccgacaacggccacaaccaccagaatggtaactctaactatactgttaatgggttttgtattgttgatagaaataatactactcatcatcacgacaacactgactcggaatttcacattcaccatgaaagcagcatgaacgatgacaacaagaaagaaaattcaagttttggtgctaataatgtcgttgtcactaatgggtcttcttcttcatcttgattttagattagtttgaataatgtttcaattagtagtaattagtgcaaggaagagaaaaactatgaggctgcaactattttactatatatatatatatattagttacctttatttctttgttcctct

SEQ ID NO: 7290 - DNA, 701 bp, Lycopersicon esculentum
  Predicted polypeptide sequence is orthologous to G2998, G2999
cagaggccaagaaaaggatatgggcttgcctaatcccaatcccatgagttataacccatctcaacttaaccagcaagaatcatcttcctctgcagcaaacaagttccttaccgcaccaaatagaacaacaaatgaacatgagaataccatttttagccctaaccaaaccctagatcagcataatattactcaaaattcagatccagatccagttcgacaactatctactagttcagcaagtgagaggaatattacccccgtccggtacaaagaatgtctcaaaaatcatgctgcaaatttgggaggatatgtactagacggttgcggagaattcatgccaagcggagaagaggagacactagaatacctgaaatgtgcagcttgtgattgtcaccgcaattttcataggaaagagactgaggacgaatcacaaacacctggtgtgcatagaaataaccaccgtatacccaaccaaactccgccttctcttccagctgtgcctacgcagcaacaacaccatcataaataccctcacagctatccaagaggtcacatggcaccagtaatgatgagtttcggcgggaacacgggagttgcagctgaatcatcaagtgaagatctgaatatgtttcacggaggacaaggggtaattcagccttgtaatttttcggcatcgaagaagagatttcgaacgaaattca

SEQ ID NO: 7291 - DNA, 1454 bp, Lycopersicon esculentum
  Predicted polypeptide sequence is orthologous to G3055
gagctttatgtttttgtatgcatattactctatttttatcagttttgggaattgaacattttggggtagtcagatctgctgtttaaatggattttacgggtgaagctggttttgctggagggaatgtgatccccgattccacagccggggttggtggttatgacagttggggtcctaatttttctgaccaggcagtttgggctactgaggatgattataaagcctggaacagtggtccctattgtgaaaccccttccaattccagtcaggatggtaggcattcacaaaaccggtcaggcagtgagcctcccaacaagaagtcaaggaatgtgcaggattcagatgctcgcattatagtcaccagtagctctaaagcaatcggaaagatgttctttaaaacgaagttgtgttgtaagttccgtgccggtgtctgcccctatgttactaattgtaactttgctcatggaatagaggagcttcgcaaaccaccacctaattggcaagagatagtagctgcacatgaaaatgagcggggagtaatggtggaactgagagaagaacaccagataccaatattgagctctcctgatttacgtggagagtctcaaaggtccgctaaagggaggcactgcaagaagttctacactgaagagggatgtccttatggagatagttgcactttccttcatgatgaacaatcaaggtctagagagagtgttgcaataagtgtgactcctactgttggtggatttggaaataatgctactggagcaacccaaaaaccttcaaactggaagacaagaatttgtaataagtgggagactactggctattgcccgtttggcagcaagtgtcattttgctcatggtgtggcagaactgaacaagtttggtggaggacctgcggaaacagatggcaaagattatgtctctgttcctccagaattaaagcagggcggggttccatcaagagcaacagaaagtacagtgccctcaaccattccagcactccacacagatgtttatcatctggggcagggtgttcaggtacaaaggccaactggcatagctgatagacctggccagaggttctttcaaaaatggaaaggcccggataagattagtaaaatatatggcgactggattgatgacatcgagtgaaggagttgtcataattagctactgatctgtttagctagacacaaatagccgaggttagctttcagccttgcattcaaaggaattttaccctagtgttttttcgcccctccgaaacttgttgtattagagctacaaactagatagctgctcgggcagtcgatgtttaatcacttttctgtattactcacaacttgtttgtaagaatgatgattggctataatctctatacttgagccttttgtcttgcgtggagatattcaaacataatttgtatttcaaaaaaaaaaaaaaaaa

SEQ ID NO: 7292 - DNA, 612 bp, Lycopersicon esculentum
  misc_feature (453)..(453): n is a, c, g, or t
  Predicted polypeptide sequence is orthologous to G3060
cattcgtctacttctactgctttgcttagggttctgcaggccgtagttatatttttcttttgttttttgttttcagagtttttttttgttcatttgttcgaatttgagtgttttaagtagctatggatttccggaagagaagcaggaatggagctggttcgaacttcaatggaggtttgaagaaatcaaagccagaaatggactccttatcgggtggtataggaagtaaaacgaagccatgcacgaagtttttcagcattgctggctgcccattcggtgagagctgtcatttccttcatcacgtccctggtggctacaatgctgtggcccagatgatgaacttaggatcagctccagcatcaagaaatgtggctgcaccacccatgtccaatggaaatgctcctgctgtgaaaaccaaactttgcaacaaattcaacacagctgagggatgcnaatttggagacgcatgcaattttgctcacggggaatggcaaattggtaagccgattgtgccatcacaggaagatccacgtgccatgggtgttggacctgctcctaagtcttttggtgggcgggacagagcctgctgtttctggacctgcttctagcttt

SEQ ID NO: 7293 - DNA, 1352 bp, Lycopersicon esculentum
  Predicted polypeptide sequence is orthologous to G3074
gaccttcgttttgcactttccccaaatcttctcctctctctctatctcacttcgaacaatgattgtcttcttctgattcttccaatttcagaaagaaatttgttcactagattctctaatttagtattttatatccttagattctctctatttttgaatggacagaatctgatttatcatgaggaagaaacttgatactcgctttcctgcggcccggatcaagaaaattatgcaagccgatgaggatgtcggtaagattgcaatggctgtgcctgttctagtgtcaaaagccttggagttatttttacaagacctttgtgaccggacatatgacataactcttagaagaggagcaaagactgttaattcactgcacttaaaacactgtgtacaaagctacaacgtgtttgactttcttcgggaagtggtcagcaaggttcctgattatggccattctgatgctgctggtgaaatgccaaaaagaaggaaagttgctatagaagaacatcatgacagtgaggatgaatacaaaaagagcaggacggagatgtctcctgttggcagtagtggtaggggaagaggtaggggtagaggaagaggtcgtggtcgggtaagccgtgctgataaggagctctcacgacctgatatgcaacttgaatcctgcacttctgctcagcagagtgttcaacaaaatccaaatcctggaactcagacagagaactgctcagaaccgaaagaatcacctacacaggattccactgtttgtgacaaagaaaactcagttgtaacaactcctaatctgaaggtcaatgtagatgataatactgataaaccagctgcaccggaaatagcaccctgcaatccatcaccaaggcctgtgaacgagaaagcagaggaaggccctcagtggtccctcgaaatggacagaatggtcattgaccctgctcatatgtcacaactgaatacaagtgtagcagaagaggaagaagattatgatgaagaagagtaggcagatgaaataacaaacaaatggcctatttgacatatgctatttattgattacagttgcctgtaggccttgacacaaagggcccttgtgatttattgacatattagtgtccgtctatttcttagttgtctttgtgactttaagtctttgtaatggtctctaacccttcccttttccactagtaataagtaggaagtgtgttcgttgctccaaccagcactccatgtatcaattactgtgtgaaattaggttaagtccattttgaatcttcactttttttattttataacctagaaatcgacgcggtagctgactaagtttcagtggcaaaaaaaaaaaaaaa

SEQ ID NO: 7294 - DNA, 618 bp, Lycopersicon esculentum
  Predicted polypeptide sequence is orthologous to G3074
ctttctgcaagatctttgtgaccgtacatacgagattaccctcaagaaaggagcaaaaacaatgaattctttccatttgaaacattgtatccagagctttaatgtgtttgatttcctgaaggatgtagtgagtcgggttcctgatctaggcgggtcagatgctggtgctgaatcggccaccaaaaggaggaaagttgctgaagaagatgatcatgacagtgatgatgataccaaaaggaatcatgcgaatgagactgcaaacaacagtggtactggaagaggacgaggtatgggtaggggtagaggccgtggaagaggttcacgagcagtagagaaaggtgactaccatgctcacagtgagaaactggaagacgctgctgctgatgtttcacatcaaaaggatgatgagaaccaaaaacaaaatgatgaaagaatggtagactatgtagcagaatcagcagtagattcaaagaacatttcagctgctaaatgctccccagaagtcgtcgcccctgctagaaacttcgatctcaacatagacttaaacgagagtgtggagtccacaccaatgccatctgaagtccctttatcatcaacggggacaccaacaccaacacc

SEQ ID NO: 7295 - DNA, 2145 bp, Lycopersicon esculentum
  Predicted polypeptide sequence is orthologous to G309
ccagcacttgtcattcttacccaatcttgaaccccatctcttaaaagatgaagagagatcgagatcgagatcgagaaagagagaaaagagcattctctaatggtgctgtttcttcagggaaaagtaagatttgggaagaagatgaagaagaaaaaccagatgctggaatggatgagcttttagctgttttgggttataaagtgaagtcgtctgatatggcggatgttgctcaaaaacttgaacagcttgagatggctatgggtacaacgatggaagatggtattactcatctttctactgataccgttcataaaaacccatctgatatggctggttgggtacaaagtatgttatcttcgatttcgacaaactttgatatgtgtaatcaggaaaacgatgtgcttgtatctggttgtggttcttcttcttctataatcgatttctcacaaaatcatcgaacaagtaccatttctgatgatgatttaagagctatacctggtggtgctgttttcaattcggatagtaataaaagacacagatcaacaacttctagtttttcaactacatcctcatctatggtgacagattcatcagcaacgagacctgttgtactagttgattcacaagaaactggggttcgtcttgttcatactttaatggcgtgtgctgaagctgtacaacaagaaaatttaactttagcggatcaacttgttagacatattggtattcttgcggtttcacaatctggtgctatgagaaaagttgctacttactttgctgaagcattagcaagaagaatctacaaaatttatccacaagattcaatggaatcatcatatacagatgttttacaaatgcatttctatgaaacttgcccttatctcaaattcgctcattttactgctaatcaagccattcttgaagcgtttacaggttgtaacaaagttcatgtaattgatttcagcttaaaacagggtatgcaatggcctgcacttatgcaagctttagctttacgccccggtggacctccggcatttagactcaccggaatcggacctccacagccggataacacagatgccttgcaacaagttggatggaagttggctcagttagcggaaactattggggttgaatttgaattcaggggatttgttgctaattcgttagcagatcttgatgcgactatacttgatataaggccaagtgaaactgaagcagtagctataaactctgtttttgagcttcatcgattgttatcccggccgggagcaattgaaaaagtgttgaactctattaaacagattaacccgaagattgttactcttgttgagcaagaagcgaatcataacgcaggggtttttattgatagatttaacgaagctttgcattattactcaaccatgtttgattcgttagaaagctctgggtcttcgtcttcagcttcaccaactgggattcttcctcaacctccggtgaacaatcaagatttggtgatgtcggaggtttatttagggagacagatttgtaacgtggtggcttgtgaaggttcagatcgagttgaacgacatgaaacactgaatcaatggagggttaggatgaactcatctgggttcgatccggttcatctgggttcaaatgcgttcaaacaagcttccatgcttttagctctgttcgccggcggcgatggttacagggtggaagaaaacgatgggtgtcttatgttggggtggcatacacggccacttatagctacctccgcctggaagctattgccggactccggcaccggcgccggagaagtcgagttgtaaactcgggtgggtgggtggaagagacaatgagagagatgtgcctaaaagggtcaaatcaatgttttttactttttaacctttttatttataagtcagcctctttatttactttttaaccactttttacattttgttctagtttattttattttattttatcctatggtttattttgtggttggttagattttttttcctccactcattttgtatgtcaaggtgtatctagagagtgatttggtgtttggggaaaaaaaaaaactttcattttatattttggctgattgggagttgtgaaataaataatttattttctaaaaaaaaaaaaaaa

SEQ ID NO: 7296 - DNA, 845 bp, Lycopersicon esculentum
  Predicted polypeptide sequence is orthologous to G3111
accacaccattgtcctctttcttctatattgttcaatttttattatgactcgtccttctagatttctgcttagcaccaactcatcttcaacgccggcggcggagccaccgtcgacggtgacagtggagtctgatttcgttgtaatactagctgcgttgctctgtgcgctgatttgtgtagtaggactcatcgccgtcgcgagatgtgcgtggctccggcgaggaatcggggccggcgggaacggtggtagtcaaccgtcggcgaataaaggattgaaaaaaaaagtgttgcaatcgttgcctaaattcacctacgatccaagtagtacggcgaacggtgcggcgttcacggcggagtgtgcgatttgtttggcggaatacgccgtcggaaatgagatccgtgtgctgccgcagtgtggacatagttttcatcttcagtgtattgatacttggctgggctcacactcttcatgtccttcttgtcgtcaaattctcgtcgttgctcggtgccggaagtgcggtgagttcccggcagtttcctgtaaatccgacggagctccggttacaactccggccgagtctcgttcatgcggtacatctactagctcaaataatttcttggtctagcgtaacaataaaaaagaggcattagttttttaagttatatactctgacaaatcggtgtaaacgataaatgtaatttacaccgtcagtgcagttttacctgtggtaacatgtcagttactgtgttgatgcaggttagggtaaagttacatgtaattaatcttaaattacatcgttgaaatgcaaaaaaaaaaaaaaaaaaaaaatgcctgtcggccgcct

SEQ ID NO: 7297 - DNA, 675 bp, Lycopersicon esculentum
  Predicted polypeptide sequence is orthologous to G328
gagaacagtaacaattgggcaagggtgtgtgacagttgccattccgcaacatgtaccgtttactgtcgggcggattccgcctatttgtgtgcgggctgtgatgcccgcattcatacagcaagtctcatggcttctcgccacgagcgtgtatgggtttgcgaagcctgcgagcgtgcccctgcagcctttctttgcaaagcggatgctgcctcgctttgtgcctcttgcgacgctgacattcactctgcaaaccccttggcacgtcgtcaccaccgtgtcccaattatgcccattccaggaaccatttatggtcctccagctgttcacaccattaccggtggttctatgatgattggtgggaccacaggggaaggcaccgaggatgatggattcttgagtttgaatcaagatgcagatgatacaaccatagatgaagaagatgaagatgaagcagcttcatggttgttgttgaatcctcctgttaagaataacaataagaataacaactatgggatgttgtttggtggagaagtagtggatgattacttggatcttgcagagtatggaggggacagtcaatttaacgaccagtacagtgttaatcagcagcaacaacattactctgttcctcagaagagctatgttgaagatagtgttgtgccagttcagaaacga

SEQ ID NO: 7298 - DNA, 1205 bp, Lycopersicon esculentum
  Predicted polypeptide sequence is orthologous to G351
ctcaattttactctctctctctgtatatctttgtacttttattctcgatgtcgattgaagctttgaagtcacccatggcggcgaagctgtcacccacggtggcggagctaccaccgcttgaagagattgatgatgattcacataatttggattcgtgggcgaaaggtaaacgatcgaaacgaccacgtattgaaaatccaccaactagagatcagtatttagcgctctgtttactcatgctcgctaacgatgacggtactggattcgggaaaggaaaaggaaacggaaccggttcgattggtgttgaacaaacggagaaaaaaccggccgagttgaagccggtttttattgaagagaaaacagagcaattactgaagccggttgttgataaagaaaaaacagagcaattactgaagccggttgttgttaaagaaaaaacagagcaattattcaggtgtagcgagtgtcctaaagtttttacttcttatcaagcacttggtgggcataaagcaagtcaccgtaaaattaacgttcccgccaccggagacgatgatagcaatccgtcgacgtctacttccactagcggcggcggcgttaatatctctgctctgaatccgagtggccgttctcacgtgtgctctatttgtcaaaaggcttttccaactggacaagctttgggtggacacaaacgccgccactacgaaggaaaactcggcggtaacaatcgttatatcggcggtggcggagaaggcggaggcgttcatagtggaagcgttgtgactacatcagacggcggaagcggcaacggcggcggcggcgcgtcgactccgattgcgcgtgactttgacctaaacatgcctgcctcgccgggatggcaattggatctgacaatcgactgcggaggtagaactcaacatccgattgaacaagaagtggaaagtccaatgcctgctaagaagccgcgtttatttttcgagtgaaaatttgattgaattctgttttaagtcaaattagttaattggttttacatgtgatgatattattttaatatatacattttagggaaaaaaagtaaaaacattgataagtactactttttattattattattattatgtatagaagcaaacagtaggttattcattggttttacattttctactatttcaatacaatattcttttttatttaaaaaaaaaaaaaaa

SEQ ID NO: 7299 - DNA, 628 bp, Lycopersicon esculentum
  Predicted polypeptide sequence is orthologous to G351
gagtacttagctctgtgtctactcatgctcgcacgcagcaataacaataacagtaacagtaacgtttctattactggtgacaatttgtacaagtgttcagtttgtggtaagtgttttggatcttatcaagctttaggaggacacaaagctagtcatcgtagtaacagagataaagtctgcgaacaatctgtgatcgtcacgtcaggtaatgtggttagtggaaggactcatgagtgtaccatttgccacaagacttttccaagtggacaagctttgggtggtcacaaaaggcgacactatgaagggaagatgacgtcatcatcatcgtcgaacggtgtggggtcggtcaacaactttgacttgaatattccggtgttaccagataattggccgggttttgcctcgggcgaagatgaggtggaaagtcctcatccaactaagaaattaaaacaatttccttcacttgaattatttcaaacaacaataggacacactttgtaaaagtgattacttgattatttcattcatttgatttattcttttaaaaaaattactattattattttgcctttgattgtgtttgttgcactaacaaatattgttgacacacaaacaatagttattgcgc

SEQ ID NO: 7300 - DNA, 903 bp, Lycopersicon esculentum
  Predicted polypeptide sequence is orthologous to G354
cggccggggaaaaatatttcatattcttttcttcctcttaccccccaaaaaaataaaaaaaaatctcaaaaattgcaaaaaaaaatcatggtggttttaccaatgaaaagagaaagagaaggagaattcgatataacaaccatggcaaattacttgatgttattttcacgtcaagaaaatcatttcaacactatggtaaacaactctcctagtcgagttttcgagtgcaagacttgtaatagacaattttcatcgtttcaagcactaggtggtcatcgagcaagtcataaaaagccgagattaatgggagaaatgaattttcatttgccgatttcaccgcctaagccaaaaacacatgagtgttcaatttgtggacttgaatttcctattggacaagctttaggtggacatatgaaaagacatagaggtatgttaaatgaaaataataataataataatcaagttcctaatcacgatgttatgaagaaatcatcaaataatccaagagttttgtgtttggatttgaacttaacaccattggaaaatgatttagagttcaagttgaagaaggcaaatcctatagttgattgctttttgtgatcaatcaataatattggatcagatcgcgaatctacgataggagttctacgagttcaaagttatcaatccaatcatttacatatgctgaactcgctgattcaaaattctgaattcatatcgatatatttttgcacatatatatctaaaacatctagatgtttcattattttaatttttttcttctaattctatttttttttcttatgtattttgcactagatatggatttatttattcgtttatatgagggaatataggaccttagccctaatagatgtaatatatagtaccatatttagtgta

SEQ ID NO: 7301 - DNA, 685 bp, Lycopersicon esculentum
  Predicted polypeptide sequence is orthologous to G354
attatcgaaagcatcttatttgtatcaactcttcataatgataaaaattagagaagacaagggtgaagtggaagcacaagcaatggctaactgcttaatgcttttatcatccatagatcgagatcgtcgtaattcatttgaatgtaaaacctgcaaaagacgcttctcatctttccaagcgcttggtggccatcgaacgagtcataaatcaacgattgatatcggaaaatttcttcacggtaaaatatccaaaaaacgcaaggtacatgaatgtttaatttgtggaatggagttttctatgggtcaggctttaggtggacatatgaggcgtcaccgtgccccagtaaatgaaattgaacattcggccaaaaggataccagttttgaagaaatcgaatagcaacgagagaatattttgcgtggatcttaatttaactcctgatgagaatgatgactttcacttttggcctatgccacctgtacctccattcttatcctcttaggacttggctagaactataaatatcattcattttaattcttgtgggtagattcacaaattttgttatctatttaccttaattgatcggatttctttattgatgagtatatttattcacaataaattttattacatgcatgttcgatacgttaaagattattttgtggtaatatatagagatctt

SEQ ID NO: 7302 - DNA, 777 bp, Lycopersicon esculentum
  Predicted polypeptide sequence is orthologous to G363
cttctttctgttatcttttgtaattctgcctcaccatatttagtaaaaaactaaaaacacacacacaaaggaggagaagaacaacaagtcttgtcatatcattgaaaaattcatcaataaaattaaaaaagagaaaaaagcatgaagccaccgaatttcaatcttgaatcggaagacgagtccgaagtcagcagcagccaagttgcctccaacacttctgcccaagaaatttctcctgatccttacaaggataacacgaccaattcgtcctgtctgacaaactctctcaatcttcagcaggagtcgaaagccgttacacttgacttgactcttggcttcaacagcggtgctgataccgagtcgaagggcaatcccgaggctggcagtgaagtagtgcctcatcctccagctgcacaagtatcgaggatattctcgtgcaacttttgtaggcgcaagttttatagttcacaagctttgggaggacatcaaaatgcacataagagggagagaactctagcaaagagggcgatgcggatgggaatgctatcagagaggtacgctagcttggcatcgctcccccttcacggatccccatatcgatcacttggcatcgaagctcatgcctccgtacatcaacgtgcctctcaacaacaagaaaggcatatgcatgctattagaggcggggcaagattcgaacagagctatttcggggtggcagtatacatggaggatgatgacatggagatgttttggcccgggagcttcccgtcagttgac

SEQ ID NO: 7303 - DNA, 702 bp, Lycopersicon esculentum
  Predicted polypeptide sequence is orthologous to G385
catctcttcttctactttctcaggattgctctcctcaactcttttttttgtaatttcattctaattttgcacatttttccaccttaggtgtaataactagtcatctaaacggtagatattaactttttagattgagtttaatttttagtgttgaagaacatgatttgagtgatcaagctcagatccatgcttaaattgagtgaatttaagatttctctgttttgtgtttttgtgaatatgaacaaaacacaccgtttctcctcatcttcatgtagagatgcttcagatccaatatcacataaatgaatctttgcatgtcagctcagataccattgttgatgtcttcgccagctatcctactctagttagcttgtttagcaacataatcgtagctgatggaagactaaacagaattttgcaaatcaatggcaccgggtggacgtatcttcaagcagactacacttacaggggaaactattcaagctactgaataaccagatgaatcgaataacattacccctgttgttgttacagaatcaggaaatgtcgtggcaagactagaggaaaaggtcttgaaaaaatgaagaagtctatgagaggcaagatgaagatcgagatatcagttggtaaagggaagtccaactaaaccaactcaatcagaaaaaactatccaatgagttgggcgtaattgcccggaaattt

SEQ ID NO: 7304 - DNA, 1552 bp, Lycopersicon esculentum
  Predicted polypeptide sequence is orthologous to G4
gacaattatacattttccgtcaaaacataaatcatgtgtggtggttctataatctccgattacatagaccctagccggacttctcgccggctcaccgccgagtttctatggggtcgtttcgatctcggtaagaagcaaaaaaatcccaacaattatcactctaaagctaagcatttgcgatctgaagttgttgacgactttgaagccgattttcaggacttcaaagagttatccgatgatgaggatgttcaagtcgatgtcaagccatttgccttctctgcttccaaacactctactggttccaaatctttgaaaactgttgattcagacaaggatgctgctgctgataaatcctctaagagaaagaggaagaatcaatatagagggatcagacagagaccttggggtaagtgggcagctgaaatacgtgacccaaggaaaggggttcgggtctggctgggaaccttcaatactgcagaagaagctgccaaagcttatgatattgaggcgaggaggatcagaggcaagaaggctaaggtaaactttcctgatgaagctcccgcccctgcatcaagacacactgttaaggtgaatcctcagaaggtccttcctgaggagagcctgtattcacttcagtccgactcagcaatcatgaacagcgtggaggatgaccattatgattcttttggattttttgaagagaaacccatgacaaaacagtatggatatgagaatgggagcagtgcttctgcagatacgggatttggttcgttcgtcccttcagctggcggtgatatctacttcaactctgatgtaggaagcaactcttttgaatgctctgattttggttggggagagccatgctccaggactccagagatatcatctgttctgtcagctgctattgaatgtaatgaagctcaatttgttgaagatgccaattctcagaaaaagttgaaatcatgcaccaacaaccccgtagctgatgatggaaacccccgttactatggtacctgaagagcttccagcttttgaacctcagatgaatttctttcatctcccatatatggagggaaattgggatgcatcaggtggtaacttcctcaacacaagtgcaactcaaaatggtggtgaaaatgctatggacctgtggtcctttgatgatgttccttctttaatgggaggtatcttttaagtcaacatgccttgagttttgtaaataaggcttcatgtgagtgattttttgctgttgtataatgtacttagtgcaaatatttgatatgttaatttgatctccgttaacttgttcttttaggtgtgtctggtggtggaagaagaatgatccacagagaaccatgattaagccatggataatgcactaagtagagcagtgcataggtaattaggtttaattaactactagtagagatgttaaattcgagttttacttaaaaacaattgggctgtatggattatgagaattgatgagacctcgatgcttgctataacgttacctttttagtgttgctttcacaaaaaaaaaaaaaaaaaa

SEQ ID NO: 7305 - DNA, 1518 bp, Lycopersicon esculentum
  Predicted polypeptide sequence is orthologous to G4
gatccgcaaaagcaaattttgacagtacttttcacttctcaccggtaccggaaaaagcatgtgtggtggtgccataatctccgattggataccgccgtctcgatcttcgagccgactcaccgccgaccagttatggggttgcgccgatctgcaaaacaagaagaggaacaagaagaagaggaatccttccaattatcactctaagcgcttgagatctgagaatgtagactttgaagctgattttcaggattttaaggatttttctgatgatgaagaagcttatagtttggatatcaaaccatttgctttctctgcttctgaactctctggaacctctgctggatccgaatcactgatatctgttgatgcaaacaaggaagttgagaaatctgccaagagacagaggaagaatcagtatagggggatcagaaagcgtccttggggtaagtgggcagctgaaatacgtgatccacagaagggggtccgagtttggattggaacttttaatactgcagaagaagctgccagagcttatgatgctgaagctcggaggatcagaggcaataaagctaaagtaaactttccagatgaagcttcagtgcctgcctcgaggcaagctggtaaggtgaatcctcggaaggttctttctgatgagagctctaacccagttccacccaacaccatgcttatgaacaacttgaatagtggatattgtgacaatgtgggcctgctcgaagagaaaacaaagactctgaatggctacgaagctttgtgtgtgactcctgtagatacaggacctaacccatatccccatccagctgctgctggtgtttacttcaattctgaccaaggaagtaactcttttggcccctcagacttttggggagaaacatgttcaaggactccagacatatcatctgttctgtcagctgctatagaatgcgatgaagctcaatttattgaaggtgtcgacctggaggagaaaccaaaatcttgtaccaacaatttggtgcctaataatgtgaacactgaacacaagccacctgaagtattttcaacttttgaatcccagttgaagttctatcagacaccatactcagaaggaaatatggatgtaccagtcgatgccttcctcgatgctgatgctactcagggtgttgaaaatgctatggacctttggtcctttgatgagctttcttctttaatgggaggcatctgagaaatgtgttacctgcagattctgtgtaaataagggcttcatgtgaagataaggtgtctgtgttaaggaggaggatgacaagttgacaaccattcaagcatgtttaggattccatggatggtgtactgagtagctgttttggttgtatagaccaataggtgggtaattagtttattaacaactgttgacaacaagctgaagtttccaaattttgcatcaatgtggatgataattgatggttcaaaatgctttaatatttcacaacttgggtgcttgacattgataaaaaaaaaaaaaaa

SEQ ID NO: 7306 - DNA, 1391 bp, Lycopersicon esculentum; identical to SEQ ID NO: 2255
  Predicted polypeptide sequence is orthologous to G4

SEQ ID NO: 7307 - DNA, 1472 bp, Lycopersicon esculentum
  Predicted polypeptide sequence is orthologous to G409
gagtcgcaaaataaacttacaaaacagcacatatatatagagacaaaatcacataatacgccctcgccggaatcttattttcactgtcgccggccgttaaaactttttttttctagttcggaggtcaaataattaacctccgatcggaagaagtagttattctaactgcttctatttaatctgaaaacgggaaaacccctgagctggttaaggtggatttcgtgatgggattttgtatttgtcctttggaaactcctgctagattactgtggagtactagtttcttccgccacaagcttatgctcttctaaaacttagtcaactctcttttttcatacacatccctgctaaaaaagaagaactctgtgctggagtttttgttttcctttttctgtttcgccggaaacatataaataatcttctgtgtgtaaataggcgattttccagatagttgaaaatatgggatctgggcatatatttttcgacccgtcgtcgtgtcacggcaacatgctgttccttgggagcggagatcctgttttccgaggaccaagatcgacgatgatgaagatggaggactcctcgaagaggcgacccttctttagctcgccggaggatctatatgacgaggaatactacgacgagcagtcaccggagaagaagcgccgtctcactcctgagcaggtgcacttgttggagaagagctttgagacagaaaacaagctggagcccgagcgcaaaacccagctggcctaaaagctggggctgcagcccagacaggtggctgtatggttccaaaaccgccgtgcccggtggaagaccaagcagctcgagagggattatgatcagctcaaatcctcttatgactcccttctctctgattttgactccgttcgcaaagataacgataagctcaaatctgaggttgtttcattgatggaaaagttacaggggaaagtggttggaggagcagggggaaatgaaaaatctgacatcttggaggtggatgctatgacgatccttcaagtgaaggtgaaggctggggaccggttgagcagtggcagtggtgggagcgcggtggtagatgagcatagttcacagctggtggacagtggggactcatattttcacactgatcatgaggagtatccagggcctggaggatgcaatgttcctccacccatggatggtttacaatcggaggaagatgatggtagtgatgatcatggcagttgccatggctacttctctaacgtctttgtggcagaagagcagcaccatgaacaaggagaagagcctattggatggttctggtcttaattgaattttagaatattatattacagtttttcttatctacgcgcgctttgtatgatgaaataagtgtcgtaattccaacttcttatttaaacatctattaatatgcttttgcagcttttattctcttgatttagcaaaaaaaaaaaaaaaaaaaa

SEQ ID NO: 7308 - DNA, 644 bp, Lycopersicon esculentum
  Predicted polypeptide sequence is orthologous to G409
aactcttttttttttcttggataatggcactgacccttcttcattctccccttaattatcacataaaaattttccaaatttcaagattcaatcaaaaaaccccatttcccactgcttaaacaaaccccacatagtttttttgttttcacaattcttgcaccttagagaacttaagggttgaaagtaaaataaatatggaagttggaagggttattaatgaaaaactttctcattgtctctggatgtccaattcttccccatcttttcatggttctgtatcaatggttaatttcgaagatgttggtcgaggagaagtgtctaaagagaggtcatttttcccaggaattgacaaagaagaaactagcaatgatgattatgatagctgttatcatcagccagagaagaagagaagacttttgcctaatcaagttcagtttcttgagaagagttttgaggtagataacaagcttgaaccagagaggaaagttcaattggctaatgaacttggcttgcagcctagacaaattgctatttggtttcaaaataggcgcgctcgatacaaaactaaagtacttgagaaggattatgatgctttgaaagctaactttgataagcttaaagctgattatgacacccttttcaaa

SEQ ID NO: 7309 - DNA, 804 bp, Lycopersicon esculentum
  Predicted polypeptide sequence is orthologous to G409
aatggctttatacttccaaatgaaattcttcctcctacttctaattggatatctaattcttcctccattttccatggctctgtatcgatggtaaatttcgatcaagatcgagtacagaagtctaaaaagaggtcatttttagcacaacttgatcaagacgacagtagtagcaatgatgacaattacaattatcatcaccaaagtgaaaagaaaagacgattgttaccaaaacaagttgagtatcttgagaaaagtttcgaggtagaaaacaagcttgaacctgaaaggaaagtacaattagctaaagaaactggattgcagcctagacaagttgctatttggtttcaaaatcgacgagcacgatgcaaaacgaaacaaattgagaaggattatgatgtccttaaagctagctttgatgaattgaagactcaatatgattgtctcttcaaagagaatggaagcttgagaaatgaggtacatttactcaaagagaagttgatcaacagagtaaaagggaaggaaattttagaatttattagtccacttgatcatgtagaacctcaaaatccttctattggagttgattcaaatttagcaatggtgaagtgcaagcaagaagatgcaaaaagtgatgttcttgattcggacagtccgcgttttactgacggagattacacttcatatttggagcctgctgattcttccaatgtatttcagacagaacactctaatttttctcgagaaatgacacattatgcttccccaaacttgaagacatcatcatcacgatgatttacctggtaa

SEQ ID NO: 7310 - DNA, 3644 bp, Lycopersicon esculentum
  Predicted polypeptide sequence is orthologous to G409
gattcgatcagttttttattttttatttaatttgaaagaaaaacacaaaaagttgaaaaaggcaaagagaaagagcaacaatatacgtcaccccaccgactgattgggactttgttttcatctctctatttttatatttaccaatttatcaccaactgctttgaactgaattctagaaaaatttgcaatactaaattttctgtagatctgtatcttgaagagatacatatatatttgtatatttatatatttatgtatatatatgtataaaattaagacgagttaatagttttaagaacatatatatatttgtatttattttttcttattcttattctaagaatatatgtttatacgtaaatacattgaaaacaaagagatatatttataagctttgaacttgagaaaagtgtttgatttatgataacttaaaatttaatgcttgtattatatactactatgaaatagatacacgttaattaatataaaaagagtgtaaaataacgatacacaaatgtatttgtatgtcaagtgaatgcatgtatgatatttaacattaaaaatgtgaaacttgaatatattttaatatgagatatttctccaaagtatgtataacttgcgctcaaaatatgaagttatgattttaatttttcagttttgcattcacatataattgaaaatcgtgatttaaaaatttaaattttcgtaaagtatgatttgcaatattattttttaaaaaacttttattttgtgaaatataacactagactcataagtttatataatttataaaagaagatatcttttaaatttttgtaagaaattataatgcacgatatgatctataatttggtaattataaaataaaaaaaatttaatattttcataacttatgtgaaaagatacacaatttatttttttttaaaaaaaattatctaaactatttcaactttataggaattttgattttatattatgattttatatagttggttaaaatatgattttatatagcaggttaaaatggtccctttaattaataacactcactaggtgaccaaagcttaaaattatttttggttataagtagtctgttggcaaagagaaagtaatcaaaaacacttcagtcacatctcttctctgctccaacacaccctctttgctctgctttattcccaaaaaaaaaaaaatcaacaaaatttctgtttttggttctggaacttggctatctttttttttttggttcataatcatatccttgtattgaatttgtaagcaagggtgatgtagtttatggtgatcggcagtaggtgctctcacacttcccacatcactgaaatcataatcacaagcttctttcgccacaagctatagatctttactaattccatatagtatatagttttaatacaagaatacaatatatatatatatattaaagggggtatttatcaagaaccccaaattcttaattacataacgaaacgagcggatatgggtgtttcttgaaaagatctctgttttataatttaaaaaaatttgtctgtagaattcgaagctatgatggctccagggattctctatggtggttcttctaatttcgatggcgtttttactcaaaaacagagagacgtgttttcttcatctactgcaccgaaagggcatcttggttccctttttgcccctgcctcttcttcttctaatttcttgggtacatctattttcttacaccgttgactttgtatgttttttatttggttaattttggtttagatagaatcttatctgtttgtatgaatttgtgataatattgaattgaattactattatgttcatttggttgattggcctgagatagttgttatcacatccatctatgtgatgaattgaatttgtatagcatattgtaaagaaaaagttgggtttgatgagcttgagctaaggttaaacaggatctctatgtcgtgtgaaagtagtaatgtctatgtacactctgttctcccgagattttatttagtggatttcactgggtatgttgttttaaatagtaaaagaaagtaaagatacaagagtaactgatggtgtatagaaatgatgttttgataaggagaatactagaaagtcttagctagttttaaatggaactgaattttagtcaaaattgataacttggtagtaatttgttctgtgggtgtttttatctatcaggatccagttctatggtgagttttcgcggtgttaatggagggaagagatcattctttgattcgttcgatcaggatgacaatgaagctgatgaattgggggaatatcttcatcaagcggagaagaagaggcgacttactgacaaccaagttcagtttcttgagaagagttttggggaagagaacaaacttgaaccagaaagaaaagttcagcttgctaaagaacttggtctgcagcctcgccaaattgcaatttggtttcagaatcgtcgtgcgcgatggaagactaagcagctcgagaaagattatgatgaattgaggaatagatacgatactctgaaatcaaattacaataatcttctcaaggaaaaagaagatcttcgaactgaagtaaggaccttgcatcatatttggtacttcattaaatgtaatttcattttcttgagcttgtcgactatgcttgtgtttgatggttcaatccttgttcaggttttccgtctcaccggtaagctgtttatcaaagagaaaggaaatgggcaattggatttgcgcgatgaacacaaacactccaatgcattggcaaaagaaaccgtggttgatccaatgtccaatgtaccagctctggttgttaagcaccagcaggaagatttaagctctgctaagagtgatgttttcgactcagaaagcccacgttacaccagtagaatgcattcctcagtcgtagatcaggatgattctgctcgcgcatttgaaactgatcagtcggattcatctcaggatgatgatgaaaacttcagcaagaatatgctttctactgccaacctacttggcaaagacgcggatgatgattatcccgcgacatcatcaaatttgagttactttggatttccagttgaagaccaaggttttggtttctggacttattaagttaaaaaaaatgtttgtatttgattagtagtaatgcagaatactatttaatgtgtcctagtaatatgtcatatatttggagacattgtatagaaagcacatttctgtaataaataaagtccaatgtatgggtccaagaatagtaatgagttctggtcacaaaacagtttggaactatggctattgcgctttgcatacctgttgtgtaggctctagctggtgctttatatgttgtgaaattacgttattgaattcactattagtgatcacaattctattataccatgaccaattctataggcaaaaggtccaaatccgcgctctagcatgtagtatgagaaaatgtcctttaactttgctatctgttaaaagtttaacttatttatgtttggctcatattgactttggtcactaatgaatcaaggtgcagataattaggaggatgctccataataaataggagtgagcataaatcaccgtattactgaattgaaaggtaattgtctatgtaaa

SEQ ID NO: 7311 - DNA, 1198 bp, Lycopersicon esculentum
  Predicted polypeptide sequence is orthologous to G428
gctgttttgatgatggatgaattgagcaaacttcattctgctattgtttgttcacacagtagacgacaacaagaggttgaggttgaggctgaggccgggccgacaattattaataacactactactagttttgctgctgttcatcatcattattgtcaattagaagcagcggttgctgctgatcataatcatcatcaaaataatactaaatccaccaccaatatgtcagatcttattaaagctcagattgctaatcatcctctttatcccaacttactttctgcttaccttcaatgtcgtaaggttggagcaccgcaagaaatgacatcaattctcgatgaaattagcaaagagaacaacttaatatccagctcacgtcacagtagtgaaattggagctgatccagaacttgatgagtttatggaatcatattgtgcggtactagtgaaatacaaagaggagttttcaaaaccgtttgatgaagctacaagtttcttgagtaacatagagtcacagctcagttccctatgcaaagataatttaatcacttccacaagtttcaacaattatatatctgatgaagcaggtggttcctcagacgaggatctaggctgtgaggagatggaagcagcggatagtcaagaatctcctgctaactgtgaaggcgataatgagctaaaagaaatgctgatgcgcaaatatagtggctatcttagcagtttgagaaaggaatttctgaagaagaggaagaaaggcaaattacctaaggaagcaagaattgtattgctggactggtggaagaatcactatcgatggccttatcccacggaagaagagaaaaataggttatcggagatgacagggctagaccagaagcagataaacaactggttcattaaccaaaggaagcgacactggcgcccatcggaagacatgaaatttgctctaatggaaggtgtaagtgctggatcgatgtattttgatggatctggaggtactggaaatattggcacttgaaaatgacaaaacaaaaaaaaaatggaacctcctgctagctaacacgtagtgtatagtgtgacagaaagtatgtgttttgaagtttataaatcaacaattggtaatcatatactctcgtctctcttcctatttttagagctaacaaacgagtttgaaattttaaaaaaaaaaaaaaaaaaaa

SEQ ID NO: 7312 - DNA, 1149 bp, Lycopersicon esculentum
  Predicted polypeptide sequence is orthologous to G428
cgagtttagttctctccctttttaaaaaagaaaaaagaaaaaagaaaaacacaacacccacttgaaatatcaaacaaattcctgatttgattattttgtattttttttagatatatggatgatgaaataatgtatggttttaattccacaagagatgattatgccgataaagctttgatgtcaccggagaatttgatgatgcaaactgagtacaacaatttccacaactataccaactcctccatcatgtttggatccgatcctattcaattatcatcggaacaaacgcttcaaaataatatttatcgtggaaattgttgtggaggcagtggaagtggtggtgataacaataataataatgatgaagatggttcaaatattatcaaggctaaaatcctctcacatccttattatcctaaattactcaacgcttatattgattgccaaaaggttggagcaccagcgagtatagtaaatctgctagaagagataaggcaacaaaatgattttcgtaaaccaaacgctacttgtttatgtataggagctgatcctgaacttgatgagtttatggaaacgtattgtgatatattgttgaagtataagtccgatctgtctaggccttttgatgaagcaacaaccttcctcaacaatattgaaatgcaattaggtaatctttgcaaagatgatgatgaggaggaggaggaagagttaagttgtggtgatgcatcatcatcaatgagaagaagtgaggataatgaactgaaagataggctgttacgtaagtttggaagtcatttaagtagtctcaagttggaattttcaaagaaaaagaagaaagggaagctaccaaaagaggcaagggaaatgttacttgcatggtggtatgatcactttagatggccttattctacggaggctgataagaattcactagcagaatcaacaggacttgatccaaagcagatcaacaattggtttataaatcaaaggaagagacattggaaaccatctgagaatatgcaattagctgttatggataatctaagtgctcaattcttctcatcagatgttgattgagtttcgaatactgctctcatcatttctctttttattatataaattgtatatttttcaaaaaaaaaaaaaaaa

SEQ ID NO: 7313 - DNA, 977 bp, Lycopersicon esculentum
  Predicted polypeptide sequence is orthologous to G450
gaccaaaagatatttcatttcaccaaactatctaaaaagggggaaaatgtcatcggagacagccaaatcagcgaacggtttgacggaaacaaataattccggccttaatttcaatgaaactgagctaactctcggcttacccggcgaatcgcggaagcaaatctccggtgcaaaacgtggaaattccgacggtatggaattaagcctaggaagctcaacttccggtgaacgccgccgtgatatctgcgaagttaatcactcgaaaaacgaaatctctaccggaaacaaacctccagcaaaggcacaagtaattggatggccgccggtgagatcatacagaaaaaacgtgatagaaaagtgcaaatacgtgaaggtagcagttgacggagctccttacttgagaaaagtagatctggagatgtacgacagttaccagaagttgttgaatgctttagaaaacatgtttacttgcctaacaatctgtaattctcaaagtgaaagcaagcttatggaccttacaaatggtgtagaatatgtacctacttatgaagataaagatggagactggatgcttgtaggagatgttccatggaaaatgtttgttgatacgtgtaagagaattagattgatgaagagcacggaggctataggattagctccaagaacacctgggagatcgtcgagttgaagctaaataaagaagcttaataactgcatgtacagataccaactggcttgagtgaataagtttttttatttttaccttttgcgttctttaattataggataagtaatatataattaggcaattacttagaagtgtattttgtgctacgatgcttcccgtgtgagtgaagacgattgattttattaatactgtatttgtatttttatttgtatgtttttgtcgttacgattgtagatctcaatatgaataaagccacttggggaaaaaaaaccaaaaaaaaaaaaaaaaa

SEQ ID NO: 7314 - DNA, 720 bp, Lycopersicon esculentum
  misc_feature (431)..(431): n is a, c, g, or t
  misc_feature (561)..(561): n is a, c, g, or t
  misc_feature (621)..(621): n is a, c, g, or t
  misc_feature (662)..(662): n is a, c, g, or t
  misc_feature (685)..(685): n is a, c, g, or t
  Predicted polypeptide sequence is orthologous to G450
ttttaagcaacttaaactaaattattattagacaaacgatttatcgagttgtattaaataagaaatattatagcactaaataaattacatttacagaaataaatatgctacactcattattaatacatacaagcactttataatagcagcattaatacataacacactattcaattcgaataaacatttactataatcgatgaaattttgattgatgaaattcatttaaaaaggttaacgttgatttcatccatttctgttcttgcacttctccatagcccttggtgctagtcctattgcttcagttcctttcatgatgcgcaagcgtttgcaagaatcaacaaacatcccccatgggacatctccaacaagcatccaatcaccatctttgtcttcataggtaggaacataatcagaactattcaaaaggnccatcagtttcccctcatgcatgaaatctttcattccttggacaatagtgaaggaattgaacatcttggttaaggcatcaaataattcttgataactcttgtacatgtttaagtccactttcctaaggtnaggtgcaccatccatgctcaccttcaccaaaatattatcattcctctcgatcaagctttngagaagtcaaaatattctttcgaaaggacctttcgggcggncaacccacaacttgtgccttggnagctggggtttttgggtgttgaattcttgatggtg

SEQ ID NO: 7315 - DNA, 723 bp, Lycopersicon esculentum
  Predicted polypeptide sequence is orthologous to G450
gagtatgacaagcgtgttgggtgcggagtgtgacaaaatccgattggattatgaagcggagacggagctgaggctcggattgcccggagctaatgggaatgaactggaatcgagtaataagaacaatggcaaaagggtcttttcagaaactgttgatttgaaattaaacctttctaattcaaaggattccacattaatggataatattaatattaatcaagttgataacatgaaggagaagaagaataatattgttgtgccaagctctaatgatcctgctaagccaccagccaaggcacaagttgtgggttggccaccagtgagatcattcaggaagaatgtaatgactgttcagaaaaacaccaccggcgccggcgaaatctccggcaccggcaccggcgcagcctttgtgaaagttagtgttgacggtgcaccatacttacgtaaagtggacttgaagatgtacaaaagttaccaacaactctctgatgcacttggcaaaatgtttagctcttttactattggaaattgtgggactcaaggatttaaggatttcatgaatgagagcaaattgatagacctcttgaatggttcagactatgtaccaacttatgaagacaaagatggtgattggatgcttgttggtgatgtaccttgggagatgtttgttgattcatgcaaacgtttacggataatgaaaggatcagaagctattgggctagc

SEQ ID NO: 7316 - DNA, 651 bp, Lycopersicon esculentum
  Predicted polypeptide sequence is orthologous to G450
gagtttgatttttgatggatttgaaagaaactgagttgtgtttgggactacctggtggtggtggtggcggaggtgaattaattcgcgataataataataataataacaaggttaatgggaaaagagggttttctgagactgttgatttgaagctcaattttcatcaagctagtgatgatatttcttgtgctatggagaataataagatgaagagcagtgttactactactaaagaagttgtttgtaacaaagatccaatcaagccacctgccaaggcacaagttgtgggttggccaccagtgagatcatttaggaagaatgtaatggctcaaaagagcaacactgaagaaagtgagaagactactgctgcatttgtcaaagtttgcatggatggtgcaccttacctacgtaaggttgatttgaaaatgtacaaaagttaccaagaactttctgatgctttggctaagatgtttagctcctttactaatggaaattatgggtcccaaggaatgatagattttatgaatgagagcaaattgatggatctccttaacagttctgaatatgtaccaacctatgaagataaagatggagattggatgcttgttggagatgtacctctggagatgtttggtgattcatgcaagcgtt

SEQ ID NO: 7317 - DNA, 741 bp, Lycopersicon esculentum
  Predicted polypeptide sequence is orthologous to G450
agcactatccatacattattaatcccaaaactttgtgtgagtacatctctctctctattttcaatttccataaaccattgcccatatagtattattaatttgtatagtggagaagaaaaacaagtaatggacttgaaaactgagttatgtttggggctgcctggtggtggaggagatcacaatattaagaaaagaggattttctcaaactgttgatctcaaactcaacctccatcataatgataatattccttctatgaacatcaacaatcctccaaaggataattcctccaacaagccaccaactaaggctcaagtggtggggtggccaccagtaagatctttcagaaagaacatgttgtctcaaaaagggaataataataataataataatgaagaaattagtgagaaggatgaaaaaacaatagcatttgtgaaggtttccatggatggtgcaccttaccttcgtaaggtagatttaaagatgtacaagagttaccaacaactctctcattctttgaccaacatgtttagctccttcactatgggtaattatgggtcccaaggaatgatagattttatgaatgagaggaaactgatggatgtccctcatagttctgactatgtaccaacctatgaaagataagatggggattggatgcttggtggagatgtaccttggcaaatgttgttgattcatgcaaagcgttacgcataaatgaaggatcagaagctattggac

SEQ ID NO: 7318 - DNA, 929 bp, Lycopersicon esculentum
  Predicted polypeptide sequence is orthologous to G451
cggccggggacctttttcttgaaatacacaacttcttctgagatagtaaataaaggagcaatcttgatcaagaaagtgtttaaagaatttctgtgtgtgtgttttgagatttgaggatttcatttggtgttttgggtatttcaagattcaatttttaattttttttggaggaaagaaagaaaatgacaagtatagtgggcaatcagaaagatctgaatttcaaagccactgagctgagattaggtttgcctggtacagaaaatcaagaatctgaccaagaaatatcaaattccaagaataacaacaaaagggctttacctgaatcaactcatgatgaggaagattgtgaatctaagtcaagttctggtcatgtcaaaaccccaccacctgttgccaaggcacaaatcgggggttggccaccagtgagatctaacaggaaaaacatcatccaaccaaagaaaacagaatctgaatctggaacgtatgtcaaagttagcatggatggtgccccttatctaaaaaaaattgatctgaaaatgtataaatgttatcaagaactactaaaagccttagaaaacatgttcaaactcaccataggtgaatactcagaaagagaaggctataaaggctctgaatttgcccctgcttatgaagacaaagatggtgatttgatgcttgttggtgatgttccttgggaaatgtttatgtcttcttgtaagaggctgagaataatgaaaggatcagaagcaagaggcttgggatgtggagtttaacttataaattataaaaattcccaaatagaatattatgatgatgaagaagttttttttcctctttttacagtaaaagagtctttttttcaccttaggttcttgattaaaatgaccttaaatattgtaatcaaaatagttttttctctggacagacat

SEQ ID NO: 7319 - DNA, 772 bp, Lycopersicon esculentum
  Predicted polypeptide sequence is orthologous to G451
tatcagttttggagaaggaaacttgaattgcaatccaattttgtgaaaaagaaaaatggagtgtgttttggctcatgagaaagatttgaatctcaaggcaacagagcttagattgggtttaccagggaggacagatgaagaatctgacaaagaaattgtatttcatttcaagaataacaagagggctttgcctgaggatgaagattgtgaatcaaactccatttcagatcccaaaactccacctgttgccaagacacaaatagtagggtggccaccagtaagagctaacaggaaaaatagctttccatcaaagaaagcagaagctgaatgtgggatgtatgtgaaagttagtatggatggagccccttatcttagaaaaattgatctgaaattgtacaagggttatccagaactgttgaaggcattagagaaaatgttcaagctgagtatcggtgaatattcagaaagggaagggtataaagggtctgaatttgctcctgcttatgaagataaagatggtgacttgatgcttgttggagatgttccttttgaaatgttcttatcatcatgtaagaggctaaggataatgaaaggatcagaagcaagaggattaggatgtggagtttgagaagaagaataatacaagattatgaattcttctctgttttaaacaggaaaaaaaaagggggtctttttgagcttggggttgtcgaattgcaaagaagctggaaaatttgttttacactgattgggaaagtgcaaacagaagaaa

SEQ ID NO: 7320 - DNA, 724 bp, Lycopersicon esculentum
  Predicted polypeptide sequence is orthologous to G451
attcaaatcaatcattctttctaaatcatgagaatttacgagaaggatatcaatgatcttgaggcaactgagctaagattaggtttgcctgggataataaacgatgaatcttcaacatcaactagtacttctaaaaatagcagaaaaagaccttcatctagtagtgtaaatgaaaatgaacaacaagactcagctcctgcaccaaaagcacaagttgttggttggccaccagttcgatcatacaggaaaaatcatgtgtctaaattatcagaatctgataataattcctcaggaatgtatttaaaagttagcatggatggagcaccttatttgaggaaaattgatcttcaggtttacaaaagttatcaagagctactcaaggctttacaaagcatgttcaagtgcactattggagtgtattcagaaagagaaggatataatggatctgattatgcaccaacatatgaagacaaggatggtgattggatgcttgttggtgatgtaccatgggagatgtttataagttcttgcaaaaggcttagaattatcaaaggatctgaagctaaaggtctagcatgtctataaaaacatggaaatatatataaacatacatacaaatctgctagggatgaacaagtttcagttttgtaaactatctcgatcttctattagtttcacgggatatatagatctagatctacatgtacaaatagttttatccttc

SEQ ID NO: 7321 - DNA, 208 bp, Lycopersicon esculentum
  Predicted polypeptide sequence is orthologous to G451
ggttcgatcctatcgaaagaacattttagaagcgagctatgttaaagtgagcatggatggtgcggcttatttaaggaaaattgatcttaatacttacaaaagttatccacaattactcaaggctttagagaacatgttcaagtgctctattgatgtatattcagaaacagatggatacaacggatgtaattatataccaacttacgaa

SEQ ID NO: 7322 - DNA, 1221 bp, Lycopersicon esculentum; identical to SEQ ID NO: 2231
  Predicted polypeptide sequence is orthologous to G489, G714

SEQ ID NO: 7323 - DNA, 1304 bp, Lycopersicon esculentum
  Predicted polypeptide sequence is orthologous to G519
ggcacgagcaaagcaggagcaggagcagcaacaaacagagagaagaaaacagaggaagataagaggaaaatttatcgaattcgaatcgagagaaaaggggaagtgaagttgcgaagagtgagaatttcaaaggaaatgaacaaaggagcaaacggaaatcagcaattggagttaccggcgggattcagattccatccgacagacgacgaattggtgcagcactatctctgcaggaaatgcgccggacagtcgattgctgtatcaattatagctgaaattgatctttacaagtttgatccatggcagttgcctgagaaggctttgtacggtgaaaaagagtggtattttttctcaccaagggatagaaaatatccgaacggttcacggccgaaccgagcagcaggaaccggttattggaaggcaaccggagctgataaaccggtgggaaaacccaaaaccttagggataaagaaggcacttgtgttctatgccggaaaagcacccagaggtataaaaacaaattggattatgcacgagtaccgcctcgccaacgtggaccgctctgctggcaagaacaataacttgaggcttgatgattgggtattgtgtcgaatatacaacaagaaaggcacacttgagaagcattacaatgtggacaacaaggaaactacaagctttggagaatttgatgaagaaataaaaccaaaaatattgcccacacaattagcaccgatgccaccacggcctcgatcgacaccagcaaacgactacttttatttcgagtcatcagagtcgatgactagaatgcacacgacaaactcgagctctggctcagagcatgtcttgtcgccatgtgacaaggaggttcagagcgcgcccaaatgggacgaagaccacagaaacacccttgattttcagctaaactatttggatggtttactaaatgaaccatttgaaacccaaatgcagcagcaaatttgcaactttgaccagttcaacaatttccaagacatgttcctatacatgcaaaaaccttactaaaattgtataaattcattggatctaaattgagtgtgatccatgacattttctttgttctttggtggtgtaggtcaactttttattaagtagtttagagaagtacaaaatgctagtcaaatttggtgggctacagcacaaatgagccttgataagcatagccaaagagtcgtatagaagggcttattattattgtaaggtatgtaaaaacaaatgaaaatttgttaatatcaagttatcattcttcaaaaaaaaaaaaaaaaaaa

SEQ ID NO: 7324 - DNA, 920 bp, Lycopersicon esculentum
  Predicted polypeptide sequence is orthologous to G519
gtaattacaaaaacaaattaaatcaattctttttcttgaagacaaagtaatggtggaattgcaatttcctgctggatttcgattccatccaactgatgaagagcttgtgatgcattatttatgtcgaaaatgcgacgcacagccaattgctgttccgattatagctgaaattgatctctacaagtacaatccatgggatctacctgatttggctttgtatggtgagaaagagtggtatttcttttcgccgagagatcggaagtatccgaacggttcacggccgaaccgagctgcggggagtggatactggaaggcgacgggtgcggataagccgattggtcgtccaaagtcgatgggaattaagaaagctttggtgttttacgcaggaaaagctccgaagggagaaaaaaacaaattggattatgcacgaatatcgacttgctcatgttgatcgatctgctcgtaacaaaaacaacagcctaagactcgatgattgggttttatgtcgaatctacaataagaaaggtacaattgagaagaatcaactgaatatccgaaaaatgaacggtgaaatgtcgccggcggtgagtgaaggtgatgtaaagcctgagatcgtgccgatttcagtttcaacaaacccatcttcgacgtcttatcacgtttacaatgacttcacgtactttaattcaccagattctcttacgaaacttcacgccgattccagctgctcggagcacgtaccttcgccggagttcacatatgagaaggaagttcagagtgagccgaagccgaaaccgagtgagtgggaaaaaactgcccttgattttccatttaattacacagatgccactgcttctgagttgcagagttgttatgagatgtcaccgctacaagatatattcatgtatctgcaaaagccg

SEQ ID NO: 7325 - DNA, 806 bp, Lycopersicon esculentum
  Predicted polypeptide sequence is orthologous to G519
agctgctggaactggatattggaaggctactggtgcggataagccgattggaaatccgaaagcggtgggaattaagaaagcattggtgttttattctggtaaagcacctaaaggagagaaaactaattggatcatgcatgaatatcgtctagctgatgttgatcgatctgctcggaagaataacaatagcttaaggctggacgattgggttctatgtagaatttacaacaaaaagggatcgattgagaagaacaggaaaatgaacactacctgctacatggataaagttggatctccagaagatcggaagccggagattctaccaccgctacctccacatcctcagccgcagcaattgcacaacgatttcttctacctgccgtccgattcagttccgaagatgcactccgattcaagctgctcggaacacgtgctctcacccgaattcacatgtgaaagagaagtgcagagtgagccgaaactgacagattgggagaaagctaccctcgatcttccatttaattacatggatgccactaccggcgccacaacggtggataatagcttgttaggttctcagtttcagagcagttatcagatgtcgccgctgcaggatatgttcatgcacctgcacaagcctttttgagtggggccaccaatggattattttcagccgcaagtgtcaaacgagactttaacgtccgtgactttgcacgtgccgccgtagtagaataataggagtagcatcttctgcgttcacattggcaaattgtgaaacacatttgtacatgtagtagatgatgggg

SEQ ID NO: 7326 - DNA, 656 bp, Lycopersicon esculentum
  Predicted polypeptide sequence is orthologous to G525
gaacggttaggtaattaacgacctgattattttttaaaaaaaagatcataaaaaagggtgtgtaggttgtttttgatgatgatggagaatttttctgcaagtgttaagatggatgatcaacagcagatggaacttccgccgggatttcgctttcatcctacagatgaagagctaattactcattatttgtctaagaaagtggttgatatgaatttctctgctattgctattggagatgttgacatgaacaaaattgaaccttgggagcttccatggaaggcgaaaattggggaaaaagaatggtactttttttgtgtgagagacaagaagtatccaactggtttgaggacaaacagggcaactgctgcaggttactggaaagctacaggaaaagacaaggagatttttagaggaagatctcttgttgggatgaagaaaactttggttttttacagaggaagggctccaagaggtgaaaaaacaaattgggtaactcatgaatatagattagaaggaagattatcactaaacaatcttcctaaaacagtaaagaatgattgggtgatttgcagagtatttcaaaaaacaactggtggaaaaaaaattcacatttcagggcttgtgagagctaattctgatgaaaatgaaatggtcaa

SEQ ID NO: 7327 - DNA, 2119 bp, Lycopersicon esculentum
  Predicted polypeptide sequence is orthologous to G559
ggtcctccctgtccgaatttatagtgtttccattctcacacagatttgcctctttgtttatcgtctctcttctccacaagcttttcccttttctctctcgcatgtgataaagctgcttccttctgcttctgcttcccttttcacatttttcccttctctgcacatctaatttcaaagctaatcgaaaccgtagggaattgatctgggataagcttgtttggtgtttgcggaatctacagggtctcagcaaggggtttcatgttctgaggaaaagcaacttggattgtgattttatggttttcctgctataatgttcttgctttgaccggggaaaagtatcattacttgttgatttttggttttctgttggtacggttcttgttggagtatatatatatgtgtgggatgttgggtttgttcctgtgctgttaacatttggaatttgaagggttggggttttttctgtttggatttggagggtttgtatggataaggataagtcttcttcaagccatataggaggttcgttgcctccatcagggagatactcattattttcacctcccggtagtagctccaatgtaaagtcagaacaacctggattagcaaatttacctcccttaggacctggaaatgcttcagaatcaggtcattttggtcatggtttgtcggcagattcaagcctgtttagtcttgatataagccgaatgtctgatagcccaccaagaaaatttggtcataggcgtgcccactcagaaattcttactcttcctgatgatattagctttgatagtgatcttggcgttgttggactagatggaccgtctctgtcagatgagactgaggaggacatcttgtcaatgtaccttgacatggataagttcaattcttcaactctgtcttctgaattccaagtgggtgagtcttcttcagctgctccaggttcatcacaaacaacagcaatggcttcaggaacaaataaatttgctcctactgttagtgagaagccaagagttagacatcagcatagccagtccatggatggttcaactacaatcaagccagagatgctcatgtcaggagtggaagagccttcttcagctgaaactaagaaagccacgtcagctgctaagcttgctgaacttgctcttattgatcctaaacgtgccaagcggatttgggccaacaggcagtcagctgcaagatcaaaggaaaggaaaatgagatatatagcagagcttgagagaaaagttcagactctgcaaacggaagcaactactttatctactcagttgaccctattgcagagagatacaaacggcctgaatgctgaaaacagtgaacttaaactgcgtttacaaacaatggaacaacaggttcacttgcaagatgcgttgaatgatgctttaaaggaggagatacagcatctgaaagtgctaactgggcaaggcatagcaaatggtggacctatgatgaacttcccagcaacctttggaggcaatcagcagttctactctaacaaccaggcaatgcatacattgttggctgcacaacaacttcaacagctccagctacattctcataagcaacaacaccagtttcagcaacatcagctacaccagtttcagcagcaacagttgcagcaccaacaacagcaacagcaacctcttatgcagcagcagcagcagcaggatcaactttcacaagccggagatgtgatgtcaagaggttctctgtcatctcctcaaaatgaaaacgcttctgatgttagttctgtagcaaaggattgaacagctgatggccagagagacaggagatggtgtatgttttaaaaatcatcatgtgttttcccatctagcagctcatttttgtgtttcaaaatcatcacgtgttgaaacaacatctagctcaggttctcttgctttcagttagctccttcatctgcattttagtacttttgtagggtcatttgacttttagttgaaattgttcaaatcccattctatgcatatgtcattttgtcaactatcaacatgattttcttcatgttaccaatattgttggtggtagtttttttggacatcaatcacttatatctcttttgaaaaaaaaaaaaaaa

SEQ ID NO: 7328 - DNA, 1853 bp, Lycopersicon esculentum
  Predicted polypeptide sequence is orthologous to G562
ctttttttgaagttccttttagagagagaaaacatacacagagaatgcacaaacactgaaacttttcactactaaaatttgcctctctctttctgctactctcttctacagttttttgaagggttgcttttctgaagctagttgggacaacactcttatcagtgactataaaaggaaattctgattgcacctctaatttagtacgacatcgacttggttcctattacatgggaaatagtgaggatgggaaatcctgtaagcttgagaagccatcctcgcctgcagcggaccagagcaatcgccatgtctatccagattgggcagccatgcaggcatattatggtcctcgagtagctgttcctgcatatttcaattcagcagttgcacctggtcatacccctcacccttatatgtgggggccacagcctatggtaccaccttatggtaccccttatgcagcaatatatgctcatggtggggtttatgcacatcctggagttccaattggatctcatcctccaggtcatgtgatggcgacatctcctgttgtcagccaagccatggatggtgcttctttgagtttagatgcgtctgcgaagtcctcgggaaattctgatagaggattgatgtctaaactgaaggaatttgaggggctggcaatgtcacttggaaatggcagcactgacaatgttgagggtggaacagacaatggacattctcaaagtggggaaactgaaggttcaactgatggaagtgacacaaacggagctggggtcagtgagagaactaagaaaaggagctgtgagacaactcctgataactctggtgatgataagagccactcacaaagatttcaacctactggggaagtaaatgatgatgctgagaaggcaatcgttgttgcagcgaaaatgacgggaacagtactttctccttgcatgacaactttggaaatgagaaatcctgctagtgcacatatgaaatctagcccaactaatggtggttcaccactcagccctgcactgcctaatgaaacctggttacagaatgagcgtgagctgaagcgggagaaaaggaaacagtctaatcgggaatctgcaaggcgatcaagattgagaaaacaggctgaagctgaagaattggcaatacgagttcaggctttaacaggagagaacttgacactcagatccgagattaacaaattaatggagaactcggagaaactgaagctagacaatgccactttaatggagagactgaaaaatgaacagcttggacagacagaagaagtaagtttaggtaagattgatgataagagactgcaacctgtaggcacagtaaacctgctagcacgagtgaacaactcaggttcctcggatacaacgaacgaggatggtgaagtttatgagaacaacagctctggagcaaagcttcatcaactacttgataccagccccagaactgatgcagtagcagctgggtgatcccctaaatttaatttgagatgttaaaacttagtctgattgtgtaattttggcgtaattttaagtccaaaattgctactaactacgggagaggaacaggtgaataggattacgagatttctaattttacctacctaattgtagtttacaggtcagtagaaccgatgtgtgctcttttttctgttttgcatttctgagttgaatgaatgtggctataatagcgtatgtaaagtttaatgttcgacatactaaagacttgatttgaggaaatactatagaaccgaaatgttttcggtttggacgatgaaagtgaacttcatatttgataaataaatgtggtatgtttatgatgttaaaaaaaaaaaaaaa

SEQ ID NO: 7329 - DNA, 1652 bp, Lycopersicon esculentum
  Predicted polypeptide sequence is orthologous to G591, G793
ctcattttccgttcctcttaaagctcaataaacctatacgccggcaaactccggcatggcggacaacccaccggaggtatatgctgccgatgattttctcgagcaaattctggcgattccctcttatgctagcctgccggtaactgatttaaccgccggtgcctcatcggagaattcaacatctggtgtctctcagctccagcagcagccgttgttcccattggggttaagtttggataatggctttgctgacgccaacaacactggaggttttcaagtgaagactgaaagagaagcaatgaacatggggaatttgtatccaggtctagaacatttgcaatctcatgctgtttgcctaagtgttcctcaagttcaccaagtccagccttttcaaggccaccctacatcaagcgcaatagtaacaataccacaccaacctgcaattcgtcctagggttcgggcacaaagaggacaggccactgatccacatagtattgctgagcggttaaggagagaaaggatatcagaacgaataaaggctttacaggaacttgtccccagctgcaataagaccgacagggcagcaatgcttgatgagattctggactatgtgaagttcttaaggcttcaagttaaggtactgagcatgagtaggttgggaggaactagcgcggcggcacaagttgttgctgatattccattgcagtctgttgagggagacacctgtgaaagtcattccaaccagcacgtctgggagaagtggtctgattctgaaacagagcaagaggtagcaaagctcatggaggaagatgttggaacagccatgcagtaccttcaatccaaatcactctgcatcatgcctatttcacttgctgcacttatctatccgactcagcaaagtgacaaccaatcaatggtcaagccagaacaagcggccccattgtagacttctaaattactgcaggtgcaatcaagaactcctaatttcttttaggcccatccgtctatatatccttacctattttctcttgaatcaccctctgaaatccttggtaatgcaatcaaactcagatgacacaatttttgcttttagctcaatcattggcccctttatcaactttcttgagttcagtcacaccttgaacaatggcaacacttaagaaagcaaccaatccatctatctatatcattgtagggaggagtgtatatttttttttccaaactctctgttattagctgcttgtttccccctcactcttgtgggttggttgtgactccttgtatcttttttatagtggatagctagcgatgtattataaaagaaaattgtcccagcttgcatttggtggactgtgcggggagaaagaaaccaagtttgtttgaagacaaagccattagtatacagaaactaaagatggaatgtttagggcttttctttttttggtgtaaccatagcttaatggatgatttagaatcaacttatgatgtactagattccttgtgagaagattaaggattaggagcttcttcatttctttatttctgttcttttgctcatctggatgtatatatgggggattacacaccctttgtgtagtttgttattaatacacaaaaatgttacctgttccaaaaaaaaaaaaaaaaaaaaa

SEQ ID NO: 7330 - DNA, 773 bp, Lycopersicon esculentum
  Predicted polypeptide sequence is orthologous to G591, G793
ttcagttcctcaaaacccttaacttcttctcgccgggaaaaaaattaatttcgccggataaatctccggcatggcagcaaaccaaccggaaggctatgccgacgatttcctcgagcaaattctcgctattcctccctactctggcttgccggttgctgatgttggcactccatcagagacgacgtcgtttacctcggcgtctgccgtatctcatcttaactctgccgctgctgctggcctacagcaacctttgtttccgctgggattaagcttggataacggccgtgatgacgtcggcgatgcaggtccttatgcagtgaagcatgaaagagatggaatgaatatcggaaatctatatgcaggtctagaacacttgcaatctcatgcagttcgtcactctgtgccttctgttcaccatgtccagccttttcaaggcccaccaacaacgagcacaacagtaactgtgccacacccaccttcaattcgtcctagggttcgagctcggaggggacaagccacagatccacatagcattgctgagaggctgagaagagagaggatatcagaaagaataaaggctttgcaggaactggtacccagctgcaataagacagatagggccgcaatgcttgatgagattctggactatgtgaagttcttaaggcttcaagttaaggtactgagcatgagtaggctgggaggagccagtgcagtggcacaacttgttgctgacatccattacaatctgtgggagggggacagtggtgaaagta

SEQ ID NO: 7331 - DNA, 621 bp, Lycopersicon esculentum
  Predicted polypeptide sequence is orthologous to G591, G793
gaagaattagagcattgcaagagttggttcccagtgtcaataagactgatagagctgtaatgcttgatgaaattgtagattatatcaaattcctacggctgcaagtgaaggtgttgagcatgagtaggttaggaggagctggtgcagtagcaccacttgttacagacattccaatatcatcagtagaggaagagagcagtgaaggtggaaataataaccaaccagcttgggaaaagtggtcaagtgatggcacagaaaggcaagtggctaaactcatggaagaaaatgttggtgctgcaatgcaatttcttcagtctaaagcactatgtataatgcctatttctcttgcatcagcaatttatcactctcagccaccagatacatcaagtcttgttaagccagaaacaaatcctccttcatagatgaacacccttatagaaaaaggtgacataacatgctaatgaccttaaagaattttcttgcagtggatggttcctacttttatctattcaagtaatatttagcttttttgttgaaaaaacagggttcttttttaaaaatatttatgtataaagtaaaccattttctatcatttatatattttgagtagtttttgttctt

SEQ ID NO: 7332 - DNA, 848 bp, Lycopersicon esculentum
  Predicted polypeptide sequence is orthologous to G653
tttttctcccattcatcattctctctttggctcattctcccaaaaaaaaacattctcttcatccgccattaacgctcgccgcatcacaagcttcgctccatcaacagcaccattttttttgatcttccaatagtcaaagaggttggaggatcaaatctaggagttgaaatcatgtcgtttacagggactcaacaaaaatgtaaggcttgtgaaaaaactgtttacccagttgagcttttgtcagctgatgggattagttatcacaaatcttgtttcaagtgtactcattgtaaaggaactctcaagttgagcagttactcctcaatggaaggtgttctgtattgcaagcctcattttgagcagctctacaaggagtctggcaacttcaataaaaactttcaatcccctgtgaagtcagctgaaaagttaactccaatgctgacaaaatctccaagcaaagctgccggcatgttttctgggacacaggaaaaatgtgccacctgtggtaaaacggcttatccacttgagaaggtgacagtggagaaccaaagttatcacaagtcgtgtttcaagtgttctcatggtgggtgctctttaaatccttcgaattatgctgccctagatgggatattgtactgcaaacctcatttttcacagcttttcaaggagaaaggcagctacaatcatttaatcaagtctgcttcaatgaagcgtccagcagcaactgttccagattcttaaactatatctccatcaactattttatccagggagcttgtcttttaatatttgtttcctcccttcttttccgtatatctccaattggggtgccatttttgtttactgtg

SEQ ID NO: 7333 - DNA, 564 bp, Lycopersicon esculentum
  Predicted polypeptide sequence is orthologous to G653
ttacgagcagccgcctttgtaaagctatacgcagaagtcccatcacatcatcctctttgcgagcaaaaactcccatctccaggtatacctcaaaacttatcctatttttgtttccttttttctggttgtaatttcaaccttttcttccttctatgctactgtaatttgatcatgaattatctaggcattggaacaaaaatgatttgctaatattactctgataaaattatattctttttcttagaaatagggcaaaagttcacaatgttttgccaagttctttctatcggaagtgtgtcagtttttatggaatattttttatattcgcactgaagcccagttatatatggactcatacataataaggctccattggtacggaagtactctaccaaagatttgaaccaagacccctgtttacaaggaaagcaatcccgtccacaacatcgcatcttgcttataagtttttgccgtgagtatatgtaaatatatgtgtataggcattttttcttttacaaaatacatagtaatattttagtacaaggattgtagtttattactaaa

SEQ ID NO: 7334 - DNA, 825 bp, Lycopersicon esculentum
  Predicted polypeptide sequence is orthologous to G663
atgaacagtacatctatgtcttcattgggagtgagaaaaggttcatggactgatgaagaagattttcttctaagaaaatgtattgataagtatggtgaaggaaaatggcatcttgttcccataagagctggtctgaatagatgtcggaaaagttgtagattgaggtggctgaattatctaaggccacatatcaagagaggtgactttgaacaagatgaagtggatctcattttgaggcttcataagctcttaggcaacagatggtcacttattgctggtagacttcccggaaggacagctaacgatgtgaaaaactattggaacactaatcttctaaggaagttaaatactactaaaattgttcctcgcgaaaagattaacaataagtgtggagaaattagtactaagattgaaattataaaacctcaacgacgcaagtatttctcaagcacaatgaagaatgttacaaacaataatgtaattttggacgaggaggaacattgcaaggaaataataagtgagaaacaaactccagatgcatcgatggacaacgtagatccatggtggataaatttactggaaaattgcaatgacgatattgaagaagatgaagaggttgtaattaattatgaaaaaacactaacaagtttgttacatgaagaaatatcaccaccattaaatattggtgaaggtaactccatgcaacaaggacaaataagtcatgaaaattggggtgaattttctcttaatttaccacccatgcaacaaggagtacaaaatgatgatttttctgctgaaattgacttatggaatctacttgattaa

SEQ ID NO: 7335 - DNA, 490 bp, Lycopersicon esculentum
  Predicted polypeptide sequence is orthologous to G663
taatgaatactcctatgtgtgcatcgttgggagttaggaaaggttcatggactgaacaagaagattctcttttaagagattgcattcaaaaatatggtgaaggaaagtggcatcttgttcctgctagagctggtttaaatcgatgtcgaaagagttgcagactaaggtggctaaactatctaaggccacatatcaagagaggtgactttgctccagatgaagtggatctcatcttgagacttcacaaactcttaggcaataggtggtcacttattgctggtagacttccaggaaggacagcaaacgatgtgaagaactattggaatacacactttcacaagaagttaagtattattgctcctcatctacatcctcattctcgtcctcgttctcatcctcgtctacagattaagcataagagcatcgcggttactaagaatgaaataataagacctcaacctcggaacttctcaaacgttaagaagaatga

SEQ ID NO: 7336 - DNA, 833 bp, Lycopersicon esculentum
  Predicted polypeptide sequence is orthologous to G666
atcggccgaattgacacaactcttgaacaaaatttcctataaagagagtaaagcaatacctaaaaacgaaagatacatccttttattttcattgatcttcaagtcataaaaagaagaaaaagatcattttgttcctagatatcgatcgatcgtgtaggtagaatgggaaggccaccttgctgcgataaaataggggtgaaaaaaggaccatggacaccagaagaagatatcatcttggtttcatacattcaacaacatggtcctggtaactggagagctgttcccagtaatactggtttgcttagatgcagcaaaagctgtaggctcagatggactaattatctccggcccggaattaaacgtggaaacttcactgaacatgaagaaaaaatgattatccatcttcaagctcttctaggcaacagatgggctgcgattgcttcgtatctcccacaaaggacagataacgatataaaaaattactggaatactcatctgaggaaaaagctgaagaaacttcaagggaatgatgagaatagtactcaagaaggagaaagctcatcatcatcacaatccaatttctcaaagggacagtgggagaggaggcttcaaacagatatccacatggctagaaaagccctttgtgaggctttatcacttgacaaatctgattcatctgctaatccaattccagctcaacaacccgttacaggatccagctcttatgcttccagtgcggaaaacatttctaggttacttcaaaattggatgaaaaattcccccaaatcatctgaattaagtcgatcaaattctgagacaactcaaagctcgtt

SEQ ID NO: 7337 - DNA, 1354 bp, Lycopersicon esculentum; identical to SEQ ID NO: 1937
  Predicted polypeptide sequence is orthologous to G666

SEQ ID NO: 7338 - DNA, 2143 bp, Lycopersicon esculentum
  Predicted polypeptide sequence is orthologous to G720
gacccacctaactataatcaacaaacgacccttaaaagaagaagaaaaaacaagaacagatgagctaagtcttcttcatttcccaagagatacaggattgaatagttaatgactgattaaaaagtgaccgagttggagggactaaaaaggatgcctttttagaaatgatttgcattgagaatgaattattgggttggaaagatttcccaaaggggcttaaagtcctacttcttgatgaagatagcaactctgctgctgagatgaaatcaaggcttgagaaaatggactacatagtctactcgttctgcaacgagagcgaagctttgactgcaatctcaagcaaatccgagggctttcatgttgccattgtggaggtaagtgcaggcaacagtgatggggttctacggtttcttgaaagtgccaaagatctaccaactataatgacatcaaatatacattctcttagtaccatgatgaaatgtattgcgctaggcgcagttgagttccttcagaaaccattgtcagatgataaactcaaaaatatatggcagcatgtagttcacaaggcattcaatactagaaaggatgtgtccaaatcacttgagccggtaaaagattctgtcctctcgatgctgcagttacaactagaaatgggtgaagcagatgacaaaagttcaaatggaacagaacctcccactgcagtagcggaaagcaatactgaacagtcatcgggctgtgataaataccctgctccctcaaccccacaattgaaacaaggagtgcgatccgtcgatgatggtgactgccatgatcatactatcttctcaactgaccaagacagtggggaacatgatgctgacactaaatccgtcgaaactacttataacaattcacttgctgagaataatgtccaaacaagtcctactgtacagcaaggagatattattttgaaagaggataatgtttcatctcctgatctaaagacggagactgatatcgctaccacttcacgaagtaacgactgccctgacaatagcattatgcattctgctgaacctagtaaagcatctggtcctcatagttcaaatgggactaaatccaataggaagaagataaaggtagattggacacctgaactacacaagaagtttgttcaagcagtagagcaactcggtatagatcaagccattccttctcgaatactggacctgatgaaagtagagggcttaacgagacataacgtagctagccatctccagaaatacagaatgcatcgaaagcaaattttgccaaaggaagtagaaagaagatggcctaatccgcaaccaatagattcagtccaaagaagttactatcctcataaacctatcatgacattcccacaatatcattctaatcatgttgccccaggtggtcagttctatcctgcttgggtaacaccagcaagttatccgaacggtttacaagtgtggggttcaccttactatccgggatggaaacctgcagagacttggcactggacgcctcgtccagagctgcatgctgatacatggggctcccctatcatgtcaccgtcgcttggatcatatccaccatatcctcagaatgctggagtgtaccggccacatggaacacataacagatatagcatgctagagaagtcgtttgatcttcacccggcggatgaggtgattgataaagtagtaaaagaggcaataaccaaaccatggttaccacttcctttgggcctaaaagctccttcaacggagagcgttcttgacgaactttctagacaagggatctcaaccattccttcacaaatcaacgactcccgttgtcggagatgagatgacatgtcattctaattttttttgggtcccatagttggtgcatgtcaaaaaaaaataataatctccaattacttgatggacatatgtaccatgacattacccagtgacccgagtgacccacgcgtatggcattgactcgacggtcaaaatcgagttgttgtaaataatggacccaaatatgggttttcccttttttgttggcccaattttagatgtttgggccgatgagtgtgctccattaatttctttggaaaataatgaataaaccattcttagctaaaaaaaaaaaaaaa

SEQ ID NO: 7339 - DNA, 765 bp, Lycopersicon esculentum
  Predicted polypeptide sequence is orthologous to G720
atatgctgcagcatgtcctctatttttctttgaaaaaatttcttgtgactaactaaaaagtgtacagttttttggtgattaataaatttgttcatgtgtgcagatgctgaaaagtgagcatcataattaatggcttgtttgggtgcctgaaaaggatgccaattcagaaatggtttgcactgagaatgaattattggagtggaaagatttcccaaaaggacttaaagttcttcttcttgatacagactccaattttgcctcacagatgagatcaaggcttcaacaaatggactatatagtttacacattctgcaatgagaatgaggctctgtctgcaatatcaagcaagtcggaggtgttccatgttgccattgtagaggtaagtgctggcaacagcgatggaggattcaaatttctcgaaagtgctaaagatctaccaactataatggtttcagatattcactctattaacatcatgatgaagtgtatagcacttggtgcagttgagttccttcagaaaccattatcagatgataaactgagaaatatatggcagcatgtagttcacaaggcatttcattctggaggaaagagtgtctctgagtcactaaagccggttaaagaatctcttttgtccattctagagctccaaccagtaaaacacgaagcagataatgagaatactaatgaagcagaacccttgatatcagtggtggaaaaccaaaaagcatcatcatcctgctgcgaataatatccagcttcttc

SEQ ID NO: 7340 - DNA, 617 bp, Lycopersicon esculentum
  Predicted polypeptide sequence is orthologous to G748
cctttagggaagcattcaagggacggtgagttgcttaaaccaaacaaccctgagggtcaaaagaactcagaggggtctgttttagtaccaaaaacattgcgaatagatgatcctgatgaagctgcaaagagttctatatggtcaacactgggaatcaagtacgactctgttagcaggggagggcttttcaagtccttgcaaccgaaaaacagtgagaaggatcaccctaccactacctccccgtctttgcaggctaatcctgcagccttctctaggtccctcagcttccaggagagagtataaagtctgaggtacttagttgttaaccaacttatcttccggcagatggatgttgatcttccagccttatggatattcaattacgcttaatcgtatgtaccagggctgagaatctcaagatcccacaagtgcttcaactgaaactgggaaagctattgtcaaaattagtgtttatccttcccttgtaacatatttttgcttggtcagtgtgtgttttccatgtacataaactttatacagctgacagtagaaagtggaagagagaaatgtttagatgtatatcatgtacccgtcaaagttttaatctggaaggcggg

SEQ ID NO: 7341 - DNA, 783 bp, Lycopersicon esculentum
  Predicted polypeptide sequence is orthologous to G783
ctttctatctgtttcacatttattgctcttatcctttcaatctttcttatctttaagccctatttctgatgtgcttgaaatgatttcttttggggttgcgcttttaacaaaattttattaggttttttttatttttgcgtaggcagagagcagaagtcatggggcttcttttacgaattttttgttcttgctttggtgaagaattgggaactaaaggttttttcttatcaataaatagttgattatagaaaaatggggatcaaatgctgttatttactacccagtcttccgaaacaaagagtgtttctgcttagttcgcttgaattttacttacctcaatttaggagttccgctgtttaatagcatagcataggaaatagatggtgaagtaatgagaaatcggctaagtataccgtgttaatgctgaaaatttgttacttcaaatgaacttagcttgattgttcatcatttgacaaacttttggacaatccttacttgcacctttttttcccttggacagacaatagtttttctcatcaaaggctacaccgtggactcgaataagagatggatacagaaaatcctgctccaatagttgaaaaggatactacagatgcggagacatcattggatagctctcatctcaggaagaagattcagaagaaagttccaaaaagaattcacaaagctgagagagagaaaatgaagagagagcatttaaatgagctttttcttggtttggctgatgctctttgactatctgagcagatgaatggaaaagcc

SEQ ID NO: 7342 - DNA, 469 bp, Lycopersicon esculentum
  Predicted polypeptide sequence is orthologous to G8
tttttttttttttttttttctaaaaattatccaatccacaaaaatggtattcatacaaaagaaatcaatgactatgtttatacctatattactagttacggataagtacatgttatggaagtggtaggcggggattaatctggtaaaagcactgcgaggcatttgttgaagttgctaatgcagatgttgatgaagtgatagaagtagtagatggaatgaagaatcctgatgatgctgccgtgcagaacattgtcaatgggctgtttgtatcaacctgactaggcatttgcagtgcccaatttggaggtccttgtgatgaacctgtgtcctttctcttgtcatatgctcttccctcatagctggaagagaaattagaatagattccagtccacaattgagcttgttgggacgacattggtagtcccttgagatgtgaacttccaactattactgaaccaggtttatccat

SEQ ID NO: 7343 - DNA, 658 bp, Lycopersicon esculentum
  Predicted polypeptide sequence is orthologous to G811
accacgactgccactgcccctaaccttccgccaccgtgaacctccgcccagctcagtggagctccaccgcgttgacatcggaacgatatatatatatatgggatggaggctaacaatattattgctccgttcgtgatgaaaacttatcaaatggtgaatgatccgaagattgatggacttatagcctggggaacagctaataacagtttcatagttgttgaacctttggatttttctcaacgaattttgcctgtttactttaagcacaacaatttctccagctttgttcgtcagctcaatacttatggattcagaaaagtggatccagataagtgggaatttgcaaatgaatggtttctgagagggcaaacgcatttgttgaagaacatagtgaggaaaaagcacagtagaaattcgtgttctcagaagcaggatgagagtgaagatgaagaaattttgactgaaatttctagattaaagcaggaacaaaaagcattagagcatgaagttgagaatatgactagaagattagaagctacagagaaaaggccacagcaaatgatggcttttttgtgtaaagttgttgatgatcctgagattctgcccagaattttaatggagaaagagagatctaaaaggctaagtttaacaaatcgtg

SEQ ID NO: 7344 - DNA, 635 bp, Lycopersicon esculentum
  Predicted polypeptide sequence is orthologous to G869
ccgcaatttccctctttcatctcaccctaaatacttcattcaattcaacgtattttgccctttttttgtaataacaaaatcgccatggaagttgatcaattgagcagcaagtgacccgaatggtagagtccgacccggatgttgcaccctaaacggatcgtcgtcatcagttaatcagccggtgactggagttgatgagatttttcttctgataacaggtaaagcttataactcctttttttacaacaaaattacatggattctaagaaattagtagttaatgtcaatcaaggggaaacacttgaatatgatgagtgtaatattagtaaaaactgcaaaactaaagcgaatgtaagcttaattggaatccgaaggcaaaagaatgggagatgtgctgctgtgattactgatcgaattaggcataagaaagtatggttaggcacttttgacactgttgaagaggcttcacaagcttatttctctaagaaatctgagtttcagaatgagaaattaaggaatcaaggaaataagaagagtgaaagaaaacgtgaaacgagaagtattgttgaggtttacaagagaggaaaatattattctgagaaatcagatgtaaagcaaggtaatgaaaatgtgaa

SEQ ID NO: 7345 - DNA, 609 bp, Lycopersicon esculentum
  Predicted polypeptide sequence is orthologous to G869
ggaagaacaggaggaaggaggaggaggaaggaggaagaaaggggttgtgatatatgtcggcaaatttctgtttggctgtgattagagctccattgaagctctgggtgtctgtttcttcggtgatatttggtctttgcatgcaacaaatcctctgctgtgatcatcagcagcagggtattactctgtttttcacaactgtttcgatgcgtttgaggcccaaaaggacttgttctggtgttgtttgctttggtggatttcatataaaccgatttttacatcctattttgctcttgagacggccgattacttgaaaatttttgctgagtttttcaaattaaattcaattttatttgtgtttcctgttgaaaaaaaccaattttctgggcatatttcgaggggttttgaagatttgaagaaatcatgaaaatgtccgagtctcggagacaatctcagaaatcgaagattagggaagaatcagcccgacccatgaggaaaatccggatcgtttgtgacgacccggaagctactgattcatctgatgatgaaagggttgatgtatcgaaacccaaacgaattgttagggagatttatcttcctgttgttagctct

SEQ ID NO: 7346 - DNA, 1369 bp, Lycopersicon esculentum
  Predicted polypeptide sequence is orthologous to G896
gatctcaactctcaagtagtcaatccactttgatcaccctccatacaatggacagcaggagatgcaaatgccagtggtgtgggatgaagatagcagctcccattggagcacaaacagctacctgtccgaggtgccaatctgtgacacaactccaacctgcaagaaaccatggctttgctaattttcccactgccaataacaatatgagcccagcttttccatcaaggccaggaaggatgtgtgcaaatgctaataattttcagcctcaacaattcaaccgccctatgtcaccacagatcaataatatccgacctcctgcagtacatggacgaaaaagagcggttctgtgcggaatcacttaccgtggccatccaaagagtctgaagggaagcattaatgatgttttatccatgagatattttctggttgagaagttgggattcccaaatgcatcagtacttgtccttacggaggatgagaaagatccatacaaatacccaacgaaggccaatatcagatcagccttacgttggcttgttcaaggctgtcagccaggagattcactagtgttccactactctggccatggcacacgagtacgagaccatgatggtgatgagattgatgggcacgacgaatcactatgccctgttgattttgagacagaagggaggatactagatgatgagatcaataataccattgtcaggcccttaccccgcggagccacacttcatggaataattgatacatgctttagtggaactttcctagatttgccctttttgtgcagaataaacagggcaggatactttatgtgggaggaccatcggatccgctcatacaaaggtactaacggtggaatagcaatctctatcagtgcctgtgacgaccatcaaaattctggagatacaacggctttcacaggctttccaacaggtgccctgacttatagtttcatccaaacattggagcaacagactaaattgacttacggacgcttactcatgagtatgcagaagaagattcatgaagcacagaacggcataggccttgatggtgaaaatgaaactcaggagccccaactatcctcatctgagcagtttgatattcactcgaagatggtggctatataggaacttaaagtatccaactccagcccgagtacaacttccctggcataataaacttgttgtactaataaaatttgtaataaattcaacagtttgttttaccatcgcttgtagattcactcatatagtattgttctggtgtgaatcttggtcatatattttcgttatgtaaactatatagcagtaacactgaataaacttccagatggaaatttgccaaaaaaaaaaaaaaaaaa

SEQ ID NO: 7347 - DNA, 771 bp, Lycopersicon esculentum
  Predicted polypeptide sequence is orthologous to G896
gtaaaagcatcaccattttcaatttatcaaattaattgaaacaagaagaagaaagaaaaaacatgatgatgcttgtcaattgttccaagtgtcacacccccttacaactcccaccaggtgcaaagtccattcgctgcgccatctgcagagccatcacactaattgctgatcctcacgctgctccgccaacacccccttccgcttacaataaccactactatcccccttcttctccttctcctgctcttgctccatctacttatagttccggtcaaaattcatcgtcacgaaagagggcggtcatcgtaggtatttcgtatacgaatacgaggaatgaactgaagggatgtattaatgatgctaaatgtatgaaatttttgctcaccaatcgattcaactttcctcaagactctattctcatgcttactgaagaagagagggatccatacagaataccgacaaaacataacataagaatggcgatgtactggcttatgcaaggttgtcaagcaggggattctctggtgttccattattctggtcatggttcacaacaaagaaattacacccggagatgaagttgatgggttcgatgaaacactttgtccgttggattttgaaacccaaggaatgattgttgatgatgaaattaatgcaacacttgttaggcctcttccgcgtggagctaagcttcatgctattatagatggcttgtcacagtggtactatggcttgacctacccgtttctttgtaggatggacaggactgga

SEQ ID NO: 7348 - DNA, 884 bp, Lycopersicon esculentum
  Predicted polypeptide sequence is orthologous to G921
tcaggatcagaacagcgatggatcgaagaaaattaaaattgaaaacaacaacaataataataataataatgaaattgtgaaatcgtcagttcaagtgttgaattcagagagcagctcaagtgatgaagattcatctacaaagaaaccaagagaagaacacattaaaactaagacttcaagagtttatatgagaactgaaccatctgatacttctcttatagtgaaagatggataccagtggaggaaatatggacagaaagtaacaagagacaatccatctccaagagcttatttcaaatgctcttctgctcctacctgtcccgttaagaaaaaggttcaaagaagcgtggaagaccaatcgattctagtagcaacctatgaaggagaacacaaccattctaaagtggataccgcaggccctgttacaacaacttccccgtctagccgatttaacccgaaaaataatacttatgctgctgcggtaatgccaagacaaaccttaactcttgatttggcagaaccaaaaacattacaaaatgatatcaaaaaagttcatagcattacaagtacaagtagtgcaagtggtcagaagcgtaaatcaccaggaactgatcaacaacagcaaaatagaccagagtttcaacatttcttgatagaacaaatggcttcatcattgactaaagatccaagttttcaagcagccttagcagccgccatatcaggaaaattcttgcaaaataatagtaacactaaggataaataattaaaacgaaaattatgttgacacattgaaatgttccagagaaagacaggcagccactaggacatgtcgttataaattgtatatattgtttactatactcgtctctttttttgggagaaca

SEQ ID NO: 7349 - DNA, 782 bp, Lycopersicon esculentum
  Predicted polypeptide sequence is orthologous to G921
cttgaactttgaatactttaattattttaaataataaaaaaagcctaaaattcaattaatataaaatagaggaagtattttattagtggttgtgcaaataaaaacatgacaaatagaagacaaaagatggagttagatggagcttcatgggttcggacgaactcagtagctttttcataaaccctacacttgtattaaaaatttaattaaatatttatgtatattaatttatgaatcactaacaaagttaattgacgtttgttaacaaaatttagaaccccaaaacacttaatccccgcttcggctatgaactagaaggagtaaatgcttggaaaaggatgtgtttactttaatgttcccacctaacataagagtatagaaatgaaataacattactatactaagtatttaattttgtgttgtctaaatttcttttatattaataggtacaaagaagtgttaaagatgcatcaattttagtagctacatatgaaggggaacacaatcatccccaaccacctcaagctgaaataacagtgccattagtgaatacaacagatccaacatttttgaacaaattcatgaaagacatcaacacaaattcagtgcaacaacaatatttagtcgaacaaatggcgtcttcgttgtcgaagaatcctagttttgcagctacagttgctacagccatctcaggattacttttttgaattatatgatgatttaattacctttcaatgacacaaaatactgtttgttgagaggatttaaatggtaatgtatta

SEQ ID NO: 7350 - DNA, 787 bp, Lycopersicon esculentum
  Predicted polypeptide sequence is orthologous to G921
tatggtggtgaaaaatgaggcaggggatttgttagaggaactaaacagagtgagtagtgaaaacaagaagttaacagagatgcttactgtagtttgtgaaaattacaatgctttaagaaaccaaatgatggagtatatgagcacacaaaatggtgtagctgaagatactagtgcagggtcaaggaaaagaaaagctgaaagtatctctaatcctgttaacaacaacaacaataataataacaatatggatgttgttcatggacgttcatcagaaagcagttcgagtgacgaagagtcctgttgcaagaaactcagagaggagcacataaaagcgaaagttacaattgtttctatgaagactgatgcatctgatacctctcttattgtaaaggatggttatcagtggagaaagtatggtcagaaagtaactagagacaacccttgtccaagagcttacttcagatgctcatttgcacctggttgccctgtcaagaaaaaggttcagagaagcattgaagatcagtctattgtggtagcaacatatgaaggagaacataaccatccacaaacctcaaaaccagaatcaggtccaagtactaatacttccacagccagccgattaaatgtgacaactatcgcgggcactactacttcagtcccttgctctaccactctcaattcctcaggaccaaccattactctcgatcttactgcaccgaaaacagtggaaaagcgcgatatgaagatgaatcacagtactactagtcctaccagtgggcatagcatt

SEQ ID NO: 7351 - DNA, 2402 bp, Lycopersicon esculentum
  Predicted polypeptide sequence is orthologous to G938
atagtctcttaaaaaatggtcaaattattattctcctaagtagagaaaaagagtttaatcaaattttttcaaatatcataaattcaggattaaatatcgcgtaatttggattgatgagtgttgagaaaggacaggataatctgtgaaaaaattgggtgttagctgctagttctgtttagatttcttgacgtttggtgattagttttttggaggagtttgttcttgtgaagatgatgatgtttgaggaaatggggttctgtggggatcttgatttctttcctgctccgcttaaggaagtggaggtggctgctccacagactgaggcagagcaggtggtggatgatgattatagtgatgaggatattgatgtggatgagctagagaagagagtgtggagggacaagatgaagctgaaaaggctgaaagaaatgaatcaggggatggaagatgttgattctgtcaaacgacgccagtcacaggagcaggcaaggaggaagaagatgtcgagggcacaggatgggatcttgaagtacatgttgaaaatgatggaagtatgtaaagctcagggttttgtttatgggatcattccggagaaaggcaagccggttggtggggcatctgataatcttagggagtggtggaaggataaagtgagatttgatcgcaatggccctgccgctatagccaaataccaggctgagcatgctatcccaggcaagaatgacgtatcaaatccagttggtcctacccctcacaccttgcaggagctgcaagataccacccttggttcgttattatcagctttgatgcagcactgtgatcctcctcagagaagatttccattggagaaaggtgtttcacccccatggtggcctacaggacaggaggactggtggccacaattgggtttgcagaaggatcaaggtcctccaccttacaaaaagcctcatgatctgaagaaggcgtggaaggttggtgtcctaacagcggtgatcaagcacatttcccctgatattgctaaaatccggaagcttgtgaggcagtcaaagtgcttgcaggataagatgacagcaaaagaaagtgcgacttggcttgctatcatcaatcaggaggaagctttggctcgagaactataccctgatcgttgtccacctttatcgtcagctggtggtagtggaactttcactgtgaatgacagcagtgagtatgatgttgatggtgctcaagatgagtgtaactttgatgttcaagagcaaaaaccacaccatctcaacttgttgaatgtcactgttgagagattcaacgagaggcagcctctgcaacaacagtctcatcctatcaaggatgaaataatcaccagcttagatttcacccgcaagaggaagcaatccaatgaacagactgttaccatggctcagatttatacatgtgagattcttcaatgtccttacagtgaacttcgccacggttttcaggacagatctgcgagagacaatcatcaactggtctgcccttatagaaacacttctcaatttggagtttcaaagtttcccatgaacgaagtcaagccagttgtcctccctcaacaatatatcccgtcaacttcagttgctctgcctgttaatccaagtccacctccttttgatctatttggagtaggagttcctgaagatgggcaaaggatgattgatgaccttatgtcattctatgattgtaatatacaaggaaacaaaagccaaaatacgggaaatgttgcagtgaccaaagagcagcagcctcatcaacaacctcgtgttgaccaggtcaattacctacacagtcgagggatgatggaggggaatatcttcaaagacattaatgtttccgcaagtcagtctatgcagccacaaggcaatcttgttgatcaatgcaagatcctaaattcaagtgacaatttgcaattcatgtttgggcctccattcaacttacagtccaccaattaccctggaagtctgcctggcattggatgtgacaccacaccgaagcaagatattccaatttggtactagccatgatattggtgaaacgtatatagtcagtcggggcttcatagatatagcttgttccccgagattggcacaccccattataattggtcttcattatcaggtggatttttaatcgcttacaactctcttagtcaagatatttcctgttaccatatgttttagagggttgaaagctaggcggcatggtgtaattgaggagaaggaagagaccccctccaagtattagccaatgctgcttatagaatgtatagatatctgataaataagttaagactatcttgttatcttgtgttgaaattttggtttaatccaaaaaaaaaaaaaaaaaaaaaaaaaaaaaaaaaaaaaaaaaaa

SEQ ID NO: 7352 - DNA, 2207 bp, Lycopersicon esculentum
  Predicted polypeptide sequence is orthologous to G938
ggcacgagcctctcttcttcttactttccaatacacaacaaaagtgaaaacatcacttcaatacacctaacattcttctcaaaccccttctctttctctcttttttcttttttttttggttcaaaatcaaagtagtatagccatagataacagcttcaacaagctgttttcaagaaaatcataatttggtaaatggggatatttgaagatatggggttctctggaaattttgagtttctatctgattctatgggatgtggagctcaagaagttgagcataagccggttgggttggaggaggatgattatagtgatgaggagatggatgtggaagagctagagaggaggatgtggagggatcgaatgcttttgaggcgtctcaaagagaaaaacaagaataaagtggtgggggatggtgcgaagcagcgtcagtcgcaggagcaggctcgtagaaagaagatgtcgcgtgcacaagatggtatactgaagtacatgctgaaaatgatggaggtttgtaatgctcagggttttgtttatggaattatccctgagaaagggaagcctgtgactggtgcttcggacaatcttcgtgcttggtggaaggaaaaggtcagatttgatcgaaatggccctgctgctattgctaagtatcaggctgataatcagattcctgggagagttgaggaatcgagtgtgatagtttccactccccacactttacaggagctgcaggatacaactctaggatcccttttgtctgctttgatgcagcactgtgatcctccacagaggcggtttccgttggagaagggggtatctccaccctggtggccctctggtaaagaggaatggtggggtcagttgggtctgccaaatgatcaagttcaacctccatacaagaagcctcatgatctgaagaaggcctggaaggttggtgttctgacggcggtaatcaaacacatctctcccgacattgctaagattcgcaagcttgttcgacagtcaaagtgcttgcaggataagatgacagctaaggagagtgctacttggcttgctattatcaatcaagaagaggctttggctcgtaagctgtatcctgacagctatccacagggatctctagctgttggtaatggttcctttttcatcagcgatgctagcgattacgatgtggaaggagtggataacgagagaaacaatgaagtggaatgtaaaccccatgacatcaatctccaaactggaattatgttacctaaagatagggttttgatgccaggtttagctccagtgaaaggagaaattattgatttaacttccgattttatccagaagaggaaggaaccatgttttgaggagtctgttgatcaaaagatatatacttgtgagtaccttcactgcccatacagcaattatcaagctggattccttgacaggacttcaagaaacaaccaccaaatgagttgtccattccggttcaattctgctcaaacacttactacacctaagtatcagatcaactatgagcacaacacagtttttcctgcacaaactgcaacttctaagccagcggtctcgtcagtcactgcttcctcttcgatgagtgcctcggggcttggactccctgaagatgatcagaggatcatttctgacctcataacatcatacgacaacaactttcagcaaaatggtagcatctgttccggaatttctgagattctagtaaaccaaagcctgcctcagcaacaaacagttgaacttcccatggatggcaacatcaacctaggacatatggagacctcagctcaagaaaccagcatgcctgtttatcgttcaacagagtttcaatatgatcaatgcaaaatgtcctttgacgcccccttcggtggaaacataaatgatataactgattacagattcggttccccgttcaacttgggaggaagcgactacgccgtggaacagctgacaaagcaggatatatctacatggtacctctgaactagtactagtattaaactgtcttatttcctatatgaaggcttgataggttgtatatgtttagataagtgatcaactctctgtcctttatatatacaggtattgtagtttctttgtgatgtagttgatgtttccatggttgtaagtgctaaacacaataattatctttatgcaattatgttttaaaaaaaaaaaaaaaaaaaaaaaaa

SEQ ID NO: 7353 - DNA, 2509 bp, Lycopersicon esculentum
  Predicted polypeptide sequence is orthologous to G938
ggcacgagtctaccttctatattctgaagggtcaattcttgaacaaaattttggaagcaaaaagaagaaacccctttgaggttgctggtttttttcaaaccaaaatttggctgccaagatgatgatgtttgaagacattgggttttgtgctgatcttgatttcttccctgctccgctgaaggaggcggaaacagtagctgctgttccaccaattgtgccggagccgatgatggatgatgatgatagtgatgaggagatcgatgtggatgagctggagaagaggatgtggagggataagatgaagctgaaaaggctgaaagaaatgagcaagggcaaggaaggtgttgatgctgtcaaacaacgccagtctcaggagcaagctaggaggaagaagatgtccagggctcaagatgggatcttgaagtacatgttgaagatgatggaagtctgtaaggctcagggttttgtttatggaattatcccggagaaaggcaaaccggtgactggggcatcggataatctcagggagtggtggaaggataaagtgaggtttgatcgcaatggacctgctgcgatagcaaagtaccaagctgacaatgccatccctggcaagaacgagggtgctaatccgattggtccaacccctcataccttgcaggagcttcaagataccacccttggttctctactgtcagctttaatgcaacattgtgatcctcctcagaggcgatttccattggaaaaaggtgtatcacctccatggtggccaaatggacaggaggattggtggcctcagttgggactgccaaatgatcaaggtcctccaccttacaagaagcctcatgatctgaagaaggcttggaaggttggtgtcctcacagcggtgatcaagcacatctcccctgatattgctaagatacgcaagctggtaaggcaatcgaagtgcttgcaggataagatgacagcaaaggaaagtgcaacttggcttgccatcatcaatcaggaggaagttttggctcgcgaactttatcctgatcgctgtccacctttgtcctcaggtggtagtagtggaaccttcactatgaacgacagcagtgagtatgatgttgaaggtgctattgatgaccctatctttgatgttcaagagcaaaaaccaaaccatctcagtttgctgaatgtcaatgttgagatgttcaaggagaagctgcctctgctacagcagtctcagccaatgaagggtgacatttttgccaacttagatttcactcgcaagaggaagccggctgatgacttgactttcctgatggatccgaagacatatacttgcgagtgtcttcattgccctcatagtgagcttcgcaatggttttccagacagatccagcagagacaatcatcagctaacttgcctcttcaggaatacttctcaatttgtagttccaaactttcacatggaggaggtcaagccagttgtcttccctcaacagtatgctgagccaaagcgggcttcgcttccggtcaacccagctccaccctcctttgatacatctggacttggggttcctgcagatgggcagagggtgatcaatgagcttatgtcattctatgaaagtaatgtgcaaggaaacaaaagttcaatggcggggaactctgtgatgtccaaagagcagcctcttcaacaacctagcattcaacagaacaattaccttcaaagccaagggaatgtgttggagggaagcatctttggggacaccaacatttctgctaacaactccatgtttgtgcagggtgatcggtttgatcagagcaaggttttaacttcaccattcaatgcaagctctactgatgatttcaatttcatgtttggatctccattcaacatgcaatccactgatctctctgaatgtctttctgggatttcacatgatgacgtgacgaagcaagatgcctcggtttggtactagcaatgcgattactcaaatgaacatcaagcagtggatatcacaatatacctttaatcaggtggatttcagtttgcctatagttctcagtttggtttttctgttaccatgtagttgtagaggttggaggatcgtgcatgacgttattacaagggagtagtaagagatgtcatgctgctggttagaaggaacttatagatgtttctaaataaggtttagcagtcagtttattttcatatatgtctataactctatataggttttagctttatcccatagtcaatcgttggtttcggagatatttaaacgcttttgtccctatatctggttctggaaatgttacaaattacctgcaggtgcagctgcaggtctttttgttatatgttatagtactatttgtcatggtggtggtgtaatatatacatatgtgttggccaaagctgtgtgatatgttgttagcatcctatataaggccatggcttgacaataaaatgttatgatgtattttggtatgtcctcttttcaccataaaaaaaaaaaaaaaaaaaa

SEQ ID NO: 7354 - DNA, 2458 bp, Lycopersicon esculentum
  Predicted polypeptide sequence is orthologous to G938
ggcacgagctgagttccagttgaaccacagttttgcaacgacataaaaaaagtgatctttttgaggctcatgtaatttgatcaatttcaattagattctgatctgaatattggattttgggtattagctgcttaatcctgtggaagttgcaagtagcttcacctttttcatcctgtggaagatgatgatgtttgaggaaatggggttctgtggggatcttgatttcttccctgctccgctgaaggaagtggaagtgtctgctccgcagagtcagactgagccggattctgtggtggatgatgattatagtgatgaggaggagattgaagtggatgagctggagaggaggatgtggagggacaagatgaagttgaaaaggctgaaagaaatgagtaaaagtaaggaaggtgttgatcctgcaaaacaacgtcagtcgcaggagcaggcgaggaggaagaagatgtcaagggcacaggatgggatcttgaagtacatgctgaaaatgatggaagtatgtaaagctcaggggtttgtttatgggatcattccggaaaaaggcaagccagttagtggggcatctgataatcttagggagtggtggaaggataaggtgaggttcgatcgaaatggtcctgcagcaatagccaaataccaagctgatcatgccatccctggcatgaacgaggggtctaatccagttggtcctacccctcacaccttgcaggagctgcaagataccacccttggttcgttattatcagctttgatgcagcactgtgatcctcctcagagaagatttccattggagaaaggtgttccaccaccatggtggcccacaggaaaggaggattggtggcctcaattgggtttgcagaaggaccaaggttctctaccttacaagaagcctcatgatctgaagaaggcgtggaaggttggtgtcctaacagcggtgatcaagcacatgttccctgatattgctaaaatccgcaagctggtaaggcagtcaaagtgcttacaggacaagatgacagccaaggaaagtgcaacttggcttgccatcatcagtcaggaggaagctttggctcgagaactctatcccgatcgctgtccacctttgtcctcagctggtgttagtggaaatttcatgttgaacgacagcagtgagtatgatgttgaaggtgctcaagatgagcctaactttgatgttcatgagcaaaaaccaaaccatctcaatctgttgaacatcagtgctgagagattcaaggagacgatgcctcttcagcaacaatctcatccaaacaaggatgaactggtcacaaacttagacttcagtctgaagaggaagcaagctaatgaacctactgtgatgatggatcaaaagatatacacatgcgagtttcttcaatgccctcacaatgaacttcgccatggttttcaggacagatcttccagagacaatcatcaatttgcttgcctttaccgaagttctacctgttttggagtttcaaactttcagattaatgaagtcaagccagttgtgttccctcaacaatatgtccagccaaagtcatctgctctgcctgttaatcaaggtccaccttcctttgatctatctggtataggagttcctgaagatgggcaaaggatgattaatgagcttatgtcaatctatgatagtgatgtacaaggaagcaaaaggcaaaatagggggaacattgcattgaccaaagagcagcctcatcaacaacctcgtgtccaccaggacaactacctgctcagccaagggataatggacggaaatatcttcaaaaacactaatatttccacaactcagtctatgctcccacaagtcgatccatttgatcaatccaaggctttcaatgcaggctccaacgacaacttccatttcatgtttgggtctccattcaacatacaatctaccaattataacggaaatctacctagcattggatacgataccacaccaaaacaagatgctcctatttggtactagccagccagaagtctgttgacatgttgtatatcaagtagtcagttttggcttcatagatatagcgatttctcatgggtaaaaagatcccatgtactcgtctgcttttttcattctggtggatttttcatcgcctatagtcctcttagttatggtgttttcagttaccatgtgttgtaaaggttgaagaactaggcatggtgtaaacaaacacccctcaaatacttgccaatgcttctcataggacatgtagatataaataagttacttgtttcatcatggccagttttatcagtctctttaaaactgttgaatttataggctatggttaaggtctttactccttgtttaatacttcttctcaagattgtttgggatatcaatgttgttattgttgccatatcttatatgatgtttttctttcattaaaaaaaaaaaaaaaaaaaa

SEQ ID NO: 7355 - DNA, 584 bp, Lycopersicon esculentum
  misc_feature (499)..(499): n is a, c, g, or t
  Predicted polypeptide sequence is orthologous to G976
cctaccaccccacccccctatagaaatctacatatacatacacacacacaaaaaaaaacatatatatatatggctgactctcaaaattctaccaagtccacccaaataattcaacctcctaatcaatcaagtgaaagtacgaaaatacccttcaacactacccttcctccaccactaccaccgttgccgccgcctccggcgccaccggagacacatattcaaataaccaatacattatcatcaaaattagaaaacacaaatacaactccaaaaaccgttattattccaactgcaatcatgagttccacctcatcgagcggcttgggatctccgagccgctcaataggcggaaaacatgcggtattccgcggaatacgatgtaggagtgggaaatgggtgtcagaaattcgagagccacgtaagactacgagaatatggttaggtacttatcctacacccgaaatggctgctgctgcatacgacgtcgctgcaatggctntaaaaggaaacgacgccgtaattaactttcccggtaatattaattcgtatccttcactccctccttcgcccgccgcggcggatat

SEQ ID NO: 7356 - DNA, 1729 bp, Lycopersicon esculentum
  Predicted polypeptide sequence is orthologous to G988
cctctgtccttccccccaggtcccctttttttcctttctctctctcctttatttctcttttcataagcatattctttctctctctagggttttcactttcacctgaaatagtgttgttaaattgaatgatatgttaggatcctttggttcttcatcatctcaatctcaccctcatcatgatgaagaatcttctgatcatcatcaacagcgtagattcaccgctactgctacaactatcaccaccaccaccatcactacctcaccagctattcaaatccgccagctactcattagctgtgcggagttgatttcgcagtccgatttctcggccgcgaaaagactccttactatattatcaactaactcatctccttttggtgattcaactgaacggttagtccatcaatttactcgcgcactttcccttcgtctcaaccgctatatatcgtcaaccaccaatcatttcatgacacctgttgaaacaactccaactgattcttcttcttcgtcatcattagctctaattcaatcatcatatctatctctaaaccaagttacccctttcataaggtttactcaattaaccgctaatcaagcgattttagaagcgattaacggtaatcatcaagcaatccacatcgttgatttcgacattaatcacggggttcaatggccaccgttaatgcaagcactagctgatcgttaccctgctcccactcttcgaatcaccggtactggaaatgaccttgatacccttcgtagaacaggtgatcgtttagctaaatttgctcactcattagggttgagatttcaattccatcctctttatatagccaataataaccacgatcacgatgaagatccttctattatttcctccattgtactactccctgatgaaaccctagctatcaactgtgttttctacctccaccgccttttaaaagaccgcgaaaagttaaggatttttttgcatagggttaagtcaatgaaccctaaaattgttacaatcgcggagaaggaagcaaatcataaccatcctctttttttacaaagattcatcgaggcgttggattattatacagctgtgtttgattcactggaagctacattgccaccgggtagtcgagagaggatgacagttgaacaagtgtggtttgggagagagattgttgatatcgttgcgatggaaggagataaaaggaaagaaagacatgaaaggtttagatcatgggaagttatgttgaggagttgtggatttagtaatgttgctttaagcccttttgcattatcacaagctaagcttcttttgagacttcattatccttctgaaggctatcaactcggagtttcgagtaattctttcttcttaggttggcaaaatcaaccccttttctccatctcgtcttggcgttgagaaaaactatcaaatagccaacttcagagggtaattaagactactgatagtttaggagggatctgaagaaaacgcgtggagtgaaaaccctaaataaccagattttctaatgaagttgtagtagtagaaatttgcatggtgaagaacaatattgaagaggtattgaaatttcatgttttttttgttttacttattgatatgaatgttttaaaatttttaacatagaggactaggttgatgatatatagtatttaagttaactagtctttgtataacgcaagatcttgatcaacttatttttatttttaatta

SEQ ID NO: 7357 - DNA, 658 bp, Lycopersicon esculentum
  Predicted polypeptide sequence is orthologous to G993
gtagttacaccgagcgacgttggaaaacttaataggcttgttattccaaaacaacacgcagagagatatttccctttggttgccaaagtaaataaaaatgataatacttctaaaggggtattattaaatttcgaagatatgaatgggaaaatgtggcgatttcgatattcgtattggaatagtagtcaaagttacgtattaactaaaggatggagtcgttacgttaaggaaaaaaagttgaaggccggagatatagtgagtttcaaacgatgttctggagttgaaatcgaagataaacttcttattgattcgaagaacagaataatacgaggcgaacaagtaaaaatggttagattatttggagtgaatatatgtaaggttcaagatgttagtaataatgttgttgttgagaaaaatatgagtgttggcaaaagaatgagggagatggagttgttggcatttgagtgtagcaagaaacaaagggtaataattgatgccttgtgaatttttcttttgtttgtaattttttttttttgtactttggtttttttagatgttttaatttatataacttccaattgtatattagtgttattaggaaaaaaaaaagggctcaaaaagagagctaatcaactatggtgtaaacatagatgaaaat

SEQ ID NO: 7358 - DNA, 936 bp, Lycopersicon esculentum
  Predicted polypeptide sequence is orthologous to G1006, G22, G28
caaatacctcataaatcactagaaaaaaaaactaaaattcaaagcgaaatggatcaacagttaccaccgacgaacttcccggtagattttccggtgtatcgccggaattcaagcttcagtcgtctaattccctgtttaactgaaaaatggggagatttaccactaaaagtcgacgattccgaagatatggtaatttacggtctattaaaagacgctctaagcgtcggatggtcgccgtttaatttcaccgccggcgaagtaaaatcggagccgagagaagaaattgaatcgtcgcctgaattttcaccttctccggcggagaccacggcagctccggcggctgaaacaccgaaaggaagacattatagaggcgttagacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttggatgtcaaattgaacaattgacaggtgtccatcaactattggtcatttaaaaagccgaatatttctccgaacgcaaaatactatatgatttttccaaatttattgtaaatacgtaatactctatgataacggagaaaatagaaagttgaattggaaaaatattgtgatagggttaatccaaagttgtaaaaagtttcattttcattaatattaatttacgtaattgattgaaa

SEQ ID NO: 7359 - DNA, 465 bp, Lycopersicon esculentum
  Predicted polypeptide sequence is orthologous to G1006, G28
ttgtactaaattcgcttcgatataaaaattcataaccaaaattcaaaatgtattcaaattgtgaactagaaaatgatttttcagtactcgaatcaattagaagatacttacttgaagattgggaagctccattaacgagctctgaaaactcaacatcctcagagttcagccggagcaacagcattgaatccaatatgtttagtaattcatttgattatacacctgaaatttttcaaaatgatattcttaatgaaggatttggatttggatttgaattcgagacttctgattttataatccctaaattagagtcacaaatgtcaatcgaatcacctgaaatgtggaatttaccggaatttgtggctccattagagacggcggcggaggtgaaagttgaaacaccggttgagatgacaactacgacgacgaagccaaaggcaaagcattatagaggtgtgagagtga

SEQ ID NO: 7360 - DNA, 545 bp, Lycopersicon esculentum
  Predicted polypeptide sequence is orthologous to G1006, G22, G28
gcaaatactcataatgtatcaacttcccacttctactgagttaactttttttccggcagaattcccggtgtattgccggagttcaagtttcagtagtctcatgccatgtttaaccgaatcatggggtgacttgccgttaaaagttaacgattccgaagatatggtaatttatgggtttctacaagacgcttttagtatcggatggacgccgtcaaatttaacgtccgaggaagtgaaactcgagccgagggaggagattgagccagctatgagtacttctgtttctccgccgacagtggctccagcggctttgcagcctaaaggaaggcattacaggggcgttagacaaaggccatggggaaaatttgcagcggaaataagagatccggctaaaaacggcgcacgggtttggcttggaacttacgagtcggctgaggaagccgcactcgcttatgataaagccgcttttaggatgcgcggtactaaggctctattgaatttcccgcatagaattggtttaaatgagccggagccggttagagtga

SEQ ID NO: 7361 - DNA, 738 bp, Lycopersicon esculentum
  Predicted polypeptide sequence is orthologous to G1033
gaggcaacgcaccaaatccacacaaacgaataatatccaattctctctagaggtttcatcatgaaaggagctaaatcaaaggctaaagctgataccaagcttggtgtaaggaagaaggctactgagagtaagaaggcgaagaacgctgctaaggatccaaacaagcctaagaggcctccaagtgccttcttcgttttcatggaggagtttaggaagacctacaaggagaagcacccaaacaacaaatctgttgctgttgttggcaaagctggtggagacaagtggaaacagttgtcagatgaagagaaagctccttaccaagccaaggctgagaagaggaaggctgagtaccaaaagagcatggatgcatataacaagaaactggctgctggtgatgctgatgatgagtctgacaagtccaagtctgaggtacatgatgatgatgaggacgatgatggaagtgaagaggaggatgatgattaaacaatcagtaggctgttgaaattcagagaatgatggataagttcatgtaggaattgctcagtccttccttgataaatagatgccctctttttttacattttttgtctagtttttgttctttgagggtttagtttggacagaaaggtgaaattcagatgacttgccttgaaagctcaagtagtttatgtaatttctctattttgctgatgttaatgaaaatttagcttggaaaaaaaaaaaaaaaaaaaaaaaaaa

SEQ ID NO: 7362 - DNA, 887 bp, Lycopersicon esculentum
  misc_feature (61)..(61): n is a, c, g, or t
  Predicted polypeptide sequence is orthologous to G1033
ttttttttttttttttataataataataataataataataataataataatagagaaaaanccaatatcaatcacaaacagtacaataatcaaagcaaggggagatgccacatcacatatcgtcatatatatatatatatatatatatatatatatgagttcacaagagttgagagtttcagcaaactgcaaaactcaactaggtaacagaaaatacataggtttaggtaacagaattacgaaaactattatgtttgaagtgtgcatgtgatggaccaaggtaacggtgcaagccagaaattacatagcttcaatcatcttcctcatcttcatcctcttcgtcttcatcgtcctcttcctcttcttcgccctgtccactgtcctccgcatcttcatcatgtacctcaggctttgaccttttctctttttcttcttctttttcttcttcgtcctcatcatctgagctttccacctgcttattgttataagcattcatgagttttccatactctgccttcctttttgcagctttggcttcatatggtgctttttcagctgcactcaaagatttccacttttctcctccagctttcccgacagcagaaacagccttcacattaggattctcctttttaaatgtcttcctaaattcctcaaggaatacgaaaaaggcactgggaggcctcttaggcttattaggatctttctttgcctttttatcctttgtgaccttctttttggcgtccttcaacgtggcttttctcttccccatctttcggtcctcaacaggcttcaacgccgaccttgtttcttttctcaatgcaccttttccttttccacccttcattgaaacttaaaacagaagaggaagataagaaggtgttggc

SEQ ID NO: 7363 - DNA, 1402 bp, Lycopersicon esculentum
  Predicted polypeptide sequence is orthologous to G1033
tttttttattgcgaaacgaaatcaacattttttttcataatgataagatatgaaaagtaatatctgataacatttctctcagaaacaaaacaacatgaatccaaatttaagaactactatattgagagaaactcagaatttaaccttcgcctgcaaacggtcaattctcaggaatctcaacatcgccatcagaaatctcttgctgcagatcctttggatcctttccatcaacagtgcaaccaacagatacacaagtacctaaaatctccttcactgttccactcaaatccttagccatagatctaggctgcataaccttagcaatctcaataacatcatcaagcgagatatttccattatgcttgatattcttcgtcttcttcctgtcacgttcaaagccccttcttatcctctcttcacaacacacacacaatacacaattcatctcaaagggcaaaaaatatctctttgtttttttctctctcaaccctagaagtttttttttaatcatgaaaggaggtaaatccaaggggaaagcagataacaagctgggagtgaagaagagtgctgcccagactaaaaaagagaagaatgctgccaaggatccaaacaagcctaagaggccagcaagtgctttcttcgttttcatggaggacttcaggaagcagtacaaggaaaagcatccaggcaacaaatctgttgctgctgttggcaaagctggtggtgacaagtggaaacacttgactgatgctgagaaggctccttacatcgctaaggctgagaaacgaaaggctgattatgagaagctaatggacgcttacaacagaaaacaggctggtgaagctgaggaagatgaggaatctgacaagtcaaagtctgaggttgatgaggaagatggaagcgatgaggaagaagaggatgatgactgaagtgctaatgggagggagtaaattggtggggaagctgtgtaataccttagatatttctctatatgatgactccttacttttccccgttaaatacttggctcttttttttagtttattttggggtttcttaggtatgggaaaaagatgaattagatgagagctatctttaaagctcagtggcttatgtactttttattctgatgctggtgttgcttaatgataatgcaactttttaggcaatttgtctttctttttctatatttgtgtagagcttattgtttgtttctattagaacgctcttttttttagtttattttggggtttcttaggtatgggaaaaagatgaattagatgagagctatctttaaagctcagtggcttatgtactttttattctgatgctggtgttgcttaatgataatgcaactttttaggcaaaaaaaaaaaaaaaaaaacacaaaaaaaaaaaaaaa

SEQ ID NO: 7364 - DNA, 491 bp, Lycopersicon esculentum
  Predicted polypeptide sequence is orthologous to G1033
gagaagaatgctgcggaggatccaaacaagcctaagaggccagcaagtgctttcttcgttttcatgtacacatcagaactctgttcttaagatttatggtgacactcagcttcgtaaatcctgatttaataatgttattttcgtggcttggtatattaagggaggacttcaggaagcagtacaaggaaaagcatccaggcaacaaatctgttgctgctgtgagtattttctcttgtcagacctgaagccgagactgattttgtgcttgaaactggtatttgattgagagctgttttctctttgattaatcaatctataggttggcaaagctggtggtgacaagtggaaacacttgactgatgctgtaagtatctgtgttttagctatttttaaaatgctgtatcgagacttagtgatgttgcagtcttgttttagtcatcgagttttgttctattgatattgaattttgtgttgtttgaaatcatgaatac

SEQ ID NO: 7365 - DNA, 391 bp, Lycopersicon esculentum
  Predicted polypeptide sequence is orthologous to G1033
gcctctcttcacaacacacacacaatacacaattcatctcaaagggcaaaaaatatctctttgtttttttctctctcaaccctagaagtttttttttaatcatgaaaggaggtaaatccaaggggaaagcagataacaagctgggagtgaagaagagtgctgcccaaagctggtggtgacaagtggaaacacttgactgatgctgagaaggctccttacatcgctaaggctgagaaacgaaaggctgattatgagaagctaatggacgcttacaacagaaaacaggctggtgaagctgaggaagatgaggaatctgacaagtcaaagtctgaggttgatgaggaagatggaagcgatgaggaagaagaggatgatgactgaagtgctaatg

SEQ ID NO: 7366 - DNA, 187 bp, Lycopersicon esculentum
  Predicted polypeptide sequence is orthologous to G1033
tgaaaggagctaaatcaaaggctaaagctgataccaagcttggtgtaaggaagaaggctactgagagtaagaaggcgaagaacgctgctaaggatccaaacaagcctaagaggcctgcaagtgccttcttcgttttcatggaggagtttaggaagacctacaaggagaagcacccaaacaacaaatc

SEQ ID NO: 7367 - DNA, 1133 bp, Lycopersicon esculentum
  Predicted polypeptide sequence is orthologous to G1048
gggacatccagagatcgggtcccaaaatagtgagtcggaccctagtttcttcaccccacaatctccgtcgaactggcgatgatcgataacatcgatgatatcatcaactgggacgatgtagatcacatcttccacaacgttctagacaatcccgacgatgatcaattcactcttcatgattcctccccacagtcattccagcagatcgagcagcttcttatgaacgatgacgatttcggtcttgtctctgatcctcagtttgctgccgaatctctttctgacttcctcgtcgattctcctcttcactccgatcattctcactctcctgctgaacaagccattggattctccgatcccaaggtttcaagtgccgatcaggacaaacacaaggtttcccagtcgccttctgacggcgacgacgaactaaacaaccatgaccccgtcgataagaagcgcaagaggcaattgaggaatagagatgcagctgtgaggtcacgagagaggaagaagttgtacgttagggatcttgagttgaagagtagatactttgaatcagaatgcaaaaggctggggtttgttctccagtgctgtcttgctgaaaatcaagctttacgcttttctttgcataatagcagtgctaatggtgtttctatgaccaagcaggagtctgccgtgctctttttggaatccctgctgttgggttccctgctttggttcctgggcatcacatgcctgctcattctacccagccaaacctggtcagttccagaagaaagtcagggaagcagaaaccacgggcttctggttccaataaaggagggaaaaaagactagtcggattttgttgttcctgtccttcatgatgagcaaaagatgcaaagcttcaagatcgaggatgaagctcaacccccatcccttgggagttgtgatgtgactcgttgtgatcaaatcttttcccataggtggatcatggttccttttgagttctttagttttttatcagagattctcttgtatgtgtcttgctttgacatctgaaggatgaagttcactgttattagttaatgacttatgagctatataatatctatgcaactttttaatagttccaaccgaaaaaaaaaaaaaaaaaaa

SEQ ID NO: 7368 - DNA, 1400 bp, Lycopersicon esculentum
  Predicted polypeptide sequence is orthologous to G1062
ttttttttttttttttcagaattaatgagtgaatttcattgacatatccaaattttccttgcatatgctttttatacactaaaactgcaggacaattgagaaaactgctagttaatcggttcgctaagtaactgataaatggaagcaaaggttcatggaatagcaaattgtgagttgtaaaacaaaacaacagcctgctggatgaaatatagaaatacaatatgagcataggaaattggctagaacaacaagaagagtctaaagttgaaagttgtggctacattgtttccctttgtcaatcacagaagctcatatcatcccatggcaaccagcggaatccagcagtactgctttgatttgatcaggatgaaagtcttgaccttctttgcattgctcagctctaaagatatctaaggcaaatccattgaagcagctgataacagcttgttggatgtccagtccgaggttgtcgagtgccctcattgttgagagtaagaggcctggtctgcggctgcaaaacatatggatattcacagctcttccttctcttgcctttacttcaacccttgcaggttgtccagtcgggctagacagtgggcttgcaaatgaactcggatagagttcttccttgatgcggcctggcagagctggtccagttggtgttagaggatagaagcttgttgtttgggtcagtgaagagctaggtggcgtggactccagttcattatgcaggtcattgattttctgtaaaagctcctttaagtactcaattgcatcccctaagattgaagccctgtccatcttgctaatccttggtacaacagacctcaacatgtaaagcctatcgtttagcttcttcctacgtcgtcgttcagccatcaaattcttagccggaagtccctttttctttcctttctgattcccacaggtgacagtgctagttgcatttgagctatttccaccattcttaacagtatcatccaccttattagtaacattttcagtaaggtcatctgaatcataactcaatgtgcacccatcaaagctcacatcatcaagttcttccccactaccccactttctcttcctttcattctctccattcatggaattctggccaatttcacctccgaaatcccccaaactgccaccagtagtattagctaagttcttcctaagagcagcccttttctgaaaaagggttggttgtgctccatttgaagcaaaattatcaagtggctttaacaacttggacctattgagaaacagagagttctcatttgcagaaccatcaacaaaccctagtggactaaacccagtagtagtagtattttggggcaaatgggatgatgggtattgagtaaatgaattcaaattggggttacccatttggttatgtg

SEQ ID NO: 7369 - DNA, 414 bp, Lycopersicon esculentum
  Predicted polypeptide sequence is orthologous to G1062
gaagaaaattttagcaacaaggggaataccactaatgttgagcttgaaaacaaacaagatatggaattgggtgcactttctacattcaaatctatgttagatggtacagatgtagattggtatcacaacaacatgcaaaaccatactgaaaatatctgtttcactcagaatttcactgaattagctgaaaacagcatgtttctacagccagtagtaccagtggattcttcatcttcttgttcaccatcttcagtttctgttttcaacaatctagacccatctcaggtacattacttgttagcccaaaaggctattaacaacaaccctttggattatagttttaatttgggttgtgaaaatggttttcttgaagctcaaggtatgggtggtttgaataaagggggatttcttctt

SEQ ID NO: 7370 - DNA, 517 bp, Lycopersicon esculentum
  misc_feature (504)..(504): n is a, c, g, or t
  Predicted polypeptide sequence is orthologous to G1062
tgatacccttgacatgccgaggtctgttgtaccaaggattagcaagatggactgggcttcaatcttaggggatgctattgagtacttaaaggagcttttacagtatcatccaccttattagtaacattttcagtaaggtcatctgaatcataactcaatgtgcacccatcaaagctcacatcatcaagttcttccccactaccccactttctcttcctttcattctctccattcatggaattctggccaatttcacctccgaaatcccccaaactgccaccagtagtattagctaagttcttcctaagagcagcccttttctgaaaaagggttggttgtgctccatttgaagcaaaattatcaagtggctttaacaacttggacctattgagaaacagagagttctcatttgcagaaccatcaacaaaccctagtggactaaacccagtagtagtagtattttggggcaaatgggatgatgggtattgagtaaatgaattcaanatggggttaccca

SEQ ID NO: 7371 - DNA, 625 bp, Lycopersicon esculentum
  Predicted polypeptide sequence is orthologous to G1062
gctctttccctcttggttatgcgcggtgaatctgattgtatgttggcagatggacagggcttcaatcttaggagatgcaattaagtacttgaaggagcttctgcatgacatcaatgagctgcataatgagttggagtccacaccagctaacaactcttcattgagtcccgcaaccagcttccatcctctgacaccgactgcatcagctctgccaagtcgtataaaggaggaacttgttccaagccccctgtccagccctactggacaacctgctaggattgaagtgagggtcagggaaggaaaagcggtgaacattcatatgatctgcagccgcaaaccaggggttttactctcaacaatgaaggctctggacagtcttggactggacattcaacaagctgttatcagctgcttcaatgggtttgtgttggatgtgttccgagctgagcaatcgaacgaaggtcaagagatgcatccagatcagatcaaagctgtgttgatggagactgctggctttaaggggggacgatataagctgctcgatctagtatacgaaggagaggctctatcgaagattttggacctcagggtgctatagcttttagacctcaagactttattagtt

SEQ ID NO: 7372 - DNA, 591 bp, Lycopersicon esculentum
  Predicted polypeptide sequence is orthologous to G1062
gtaaatggtcataaatactatgctttattaggagtgtcaaagtttattgtatggaaacaacatggtacttgaattttagcactatcatgcggaaacattttactggagccctaagaaaccaagacgtaggaagttatctttgatagaccgtgatgctgaaagttatctacctattagttaacatttgcgtcttacttgagaatttaatcccaaacaaccattggacttgattttaatcttcctgactacctaatataaaaagcttcttcttggcatgcaatttatgaatacgcatgttcacagatggacagggcttcaatcttaggggatgcaattgagtacttaaaggagcttttacagaaaatcaatgacctgcataatgaaactggagtccacgccacctagctcttcactgacccaaacaacaagcttctatcctctaacaccaactggaccagctctgccaggccgcatcaaggaagaactctatccgagttcatttgcaagcccactgtctagcccgactggacaacctgcaagggtttgaagtaaaggcaagagaaggaagagctgtgaatatccactatgttt

SEQ ID NO: 7373 - DNA, 491 bp, Lycopersicon esculentum
  Predicted polypeptide sequence is orthologous to G1062
taacaatcatcacatcaacaacaacaacaacaatggtggtggtggtggtggtggtagcaacatgcagagccacatttcttactctacaagtttcactgaagctgaaaacagtttgcttctgcaacctgttgattcttcagcttcctgctcgcctgtttctggtaacgttttcaacaacattgacccttctcaggtgaacttcttcatgccccaaaaatctactattccttcttcactcactgggttatccaacaacccaatggataacagcttcaatttgggtatgttgaatcaagctgggaacgggatgatgaatactgggtatcatcatctgggttcaccaaaccaaatggggacgaacaacctgagttcttatactcagttttcttctcccaatctgctccagctacctcaggtagctggtgggtacagttcgatgggatttggggctaacaattctgctaatgggaacactttgttttctcaatcgg

SEQ ID NO: 7374 - DNA, 534 bp, Lycopersicon esculentum
  Predicted polypeptide sequence is orthologous to G1067, G2156
ggtgaatctgacagtgatgctggtgcaagttctggaggcggagctcccaatcgccgtcctcgaggccgtccgcctggatctaaaaataagcccaagcctccaatcatcgtgacgagagatacgcctaacgcactccgatctcacgtgcttgaagtttcgaccgatgttgatatcatggaaagtatctccaattacgcaaggcggagagggagaggtgtttgtattcttagtggtagcggcacagttaccaacgtcaaccttcgtcagcctgctgcaagtgtagtcacactccacggacgtttcgaaatacttagcctctcaggtacggtgcttcctccgcctgcaccgcccgcctccagtgggatctctatatttttatcaggtggacaaggacaagtggttggaggatccgttgtagggcctttgatcgcatcaggtccagtcgtcttaatggctgcctcttttgctaatgctgtatttgaacgacttcccttggaggaagatgatgaggctcctgctaatgttcctactaca

SEQ ID NO: 7375 - DNA, 557 bp, Lycopersicon esculentum
  Predicted polypeptide sequence is orthologous to G1076
aatatatacctattttcttactcatgctcattaattaatttcccttataattaatcatatatcatagtttattataccttagttttctgttcactacttttgttattgttatcgttatcgttatggctggtttggacttaagttccgcttctcatcatcgttttctccctcgtcatctccacgatcctcaagacgatgaaatcaatcgcaacaacactcaattttccgatgatgacaacaacaacaacgataacaataacaataatagccccggggtagcacgtagacctagaggtcgtcccgcggggtccaaaaataagcctaagcctcccgtgatcataacacgggagagcgctaacgcgctccgtgcgcatattttagaagtgagtagcggacatgatgtctttgaatcagttgctacttatgctagaaaaagacaaagaggaatttgcatactgagcgggagcggtacggtgaataacgtcaccatacggcagccacaggctgccggttctgtggtgacgttacacggaagattcgagatattatctttatcc

SEQ ID NO: 7376 - DNA, 861 bp, Lycopersicon esculentum
  Predicted polypeptide sequence is orthologous to G1078
cggaatcagaaaaaggttggtgaaaacaagcagaactatgcagcccaccatttgaataactgggagagtgaagctgagagagaagaggtacagtgcagcgagtggggagatcacgatcattacagtactacaacttcatctgatgatgacgacgatgaagaagaagaagtagaggaaaaggatgatataagatctgggtatgggccatcccgatcgaatttcgggtctactgcttccgtgaagaaatctgataagatgtcggaggacggtgggtcgtcttcgatgagttgggggaacggaaatgggaaagtggagatggtatctgatagaagtatagtggtgaggcacaaggatctagcagagattgttgctgccattaaggaacactttgataagactgcttctgctggtgagcaggtgtctgagatgttggagacaggtcgagctcagcttgaccggagctttaagcagttaaagaaaactgtgtatcattccggtggagtttttagcaccataagctccacctggtcttcaaaacctccattggcggtcaagtatcgttttgaacctagttctattgatgaaggtgggcaaaagagtctttgttccaccttggagcgactcttggcatgggaaaagaaactgtatcaggaagtgaaggcgagggaaggagttaaaattgagcatgaaaagaagttggcaacattacagagtcaggaaagcagaagtgatgacatagccaagttggacaaaaccaaggcctcaataacaaggttgcagtcactgatggtggtcacatcgcaagctgtttccactacgtcctctgccattattggcctaagggactctgaccttgtcccg

SEQ ID NO: 7377 - DNA, 641 bp, Lycopersicon esculentum
  Predicted polypeptide sequence is orthologous to G1078
gcttgttgaactttgtcatggatttatgtacatgtggaaatccatgaaccagttccatcaagttcagaatgacattgtgcagcaggtgcgtggcctcatcaacagagaaattaaaggtcaatcgacatctgacctacaccggcaggcaactcgtgaccttgagtctgctgtatctgcatggcactcgagttattgtcgcctgataaaatttcaaagggactttatccgatcccttcatggttggttcaagctcacccttgtatctgtcaatactgagccaactaatggcaacagggagttctcagattcttttatgttttgcgatgagtggaagctagcacttgaccgtattcctgacactgttgcatcagaagctatcaaaagcttcataaatgttgttcattcgatatatgtgaaacaaacggaggagttgaagatcaaaaagcggactgaatctgcatcaaaggagcttgagaaaaaggcttcgagtgtcaggaacattgaaaggaagtattacaattcattctccatggttggcattggacttcctgatgggggacctgataatggtaatattttagatgtacgagaccctcttgctgagaaaaagctgagcttgcagctagccaacggcgtgtgga

SEQ ID NO: 7378 - DNA, 375 bp, Lycopersicon esculentum
  Predicted polypeptide sequence is orthologous to G1078
cactttcatggcattttttcttcttcttcaccgtctccgcccatcgccgtcgcaacttctttagctccatagcaacaccagtaactgcgccgccggaatagccaccgtcaacggcggagacccatttgattttttttttttgatatttaacgatgggttgcgcggcgtcgaagctagataatgaagatactgtccggcggtgtaaagaccgccggcgattgatgaaagaagctgtttatgctcgtcatcacttagcagcagctcattctgattactgtcgttcacttcgtgttacgggttctgctttatctacctttgccgccggtgaaccactttctgtttctgatcatactcctgctgttctctccgtacgtc

SEQ ID NO: 7379 - DNA, 693 bp, Lycopersicon esculentum
  Predicted polypeptide sequence is orthologous to G1078
gctcttagaaagaaagaaaaaaaaaagaggaaaaaaacatcctctttcactgacacagttatactatattatttttttctctctctttttcttgttttgttgtttgagaaattttctttgtttgcagaggaaatggctatggctctgctggttaaggccaagtgggtattcccaatacttgcttttttacctaaaaacctctttctatgtttcaatgggttgttctgaaaccattcttaaaagggacatttttcgacttgttgtttctctctacagtagaatctgtgttcaaaaaaggaacttactttaatcccttttcacccccccacacatccctccaagaaagcaccttttttcaagaatctcctattttttgcaaagctgagtagggggaagaaatggggtgtgttgcatccaagttagaagaagaagaagaggtagtatccatatgcaaagagagaaaacagtacctgaaattggctgtagataggaggtacacactggctgatgcacattacaagtattgtcaagcattgtatggagtctcagcagctttaaaactctttgttgctcgtcattctacacctacttctccatatctcatcacattcccaccaccttgttgcccttcttctccaaaaaaagagtgtgtggtttcaaaccccttgtttcttcagcaaacaccttctgagc

SEQ ID NO: 7380 - DNA, 543 bp, Lycopersicon esculentum
  Predicted polypeptide sequence is orthologous to G1084
ccattacaggggagggagtgggttgaagcactaactgacattgaagaccattttgtcaaggcatatgatgctggaaaggaagtatcaaggatgttagaggcaaattgggtacattcacagcctaatttgggagaacccaaagagaactcaacaaaaatcatcccagcaattacttggaagtctcctgcatctcgttcaccatcatgcaagagtcttgtggcgtctagttccaagagttcttccacatggacagaattcaagaatgatctatttgatgattatggtggaatgggttctgggagccatttgctgacgctaggaaggctgtatgcttgggagaagaagctgtatgacgaggttaaggctggagatagcacttggaaattatatgagaagaagtgcaatcaactaaaaaatcatgatgccagaggagatgaaggacggaccgcagacaaaaccagagcagcagtaaaagaattatatagcaggatcctagtcacaattcgaagtgctgagaccatatccaaaagaattgacgaacta

SEQ ID NO: 7381 - DNA, 432 bp, Lycopersicon esculentum
  Predicted polypeptide sequence is orthologous to G1084
gagaagttattaaggatcttgaaagtcagtttgtgattgcttgtaattctgctaaagaggtgtcaactgttttagaagctatcagggctcagtactcattgcaatcgagtgatcaatcagcgatgaaaatgttgaatccagtagctctgtttcgctcaggatcatcaagatcatcctcgtcgagatttttgattaatccttcaactttaagagatgagggttatcatagcagtagtgacttatccgatgaatctagcgtgctctcaagcagtcatcaatcaaccttggatagattatatgcctgggagaaaaaactatatgaggaagtcagggcaggtgagcggatccggctagcctatgagaaaaaagtggctcaactcagaaatctagatgtgaatggagcagacccttcgtctgtggataaaacgagag

SEQ ID NO: 7382 - DNA, 507 bp, Lycopersicon esculentum
  Predicted polypeptide sequence is orthologous to G1089
ctgcctttcttcatgaagtaaaactctcggtctgaagaagaagaaacactacctcatatccataaacccttgaaaagaatatatctttctttacccaaaaccaaattaagatggtgcaaaaaaaagtcctcaacaaacttagtatcaaaactgatcatattataaaagccaacaaccaaataatgaaccacaaaccatctttccctatgttacaaaaccatgaaaccatcaagaatagaaaagctgaactcaagaaaaagatgatgaagaaatcaggcaaaaccaaactcttagaatatgaaatctccaactcaccaaaaaatttcagaaaatatgtacctcaaccaggcaaaccaccccctagtactactaactcatcaacgacaccaacgaagcgtcagcatcagcaacagcaacagcaacaacagcaatcaacatgtactccaaattatatgaaggccacaagcagttctgttgcaagaaaagagcaatctcaggttagttcaa

SEQ ID NO: 7383 - DNA, 500 bp, Lycopersicon esculentum
  Predicted polypeptide sequence is orthologous to G1090
gtataacatcagaatatagaggtgttagaaagaggaaatggggtaaatgggtgtctgaaatccgtgagccagggaaaaaaacgaggatatggctagggagttttgagacagcacagatggctgcagctgcgtatgattcagctgcatttcacttcaggggacatgcagctaagttaaatttcccagaattgattgaacatttccctaaaccagcaagttcttcgcctgaagatatacgtttggctgctcaacaggctgcaattacagttcaaaacacgaattcaatggcctcttctagtcatggacatggagcaccagttacagtaggattatctccaactgaaattcaagctattaatgacttccctatggattcaccacatatgtggactactcatgaagacatcaactatacttatgaaatgagtgattaccaagaaatggatgattgtctttgggactactcatcaactaactcattctagaggcctaatatatta

SEQ ID NO: 7384 - DNA, 1580 bp, Lycopersicon esculentum
  Predicted polypeptide sequence is orthologous to G1133, G1137
gtctctctataattccctctgcttttactctcttaccatcaaaaaaattcaaaaatctctctgggtttttaattatactcaatttgggttttgtttctgcgattttcattcactgagctttgagagttggtgaaaagcacagaaaaacagtagtcttgaggttattgtttaaattgaggaacagtatgctgtgttgttgtctatctgttgatgtttatcgaaaagtcatctccttgaacttgtactgtcatgtaattctgtagaagtaggaaaaaagaagagtttatttgtgaaatcttgattagtttttcagtttttgaaccttgggaaattgtattcttgttagtaatcttccatgggatccacacatttcattgtcataccgtgttatgttctgaggattagctgagaatctattcctcttcagaatacttagttttactggtgttgtctttgttgttgaatcggggattatcggggatattagttttcactgttgctagttaattttgggtgtggttatctttgtcatttcttctaaaaagtagattgagttaattgcgcggagtagtattgttttccaagcattttttggggggagttgtttgaaatcactggtgtttttgattgttctggtggaagattgtggttgaagggttggaacaagtagttatggtgtgccaagcagctggccagacaagatttcgggcattaaaacatgaaaatggaattgcggggtgtgccaccataattgttagagttatagcatgctttcaacctcttcaggattgccaggctgaatatttccgacagttgttgaaacctgtcacgtagtttcgtctttcttgttgttgcatcttagttaagctggatttttttggattttctgttgtttctcaagtgtacaaggaataatctgcaatttgtattacctgagttatttagaactggtgattgttgtggttgaatggaaagagactttgtatcgtggttccgtcgccagtatcctgatctgcaatctgcccattcgaacttttctagtcgtggactcaatattgggcagcagaattctgttcctatttacatgcctccgtatgcaaatgaggttccagtaaaagggagttctcccttgtcgttttcggggttgctagaaccaaaggcaagccaaccaactgaagctcacaattggttctactgtttaccacagttgcaacagggttttgctcctgttttgagcactgtaccgaacgagaagtttgctcctcagtctgttgacaattacggggtaaatgaagaagccaatgctggccccggattctcgcagaaaagatttcttgtttttgatcaatctggtgatcaaacaactttactttacagttctccaaatggtactcctgtgcaatgcctaccctcttggcatccaaaatccgctgcaccttgtcatctgattaaggaaggccaacagattttagggaacggaatttgtccatctgggaaatactccggtggtgaatattatgaagaaaatcatagagatgatgtataaagtgaattgcatgaggatactgacaaattgaatg

SEQ ID NO: 7385 - DNA, 944 bp, Lycopersicon esculentum
  Predicted polypeptide sequence is orthologous to G1133, G1137
gttttattgagtgaaacggttgggaacaagtagttatggtgtgccaagcagctagtcagacgagatttcgggcattgaaacatgaaaatggaattgatgggtctgccaccataatagttagagtaatagcatgctttcaacctctccaagattgccaggctgaatacttccgtcatttgcttaaacctgtcacgtagatcgatctttctttaccgcgttcaagttaagctggagtttttagtttttctttatttagcaagagtgcaagaaataatcagcaatttgtagtttcacagttgtttcaaactggtgattgttaaggttgaatggaaaaagacttggtctcttcattccatcaccaacattcagatctgcagtcagcccatttgaatttttcttatccacgatttgatatagggcagcagaattcttttcctacttacatgactcctcagtcaaatgagattcctttaaatggggattctccatatttcacatttcctgggctgccagtgtcaaatgcaagctggccagcagaaacttgcaattggttatattattcgcctctgttttatcagggctttaatcctgtttcgaccactttacctaaagagaagttagctcctagagcacttgaaaatctggaaggtagcaaacatcctaatggaggcaccacatctactcagaagagattccttgtgtttgatcaatctggtgatcagacaactttgatctataattctgctaatggtactcacgtacaatgcccggcttctctgaatccaaaagccccagccctttataaggaagatccagagatcaaaagaaatgaaacttctccatttgggcatttcttcggtgatgaatattatgaagaaaacaacagagatgatgttgaaagtgaaatgcatgatgatactgaagaactgaatgccctactctac

SEQ ID NO: 7386 - DNA, 571 bp, Lycopersicon esculentum
  Predicted polypeptide sequence is orthologous to G1133, G1137
gatgatgttgaaagtgaaatgcatgaggggactgttgaactgaatgccctactctactctgatgatgattacaattattccgaggatgatgaagaaacaagcactggtcactcgcctagtactatgaccactcatgatatgcgagagtgttttgacggaaggggtgaagaagttgctagttctgctggggtgactaaaaggcataaactgctagatggtagctacgatgcaccagagctcagggatactgcaacctccgcaaaagcctatacgtgctccgacttagaggatgatgcacaatccagttgtggcaatggtctcgaacaagactcaggagcaccagattctccatctgggaaaaagaggctaagaaaagataaaatccgcgagacaataagcattttgcaggaaataatccccggagggaaaggaaaagactcaatggttgttattgatgaagcaatccattacttgagatccctgaagatgaaagccaagtccctaggacttgattctctttgagcttcagcttgccactggtcatcatattgagttactaatggtatttttc

SEQ ID NO: 7387 - DNA, 851 bp, Lycopersicon esculentum
  Predicted polypeptide sequence is orthologous to G1134, G2555
gccagtttggactatctttctccatccgttgatgtttcgcagtccgctaagcgaacccgagacgatgattccgaaagttcccccagaaaattagtatcccagttgaaaggagagtcaagtgggcagttacatggttctggtgggtcactggatgctgaaatggagaatctcatggatgatttggtgccttgtaaggttcgagcaaagcgtggctgtgctacccatcctcgcagcatagcggagcgggttcgtcgaacgcgtataagtgacagaattaggaagcttcaggaactggtgccaaatatggacaagcaaaccaacacagccgacatgttggaagaagcagtcgaatacgtcaagtttctgcagaggcagattcaggaacttacggagcatcagaagaaatgcacgtgctcaatgaaagatcaataatgagaagaagagagctccactagagtatataggcaatagtttggttagttgcatgcagtttagaaatggtaattcactcctatatatcctattcttcttcatgtgtagatattaatggaaatttgcaagagctttgctactttagaatccagagtcagctttggcttttaattattaaatttaggttgtacacttttctggtgcagttgtatcatgttgtatatgtagtgtcaatttgcttaatagtcaaatttttgcagcagaaacacttccctttctgaagatgtaatcatgatttgcagatccgtcatgttaaaatcaatataaatcgttgcatcagtgtgaagtttaataaaaaaaaaaaaaaaaaaaaaaaaaaaaaaaaaaaaaaaaaaaaaactcgagggggggcgcggtac

SEQ ID NO: 7388 - DNA, 385 bp, Lycopersicon esculentum
  Predicted polypeptide sequence is orthologous to G1136
gctcaaggacttggacctagacgtgcaccacgctagtgtttgcgtggtgaatgatttgatgatccaacaagccacagtcaaaatggggagccggctttatgctcaagaacagcttaggatagcattgacatcaaaaattgctgaatcgcgatgaaattatgtccctagtgagctatgtataatgttatcttctaatgagcgagaattttcttctctgtatataaatgtgatgaaaccaatactagagatctcgagttgaggctttttagttcatgtaagattagatatatatatatgatgcagcttcatccttttgtattcttcatccaggaaataaatgagaaaccaataattggtggctgagaaaaaaaaaaaaaaaaaaaaa

SEQ ID NO: 7389 - DNA, 618 bp, Lycopersicon esculentum
  Predicted polypeptide sequence is orthologous to G1136
tacgcgcttagagctgttgtaccaaatgtgtctaagatggacaaggcatcactccttggagatgctatttcctatataaacgagttgaaatcgaagcttcaaaatacagagtcagataaagaagacttgaagaagccaaatagaagaatttaaagaaagaatcaaggcgccccggtcctcctccaccaccaaatcaagatctcaagatgtctagccacactggaggcaagattgtagacgtggatatagacgttaagatcatcggatgggatgcaatgattcgtatacaatgtaataaaaagaatcatccagccgcaaggctaatggcagcgctcatggaattagacctagacgtgcatcatgccagtgtttcagttgtcaacgatttgatgatccaacaagccacagtgaaaatgggtagcagacattacactgaagagcagcttagggttagcgttgacatcgaaaattgctgaaacacactaaaccccttagaaaatagatagaaatcgtcgagggccatgtttaaattaaaatctctggtttctgctagctctaggtaatggtttttgtaaatgaaggtttgagatattaagacgaagactatctttcgtgtta

SEQ ID NO: 7390 - DNA, 866 bp, Lycopersicon esculentum
  Predicted polypeptide sequence is orthologous to G1140
aaaaaaaaaaactcctaatggctagagaaaaaattcagatcaagaaaatagataactccacagcaagacaagttacattttcaaagaggagaagaggtttattcaagaaagctgaagaactttctgttctctgtgatgctgatgttgctctcatcattttctcttctactggaaaattatttgactattctagctcaagcatgaaacaaattcttgagaggcgtgatttgcattccaaaaatctggaaaaattggatcaaccatcacttgaacttcagcttgtagaaaatagcaactactccagattaagcaaggaaatttccgaaaaaagtcatcgattaaggcaaatgaggggagaagaacttcaaggactaaatattgaagagttgcaacaattggagagatctcttgaaactggattgagccgcgtcatagagagaaagggtgataaaataatgagagagatcaaccaactccaacaaaagggtatgcatctaatggaagaaaatgaaaaattaaggcaacaggtgatggagatatctaataataataataataataataatggatatagagaggcaggagtagtaatatttgaaccagaaaatggatttaataataataataatgaagatggccaatcatctgaatcagtaacaaatccatgtaactcaattgatcctcctcctcaagatgatgatagttctgatacttctctcaaattggggctaccttactcaggctgaagagatcaaaagcaaggtgtggctatttttgtatgttattagaagaaggagaaaaaaaaaagtaactactaattattataattaattaatgtctgattaatgtaaaagctaaccccaaaa

SEQ ID NO: 7391 - DNA, 621 bp, Lycopersicon esculentum
  Predicted polypeptide sequence is orthologous to G1140
ggtgaatagtacttattccatctccaaaattaggtcttacatatttctatactcaattattggcccatttttgtataggttttctaactagatctaaagttttcctcttttattagggtttcttacaatttcttactatttatatcttttgtgagatttcttagaaagtttgaggaaagataattagcttcttcgacctgttaaggatggcaagggaaaagataaaaataaaaaagatagataatataacagcaagacaagtaacattttcaaagaggagaagagggctttttaagaaagctgaagagctttctgttctttgtgatgctgatgttgctcttatcattttttctgctactggaaagctatttgattttgccagcaccagcatgaaggatattcttggaaagtataaattgcaatcagctagccttgagaaagttgaccaaccttcccttgatttacagctagagaatagcctcaacatgagattaagcaagcaggtagctgataaaactcgtgagctcaggcagatgagaggtgaggaacttgaaggattgagtttagaagaattacaacaaattgagaaaagacttgaagctggtttcaaccgtgtgcttg

SEQ ID NO: 7392 - DNA, 2257 bp, Lycopersicon esculentum
  Predicted polypeptide sequence is orthologous to G1146
gctgcaagaattcaggattagtctgaacacgtgatgtgtcatctacaccggtgtctgatgctgaccgtgtgaagatcaaaaaagcactgagaggtgtgaaggtggaggttactcatcgtggaaatatgcggcggaagtaccgcatcgccaatttaacatctcaagcaacaagagagttaactttccctgttgatgaaaagggcactttgaaatctgtaattgaatattttcgagaaacttatgggtttgttattcagcatacccagtggccttgtctgcaagttggaaatcagcagagacctaattacttaccaatggaagtctgcaagattgtagagggacaaaggtactcaaagcgcttgaatgagaaacagataactgcacttctgaaagtgacctgccagcgcccccaagaaagggagcgtgatattcttgagactgtgaagcataatgcctatgctgaggacaaatatgcgaaggagtttggcattaagattagcgacaagttggcacaagttgaggctcgtattttgcctccaccttggcttaaatatcacgataatggccgagaaaaagattgtctgccacaagttggccaatggaacatgatgaacaagaaaatggttaatggaggaactgttgccaattggatctgcataaacttttctcgcaatgtgcaagacactgttgcacatgggttttgttctgagcttgcacaaatgtgtggaatatctggaatgaacttcaacccgaatcctgttctgcctcctgtaagtgcacgccctgatcaggttgagagagttttgaaaactcgatttcatgatgccatgacaaagctgcagccgctatcgaaagagcttgatctcctggtcgctatcttgccagacaataatggctctctttatggtgatctgaaacggatttgtgagactgaccttggagttgtttcacagtgctgtttgacaaaacatgtatttaagatgagcaaacagtatctagccaatgtagcactgaaaattaatgttaaggtgggaggaagaaacactgtgctagttgatgcaatatctaggcgaattccccttgtcagcgaccgtcctacaatcatttttggtgcagatgtcacccatccccaccctggagaggactctagcccatccattgctgcggtggttgcttctcaagattggcctgagattactaagtatgctggtctagtttctgctcaagcccataggcaagagcttattcaggatctgtacacaactaggcaagatcctgttaaagggactgtgtccggcggcatgattaaggacttacttatctccttccgaagagctactgggcaaaaacctcagagaatcattttctacagggatggtgttagtgaagggcaattttatcaagttcttctttatgaacttgatgccatacgtaaggcatgtgcatcattggagccaaattatcagcctccagttacatttgttgtggttcagaaacgtcatcatactagactttttgctaacaaccaccgtgatagaaatgctgttgatcggagcgggaacattatacctggtactgttgttgattcgaagatttgccacccaacagagtttgatttctatctttgtagtcatgctggcatacagggtacgagtcgtccagctcattaccatgttctatgggacgagaacaagttttcagctgatggactgcagtcattgacaaacaacctgtgctatacatatgcaaggtgcacacgctcagtctccattgtccctccggcctattatgcacatttggcagcttttcgtgctcgtttctatatggagcctgagacatcagacggtggatcagtaacaagcggagctgctggcagaggggttggtgcaggagctgctggaaagaatacacgagcaccaggtgcaggttctgctgttagacctcttcctgctctcaaggataacgtgaagagggtcatgttctattgctagagtctcaacaaacaaaagcttcattgaagacttcatttggcgcatgcccttttggtttttgtgttttgcgatcaaacaaaattttatctggttcgacttgccctaatatttgtgacattgatgccagaaaactatttagagtttgtagtattgcgcattattataactgttgggagcattccggtgttcttcatagcctgtgtaatgatgaatactatgcaaatttatgcttgtttttaataaaaaaaaaaaaaaaaaaaaaaaaa

SEQ ID NO: 7393 - DNA, 971 bp, Lycopersicon esculentum
  Predicted polypeptide sequence is orthologous to G1146
tttttttttttttttttggatggacgtttgagtaaaatatcataaaatactgaatgtacgaaaaaggaacagagtaaaatataattgaacatttactgtcagctgtgatcataacttcgtcacacaacgtgcagttgcaaaaagcataaccatgatctgtaaagcccacagaccaacttaaaaaaaaatagtttaacataaaagaagatttctactgaatacttcttcagcagtaaaacatgacctccgacacattttcatgaatcttaggaagttgcctgaattgtgctgctgctcctccctcaccaccttcattagcagctcttacatccacgtcattctccatgtaatagcgtgcacgaaaggcagctagatgtgcatagtaggcaggtggtactaaggaaactgatcgtgtacacctaacgtacgtgtagcacaggtagttcgttacattctgaatgccatctgcggtgaaattgttctcatcatacagtacatggtaatgcgcaggacgactggtacccttgatcccagcgtggctacataagtaaaaatcaaactcagttgggtggcatatgttggtgtctaccacagtacctggcaaaatatttccactcctgtctgtcaaagtacgatcatcatgattggaagggaatagacgtgtatgatgtcgcttctgcactaccacaaaggtaactcgtggcatataatcactttgcagggcaacacatgccttgcggatcgcatccatttcttccaataaaacctgattgaattgtccttcgctgactccatctctatagaagattattctgtcaggcttaatttttgtcgcggcataaaacgctttcagcaggtccattatcattccaccgcgaacaacgccccttttagaatcttccttctccgtgtacaagtccataatgatctcttgcctatggggctgtccagaaacaatacccctatatttc

SEQ ID NO: 7394 - DNA, 1335 bp, Lycopersicon esculentum
  Predicted polypeptide sequence is orthologous to G1146
tcgatctgttgatcgtcatattgcccgacaataatggctccctttatggtgatctaaaacgaatttgtgaaactgatcttggcattgtctcgcaatgctgcttgacaaaacatgtgtttaagatgagcaagcagtatttagccaatgtgtcccttaaaattaatgtgaaggttggaggtataaacaccgtgcttgttgatgcgatctctaggcgaattccccttgtcagcgaccgcccaactattatttttggtgcagatgtcacccatccccaccctggggaggattctagcccgtccattgctgcggtggttgcttctcaagattggcctgagattaccaagtatgctggtctggtttctgctcaagctcataggcaagagcttatacaagatctgtacaagacttggcaagatccaactagaggaactgtgactggtggcatgataaaggaattgctgatttccttccgtcgagcgactggacagaagcctcagagaataatattctaccgagatggagttagtgagggacagttttatcaagtgcttctttttgaacttgatgcaatccgcaaggcttgtgcatctttagaacccaactatcagcccccagttacgtttgtggtggtgcaaaagcgtcaccacacaaggttgtttgccaacaaccaccgtgatcgaaatgctgtcgatcggagtgggaacattttgcctggtactgtggttgattcaaagatctgtcaccctactgagtttgatttctatctctgtagccatgctggcatacagggtactagccggccagcacattatcatgtcttgtgggacgagaaccaattttctgctgatgggctgcagtctttgactaacaacctttgctacacatatgctaggtgtactcgttctgtctccattgttcctccagcatattatgcacatttggcagctttccgtgctcgtttttacatggaaccagagacatctgacggtggatctgtcacaagcggagctgctccgtacaaaggtggtgtaggagctgttggaaggagcacaagggcgccaggtgttggtgctgctgtaaggccccttcctgctctcaaggagaatgtcaaaagggtgatgttctattgttagaagtcctctctaaccaggctatatgatatggacatgctggagtaatttcttttcaaattgtatgtgattatctcaccttgatgtttatgaaagttcagttgtcagttaaacagtagtttattcgcaagtgatgtttgtaaattgtggcttgaacaattgttattgaagagcatggctagttatttaaaaaaaaaaaaaaaaa

SEQ ID NO: 7395 - DNA, 961 bp, Lycopersicon esculentum
  Predicted polypeptide sequence is orthologous to G1146
ggtgggccttctaggccaccaattcccgagctgcaccaagcaaccacacagactcaacatcaagctgtaatgactactcagcccattacttgtggaagaccagctgacacatccatggaagtgggttcctcatctgagccacctgagatgtcagctctgcaagtgacacaacagttccagcaactggctgtgcagccagaagcagctgcaacccatacaattccacctgtgtcaagcaaatcactaaggtttccgctgcgtccagggaagggaaagtttggtcagagttgcatagtgaaagccaatcacttctttgctgagctgcctgacaaagacttgcatcagtatgatgtcaccattactccagaagtatcttcacgaggggtcaaccgtgctgtcatggcacagctggtgcttctttaccaagaatctcatcttggaaagagacttccagcttatgatggaagaaaaagtctatacactgcagggccccttccatttgttcaaaaagagttcaaaatcactcttactgatgatgaggatgggcctggtggtgccaggagggatagggaattcaaagttgtgatcaaattcgcttcccgagccgatcttcatcacttagggatgtttttagaagggaggcaggctgatgcaccccaggaggcgctgcaggttctggatattgtgctgcgtgagttgccaacatctaagtattgtccagtaggtcgttctttctattctcctaatttagggagacgacaaccattgggagagggtttagagagctggcggggtttctatcaaagtattcgccctacacaaatgggattatcattgaacatcgacatgtcttccacttccttcattgagccattgctggtcgttgattttgtggcacagcttctgaaccgggatgtgtcatctagaccactgtctgatgctgaccgtgtaaagatcaaaa

SEQ ID NO: 7396 - DNA, 634 bp, Lycopersicon esculentum
  Predicted polypeptide sequence is orthologous to G1146
ggttgtcatgaaaattgcatgactgacggcatggtcaattggtgtttgcaattggtatatactcctatatcactcttctgtaggcctagtcctttactctgggtctatgagtttgctggtaacttgttatcatgcagactgggattagctttgatagcctaaactgagcccaagttgtagtgacttctggctttctgggactccaagacattgtctgcatgtcttgcatagtttgtaattactttttagaaattcagttgtcgtaagatggctgatggattttggtgcgaacaatggctttcccaaaggacagaaatgctgaaactttgaatgaaggctaagtgtttgcagtagaaaacttaattcatgtattgcgatgcatggaattgagtaagaagaatgaggacaatgttgtcaatcagatgaccatggacttctattttcatgaaatctgaacacactgaaacagagaaactataaaaagttaagtgaggaaagacggcacgtgagaactgaatcagggattttgatgaaagctagttttacttgatcaagaaaaaattaactggataaagataagaggctttctgaagaataataaaagcaggaaagtgtgagttatatattaattact

SEQ ID NO: 7397 - DNA, 898 bp, Lycopersicon esculentum
  Predicted polypeptide sequence is orthologous to G1146
gacgcagatgggattatccctgaatattgatatgtcttccacagcattcattgagccactgccggtcattgaatttgtgagccagcttctgaatcgggatatctcttctagaccattgtctgatgctgatcgggttaagataaagaaggccctgagaggtgtaaaggtggaggtcactcatcgtgggaatatgaggaggaagtaccgcatatctggtttgacatctcaagcaacaagagagttgactttccctgtagatgaaagaggtaccatgaaagctgttgtggaatactttcgagaaacgtatggttttgttattcagcatactcagttgccttgtcttcaagttggaaatacacaaaggccaaattatttgcctatggaggtctgcaagattgtggaggggcagaggtactccaaacgcttgaatgagaggcagataacagcacttctgaaagtgacctgccagcgtcctcaagagagagagaatgatattcttcagactgttcgtcacaatgcttattcagatgacccatatgcgagggaatttggtattaagattagcgagaagcttgctcaagttgaggctcgcattttgcctgcaccttggcttaaataccatgatacaggtcgagaaaaagactgtctaccacaagtgggccaatggaatatgatgaataagaaaatggtaaatggaggaacagtgaacaactggatctgtataaatttttctcgcaatgtgcaagacagtgttgcccggggattttgttctgagcttgcacagatgtgcatgatatcgggcatgatcttcaacccgaatcctgttttaccaccagtgagtgctcgccctgatcaagttgagagggtcctgaaaactagatttcatgatgctatgacg

SEQ ID NO: 7398 - DNA, 498 bp, Lycopersicon esculentum
  Predicted polypeptide sequence is orthologous to G1146
tttttttttttttttttttaacctggctataatgctaaactaattaccattaattgaaaataaagccgctttacatcattaaaactaacatgacaattaacctaggatgatcaacatacatttacaaacaaagattcatgtggtctgaactgaaccccctacttactatttgttacatttgctactcacttgttatctcttcttcctaacaataaaacatcactctcttcacattttctttaagagcgggcaatggcctaacacccgtctctcgtatagccttgctgctgccttgatgagggctgcctgaattagtttcaggcatgtctggttccatgtagaatctggctcgaaatgcagctaaatgtgcataatatgcaggaggaaccacagagacagaacgtgtgcatcttgcatatgtatagcagagattgttagtcaaggactggattccgtctgctgtgaaattgttttcatcccacagaacatggtaatgtg

SEQ ID NO: 7399 - DNA, 634 bp, Lycopersicon esculentum
  Predicted polypeptide sequence is orthologous to G1146
ccggtaaccttcatagttgtccaaaaacgtcaccacacacgtcttttgccaaataaccacaatgacagaaatcaccacctgaccaggagtgggaacatcctacctggtacctgtggtggatacaaaaatatgtcatccaactgaattcgatttttatttatgtagtcatgctggaattcagggaactagtcgtcctgcacattatcacgttctctgggatgaaaataatttctccgcggatgaaatgcagtctttgacaaacaacctttgttatacatatgctcgttgcactcgttctgtttcagtagttcctcctgcatattatgctcacttggcggcctatggagcgcgtttctacgtagaaccagactcacgtgacaacggttctatacgtggcacacgtgcaacgaatggttctgtcaacgtccggccgctaccagcattgaaagagaaggtgaagaatgtgatgttctattgctagagggtgaatgttgagtttatgttatatagtagtagtgagtagataaaatgtatgaaattaggatatgaaatgttatgggtatgatatacatcataattagagtcaataaattataatttaattttcatgcaataaaaaaaaaaaaaaaaaaaa

SEQ ID NO: 7400 - DNA, 445 bp, Lycopersicon esculentum
  Predicted polypeptide sequence is orthologous to G1146
gctttatgatctttcttgtttgttgttcattagggtaccagtcgtcctgcgcattaccatgtactgtatgatgagaacaatttcaccgcagatggcattcagaatgtaacgaactacctgtgctacacgtaaagtcttttgaactttatttacttggaattagtatatctttttattatctcaaatcatataatcatcatctttttttcatctcacaggtacgttaggtgtacacgatcagtttccttaggttagttttcgcctacttggtggttttaaaaatttgtctgttttacagttactgaattatttgcacaacttattatggcgttatttacacagtaccacctgcctactatgcacatctagctgcctttcgtgcacgctattacatggagaatgacgtggatgtaagagctgctaatgaaagtggtgagggaggagc

SEQ ID NO: 7401 - DNA, 1184 bp, Lycopersicon esculentum
  Predicted polypeptide sequence is orthologous to G1198, G1806, G558
gatggatgcaatgggtgatagcgaaggccataggattgtgagctctactgcgttgtggaggggtgaccgccggccagcccaaattgtccaggtatcgcagttggagcaggacattgaacgagcacctcaacagggagaaagtgggcccgtagcatttgatacagattatattcgatggttagaagaacacgacaaacacatcaatgagttaaggaacgctgtcaaatcacatgcacgtgatcctgaactgcgaagaattgcggataatgtcactgcacattacgatgaggtctttaggatgaaaggaaatgcagccaaggcggacgtagtccatgtcttgtcaggcatgtggaaaacccctgctgagcgttgttgtatgtggattggtggtttccgcccctcgttactgcttaagcttctagtcaatcagttagatcctctgagtgagcaacaagtagctgactttaacaacttgcagctgtcatcccatcatgctgaagttgctctctcacaaggtatggaggcgctgcagctatcattgggggagacattagccatgggatctccatttactgaatcagggaatgtagctactacttatatgtgtcaaatggcaatggctatggggaaattaatgactcttgaagattttctccgtcaggcggacagcctgcgtcaactagtattgcaacaaatatatcgcatactgacaaccagacaatatgcccgtgctcttcttgcaataaatgattacttctcaatttttcgggttctcagctctatttggctagccagaccacgagagcaataagcacaaaaaccattgcagtattctgctgaaattcggacactactttgatacactggccagtatatgagatgcagctaagttgctatattttgaagtggtggtactgtatgtgccttgtggaagtacaaaatttgtttttcaaagtatagagaaatttagcaggggtggttgtcatttagatagttttcccaaagtggtgtatattgtgcttttgttccacttctttttgtgtggggtgaaacatttaattttgttgaattaaccttctggactctctaatatatcttgtgatattattttctgtacgaattgtaagaacaattgcttaattttatttttcaaaaaaaagttgatgtaaaaaaaaaaaaaaaaa

SEQ ID NO: 7402 - DNA, 1585 bp, Lycopersicon esculentum
  Predicted polypeptide sequence is orthologous to G1198, G1806, G558
cttgggcataactctacccaaaaacctagttcattcggtgagagttgctgaagaccatataaagaaggtcccctatttaattctacatctgcagctaatccagcagtgggatttgacgtctctgggaccatcaataggaatttagctccttcaaatacaagtttgtctactgctgctccaggatctcatgtaatacaattgcaatcaaacttagttcctgcagctggcactcatcctgagaattggggcgagtccaacatggcagattctggttctcgcactgatacttcaactgacatggatggagatgatagaaatcaaaggattgagacgggtcaatccagggctattgcagcttctgattccagtgacaaatcaaaagaaaaagtcttggatcagaagacattgcggagacttgcccaaaatcgtgaagctgctagaaaaagtagactgaggaaaaaagcatatgtacaacagctggagaatagccggttgaagctatcacagttggagcaggaccttcagcgagcacgtcaacaggggaagtacatctcaaacatggcagatcaatcaaatggagcgggcgccagtgggaccttagcatttgatgcagaatatagtcgatggttagaagaacacaacaaacacatcaatgaattgagaaccgctgtcaattcacatgcaagtgaccctgaactgcgaagtattgtgaataatgtcactgcacattacgatgaggtctttagggtgaaaggaaatgcagccaaggcagacgtattccatgtcttgtcagggatgtggaaaacccctgccgagcgatgttttatgtggattggtggcttccgcccctcggaacttcttaagcttctagtcaatcagttggagcctctgaccgagcaacagttagctggcatttacaacttgcagcagtcatcccatcaagcagaagatgccctttcacaaggtatggaggcgttgcagcaatccttggcagagacattagctaacggatctcctgctactgaagggtcatcaggagatgtagctaattatatgggtcagatggcaatggctatggggaaattagggactcttgaaggttttctccgtcaggcggacaacctgcgtcaacagacattgcaacaaatgcatcgcatattgacaaccagacaatcagcccgtgctcttcttgcaataagtgaatacttctcacgtcttcgagctctcagctctctttggcttgccagaccacgagagcaataagtatgacatgcattgcgatattctactgaaactcagatatactacttcgatacactggccggtatatgagatccagcaaagttactcttatgtataaagtggtattgtatgtgcttgtggaagtgcagaatttgttttctttctccttaggtttatagaatgccaaaattttactttgtgacttaggaaccaataatgtacctgtgtttttagttttacaaggaaaaagtttagggatttttaagaagtgtaatagatatttttagaaagttttatgcttaatcaaattatagcttgtgactaaaaaaaaaaaaaaaaaaaa

SEQ ID NO: 7403 - DNA, 1614 bp, Lycopersicon esculentum
  misc_feature (1558)..(1558): n is a, c, g, or t
  Predicted polypeptide sequence is orthologous to G1198, G1806, G558
gcttcttggaaataagagatttgacactttgtgaccaaaaagtcaaaattggctggtaagagagagaaggagagctgacaaggtataggacgtcatcccattttagcaactttcacctgcttctcatctgggtacttccggcactgcttgatttattgatttggtgattctaaacttcagttgatttctcactgattcactgaaaagctgagggacacagaagggctaaagaaattgaagggggaaaaaaccccaacagaaaattacaagatttgatgattctattgtcttattttagctttctggcaaagcttgagccttttgctatagacccttttcgtttcttgaactaagatactacatctgatttgtgttccaatttcaattgattatccacaaagttggctatagtccacgatggctgatatcagtcctagtacatcaacagatgccgatactgaagataagaacaggttcctaaatcaacaactgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggcaacagggaatatttatttcaggttcaggagatcaatcgcagtcgatgagtggaaatggagctttggcatttgatgtagaatatgcccgatggttggaagagcagaaccgacgaattaatgaattaaggggagctgttaattctcatgctggtgatgctgaacttcgcataatagtcgatggaatactggcacactatgatgacatattcaggataaagggggatgcggcgaaggctgatgtttttcacatattgtcgggcatgtggaaaactcctgcagaaagatgcttcttgtggcttggtggattccgttcatctgaactactcaagctgctcattaatcagttggagcctttaaccgaacaacaattattggcgatcaacaacttacaacagtcatcccaacaggctgaggatgctttatcccagggaatggaggcattgcagcagtctttggctgagacactcgcagggtctcttggaccttcaggttcctctgggaatgttgcaaattatatgggtcaaatggccatggcaatggggaagcttggaactcttgagggtttcatacggcaggctgataaccttcggcaacaaacattgcagcaaatgcatcgcatattgacaactcgccaatcagctcgtgctcttcttgctatcactgattatttctctaggcttcgagcactgagctctctctggcttgctcgtccccgggaataacatccgctttcttctaatacactactctaaagacccttggtaacatttgtaaatgagaaacctctttgttggaaagctgagctgctgagttttaatggatacatatatttatataatggtatttgtaacattgtttcatatttaactaagatagtgtgtgatcagngaattgttgttgtattttagtatatctaatggttccagttaggttaatggaaatga

SEQ ID NO: 7404 - DNA, 1071 bp, Lycopersicon esculentum
  Predicted polypeptide sequence is orthologous to G1198, G1806, G558
gggggtttcggccatccgagcttctaaaggtactcacaccacatcttgagctcttgacagaacaacaactccgggaggtttgtaacctcaggcaatcgtgtcagcaagcagaagatgccttatcacaaggaatggtaaaacttcatcagattctcgctgaggctgttgcagctggtcaattaggtgaagggaattactctcttccgcagatggggcctgccatcgagaagttggaagctcttgttaggttcgtaaatcaggcagatcatctccggcaagaaacacttcaacagatgtcccgcatcctgaatacgctccaagcagctcagggcttactcgccttgggggagtactttgaacggcttcgtgttctaagctcacactgggctactcgtcttcatgagccggcctaatgaagctatagaagatccctcaatacaccattcgacgagttttgccttcagaaactatactatgtaagctaaaatttagctcttgtttatgtcaataaagctctcaatatgaatataggacattatactagttgtacaaagggtctccaagagtctattgtggcttatgtttccgagcaacttttgaacgcgttggagatgagaaattgatatgtatataacatacgtcgagcaatggcatgactaatatcatgttgtgatttctcgtgagaatgttttttcgaagatttgcatctaaatatttacttttacaggttttggttaggaaagagtgttgctcacttagagagacagatccaggatttgaacttaatgagttcagcctcgcaatgaactcatacaagtaaaattatggatttgatccaagtacgtttgttgagttttttactaggttttaagttttaatcgtatacatatatgaactccgtgacgaaaattatggaccgtgtcaaaagttatggattcagataaacatcgtagccaattggctacgtccgttttgctcgcttggtaattggtagggtgtgcataatcaagtcgatcgaatgttatgtttgtgccatttcttataagtattattatctcactatgtttttgc

SEQ ID NO: 7405 - DNA, 1065 bp, Lycopersicon esculentum
  Predicted polypeptide sequence is orthologous to G1198, G1806, G558
ggagagaactagtctcgagttttattgtttttctctgcctctaaattccatttcttttttttcctttcttctttgtataatttcataattcagttttaattattttgaaaaactccaatttgtagaagagtttctttgtacttatgaacagtcaatgaacatgagttctacatcaactcagtttgcccccacgagaaggatgggcatattcgaaccattccaccatatgagtatgtgggaagacgcgtttagaggtgatattatgcccagtgttggtgcgtgtatgatcacaccggcaaatgacagggcagatgacaagtcgggatatacttctagtgaccaacttataccatctggctctgaggataatcaagcaggaaagagtatttcagacaaggtacaacggcgtctagcacagaatcgtgaagctgcacgtaaaagccgtatgaggaaaaaggcttatgttcagcagcttgaaaaaagcaatttgaagctagcacaacttgaaatggaacttgagagagctcgacagcagggactatacattttaggttcaaatggtaatatggggctaagttcaacaattaatccaggaatagctgcatttgaaatggaatatagtctctgggttgaagagcaacaaaaaaagaacgtagagttgaggaacatattgcaatcccatgtaagcgaaatggagcttcagttgctggtagaaaccgtcttaaaccactactacaatctattccgaatcaaagctgatgctgcgaaagctgatgtgttttacttgatgtctgggatgtggagaacttcggtggagcgttttttcctctggattggaggattcaagccatctgaactcataaatatcgtgatgccacagcttgagccattgtcagatcagcagatcgtgaaaatctgtaatctacgacactgttgtcagcaagccgaggatgctctcactcagggaatggataaacttcagcaaactctggcacagaacatcctaactatgaccactggaatgggaagttacagttctcaaatggtttctagtatggaaaagtt

SEQ ID NO: 7406 - DNA, 420 bp, Lycopersicon esculentum
  Predicted polypeptide sequence is orthologous to G1198, G1806, G558
tggctccgcaccaatcagctcagggtctccttgccttaggagattactttaaacgtcttcgtgctcttagctcactttgggctggacgtctttctgaacctgcttaaagaggtaagaaagaacctgtgggttttcaactttgccaatcaaagctgtgtgagctaagtaacaagtatgagttggcgctcatttgaaatgtgtatataagttctggtatgctgtaattgaaacattttcttttgttatcacattggttttgatgattgtaaatcaatatggtagaggttattgttactccaagttgtgcctctctttgtctatgatgggagccaagcaattttgaatgctttgcagatgtaacaaaatgagccaatattttattgtgcaaaattaaattcatgtttgcaatcaaaaaaaaaa

SEQ ID NO: 7407 - DNA, 841 bp, Lycopersicon esculentum
  Predicted polypeptide sequence is orthologous to G1198, G1806, G558
gcagtttcccagatagcttgattcttgaagtcgagaattgcctcgagaatgagatgcctattatggagaaaagactagagaatgagatagaggaaccatcacaagtgacagttggaacgtctaacagatatgaacctgaaacaactaaacgtattgataaggtgcgtagacgccttgcacaaaaccgggaggctgctcgtaaaagtcgtttacggaagaaggcctatgtccagcagttggaaaatagtaaactgaagctgcttcagctggaacaagaactagaacgtaataaacaacagggtttgtatgtcagggatggtttagatgctagtcagataggttgctctggaaccgcaaattcaaatagcttcttttgaaatggagtacggccattgggtggaagagcaagatagacaaacagatgatttaaggaatgctctgaactcccaaatgggtgaaatagaattgcgcattcttgtcgaggattgcttgaatcactattttgatctctttcgcttgaaagctacagccgcaaatgccgatgttctctaccttatgtctggcacatggaagacatcagctgagcgcttcttcttgtggattggggggtttcgcccctccgaacttctaaaggttctcacgccacatgtggaaccattgtcagatcaacaaatccaggaggttagcaacctcacccagtcttgtcagcaagcagaagatgcgttgtcccaaggaatggtaaaactccatcagattcttgctgaggctgttgcagctggtacactaggagaaggagttatccttccacagatgactgctaccattgagaagttggaagctc

SEQ ID NO: 7408 - DNA, 792 bp, Lycopersicon esculentum
  Predicted polypeptide sequence is orthologous to G1198, G1806, G558
ggcattgggaaatgtgcagcattttgagaattggggtgattctggtagtgcagaccatagccagcagactgacacttcaacagatgttgatactgatgaaagaaaccatcagggccaaggtgttcagcatggtgcattaatagctgtggactccatggacctgtccaaagtaaagcttggagaccagaagacacttcgcaggctggctcagaatcgagaagctgctaggaaaagccgattaaggaaaaaagcatatgttcaacagctggagaatagtaggctcaaactgtcacagttagagcaagagttaaaacgagcccgccaacagggcatatttattgctaatggatatgcaggagatcagagtctttctgctggtggaaatggggcattggcatttgacatggattatgcacgttggctagatgaacatcaacgacttatcagtgatctccgatcagctgtaaattctcacaggggcgataatgaactgcgtcatctcgttgatggagtaatgtcacattatgacgaaaaattcaagctaaagagtgtaggtttaaaagcagatgtttttcatatgctgtcaggcatgtggaagactcctgtagagaggtgtttcatgtggttaggtggatttcgttcttctgagcttctcaagattcttggcaaccatcttgaaccgtttacagagcagcagctcataggcatatgtaacttgcaacagtcttctcagcaagccgaggacgcgctatcacaaggtatggaagcccctgcacaattactcattgatac

SEQ ID NO: 7409 - DNA, 834 bp, Lycopersicon esculentum
  Predicted polypeptide sequence is orthologous to G1198, G1806, G558
ggacgagcactagtgacactatagacgagctatgacgtcgcatgcacgcgtacgtaagcttggatcctctagagcggccgccctttttttttttttttttttttttttttttttttttttttttttttccaaccaatatagacgctggatagtccttccagcattaatgtacttgtattcttattgctaatacaattgcacaatatgtcaatcatgaatccatgataacttacaagttaaatgcaagctttaccctaacttgtacaacactgaagcgcaatatgagaccagaggatgttaatacaacttgtacaaagagaactgaccctccagccatttgcaaatgcgttgcgagtttgcagccagcagccccacatttacagatcggcccagggagggactccaacgggggtgatgcttcttttgcggcctagcgagccaaagagaacttagggcgcgtaacactgaaaagtagttcgtttattgcaagaagccccccagcggctttgccaattgccaggaagccttgcatttgaagcaaggtttgttttcgaaaattggtaacccgacaaggaaattttcagggggccagttttccaagggccatggcatttccccttttggttggcacgtttccgaaaccccgtggcccaaggaccctcccgtttttgcaaggtttgtgaattgttcatcctttaacaagattctatcttgtgggggttgtggaaatggtccctatatggttttgttggggtaagttttaaaggggtggatttgaaagtggggagtttttttgaaaatccctttgagtcgatttaaaaaaccctcttagaa

SEQ ID NO: 7410 - DNA, 597 bp, Lycopersicon esculentum
  Predicted polypeptide sequence is orthologous to G1198, G1806, G558
gcaaaattataacaagttgggatggttgcacatcatgattatttttttgtttgtttggttatatcaagaattgtaaatattaggatttttctgccattaatttgattcaaaattgaatcttgataagattttcttttatcttcttctcacaaaattgaatccatttgggttttttcagttgagctgagattttgctgtttggcctttaaaagtctgtacaaatgaattcttcaacatacactcagtttgttgcctcgagaaggatgggcatatgtgagccgatccatcaaattggcatgtgggatgatttcaatgctagttgtccgagtacatcgacaaccatgattctagaagttgagaaatgcctagaggaccagataccgatgatggacaaaagattagacattgagacagaagatacttcgcatggaacagtagggacttctaatagatatgaagcggaaacaagtaaacccatcgagaaggtacttagacgtcttgctcaaaaccgtgaggctgctcgtaaaagccgtttgcggaagaaggcctatgttcagcagttagaaaatagtaaattgaagctgattcaattggaac

SEQ ID NO: 7411 - DNA, 296 bp, Lycopersicon esculentum
  Predicted polypeptide sequence is orthologous to G1198
tctactatttattagtctctttgcttctgaagaaaaattggcctttattcaagatgatctttaaattgaggtaagatcaagaatagtttgaaaattagttattatttgcatggagagtcaaagaattggagatacaacaagtacttcgtcaattgatcatcacatgccttataatacaagtttcatgtatcattccacactaaactttatatggagcatgcataaacagacctgcagcaactctggagatgttcccttcttggcccactaaagtgcatgacaccctaagaggaagc

SEQ ID NO: 7412 - DNA, 569 bp, Lycopersicon esculentum
  misc_feature (286)..(286): n is a, c, g, or t
  misc_feature (471)..(471): n is a, c, g, or t
  Predicted polypeptide sequence is orthologous to G1198, G1806, G558
gattatacatgttaggttcaaatagcaatatgggactattaggaacaattaatccaggaatagctgcattcgagatagaatacagtcactgggtggaagagcaacaaaaaaagaacgcagaattgcggagtatattgcagtctcctgtaagcgatatggagcttcagttgctagtagaaaatgtcttaagccactatttcaatctctttcgcatgaaagctgatgccgccaaagctgacgtgttttacttaatgtctggggtgtggagaacttccgtcgagcgctntttcctctggattggaggattcaagccatcagaactcataaatgtggtgatgccacaactcgagcccttggccgatcagcaaatcattaaagtgtgtaatctgcgacactgttgccagcaagctgaagatgctctcacacagggaatggataaacttcagcagactctggctcagagcatcctanatatgaacacgggagctggaaattacacttcccaaatggtttcttctatggaaaaattagaagcattggagagctttgttaaccaggcagatcacctt

SEQ ID NO: 7413 - DNA, 600 bp, Lycopersicon esculentum
  misc_feature (36)..(36): n is a, c, g, or t
  misc_feature (88)..(89): n is a, c, g, or t
  Predicted polypeptide sequence is orthologous to G1228
gtatgattgacgccacccctggttggaactcggtgnggttttttttttttttttttggtgcgtttgctgattggagcttcgttgctcnngggtagatctcgacattcgcgggggggtactttttcccgccagtagtggttgtttgttgaactggaaacctggtggattgtgggttgtgtgggggttaagcttgattgaaggtcggtttgttggctggagaaatgggtttaggtggttataggctcgtaatgtgtggggctaggcaacgctttattggacataatctggaaaaaggagatcttctcaatacgaaacttgtccatgattactaaaataggaaaaagggttcttggatactatggggctttctaactttcgctgcatgcctcatgataattggctttgcgaacatggtttttagatgtttggatgtttaaatttaatgcgtttacacccctattggtctagcctatacaaccttgtattgctacattggcatcccaaaaaatggtttctagccattccttgcttttatagccaagaattcgggcagctaatttaattccaatgggcccaaaaaaacttttttgggaaaaaggt

SEQ ID NO: 7414 - DNA, 242 bp, Lycopersicon esculentum
  Predicted polypeptide sequence is orthologous to G1246
ccatctctcaaaacttaaacttcaaccaaagtccaaacacacataaacatacttttttttatataacaacaataaaaataataataaatctagggttataatattatatggatccccatcttcatcaccatcaacatcatcttcaacaacaacaacatcaatttagtcatcaaagtgtgaatattgatacaacaagtggaggtgttaatattggaggaggaggaagagatcaatttccgaac

SEQ ID NO: 7415 - DNA, 573 bp, Lycopersicon esculentum
  misc_feature (557)..(557): n is a, c, g, or t
  Predicted polypeptide sequence is orthologous to G1249
tgaagaaggaacctccaccgttgccggagagacccaccaactccaaattccgataagccgagtgaagaaaatcatgaaactggatcaggacatcaacaagataaactcagaagccctatatctcatcgctagttccaccgagcttttccttgaattactagcagaaaaatctgcacaagtagctttggagaagaagagaaaaacaataaagctcgagcacttaagagttgccgtaaaaaggcataaacctacgagtgatttccttctcgattcgcttcccatgccttcacagccgttggatcggtctccgaaggttcaaagtcgtcctcgatcatccacagataatccacttccttccggaactcgaagaattgaggccttttttcaaaagtgtacttaaaactctgcgtttacaatctatttccagtagttgtgtgaaatagttattcacattcagtgtagggcttgtgattataatttgaaaagatatggttgatttccctagatctatatcatgcattgccaatctatgatatttgagacattagttgctgatncctaaaatatatcatg

SEQ ID NO: 7416 - DNA, 910 bp, Lycopersicon esculentum
  Predicted polypeptide sequence is orthologous to G1266
ttttttttttttttttttttaattctctgatagagagcgcttttttctttattaagcttcagaataatcgaatcgatgaattccgaacactacatgaactatacacatgtagtgagtgagtgagaatgaaaacaaaatagaagcaatttttatgtacaaacaagtagaagaatataattctaattagaggaagtactcgtcaaaagttcctctaacaattcagcacccaaatcttcaaaaaccaaaacatttctcttcttcctatttctcttatgtttaacacgtctcattttatttgttgcctttaaaacagcagctggtgaaatcccatcttcacaaatatacttaatattttcaagtgattctcttactttgtccattggaaaatttaaaagtgccaatggacctctcattgtaagtgcagcttgatcatacgctaaagcagcttcttcacaagtattaaatgttcctaaccaaaccctaatcccatttcttgttgaatcccttatttccgctgcatattttccccatggtctctttctaactcctatgtagtgtttggtggagttattcttatcatggtgatgagacgtgacctcttcgatttcatgacgattattgctttctttagaggaattcgtatcgtttgaggatgaccaacttcttggtaattgatgtaggttggaggaggaaacttcccgtctataactttctttcgaggttaagaatgaacaagtacttcctggtagagaatgatcgttgttttggtcgatgttagtcaaatattcatctaagaaatgttgatcattccatggtaatgatgattgatcttggaagaaattgaaatttggatattgagttttaggggatgaagattccattgtatattataagaaattggatattattg

SEQ ID NO: 7417 - DNA, 844 bp, Lycopersicon esculentum
  Predicted polypeptide sequence is orthologous to G1266
ctagtattcctttatgttaaatacctcattaaactataacattttcccccaacaaattaaccaaaatcccctctaataaaagctatggttccaactcctcaaagtgatttacctcttaatgagaatgactcacaagagatggtattatatgaagttcttaatgaagctaatgctctaaatattccttatttaccccaacgaaatcaattactccctagaaataatattcttcgtccattacagtgcataggcaagaaatacagaggagtacgacgtcgtccgtgggggaaatacgctgcggaaattcgcgattcggctagacatggtgcgagagtatggctaggtacgttcgaaactgctgaagaagctgcgttagcttatgatagagcggcttttagaatgcgaggtgctaaggcactacttaattttccatctgaaatagtgaacgcctctgtttcagtagacaaattaagtttgtgctcaaatagttacactacgaataataattcagattcaagtttaaatgaagtttcaagtggaactaatgatgtatttgaatcaagatgttaaaacagagctgtgcatggagaatttcttggcactctaagcgaataatgtgtggacacgtagaaaatatttctatttatgtaagaatcaactgaactattaaaatttcgttgttgtatttatattatgtgcttgcctcttctcttattttccttatggaattgtttgcagcgacgcacgctataatctcatgtaaaaagattgcttaggatactttagtagtatgtttataagttgtaatatacaccttctattttctaaaaaaaaaaaaaaaaaa

SEQ ID NO: 7418 - DNA, 914 bp, Lycopersicon esculentum
  Predicted polypeptide sequence is orthologous to G1266
gacaacccaaaaacaaaaatcaaaagatgtcaagcccactagagatagatacttcattttcacattccaatttgttgtttttggaagatgaatcatcatggattaatactcatgatccatttgttgatattgatgaatatctaccaataattataccatgtaatgatgaagaaatagtagtagaatcctcaaacgctagtactacaacaacaacaacaacaacatcaaaagtagcaagtatccaaaatattcatcatgatcaagaagaggtaacatccatagagaaaaaacatgaagatgatcaagaaaaacattatattggagttagaaagaggccatggggtaaatatgcatcagaaattagggattcaacgcgtaatggaattagggtttggttaggaacatttgatactgctgaagaagctgctttagcttatgatcaagccgcattatcaatgaggggtccttggtctctactcaattttccaatggaacatgttaaaaaatctcttgaaaatattgagtattcttgtaaagatggattatctccagctgctgttttaaaagctactcataaaactagaagagtcaagcacaagagaagtagtagaaagaagaagaatgagaatttggaaaatgtttttgtttttcaagacttgggagttgaattattagaagagcttttaatgacttcatcataggaatgtttattatattcttcgtgtcgaaaatactaagttcagttttcgtgggagataataatcaagatcgcaatgtacgagtctcttttttttctttttttttttatttggtctggatttcttgaagaatttagagtttagtttcaagaagagcttttgatgagttgaaataatgtctcagacttgttttggtacaaaaaaaaaaaaaaaaaa

SEQ ID NO: 7419 - DNA, 408 bp, Lycopersicon esculentum
  misc_feature (300)..(300): n is a, c, g, or t
  Predicted polypeptide sequence is orthologous to G1266
gcaccagataaaatatcatcccctgttaagcaagaagtttcctcaatctctcatgtatatataagtcttttagtcattgattgagcttcaaacttccaaataagaatagtccaatcatatagtaaatcaaatggattattcatctcgggatgatcttctttttcactataattcacttccatttaacgttaacgatacacaagacatgttactttataatcttgttgctgaaggatcatcgcaagaaacagtgaattcgtcgtctagctatggaataaaggaagaggaagtgacctcatntgaagaagaaagaaaagataagaattacagaggtgttagaaagaggccatggggtaaatatgctgctgaaattcgtgattctacgaggaatggtgttcgtgtatggct

SEQ ID NO: 7420 - DNA, 1292 bp, Lycopersicon esculentum
  Predicted polypeptide sequence is orthologous to G1272
ttttttttaacgaaaaatgatatttgatgccttactttcctatgtaaactgaatgttgagaagccctttgaattacatatgtgtatacaaacaagagaagagtaaattgagtggtggaaatacaaattgtgagatttgttccaccttattctcattttagtttacaaatatttagattggagaaaacagtaaattaaataagagcaacatatttacaactgttggacatcaaacgcagttgtgagttcaaggcagtggccgtcaatatctcgttatagagcttcagtgcgcactcaatctcctaaagtggagatgattgataacatatttaaaaaagtttcagacactgatgatgatgggattatgagggaacttttgctagatttttatgtgagttccgggaaaaggaagcctgagcacattatagtattcagggatggtgtcagtgaatctcaatttaatcaagttctaaacatagaactggaccagctcattgaggcctgcaattttctagatgagaagtggtcgcccaagtttgttatcattgttgctcagaaaaatcatcatacaaagtttttccagtctggatctcctgataatgttccaccagggacaattatagataacaaagtttgtcatccaaggaacaatgacttctatctgtgcgcccatgctggaatgattggtacgactcgacctacacattaccatgtgttgttggatgaagttggtttctcacctgatgaacttcaagaacttgttcataatctgtcctatgtgtaccaaagaagcactactgctatatccattgtggctccgataagttatgcccatttggccgccacacaggtgggtcaatggatgaaattcgaggatgcatcagagacatcgtcaagccatggtggtctgactaatgctggtccagttactgttcctcaattgccccgtcttcaggagaacgttgctagctccatgttcttctgttgaggcctgtgcaccacctcctgttttactctacgcggttaatgtatgctctagacaaatggtttctgtaaatagctctagtttgacagcacttggagtacgaaccttgtcctagtgacctcccaaaaacaacttagttatgcggtacaatactaggtctgttgccatattcaggtctcatgcatatttttcgcgcttctgttctcctgaacaattttgctatgtatctgtaaaatgcataaagattaacctggtggtgtgactatgcctccaaaaaaaaaaaaaaccaaaaaaaaaaaaaaaaaaaa

SEQ ID NO: 7421 - DNA, 634 bp, Lycopersicon esculentum
  Predicted polypeptide sequence is orthologous to G1272
ggtcagagttgacaaaatgtttgaagagatccagtcaaaacttcctggtgcccccaagtttcttctctgtcttcttcctgagaggaaaaattgtgacatatatggtccatggaagcgaaaaaatctggctgatcatggtatagtaactcaatgcttggctcctggaagagttaatgatcagtatctcacaaaccttctccttaagatcaatgctaagcttggtggtttaaattctatgttagctgcggagatttctccttccatccccatggtatctaaggtccccaccatgattcttggaatggacgtatcacatggctctcccggccagtctgatgttccatcaattgctgcagttgtgagttcaaggcagtggccgtcaatatctcgttatagagcttcagtgcgcactcaatctcctaaagtggagatgattgataacatatttaaaaaagtttcagacactgatgatgatgggattatgagggaacttttgctagatttttatgtgagttccgggaaaaggaagcctgagcacattatagtattcagggatggtgtcagtgaatctcaatttaatcaagttctaaacatagaactggaccagctcattgaggcctgcaattttctagat

SEQ ID NO: 7422 - DNA, 966 bp, Lycopersicon esculentum
  Predicted polypeptide sequence is orthologous to G1272
tggacttctataggacaagtaacaggcataagccagctcaaattattgtcttcagggatggcgtcagcgaatcacagtttagtcaagttctgaaccttgagctagatcaaatgatcaaggcatacaagcatcttggtgagggcggcaaccctaagttcaccttgatcgtggctcaaaagaatcaccatacaaaactatttcaagctaatgcagttgataatgtaccaccaggtactgttgtagacacaaatattgtgcatcctagaaataatgattttttcatgtgtgcacatgcggggatgattggaacaactaaacctgcacattatcatgtattgcttgatgagattggtttcgcacctgatgtcctgcaaaatctcatacattcactatcatatgtgtaccaaaggagtaccagcgcgacctctattgtggctcctgtgcgttatgcacacctagcagcacaacaattcgggcagtttgataagtacgaggaccactccgaaactttgtcagaacagggaagtgtcaaatcaattgggactactccggtaacccaactgcccaggctgcacaagaatgtcagcgactcaatgtttttctgttgaaaattgtaaagcttttaaatgcatatgctgtaaatccttagtagtttggtagtatagtacccggctccaaattttgtcgaggccttcggttagttaagtgctttaaggtcgtctaacaaggatcatgcttcgagtttgttttatttttttgacgtaattaagatagaaatttccccatttaaagggcatagaattttgggcgttgctccatttagctattttagaagttgaactgatttttgtatagtcaaagtttgtctaagtttggcgcttgatttgttaaaccgctggtctctttttagagtttaaatgactcagaaataggagtttgtgtaaaaaaaaaaaaaaactccagagt

SEQ ID NO: 7423 - DNA, 857 bp, Lycopersicon esculentum
  Predicted polypeptide sequence is orthologous to G1272
gtccagcattggttactccattatgacgtgaggaagtctctgatgcatcttcaaacttcatccactgtcccatttgagtagcagcaagatgggcataacagataggagcaacaacagatattgcagtggtgcttctctggtacacataagagagattatgaacaagctcttgaagatcatcagcagagaaacccagctcatcatacaagacgtgatagtgagtaggacgagttgtaccaatcattccagcatgagcacacaggtaaaagtcataattccttgggtgacagactttgtaggattaaaaaaaatataggaagtgatggcaaacaagttgtgcatagttgttctttgtcttgctttggtagtagttcataccacagccgcaagagacatgccaagtgacaatggtctttatgaccaaaagaatgttttcgttggcgctggaggtattggtggcattggaagcaatggattgccttttggtggagttgttagtggagtaggtgggaatgttggtggatttggtgctggaattggtggtggagctggatttggtggaggaatggggggtggtggactaggtggtctaggaggattaggtggcattggtggcggtgttggtggtggtgctggtggtggtgcaggaagtcttccacttccatgaagattaatattagttgaagtttaatttgtatcatgcatattgtttggttttagtattatggctagtgtgagaaattaaaagagtgattattttttcttttctttttgttgcatgtttggtttcattcatagtgtaatgttatgtgttttttcacgtgtttaatgtaatgtaatttggtgcacttgtaaaa

SEQ ID NO: 7424 - DNA, 3214 bp, Lycopersicon esculentum
  Predicted polypeptide sequence is orthologous to G1272
gtaaatactccccttttttttctcagtcctctctctcataaatttgtcactctccctccttctcctctcttccatttagggttttgttcttgattttggtgcttcatctgcctcttttgagcagaagataggatcctgatatggctgaagaagaaacaaatggagcagcagcagagggtctgccacctcctccccctgttccaccagatttcactcctgctaaaactgaaattgagcctgtgaagaaaaagatcttgcgcgttcccatggccaggcgtggtgttggaaataagggacaaaagattcaaatacttactaatcactttaaagtgaatgtaaacaatgtggatggacacttcttccactacagtgttgccttattctatgaagatggtcgaccagttgatgggaagggagttggaaggaaggtgttagacacagtgcacgaaacttatgatacagaattagctggaaaggactttgcctatgatggtgaaaaaagcttgtttaccattggagcactccctaggaataaaatggagttcactgttgtccttgatgacgtgatatcaaataggaacaatggtaacagcagccccggtgggcatggtagtcctaatgaagctgacaggaagaggttacgtcgtccttaccagtcaaaaactttcaaggtggagatcagttttgctgccaaaatcccgatgcaggcgattgcaaatgctctgcgtggtcaagagtcagagaactctcaagaagccttgcgagtcttggatattattttgaggcagcatgctgcaaagcagggttgcctgcttgttcgacaatcctttttccacaatgatcccaagaactttgttgatgtcggcgctggtgtgcttggttgtcgaggattccattccagcttccggactacccagagtggcttgtctttgaacattgatgtgtctacaacaatgattatccagcctgggcctgtcgtggacttcttgattgcaaatcaaaatgcaaaggatcccttttcactggattgggcaaaggcaaaacgtgtgctcaagaatttgagggtgaagacaacccccactaatcaagagtacaagattactggactgagtgaccgtccttgtcgtgagcaactatttaccctgaagcagaaaggaaaagatgcagatggtgaggtccaaactactgaagttactgtgttcgattactttgtcaaccaccgcaacatagagttgcgttattctgctgatttaccctgcataaatgttgggaaaccaaagcgtcccacctttttcccaattgagctatgttccttggtgtctttgcaaagatacacaaaatccttgtccacattccagaggtcttcactagttgagaaatcaaggcaaaagcctcaggagaggatgcaagtcttaagcaatgctctcaaaatcaaccaatatgatgctgagcctctgcttcgttcctgtggaatatccattagcaataacttcactcagattgaaggacgtgttcttcctcccccaaagctgaagacgggcggtgatgactttgtccctcgtaatggcagatggaatttcaataataagagactagttgatcccactaagatagaacgctgggccgttgtcaatttttctgcacgctgcaatgtacaagggctagtcagtgatctgatcaaatgtggaaaacagaaaggaattatggtggaagacccatttgatgtctttgaggagtctccacaagtcaggagggctccaccacttgtgagggttgagaagatgtttgagcaggttcaatccaagctacccggggcacctaaattcctgctttgtttgcttcctgagaggaaaaactgtgatgtatacggaccatggaagcgaaagaatcttgctgagtatggcattgttacccagtgtatagctccaacaagagtcaatgatcaatatatcaccaatgtgctcctgaagataaacgcgaagcttggaggtttgaactctatgttaactgttgaacattctcctgcaatccctatggtgtctaaggtccctaccattattcttgggatggatgtgtcccatggctctcctggccaatctgatgtcccttcaattgcagcggttgtcagttcaaggcagtggccatcaatatctcgttacagagcttcagttcgtactcagtctcctaaagtggagatgatagacaacttgtttaaacgtacctctgatactgaagatgatggaataatgagggaggcgttgctagatttttatgtgagctctggaaaaaggaagcccgagcatataataatattcagggatggtgtcagtgaatctcagtttagtcaagttctgaatgttgagctggaccagattattgaggcttgtaagtttcttgatgagaagtggtcacccaagtttgtggtgatagttgcccagaagaaccatcataccaagtttttccagcctaatgatcctaacaatgttcctccaggcacaatcatagacaacaaagtctgtcacccaaggaattatgacttttacctgtgtgctcatgctggaatgattggtacaactcgtcctactcactatcacgtcttgtatgatgagctgggtttctctgctgatgatcttcaagagcttgttcataatctctcttatgtgtaccagagaagcaccactgcaatatctgttgttgctcctatctgttatgcccatcttgctgctactcaaatgggacagtggatgaagtttgaagatgcatcagagacttcctcaagtcataatggagtaaccaatgctggaccagtctccgttcctcagcttccaaagctcgaggagaaagtttccagttctatgttcttttgctaaggcgcgtaacgccttcatgcttttcttttttatgtgtggtttgtgaatagtttctggttcaaaactcttttgagaagacggtggtagttaaatattttgtctagacttaaataggtaaatcactctgctaaaagatttcacatcttttggctctgtggtttgctatctcttttaacttatcctggatcatgtacttatgttttggtggtgtttttaagttatggacatgactagtagtttctctaaaaaaaaaaaaaaaaaatccattgcttttgttttatcagttttgtgtttataaaacttgttagctagtattaccagcaggtgtaatgtgaaagattttc

SEQ ID NO: 7425 - DNA, 549 bp, Lycopersicon esculentum
  Predicted polypeptide sequence is orthologous to G1272
gctcttcactctgtttcttcatccgccatttttgagctttagaagattgtggtaatggctgaagaagagaatggtggatccacagaggctctgcctcctcctccccctgttccacttaatttctctcctgcacaagctgaaccagagccagtgaagaagaaggttttacgtgttcccatggcaaggcgtggccttggaagcaagggacaaaagattccgatccttaccaatcactttaaagtgaacgtgtctaatgttgatggacacttctttcattacagtgttgccttattttatgaggatggtcgacctgtcgagggaaaaggcattggcagaaaagttctggatagagtgcatgaaacatatgatacagaattggctgggaaggattttgcatatgatggggagaagagtttgttcaccatcggttcactacctagaaataaactagagttcacagttgtactagatgacataacatctaatcggaacaacggtaccaatggcaactctagccctggcagacatggaagccctcctaatgaaact

SEQ ID NO: 7426 - DNA, 627 bp, Lycopersicon esculentum
  Predicted polypeptide sequence is orthologous to G1272
gggagataacccatctttttttttctcatagaaaatcatgtaaataaataatttgctgaaaggtctaaacagcaaaacaaaagctcccaacaacttctatcctataacaatgccaatgcaatggcataccaaagggacacaacacaaaagcacaaagaaattagcataatttagttttctccaccaacagtgggggcttagacaaaaagttgataaaaaaacaaaagacttgtagtgacaacactacataggtttaagattcatcacattacagaaccagaaattccctttagcttatcagatgaacattgaactgcgaacattcttgtgaagccgaggcaattgagggactagcacactaccagctgttgaaactccaccatggctcgaggtggcctcagaaatatcatcaaactggataaactgtgccacctgagctgctgccaagtgggcataacatatatgtgcaacaacagagatggctgtggtacttctttgatacacataagacattgaatggaccagctcttattattgtggatcattatatcaaatgagggagctgtgtcatagcaatacccataagctgtttgtgactgtgatacagcgagaaatcgtgtgagaaaa

SEQ ID NO: 7427 - DNA, 564 bp, Lycopersicon esculentum
  Predicted polypeptide sequence is orthologous to G1272
caaagaatttcattttatacgattgctttgtcaggttgtgagttcaaggcagtggccgtcaatatctcgttatagagcttcagtgcgcactcaatctcctaaagtggagatgattgataacatatttaaaaaagtttcagacactgatgatgatgggattatgagggaacttttgctagatttttatgtgagttccgggaaaaggaagcctgagcacattatagtattcaggtgatctaacccagcctgttcaccattttgctttcagcaaattatatacattctaagtgctattgctcttttattgacactacacttgtgatgaatgtctaaatcttcagaaatttttattgagcatgacattggtgagtttttatggttctacctcattttctgccatttttatcccgtttatctattgttttagaggattcatgtagctgacctaactcttgggcatgaggagtagctcttgatatttctcttgttccatcgtttgttgttattaccactaccgtgtgttccacctgcctaacattgtcacgtagcagtgaactttgtaca

SEQ ID NO: 7428 - DNA, 489 bp, Lycopersicon esculentum; identical to SEQ ID NO: 7153
  Predicted polypeptide sequence is orthologous to G1272

SEQ ID NO: 7429 - DNA, 560 bp, Lycopersicon esculentum
  Predicted polypeptide sequence is orthologous to G1274, G1275
atcacatattctatcaaagactcttttaaagtctttcttctcaaaaataatagtattagagaccatgtttggctcttccacttcccaagaaacaacaaatgtcatttctcatcaacattatcaaaccataaaccctaatttttatgcttttcatgatcctcttatcaacatgaatcaagatcatgtccacaataataattataataagtatcaagattatgacacttcatttcttgatttgtttgttgatggtgatcaagaatattattccaattacacaaacaataatgcttcaatttatttagaaaatcccttcaagcaacaagagataagtagtagtacctatagtactagtggaaactcatcatcagctagttcatttgatgccacaccaacacatgttcacatgaataatgaaaatacaagcatagggattgagaaagaaaaaaaaggtgaaaaacatgcaattgcttttagaacaaaaacacaacttgagaccttggatgatggatacaaatggaggaaatatgggaagaagaaagtgaaaaccaacataaatc

SEQ ID NO: 7430 - DNA, 740 bp, Lycopersicon esculentum
  Predicted polypeptide sequence is orthologous to G1274, G1275
ttttttttttttttttttttttttttgcgattaacttatctatatatttagcacttgaaaattcgtgcacaacttttttaaaacatatgtcgaaaatgttcaataaaaacactttatcatataatcaaagtgctccattagaacctaccataatacaaatatataactaaactttactgacacgtttaagaggttctaaaggtgaagattgtgaagggcaatattgttgggagggaattgtgtgtagtgaagcacatgaggactctcgtggttgtgaatcccttcataagtagtaatgacatagcttgaatctttattgtccctttctactcttttcttcacattgcatcccccacttgaacatttgtagtaattccttggatttggattattcttgaccatctttttgccatatttcctccatttaaatccatcatccaacacctccaactctgatctaaatctaaatgcaaccttagactttgcatccaccttctttatacctttcatacattttatgttatgacttgttggagtaggattatttgaatatgaaccactagtatcggaaacactttgaacaatttcattttgtgacaaaaaatcgtcactcgatccatcatcgagaaaaagataattataatcggagagctcaaaattctccgatgcgtcgataaaattagggttagggtttgatgagctatagggaaaattttccatagttgaacggaacgaaaaag

SEQ ID NO: 7431 - DNA, 455 bp, Lycopersicon esculentum
  Predicted polypeptide sequence is orthologous to G1335
ctcgtgcctcacaatcaaagggttttagggtttctttttctttgtgagcgaaaaaaatggctgatgagggttgtgagaggctcaagggaactgtcaagtggtttagtgaccagaaggggtttgggttcatcacccccgccgatggctctgaagatctgtttgtacaccagtctggtatcagatctgaaggattcagaagcctagctgaaggtgaggatgttgagtatcagattgagtctggctcagatggtagggctaaggcttccgatgttactggacctaatgaagcggctgttaaaggaggttcccgcagcggtggaggacgtgatggaggtggttacggcggaggcggtggttacggtggaggcggaggttacggtggtggccgaggaggaaatcgtggttatggaggtggtgacagtggctacggaggaggtagccgaggtggtggcggc

SEQ ID NO: 7432 - DNA, 608 bp, Lycopersicon esculentum
  Predicted polypeptide sequence is orthologous to G1335
cagtatcagcagagaaagtggactgcagggaaatcggcaaggccaatatggaaatcagcctagtggaacgcaaaatgctccgactggctcttctgcaggcatgtatatgagctgtaatagttgtggtggaacaggtcatagtgcttcaaactgtccaagcatgatgagtggtcagagccaggcatatggaagtggttttggcaatagggcaacttcagggatgagcagtggtggtggtggtggtgagtgttataaatgccatcagtatggacattgggcaagagattgcccaggtgtaagcaatgcacctgctgccaataacatgacatcaggaagatatgggaatactccaaggcaacacgttggtggtttttgatgaacctttgagcacataaagttgtcctgtacaggtttagatgtcttctcttagtggctcatcatggctcatgttctgcttttgagaaagcttcttgaggggcttgcgttttgcctttctgtacagtggtcgcttggggcttaaattatgcatcacggctcctggacgggagtgcactacaagtcttgtcgtccatgttttgaggaatgaccgttccgtgctctttctttgt

SEQ ID NO: 7433 - DNA, 521 bp, Lycopersicon esculentum
  Predicted polypeptide sequence is orthologous to G1335
ttgggtggtacctctaccccaactttgctgagctccaacaccactactagaaactctatcaccctacctgactgtactctgcaacgacctctaccctgtagagctagtggtctagtatggaatgaagaattaggtcgaggcccaccacgacccctttaagaagtacactgccgcattagatgatcgggatctccacaagtaaaacaaaatctctaacctgggaactgctgtgtggaccctgaaaacccacaataattgcctcgccctgaaggtcgctgctgtgaaccgtacgagccctgaaccaggacataagaacccctagatgtttggccaccctcaaatattgtcttagatgcatgaataggtccccgctgctgaaaagaaccactcactctctgtgatcccctacctccagatgaatcaccatgaaactgacttgatatacgggcccttatagggtccccaaactcctccctctcttcatcaattccaactctttggaggcgctcataatggactgg

SEQ ID NO: 7434 - DNA, 938 bp, Lycopersicon esculentum
  misc_feature (624)..(624): n is a, c, g, or t
  Predicted polypeptide sequence is orthologous to G1341
tgtggatgaccactctagtatcggctttttttttttttttttttatataatgataacattagattaacaagtagaacaaaaattacatatctcccaaagcttgaacaatgtacataatcatttttcaactaacaaagtagagttatatcaaacaaagctaacttgtatggtgcttgagagtgaaattcatcacgattagaagtataacctaaggtcttaacatgtgttcccttgagacacaaggtcataaactcttctcttcatcactcatccatgatctcataatacatccgcattgcaaccttcatctcatccttactataattgttgttaaaatcattattcctcttaagaattcttgagctctatatctggaattttagaagaaagattggattctgcaatgttcattcgcaataggcgttggttccgtccagttaatcgacaattataaacagcttttgtgcaaccttggatgacaaaatcttcttccaatattgaaggtgcaaccactgagatggaaatagagacatgtaaaaccctagaaagtaaaaggcgaagctgtcgagaggagcgagctgctagaaatgtgaagttgcttctagacagaggccacaagatgtngtcgaaagcaacgagagctgctgatggaaagaatctgcaagatagacgcctcttaagaagagagaggacctgtgccaaatccgggaaccctatgtcacctgcagccgcggactccattgtcctttaggaggatatcgacttgcaacaagggtaatgtttcttgggaatttccctccatccaacattccaccgaagtaggaaagcgggccatgggggccccaaatacgtgggttgggaatgggttttacaaatctctttatttttcccccccccccccccccctcctctttttgggggtggtggttagtgggacg

SEQ ID NO: 7435 - DNA, 331 bp, Lycopersicon esculentum
  Predicted polypeptide sequence is orthologous to G1361
ttacataagtggagttgtcaaaggttacaagaaaattttggtactttatacaaattatggtagacagagaaagcctgagaaaacaaattgggtaatgcaccaatatcacttaggtgaaaatgaagaagaaaaagatggagaattagttgtttcaaaagttttctaccaaacacaacctagacaatgtggatcatcaaccataaaaaaaacaattgatcatagcaacaatattattaaccccctccttaaaacaacgaatttcgtcgattattataatcctaatcctttcgtttcatataatgttgagagccaaagctcacctcatgagtta

SEQ ID NO: 7436 - DNA, 935 bp, Lycopersicon esculentum
  Predicted polypeptide sequence is orthologous to G1364, G481, G482, G485
agagaaaagagattctttttatatatagttataaaaaaatttcagagttttctttgtaaaacgaacggtgttgatagggcaaaatccaaaactctgcctcatctcagtcgtctccctttctcccttcttctccaacgtccgatcttccagttccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgacgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatggttcttctgctgtaacctctgtaacatggtttattaattctagtgctctctagtgagtgccatgtcatatttaaagtttgtaaattgaggagatgttttaagaaatattatagacatgattgtttgtagtaataatgaaaaccattacctagtaaaaaaaaaaaaaaaaaaaa

SEQ ID NO: 7437 - DNA, 1004 bp, Lycopersicon esculentum
  Predicted polypeptide sequence is orthologous to G1364, G481, G482, G485
agtgcttcaacatttttctccctgacatattgtttattattagtttcataaaaaaaattataaaaattttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgcagaggtttagggatttggaagggcaaaaaagtggtgtctctggagagaaggatcatagtggatcagtgggttatgttgaggactaccatggcatgatgatgatggggagtcaacatcatcaaggacgcgggtatggcaccggtgtatacaatcatcatacgggggagaatgctgcaggggttggtacaggagggtcgcggtttcctgacgttgggaggcaaaggtgaagctgtgacatccgcggactacaaagatgtatcaggacgcgatgtatcaactgtcaacaggttgaagtatggacactgaaagacaggaacagactttgtagtttgtattctacagagatgtaaattggtaaacatgtgtgtacattacaatgtgggtgtaaacatggattgtaattgtctattaaaaaaaaa

SEQ ID NO: 7438 - DNA, 476 bp, Lycopersicon esculentum
  Predicted polypeptide sequence is orthologous to G1364
ttttttttttttttttttgtttgggcacttaggtgctgtacaaactataatagatggtttgttccaagtgacattcaaaaccaaatggtatgtacagagcggaagagaattaaaatcaaagtatagcaaacaaatatatttgcagaaattagtaggaatcctttaggcgtctagtcctctcaaacaagtaccaacaatgttgttgacagtttaacacagatatcagcaagaagagaaaccctggcatcttgtaccagcaaaagactaaccactgttctatgtattcagcttttttttgggtatgcatccaaagttctttgttcatcttaaaattcataattgggagtttccatagtctaagccttgtgcaaaagaaccttcatacatgaactgcgtattggacccaagctgacatccaactacatcttttctaacagatgcatcaccaacccttgcagatcccttccggcagcccg

SEQ ID NO: 7439 - DNA, 1146 bp, Lycopersicon esculentum
  misc_feature (1039)..(1039): n is a, c, g, or t
  Predicted polypeptide sequence is orthologous to G137, G145
gcaaagatagagaaagtcccagggtttccatatttccaactctctctttctttcatttattttgatttgtaccctcttttgttatccaaaagtagttgagcttgtaaccaataatccccccttcttttcttattttttttaaaatctctgaaaaaattgaagattgatttctcaatgggaagaggaagagttgagcttaagagaatagaaaataaaataaataggcaagtcacttttgctaagagaagaaatggacttcttaaaaaagcttatgaactttctgttctttgtgatgctgaagttgcccttataatcttctctaataggggtaaactctatgaattttgcagcacttcaagcatggtgaaaacaattgaaaagtaccaacgttgcagctatgctactttggaagccaaccaatcagttactgatactcagaataactaccacgaatatctgaggctaaaagctagagttgagctcctccaacgatctcagagaaactttcttggtgaagatttgggcacgttaagctcgaaggaccttgagcagcttgagaatcaattagagtcttccttaaagcaaatcaggtcaaggaagacacaattcatgctggatcagcttgcagatcttcaacaaaaggagcaaatgcttgcagaatctaatagattactccgtagaaagttagaagaaagtgtagctggatttccacttcgattgtgttgggaagatggaggtgatcatcaacttatgcatcaacaaaatcgtctcactaacacagagggtttctttcagcctcttggattgcattcttcttctccacattttgggtaattactattattattattaaaaataatttcaatttttttacttttatttcgattaataaatcaatgtgcaccaaggtatggtctaacataaacaaaaatgtggggaatgctccttaaagccctaacaaaagttaattggtacgtgtactaatgtaacgtactatatatcttacttgattagtggatggacagtactgggcacacancattgacataagttattataaggaaaaaaaaaaggcgaataatcaatatagtccaacattacattatttattataacaggtcactctagattaaatggtaatgaata

SEQ ID NO: 7440 - DNA, 931 bp, Lycopersicon esculentum
  Predicted polypeptide sequence is orthologous to G137, G145
ttttttttttttttttttttttatgaggaacataagtcaactgattaagcactcaaagaaatctagtttatgatttactaacaataacgggattgtcttatggatccccgttaggtccaggatgaaacattttctcaaacaacatacagaaattaggagatattcaatgtttatgatgataggaaaaccattgagcatatttataataatgttatgatcagaatcgtgagccttcaaggcaaccagccagccatgtagttattcacactaggccctgctcctcctactgtaattggatcattctgatacccaatttgcaaagtaggttcacaatccaaaggatgaaagaagccatcgccctgagtttgagttgtttgccggccatagcccacatcttgtgcatttggctgccactgcagatttagttggcttccttccatcaacctttgtttcaaggttctgttggcttcgttcaatgcatgttcctttctctgataatctgtaagttgatccaacattaactgagtccgagttgatctgatctgtttgagcgacatatcaagttgtctctcaagtgattcaagttctttgctgttcaaaggaccaagatcttcaccaagaagattcctctgtgatcgctgcaatgcttcgtaacgtcctttaagcttcaagtactcctgctggctactaatttccagtgcttctcgtgttgatatattcggttcaggtgctccatagttgcacttctggtacctctccaacgtctttagcatgctagaactactgcagaactcatagagttttcccctattagagaagatgattagagcaacctcagcatcacaaagaactgaaagctcataagctttcttcaaaagcccatttcttctcttagcaaaggtcacttgcctgttgatcttgttctctattc

SEQ ID NO: 7441 - DNA, 853 bp, Lycopersicon esculentum
  Predicted polypeptide sequence is orthologous to G137, G145
ggaaagtagaattgaagagaattgagaacaaaataaatagacaagttacctttgcaaagagaagaaatggactcctaaagaaagcttatgaactttctatactttgtgatgctgaaattgctcttattattttctctagtcgtggcaagctttatgaattttgcagcaattcaagtatgtccaagacattggagagataccacagatacaattatggtacacttgaaggaacccaaacttcatcagattcacagaacaactaccaagagtatttgaagcttaaaacaagagtggaaatgttacaacagtctcaaaggcatttgctaggtgaggatttgggacaattgggcacaaaagacttggaacagcttgaacgtcaattggattcatcattgaggcaaattaggtcaacaaagacacaacacattcttgatcaacttgctgaacttcaacaaaaggaacaatctcttactgaaatgaacaaatctttgagaataaagttggaagaacttggtgttacctttcaaacatcatggcattgtggtgagcaaagtgtacaatatagacatgaacagccttctcatcatgagggattttttcaacatgtaaattgcaataatacattgcctataagcaccatcaacacatgatgctactggagttgtacctggatggatgctttgaatttggagtatatggagagaaaaaatcctcttagttatacaagttatttatttttattaaaaaaataagttagatggagaattatatatatcatactttaaagaacttatattgtttgaatgttttagctagcaaacactttggattatatataatattgggatatatt

SEQ ID NO: 7442 - DNA, 1329 bp, Lycopersicon esculentum
  Predicted polypeptide sequence is orthologous to G137, G145
gcaccgaggtaaagctctaaggtatctaaatttggagtacctaagcaaatcctaaagttaaaacaatgaatccctaaagaagataggaagaaatgccatagataaaaacaacccatgttcactttttctctctctaaacattgaaattcaaccaaaacaaaaaacaaaagttgataagaatcctttctttctttctttgtgtgtgtgtgtgtctagctagggtttgcatttctttcacaattttggttgtttcagtaggagagaaaagaggatctaagagttagccaagagaagaaattagtgagaaaataaagtagaaaaagatcatcagaggaaggagggatgggtagaggaagagttgagctgaagaggatagaaaacaagataaatagacaagtcacttttgcaaagaggagaaatggattgctcaaaaaagcttatgaactatctgtgctttgtgatgctgaagttgctctactcgttttctctaatcgtggaaaactctatgaattctgcagcacaaacaatatgctcaaaacacttgataggtaccaaaagtgcagctatggaacattggaagtcaatcgatcaatcaaagataatgagcaaagcagctatagggaatacttgaaactcaaagccaaatatgagtcgctgcagcgatatcaaagacaccttcttggagatgagttggggcctctgactatagatgatcttgagcatcttgaagtccaactagatacttccctcaaacacattaggtccaccaggacacaaatgatgcttgatcagctttctgatcttcaaactaaggagaaattgtggaatgaggctaacaaggttcttgaaagaaagatggaagaaatatatgctgaaaacaacatgcaacaagcatggggtggtggtgagcaaagtctcaattatggtcagcagcaacatcctcaatctcagggtttcttccaacctctagagtgcaactcttccttgcaaattgggtacgatccaataacaacttcaagccaaataacagcagtaacaaatgcccaaaacgtgaatggtatgatacctggttggatgctgtgaatgaaaaagtcctttatcttcagctttgcataaaagcatatgaagtatatttctataataataaaggaaaactccagtacctttattttcagcaaaataccctaattaaggtgaacgttgtgaaccattttctttgcataaaaacaaacttgtttgcttggaaatgttttattttattcaaatcataatgtggatgttgctgaatataaaaaaaaaaaaaaaaaaaaaaaaaaaaaaaaaaaaaaa

SEQ ID NO: 7443 - DNA, 614 bp, Lycopersicon esculentum
  Predicted polypeptide sequence is orthologous to G137, G145
tgggaagaggaagagtagaactaaagagaatagagaacaaaataaacaggcaagttacttttgctaagagaagaaatggacttcttaagaaagcttatgagttatctatactttgtgatgctgaagttgctctcatcatcttctctagccgcggaaaactctatgagttttcaagtgcttccagcatgatgacaacacttgaaaagtatcaacaatgcagttacgcatctttggacccgatgttaccggttagtgatactcagatgaactacaatgagtatgtgaggctaaaagctagagttgagctccttcaacgttctcaaagacatattcttggagaggatttgggcacactaaactcgaaagaacttgagcagcttgagcaccaattggatgcatctttgaagaaagttagatcaaaaaagactcaatctatgctggatcagctggcagaccttcaagaaaaggagcaaatgctggaagaagcaaataaacaactaaaaaacaagcttggaagaaagtgcagctagaattccacttggattgtcatggggaaataatggaggacaaacaatggaatacaatcgactccctccacaaactactgcacaacc

SEQ ID NO: 7444 - DNA, 427 bp, Lycopersicon esculentum
  Predicted polypeptide sequence is orthologous to G137, G145
ttgaagattgatttctcaatgggaagaggaagagttgagcttaagagaatagaaaataaaataaataggcaagtcacttttgctaagagaagaaatggacttcttaaaaaagcttatgaactttctgttctttgtgatgctgaagttgcccttataatcttctctaataggggtaaactctatgaattttgcagcacttcaaggtattttttttttttattaacatcaaagattttattttttttttaaaaaaaacttaagtccttcattaccaaaacccttaattgatttacaaagtactttcattaaatttagttattctttttttttttatctctgacttcaattataatgcaagatctgtggtgtctttatatgaattgaattatatatggactggatttttactatatacatataagaaccc

SEQ ID NO: 7445 - DNA, 479 bp, Lycopersicon esculentum
  Predicted polypeptide sequence is orthologous to G138
tttttttttttttttttttttaaacaaaaatattagatacatatatatatcataaattccaagatgtcatagtgcatagttgagatggggccggcagttgttatttttataacaagttgagtgaattattctcctcactacttcaacaataattgtaagttgctaaatacagattagtggccaccacaaaaacaacattaattatattagttcatacaatacaagagaacaaatattactatgttaatccattagagcatccaccctggaataaatccattaatattatgagcagttgttgctgcattaacctcatgatcatttgcacccatatttggattgtatccgaattgaggcgatgaagaattcaaacggagaggttgaaagaaaggttgtgcagtagtttgtggagggagtcgattgtattccattgtttgtcctccattatttccccatgacaatccaagtggaattctagc

SEQ ID NO: 7446 - DNA, 919 bp, Lycopersicon esculentum
  misc_feature (16)..(16): n is a, c, g, or t
  misc_feature (881)..(881): n is a, c, g, or t
  misc_feature (883)..(884): n is a, c, g, or t
  Predicted polypeptide sequence is orthologous to G138
ggtgtgacccattgantcttttttttttttttttttttttttttttttttttttttttgggtttttttttttgggaagtttcaaatgttaaagtagcaacttatgcatacattacatttactggcctcgattaatcgatcgccgggataattcctgaagagggtttcgaaataaaatttgcaacaaaacaaaaaggggtgataatacatgcaatacattattactggataactgtttaaccaaacatggattagcttgttcgaattatcagattaaagcatccatccatgaataaatccattcatattgggggcagttgccgctgcattcacctcatttgtattaacaggattgtacccaaaatggggagaagaagaatgcaatccaagaggctgaaagaaaccctttgtgttagtgagaccattttgttgatgcataagttgatgatcacctccatcttcccaacacaatcgaagtggaaatccagctacactttcttctaactttttacggagtaatctattagattctgcaagcatttgcttcttttgttgaagaactgcaagcttgatcagcatgaattgggtcttccttggacctgatttgttttaggaagactttattggttttaaggtgttaagggcttttagctaacgggcaaattttcccaaaagtttttttggaagtgagggctaacttagttttagctcaaaatttggagtttttggataaaaccgatggtggttcaggagatattgaaggtgcttttatggtccctggctgaggtgaaatagggtcccttagaagttagccctgccagcacagtaagtttaaacctttctcaaggggttttttttttttttttttttcccccgccttantnntgcttacacctttttttaaaagaaaaagggggcct

SEQ ID NO: 7447 - DNA, 446 bp, Lycopersicon esculentum
  Predicted polypeptide sequence is orthologous to G1382
gctgagtctacctgcacctgttagtttagaagcctcgtcaattagtacttctgctgctgcaactgataatgaagaaacaaatcagagaggtcaatcaaatacaagcacgcaagggtcacatgctgataataaagatgtatcatcgataactgctgagagatcatcagaagatgggtataactggagaaagtatggccagaaacttgttaaaggaagtgaattcccaaggagctactacaaatgtacatacccaaactgtgaagttaaaaagatatttgagcgctctcctgatggacaaataacagagattgtgtataaagggtcccatgatcatcctaaaccccaacccaaccggaaggttactcctggtgtgcttacttccatccaagaagacagaagtgagagagatgcatgcctcactggtcaagaagacaaattcaacacta

SEQ ID NO: 7448 - DNA, 634 bp, Lycopersicon esculentum; identical to SEQ ID NO: 7171
  Predicted polypeptide sequence is orthologous to G1382

SEQ ID NO: 7449 - DNA, 627 bp, Lycopersicon esculentum
  misc_feature (583)..(583): n is a, c, g, or t
  Predicted polypeptide sequence is orthologous to G1382
cgcaactcaaagagacggaagaaagaagtacctacgagtgatgacatgactccacctatgaagtctcctagtgaatcacgacacattgttcaaactagcagtgaagtggatgtagtcaatgatggttaccggtggcgtaaatacgggcaaaaatttgtgaaaggaaatccaaatcctaggagttactaccgatgctcgagtgctggttgccctgcaaagaagcatgtggagaggtcatcccataatccaaaatcagtgattacagtatatgaagggcagcatgaccatgacatcccaccttccagaactgttatccaaaatacagcagaggctgattctaatacaacaagaataagtggagagtccacatctgaatcaggtgaaaacaaacatgttgtccatattggtgcaagttgagagcataatgccaaacaatcaaactcaatacagatttagataatgttacatcatcaagttatctaatcttatcttttttcttatttgttggaattggtcaattgttctccacttgtaggagaaaaaagaaaggataaatatatatgtattatagaaacagctgatntaacctcataattggtgtgaattcctatacttaaatgtataagt

SEQ ID NO: 7450 - DNA, 714 bp, Lycopersicon esculentum
  Predicted polypeptide sequence is orthologous to G1382
gaatccgaggagttactaccgatgctcggttgcaggttgccctgtgaagaagcatgtggagagggcatcccatgatccaaaattagtcattacaacatatgaaggacagcatgtccatgatttcccaacgtctaggcctataagccaaatttcagtagcacctgatgccggtacagcaggcatacgtgaagactccagaaccgaatcaggtgaaaagaaacatgtcgtggagtccaaaactgaatcaggtgaaatgaaacatatcagagagtcgaaaactgaagcaggtgaaaccaaacatgtcaaagagtccaaagccgaatcaggtgaaaacaaacatgttggagagtccaaaactgaatcagatggaaacaaacacgtcgaagagtccaaacctgaattggttggaaacaaacatgtcggagagtccatatctgaatcgggtgaaaacaaacatgttggtcttgacatggctgttcatattggtgcaaattgagtatcaaccatcttatgcaacaaaacaatcaacttatgcagaagtagagtttcttacaacaccagtcttccaatcttaccaaatttgttcaatcattctcttcctgaaggggagaaaagaaggttacatttcataggtacacttcttaacttgttattggcatggagctgtgttatcatatattcactgtataaaatatgtttcttagcaatgggaaa

SEQ ID NO: 7451 - DNA, 597 bp, Lycopersicon esculentum
  Predicted polypeptide sequence is orthologous to G1382
ctccggaggcttccgtcacaacgccgctggatcgaacggcggtgctaagtacaagctcatgactcctgctatgcttccgatctctaggtccgcctgtatcaccatacctcccggtctcagtccttcctccttcctcgaatctcctgttctcctttctaacatcaaagctgagccatctccgactacaggttccttctccaaatttcaaacagtgcaaggctctggtggggctgctgcattcttattgacaagaggttatgctagtggcaatacatacactgaaagaaaagcaagctgctttgaatacaaatatgccggtggatctagttctacatcaggatcattagcaactgaacatgtggtaatgctctattagaaaatattattgatgttggattagaaacaaaaagcaaatgaaacaagagcttttttattagcagtagccctctttaacaactgactgatgtttaatttagaaaaaatgaaagtttaactctgaggttcaggttcctgttcttgtgtctttctcttgatatggcatctatttgaggttaatgtcaaatgtgtgcaggttctaaatagtgttgtaacatgcta

SEQ ID NO: 7452 - DNA, 304 bp, Lycopersicon esculentum
  Predicted polypeptide sequence is orthologous to G1382
gatgtattatccgtaacatctgaaagatcatcagatgatgggtataactggcgaaagtatggccagaaacttgttaaaggaagtgaatttccgagaagctattacaaatgtacatatccaaactgcgaagtgaaaaagatatttgagcggtcacctgaaggacaaataacagagattgtttataaaggttctcatgatcatcctaaaccccaactgagccgccgattttctcctggtgctctcatgtctgttcaagaagataaatgtgagaaagaagtgtgtttcaggggttcaagagtctatg

SEQ ID NO: 7453 - DNA, 696 bp, Lycopersicon esculentum
  Predicted polypeptide sequence is orthologous to G1382
cttagtgaggtaaattctctataatgaagaggattgctttaacaagaaagtttagaggaattagatttgtcctatgcaatagatatgacgctctagtttatgtaatctggacaatttagcttttggtagtgttgtgactgcgagaatcgtggttttgcttctaagttggaccccttttgtttacatctatcctcagctattcctctcttgtaatatgtttttatactgagaattgtggttctgcttctaagtttgacccctcttgtgcttgtttcaggcaatgttgatgttcgtggaatgatttctggttttcagtttctacaggtaacccctttgccaaaccattataatagagacgcacataaccagtgttatgagaatattacgagagaggaatgatagataagtatattgtaagtttattgggtgttgctgcattagttctattttggagttccactgcttggtactgctacttactagctactaattgctatttgatgaagttagcttattctacaagactctcaccttatactgaaaggtaataatacaaaaaatgtagtaatagtttcttactcaccacattgctttgacaaatggttaagctgtctgattattctgtgttcttctaactacgtcaatttgaacggtgaaagaagcatccaagacttgaaaagtttccaacttgttctg

SEQ ID NO: 7454 - DNA, 1406 bp, Lycopersicon esculentum
  Predicted polypeptide sequence is orthologous to G140, G146
gagatgaagaaaaatgaaaaatgtccaagaaatgagtgatcatccatcctctcattagataattcccaatttaaccatccttctatatagtgcttattcaaaacaaagataacataggaataaacagacaatgaaaaatcttagtttagataattagtagtagtaacataacataacatagttgttatatatatatatatatatataatataaaaataaaagtaaacactcttttactttataaatacctatcccttagtccaaagtctcttccattttctgcatctacaaaatcctcttcatatattatatactaatttgcaaccaaaaaacttaaaaatcttctctttcctttccttacaaggtgaagtaatggacttccaaagtgatctaaccagagagatctcaccacaaaggaaactaggaagggggaaaattgagatcaaaaggatcgaaaacacgacgaatcgacaagtaacattctgcaagaggcgcaatggtttgcttaaaaaggcttatgaattgtctgtgctctgtgatgctgaggttgctttggttgtcttctcaaacagaggcagactctatgagtatgccaacaacagtgtgaaagcaacaatcgagaggtacaagaaagcatgctcagattcctcaaacactggttcagtatccgaggccaatgctcagtattaccagcaagaagcctccaaactgcgcgcacaaattggaaatctgatgaaccaaaacaggaacatgatgggtgaagctcttgctggaatgaaactcaaagaactgaagaatctggagcaaagaattgaaaaagggattagcaaaatccgatccaaaaagaatgagctgttgtttgctgaaattgagtatatgcagaagagggaagttgatttacacaacaacaatcagtacctgagagcaaagattgctgaaactgagagagctcagcatcagcatcagcagatgaacttgatgccagggagttcatcaaactatcatgagcttgtgcctccacctcagcaattcgatactcgaaactatctacaagttaatggattgcaaaccaacaaccattaccctagacaagaccaaccccctattcaactagtctaatgtgcttgagagattgtcttctttctgatgtgatctacatataatccccaaaagaagactgctattaagcttgaagattaatggaacttaagtatgtataccatattattaattacttgttgcatgagctaagactcttgaatattgtatgttaattaagtggacatgtattttttttgcttggtgtacttccttttctgccagtgaactatgaagaattaagcttgttatattaagttcacaactgtttttctgtcccaaaaaaaaaaaaaaaaaaaaaaaaaaaa

SEQ ID NO: 7455 - DNA, 635 bp, Lycopersicon esculentum
  misc_feature (617)..(617): n is a, c, g, or t
  Predicted polypeptide sequence is orthologous to G140, G146
gagtctttggaagttgtgtgagttttcagaaagcctttgaagttcgccggaaaatagcaatattttcaattcaagccaatcagatgggaagaggaaagatagagataaagaggatagagaacaacacaaacaggcaggttacattttgcaagagaagaaatggattgttgaagaaagcctatgaactctctgttctatgtgaagctgagattgctcttattgttttctccacacgtggacgcgtctatgaatactctaacaacaacattaaggcaactattgaacgatacaagaaggcaactgctgaaacctctaatgcttgcaccactcaagagctcaatgctcagttttatcaacaagaatcaaaaaagctgcgccaacagatacaaatgatgcagaattcaaacaggcatctggttggtgaaggattaagttgtttgaacgtaagagagctgaagcagttggaaaatagacttgaacgaggcatcagcagaatcagatcaaaaaagcatgagatgatactggctgaaactgagaatttgcagaagagggaaattctactggaacaggagaatgcattccttagatcaaagatagcagaaaatgagaggcttcangaactaagcatgatgcca

SEQ ID NO: 7456 - DNA, 667 bp, Lycopersicon esculentum
  Predicted polypeptide sequence is orthologous to G140, G146
gcatatcttatccattcaactcactcagatcgatcgattcgatcgatgggtcgaggaaagatagagataaagaggattgaaaacaacacaaatcgacaggtaacattctgcaagagaagaaatggattactgaaaaaggcatatgaactttcagttctatgtgatgctgagattgctctcattgttttctctactcgtggtcgactctatgaatactctaacaacaatgtaaaggcaactatagaacgatacaaaaaggcaacagcagaaacgtctagtgcgtacactactcaagagctcaatgcacagttttaccaacaagaatcaaagaagttgcggcaacagatacaaatgatgcagaacacaaataggcatctggtgggtgaagggctgagctctttgaatgtgagggaactgaagcaattggagaacagacttgaacgaggcattacaagaattaggtccaaaaagcatgaagcaatactagctgagactgaggatttgcacaagagggaaattcaacttgaacaggaaaatgcattccttagatcaaagatagcagaaaatgagaggttgcaggaactaagcatgatgccatctggtggggaagagtataatgcatttcaacaatatttagcaagaaatatgctacagctcaacatgatgg

SEQ ID NO: 7457 - DNA, 884 bp, Lycopersicon esculentum
  Predicted polypeptide sequence is orthologous to G140, G146
gggtagattttctttctttctttctatacccaatctttgctatatcgccatttttttcttaattttaataatgaaaattgttgttttttcttcttttggatgctacaaacacatacacaaaaatatttttaatttttttttgttagactataatttccctgattgagtgtgtaatttagctaacgagatcgcgatatttgttttgcttttttcagttttttttttcttcttttcgatacaagacgatatggtttttcctattaatcaggaattacttgtcgatgagtcgtcttctcagttgagaaaaacaagtggaggaactggtggaggaggtagagggaagattgaaattaaaaggatcgaaaatacgacaaatcgacaagttacgttctgcaagcgtagaaatgggctattgaaaaaagcttatgaactttctgttctttgtgatgctgaagtttcactaattgtattttccagccgcggccgtctctatgaatatgccaataacagtgttagggcaactattgataggtacaagaaacaccatgctgattccactagtactggatctgtttctgaagctaacactcagtactaccagcaagaagcatccaaactgcgacgacaaattcgagatatacagacttataacaggcaaatagttggagaggcattgggcagtttaagccctagagacctcaagaatttggaagggaaacttgaaaaggccattgggtagagtccgttccaaaaagaatgaattgcttttctcagaaatagagctcatgcaaaagagggagattgagctgcagaacgccaacatgtatctacgcgcaaagatagcagaggtagagagagcacaagagcaaatgaacttgatgcct

SEQ ID NO: 7458 - DNA, 1397 bp, Lycopersicon esculentum
  Predicted polypeptide sequence is orthologous to G1419, G43
ggttcaattaccaacaatatttttcaagaaaaaaaatggattcttcttcactagaaatgataagacaacatcttcttgatgatgttgttttcatggaaacttgttcttcttcttcttcttcttcattagaaacaacaagtagtacactttattctcaaacctcatcgaattcggaatctttagaatcattaacctctgagatcaaacttgaaagcaatttctctgtttatcctgatttcatcaatacacctcaaagttcaaatcttgaatctgtctctcgttttttcgataactcaactattgaattccaagctaaaccccaaaagaaaagaagtttcaatgatcgaaaaccttcgttaaacatttcgattccttctgttaagaaaacagaggaaccaaaaacaggggaagtaaaaacaggggaaccaaaaacagaggagccaaaaacaggggaagtgaaaacagagtactctgttaaggagaaaatggtagaaaattcggagaaaaagcgatacagaggagtgagacaaaggccatgggggaaatttgcagcggagattcgtgacccaactagaaaggggacacgagtttggttaggaacattcgatactgcaatggatgcagccatggcatatgacagagcagcatttaggctcagagggagtaaagcaatcttgaattttccacttgaggtaagcaatttcaagcaagaaaatcatgagattgagaaaaatgttgtgaatttgaattcgaatacgaattcttgtgggaaaagggtgagaggggaaatggagaatgatgacggaattgtaatgaagaaagaggtgaaaagagaacaaatggtggcaactccattaacaccttcaaattggtcttcaatttgggattgtggaaatggaaaaggtatttttgaagtgccacctttgtcaccattatcaccacattcaaattttggttattctcaacttttggtatcatagtgaaatccccaaaagaatccacttgagtatgttatggaatattatatagcggaactatactgccatcacgatccactgagatttagtcttttgttatgttgagagtttctaaaatgttatggcagaactatattactgtcacaatccactgagatttagacctttattgtgtcgatccactgaaatttagtcgagagtttctaaaatgaaatattttgaacaagtatgaagtgatttcaagttgtaataaggaatttacctcttggaaattttggataaaaatagcacatgtacaaatgaagaaacatggaatgatggagggagaatggaagtgttttgaatcatggatatttttaattattttttgatttcattgattaagctttttttttttccatgtgaatatgaattttaatt

SEQ ID NO: 7459 - DNA, 878 bp, Lycopersicon esculentum
  Predicted polypeptide sequence is orthologous to G1419, G43
gcacacaaacaccttcactagaaaaaattcagattcacagagacataaacacaaacaccttcactgcaattctcaaaatactgcaaaatgacgaaacaagatgaaggattaacattagaactcatacgacaacatctcctcgaagatttcacaactacagaatcattcatcgacagtctcaattcttgtttttccgatcacatctcctcctccgatgacatctcccctgttttcacttcagtaaaaacagagccatctacatccaattccctctcagattcacccaattcctcatacccaaatgaacccaactccccaatttcccgttacttcaatctccgctccgatttccctgaattcaaaatcgattcagataccatcctcagtccagttttcgacagctccgccggttctaatgaagacaataataagaagaagaattacagaggggtaaggagaaggccatgggggaaatttgcggcggagataagagatccaagtcgaaaaggatcgaggatttggttgggtacttttgatactgatattgatgctgctagagcttatgattgtgcagcgtttaagatgagaggaagaaaagctattctgaattttccgttggatgccggaaaatctggtgctccggcgaatgttggccggaaaaggagaagagagaacaagatggagttggtgtagatgactaatttgtaatttgtgttaaagcatgttaattacttaatcctcttctacatcataattaatagagctttcccccccacatatttattaaagaatatcattccataatgtaaattttgattaacaaatttgaattcctaaaaatgataatatgttattatactaaaaaaaaaaaaaaaaaa

SEQ ID NO: 7460 - DNA, 559 bp, Lycopersicon esculentum
  Predicted polypeptide sequence is orthologous to G1419, G43
tttaaagaaaaaaatgggttctccacaagagacttgtacttcacttgatttgattaggcaacatctttttgatgaatctctggaccagacttgtttctcttttgaaacaactcaaacttcaaatcttgatgacatcgcaagcttctttaatgctacttcaaaaacagagtatgatggttttttcgaatttgaggcaaaacgacatgttatccattcaaattctccgaaacagagtaacttgagagaacggaagccatctctgaacgtagcaataccggcgaagcctgttgttgttgtagagaacgttgagattgagaagaagcattacaggggagttagacagaggccatgggggaagtttgcagcggagattcgtgacccaaatagaaaggggactcgagtttggttaggaacatttgatactgctgtggatgcggcaaaggcatatgacagggcagcgtttaagcttagaggaagcaaagcaatattgaatttcccactcgaagttgcaaactttaagcaacaaaatgatgagactaaaacagagatgaagtcgtca

SEQ ID NO: 7461 - DNA, 434 bp, Lycopersicon esculentum
  Predicted polypeptide sequence is orthologous to G1419, G43
atctcccttatggtaaagtatataaaacatggagaacgtaatattcttagtcctgaaactgattgcatctattcaatatgttgtatctccatttagaagcaaaggacccatgagaacgcatctttatctgcatttgttaagtatttaaagatgatttgatttaggatatgtttatctgtttggttgggtcggtatttgtataaaccagttgcacgaatcgaccattggtttttagatatgctctcctgtgaaccgaactgataagatatcggttggttcggttttccgagcagtttgggtcggacatgaatctctgctgcaaatgttccccatggtctttgccttgcttactctcctctgtagcgtttcttctccaaggtatctttcactttatgaacaaagtactctgttgcttactccattttcttgacagg

SEQ ID NO: 7462 - DNA, 857 bp, Lycopersicon esculentum
  misc_feature (824)..(824): n is a, c, g, or t
  Predicted polypeptide sequence is orthologous to G1421, G1750, G440
tggaatcggatccaaattggggccccaacctgttttgtctgcgtggtatatgtggcctttcagagctgtacattattgtcccatgcactatatatcttgagcggagtgttaaacccctgccttctctgtttatacttcctctcttttcttccctatttttggctttatacctctaattatattgttctaattatatggtagaaagatctacttcccgccaaaaacaacaaagaaagtaatctctttttctttgttcactcatcaacttgtttctcaaatcatttgtatcactgcaactttttccacacttaaaaactttttatacaataatattggtcactattcactcacttcaaccagttcttgattgttttagtactcctttttgagcttatgatgatttttttttgtgctctttgaaaaaaatatcttttaaatcgaactgtaactttaagtttttggtataccatgacggaaaattcagttccggtgattaaattcactcaacacatagtaactacaaacaagcatgttttttctgagcataacgaaaaatccaattcagagttacaaagagttgtgaggattatacttacagatgccgatgctacagattcttccgatgatgaaggccggaatactgtacggagagtgaagaggcacgtgacggagatcaaccttatgccgtcaaccaaatcgatcggcgacagaaaacgaagatcggtgtctccggattctgacgtcactcgtcggaaaaagtttagaggcgttcgtcaaagaccgtgggagtcgttgggctgcagagattcgggacccgacccggngaaaacgggtgtggttgggtacttatgacaccc

SEQ ID NO: 7463 - DNA, 487 bp, Lycopersicon esculentum
  Predicted polypeptide sequence is orthologous to G1421, G1750, G440
aatcctcttatgctttgttgttctccgtgtgggactgactgtgggtgtgtttctcatcttttgatgttttgggtctttttttttgtcagtgaatgatcgtgttttaagcttctctttgacggttccattgctcgttctcatctattaagtgtgctactttttgtggtgtcactctcaaagcaatccatcttttatctttctttctttcctttttaatcaatcaggcttagcattgaaaaataaccaatcgaagatttattcgatggattatcattcgctgtgtccgatcaaatacactgagcatcggaatgttattagaaaagttactaaaccatctttggtgaaatcaaaaaaactctcagaagctgcaaaatcctctcagttgaatccctctgttccaaggactgttcggatttctgtgacagacccatacgcaaccgattcttcaagcgatgaagaagacctgctttttggacggcgacgggtg

SEQ ID NO: 7464 - DNA, 645 bp, Lycopersicon esculentum
  Predicted polypeptide sequence is orthologous to G1421, G1750, G440
ggaaaacgggtgtggttgggtacttatgacaccccagaagaagcagctgtcgtttacgataaagctgcagttaagctcaaaggtcctgacgccgttaccaattttccggtatcaacaacggcggaggtaacggtgacggttacggaaaccgaaaccgagtctgttgccgacggtggagataaaagcgaaaacgatgtcgctttgtcacccacctcagttctctgtgacaatgattttgcgccgtttgacaatctagggttctgcgaagtggatgcttttggtttcgacgttgattcacttttccggctgccggattttgctatgacggagaaatactacggcgatgaattcggcgaatttgactttgacgattttgcccttgaagctcgatagtgtacgaggggctatttcgtccatttttgcaaatgggttcactggttagttgactagtgacgtggcatttttggcgggaatatatatatagtgattagcagtctctattcatacgaagactttgtgagagatttttgtttttatttttctgttaattgtgggtgaatattgtaatatgaaaaattttgtatggtgaaattgaattaattaacgatgaagataaggagagtgaaggggggatgtgtgtatttt

SEQ ID NO: 7465 - DNA, 568 bp, Lycopersicon esculentum
  Predicted polypeptide sequence is orthologous to G1421, G1750, G440
atatatttccctcttctctctctcactctctctacaacactcattgactagtcgttaaactcatcaagacttgttcttccttttatttctctttacatctctcctataaactcactgtatttcactatcttccatgttcaaaaaatggaatcacaaaaaatcaaaaagaaattagtccacaaaactatcactactaagtatgatcatcacaacaagtggactcctaaagttgttcggatttgttacactgattgtgatgctactgattcttcaagcgacgacgatgacgacgagaggaatcgagtgaaaaaatacgttacagagattaaatttgagaagaaaatggctgctgcagatgtgaggaaatcgttgaattcgaataagaagaagaagaaagcgatcgatttgaagagagatgagaatgttaaaaagtttcgcggtgtcagacagaggccatggggaaaatggtctgcggagattcgagatccggtgaaaaaaacgagggtttggttaggtacttttgataccgctgaagaagcggctatgaaatataatatagccgctattc

SEQ ID NO: 7466 - DNA, 608 bp, Lycopersicon esculentum
  Predicted polypeptide sequence is orthologous to G1435
ggccttctccatttttcttcattcaacggcatctctctcaaattcgccggaatatactccaccagcggaagaagattttagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcac

SEQ ID NO: 7467 - DNA, 508 bp, Lycopersicon esculentum
  Predicted polypeptide sequence is orthologous to G1435
caattatgcagcttatgaatgtggaaggattgacgagagagaacgtagcaggtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtagctccacaagctgggacctggatgatgtcatttgatcgtggaggaatcatggcaggttcatgaagtgttgttctctggtaaaatgtgggacaaatatga

SEQ ID NO: 7468 - DNA, 2244 bp, Lycopersicon esculentum
  Predicted polypeptide sequence is orthologous to G1451
gtcatacctctcgccaagtatgctaaagcagtgtatcatacgcgagtttctgttggcatgaggttccgaatgctatttgaaacagaagaatcaagcatccgtaggtatatgggcacaattactggcatcggtgatctagatcctgttcgttggccaaattctcattggcagtctgtaaaggttggatgggatgaatcaactgcaggggagaggcagcctagagtttcactgtgggaaattgaacctctgacaacatttccaaagtatccatctcctttctcccttatgttgaagcggccatggccacctggactgccttcatttcctggtctatcaaatggtgatatgactatgaattctcagcttccatggctgcatggtggcatgggtgatcaggggatacaatcacttaatttccagggatttggtgttactccattcatgcagccaaggttcgatgcttctatgctaggtttgcagcctgacattttgcaagcaatggcagcattagattcttctaagcttgcaaatcagccacttatgcagttccaacatatccctagtacttcagcatcttcgattcagagccagcttttgcatccatccaatttgcaacatactttcctccaaggcctcccggagaaccaactaatatctcaggcacagatgctgcagcagcaattgcagtgccaccaatcttataatactcagcagcaacagttgcagcgccagcaattgtatcatgatcaacaacttcaggaaccccatcaagtacagcgtcaagatcagcagcaaaccaaggctcaattgtgttcagctactcagtcacagctttctcatttacaggtcctaggttcaacgggttctcaacaaacattttctgatttagttggtcatcatattaatacatctaacaacagttccaccatgcaaagtctcctgagctcattttcccataatggagcatccacttccctgaacatgtctgagaccaactccctagtgtctccttcctcatcatcaaagcgaattgctctagaatctcagatcccttcacaagctccatacatggtgacacaggctgaagttttgacggtgcctaatactaaggtctcagatttttccactttgttttcaccaaatcctggcagacaagttttggattatcaagctgtagcagttagccaaaacaatgcgctatttggagttaatggtatgtcaaacctgaagggtaacagtccggagaacggatctttacctgtgccttatgctacctctaccttcacaagtacagtgggtggcgagtatcccgttaattcagacatgacgacatcaagttgtgtagatgaatcaggtgtcttgcagtcctcagaaaatgtggatcaagcaaactcacttacagaaacctttgttaaggtttacaaatcagagtcctttggacgatcactggatatctccaaatttagcagctataatgagctgcgaagtgagcttgctcgcatgtttggccttgaaggcctgttggaggatcctgagagatcaggctggcagcttgtattcgttgaccgtgagaatgatgttctcctccttggtgatgacccctggcatgagtttgtgaacagtgtttggtacatcaagatactctctccacttgaagtgcagcagatgggcaaacagggcctcgacctaccaagtgctggcaaaacgcagaggatcactagcaatggcaatggctgcgatgatttcatgaaccggaaccattcgtgtaatattatgaatgggatccctctgggatcacttgagtactaatttatgttgcttggacactcaaaatgttattgcacccgtgttggatcgtacactacttttggaggataagacacactcgttggcaattttgacgagtttgagcaacataaactactaatgaacaagaacaaccaagtgacccctaaggtaaatgtaccatgtagttgctggtatcagcaattctttgtaccttgttctatcaaaatgttattttttgtcatgcatttcttctacctaaaaaaaaatgaggtcaaatctcatttaaaccttgtaaaccagataattttcaatgtaattatttaatgttgtattgttgttattcctgtggaacaacttcaagagacaactgtacaatagtgttactagctgaagcaatgtcttttcttcctattgtatttaagaatagactgattacttaaaaaaaaaaaaaaaaaa

SEQ ID NO: 7469 - DNA, 1087 bp, Lycopersicon esculentum
  Predicted polypeptide sequence is orthologous to G1451
gtatcttcatcctcatcatctaagcgaattgctctagaatctcagctcccttctcgggttactccatttgtggtgtcccagcctgaggatgtgatagcgcacaatacaaaggtctcggatctttcctctttactgccaccttttcctagtagagaatcgttttctgattatagaggagtagacgatagccaaagcaatgcactctatggatttacagactttttgaacatactgcagaccggtatgtccaacatgaagggtagtagtggtgataatggatctttatctattcattatgctacctctaccttcacaagtactgcgggcaatgagtacccccttaactcagacatgacagcttcaagttgtgtagatgaatcaggtttcttgcagtcctccgaaaatggggaccaagcaaacccaactaatagaatctttgtgaaggttcaaaaatcagggtcctttggacggtcactcgatatctccaaatttagcagctatcacgaacttcgaagtgagcttgctcgcatgtttgggctagaaggcttgttggaggaccctgagagatcaggttggcagcttgtaattgttgaccgagagaatgatgtcctcctcctcggtgacgatccttggcaggagtttgtgaacaatgtttggtacatcaagatactttctccacatgaagtgcaacagatagggaaagagggacttgatcttccaaatggtgtccaagcgcagacgcttcctggcaatgtcaatggatgtgatgattatatgaaccagaagggctcccgaaatactatgaacgggataccattggggtcacttgactactaatgaccattagtgtgatctgcctaaggtaattgtactgtatagttgttgttgcccttggttaatgtctgcaaattttttgtaccatgttgtgtcttaagtgtcatgtatcttttctatctaaagacaagggccaagtctcatttgtagcttgttaccccagagaagtacaatgtaaattataaatattttattattgataagactggaactaccttctagtgatcagctgcaaaaaaaaaaaaaaaaaaaa

SEQ ID NO: 7470 - DNA, 1056 bp, Lycopersicon esculentum
  Predicted polypeptide sequence is orthologous to G1451
ggaattcggcacgagggaggcaaccaagggtctcattatgggagattgagcctttgactacttttccgatgtatccatctctttttcctctaaggctaaagaggcctttctatcaaggaacctcatcttatcaggatagtaacaatgaagctattaatcgaatgtcatggttaagagggaatgctggtgagctaggacatcattcaatgaatcttcagtcttttggcatgcttccttggatgcaacagagagtcgattcaacaattctcccaaatgatattaatcagcactatcaagctatgctggctactggcttgcaaagtttttgggagtggagatttactgaaacagcaattaatgcagtttcagcagcctgtccaatatctgcaacatgcaagtactgagaattcaattttgcatcagcagcagcagcagcagcagcaaataatgcagcaagcagttcatcagcatatgctgcctgctcaaacccaaatgctgtcagagaaccttcaaaggcaatcccagcatcaatccaataatcagtcagaagaacaggctcaccaacacacttaccaagaagcattccaactcccgcacgaccagctccagcagaggcaaccatcaaatgttacctctccatttttgaaagcagattttgcagatttgacctctaagttttcagcatctgttgccccttcaggcgtgcaaaatatgcttggttcgttgtgttctgaaggaagtaataattcattgaatatcaacagaactggtcagtccgtgatcatagagcagtcgcctcaacagtcctggatgtcaaaatttacagagtcacaactaaatacgtgctccaactcatcatcacttccaacttacgggaaagatacattcaatcctaggggaaattgtagcttggattcccagaatcaagcgctttttggtgctaatattgattcttcagggcatctccttccgaccacagtgtctaatggtactactacatgtgctgatttgtccttaatgccacttggggcttctggatatcagaattctttatat

SEQ ID NO: 7471 - DNA, 509 bp, Lycopersicon esculentum
  Predicted polypeptide sequence is orthologous to G1451
gagagagagaactagtctcggtttttttttttttttttttcgaaaaaagggaatttactcacaaaagttcaactgcattaacaagtttacaaatcaagattcttagtctacatcacatatgtcctgatcctcagtacagcgatcaagattaactaatacaaatagcattgtaatacaaatgacagatggggattaagtctttactacataaagaacagtgtcttagaaacgagaccggattaattaggcgaaagcaaaagaacgccaagctcttgtgaagcagagccacacttggtttatcgaacaacgacagcagtcagtaatcaagtgatcctatagatggaagtccggacatgaaatctcgaccatcagcactattattactgctcatcctttcaggtggaccgcggtttagggatccaacctcctctttccccagtttctgcacatcctcgggtgaaagaattttgatgtaccaaacattattgacaaattcctcccacggatcg

SEQ ID NO: 7472 - DNA, 595 bp, Lycopersicon esculentum
  Predicted polypeptide sequence is orthologous to G1451
tggctacgtggtgacatgggagaacaagggatgcagtcgcttaattttcagggatttggtgcaactccgtttatgcaaccaagaatggatgcttctatgttaggtttgcaacctgacattctgcaaacaatgacagcactagatccatcgaaacttgcaaatcaatcccttatgcagttccaacatagtattcccaacagttcagcgcctttgagtcagattcagatgttgcagccttctcattcacagcataatctgatacaaggcttttctgaaaaccacttaatatctcaggcgcagatgcttcagcagcaattacagccgtcaaaacttcaatgatcaacagcaattgctacagccacagctttagcagcaccaagaagtgaactcgcagtttcaacatcaatagcaaactaagaccatatctggtctctctcagatggcttcagccacacagccccatctttctcatttgcaagtcctaagttcgactggttccctgcaaaccttttctgatatactgggtaaccatgtcaatgcatctagtaattctaatatgcaaagtctgttgagttcattttcccgtgatggagca

SEQ ID NO: 7473 - DNA, 512 bp, Lycopersicon esculentum
  Predicted polypeptide sequence is orthologous to G1451
gagaaaacgagtggatgactaaaatatatagaacgaaaaaaggtggttgtagagatgatataggaaataaatcgaggacaaagttgttaaacgaatgaaatgccgaatattaacggtgaaaaggatctctcacgcgctttaaaaggtgagtaatctcaccaatctggccagtaagcattaagcgttaaaaaatgggcatgaaaagaggagccagagggttgaaatgaaactagattgagttggagtgacaaaatgaaatatcgacacatgttaaggggttgtgtatgtatttggctttctttctttctaaaattcgatttgataatatgttggatagaaggatgattacttgctgctgctgctcatgctgctgctactaatagctgtttcaatgtcttttttaacccaagggctagcccatccgaatttgttatacctctttcaaaatacatcaaagctgtatatcacactcgtgtttctgttggaatgcgctttcggatgctatttgaaac

SEQ ID NO: 7474 - DNA, 577 bp, Lycopersicon esculentum
  Predicted polypeptide sequence is orthologous to G1451
tttgaatttcaatataattggtcagcagcctgtgatcatggagcatcggcggcagcagaaatcttggatggcaaaattcgcaaattcacaattgaacatgggctccagttcaccctctctctctggatatgggaaagaaacttccaattcacaggaaacatgtagtctagatgcccagaatcaatctctttttggtgctaatgttgattcttcagggcttctcctccctacaactgtgtctaacgtcgctactacatcaattgatgctgatatatcctctatgccactagggacttctggatttccgaatcccttgtatagttatgtgcaagattctactgacttgttgcataatgtagggcaagctgatgcacaaactgtgccccgtacatttgtcaaggtttacaaatcagcgtcccttgggaggtcattggacatcactcggttcaatagctatcatgagctacgacaggaacttggacagatgttcgggatcgaagggtttcttgaaaaccctcaaagatcaggctggcagcttgtatttgttgacagggagaatgatgtccttctccttgga

SEQ ID NO: 7475 - DNA, 610 bp, Lycopersicon esculentum
  Predicted polypeptide sequence is orthologous to G1451
cgtctatgcaggtttacaaatcgggatgtgttgggaggtcactggatatcactcagttccacagctatcatgagctgcgacgggaattggggcagatgttcggtattgagggattccttgaagaccctcaaagatcaggctggcagcttgtatttgttgacagggagaatgatatccttctccttggagacgatccatgggaggcgtttgtcaataacgtctggtatataaaaatcctttcacccgaagatgtgcagaagctgggaaaggaagaggctgaatccctgaaccgtggagcggttgaaaggatgagcagcactaatgctgatgatcgggatcttatttctggaatgccatctcttggatcgctggagtactgattgttggaatgcttcaaaagaagaggactgattctgattctcaatcttctcaagggtcagaaattcaaatttcatgcttcataacctggcttctttagctttcgtctaattggtccatctcccaattgtatgttgtattttgcgtttggatgtagctgtaataggacttaagggttctcccatttgtatggtgtagttatcattgtaatcctgttgtacaagttagtata

SEQ ID NO: 7476 - DNA, 903 bp, Lycopersicon esculentum
  Predicted polypeptide sequence is orthologous to G148
aaaaatggggagagggagagtggaactaaagagaatagagaacaaaatcaaccgtcaagtgacattttctaagaggaggaatggtttgttgaagaaagcttatgaattatcagtgctttgtgaggctgaagttgctctcatcatcttctctagtcgtggaaagctctatgagtttggtagtgcaggtatcactaaaacccttgagaggtaccaacgttgttgccttaatcctcaagacaattgtggtgaaagagaaacacaggccaagtttgaagcacttcaacgaactcaaaggcacttgcttggtgaagatcttggagcactaagtgtgaaggagttgcaaaatcttgaaaaacaacttgaaggtgcacttgcacaagctagacaaagaaagacacaaataatgatggaacagatggaggagcttcgtagaaaggagcgtcatcttggtgatgtgaacaagcagttgaagattaaggtttctcttgaactatcatcgtttgagggtgaaggacaaggtgttccttttccatggagtaattgtaatgcatctttagatgaagcaggaagcagcacctttcatgtccaccattctcaatcaaatcacatggactgtgatttacctgatccagttcttcaaatagggtatcatcagtatatggctgcagatggagcctcagggtcaaggaacatggctgttgagagtaacattatccatggttggggtctttaatttctaattctaattatggattatactagtacaagttttttgcttttaagtttttcagattaaaaaactcaagtgacatataattatgatttgaaatgcatgttatatagtaatgtataattttagcaagtgtcatatacactcctgtttttaaaaaaaaaaaaaaaaaa

SEQ ID NO: 7477 - DNA, 499 bp, Lycopersicon esculentum
  Predicted polypeptide sequence is orthologous to G148
caaaatcaaccgtcaagtgacattttctaagaggaggaatggtttgttgaagaaagcttatgaattatcagtgctttgagaggctgaagttgctctcatcatcttctctagtcgtggaaagctctatgagtttggtagtgcaggtatcactaaaacccttgagaggtaccaacgttgttgccttaatcctcaagacaattgtggtgaaagagaaacacagagctggtaccaagaggtctctaaattaaaggccaagtttgaagcacttcaacgaactcaaaggcacttgcttggtgaagatcttggagcactaagtgtgaaggagttgcaaaatcttgaaaaacaacttgaaggtgcacttgcacaagctagacaaagaaagacacaaataatgatggaacagatggaggagcttcgtagaaaggagcgtcatcttggtgatgtgaacaagcagttgaagattaaggtttctcttgaactatcatcgtttgagggtgaa

SEQ ID NO: 7478 - DNA, 1388 bp, Lycopersicon esculentum
  Predicted polypeptide sequence is orthologous to G1480
aaaaataaaaagcaaatcaatttttgattctctcacttaacacagaaagaaaaaactaatcgaaataatgggaacggagaattggagtttaacggcgaagttatgtgactcatgcaaaacgtcgccggcgacggtgttctgccgggcagattcagcatttctctgcttaggatgtgactgcaaaatccacgcagcgaacaagttagcgtcacgtcacgcgcgtgtctgggtttgtgaagtgtgtgagcaagctccggcgagtgtcacgtgtaaagcggatgccgctgctctctgcgttacgtgtgaccgtgatattcattcagcaaatccgttagctcgtcgccatgagcgttttccggtagttccgttctatgatttcgccgtcgcgaaatctcacggcggtggtgataccgatgccgatgctgttgatgatgagaagtactttgatagtactaatgagaatccttctcaaccagaggaagaagctgaagcagcgtcgtggatacttccgacgccgaaagaaggaactgatcagtataaatctgctgattacttgtttaatgatatggattcatatttagatatagatctaatgtcatgtgagcaaaaaccacatattcttcatcatcaacagcatcaacacaaccattacagctccgacggagttgtaccagtacagaacaacaacgaaactactcatttacccggtccagtcgttgatggattccctacatacgaactcgatttcactggatctaaaccttatatgtacaatttcacctctcaatcgatcagccaaagtgtttcatcatcatctcttgacgtcggagttgtaccagaccacagcacaatgacggatgtatcaaacacttttgtgatgaactcatcttccggtgctattgccggcgccggcgccgacgttgtaccgaatgcagtttccggtttagacagagaagcaagggtaatgaggtacagagagaagaggaagaatagaaagttcgagaagacgattcgatatgcttctagaaaagcttatgctgagactcggcccagaatcaaagggagattcgctaaacgtactgaaactgaaatcgattcactcatcaccgtcgatgcatcatacggtgtcgttccatcgttttaattattttttatatatatatttattatctctaattattaaaaaaaaaaaaaaaaaatttgcttttttcctctttatgttgttagtgaggaggatcgtaactacgtgtatatatatctaattttgtttctctttttttgtatcaaaaagctattaaaaaaatagaaatttgtaatggataaattttgtagtgaattattaaaattttcttatattttgtttaatgatgaaatttgaaaaaaaaaaa

SEQ ID NO: 7479 - DNA, 1377 bp, Lycopersicon esculentum
  Predicted polypeptide sequence is orthologous to G1480
gttagggtagagaaaaagaagaagaagaagaagatgggcatatttagagaagcccccaattgttttcccggaggatggaacatcggcgcggcggcacggatggcaaagtcgtgcgagtattgccacctggccgccgcgctggtgttctgtcgcacggataacacgttcgtgtgcctgtcgtgcgacactcgcttgcacgcccgccacgagcgtgtgtgggtgtgcgaggtctgcgagcaggcggcggctagtgtcacgtgcagggccgacgcggccgcgctgtgcgtcgcgtgcgatcgcgacatccactccgcgaacccgctcgcccggcgccacgagcgggttcccgtggtcccgttttacgacccggtggagtcggtcgttaagtccaccgccgccacactcctcgtatcaatcaacggtaccacaaccacagccacaaccacggccacgatcaccccagagttgggtaaagtagatacttgtattggacaccatgaaaacaacaatgatccatggattccaccaaacacaatcacatcaaagcttccattaaacacagaaatgaaagggatggatttcatatttacagattcagaaaactttcttgattttgattatcctgcttgtgtagacacacaatctcaacctcattacaattcatccaatgatagtgttgtaccagtacaagctaatactccaattaaatcattgccatttcatcatcaagaaaaacattttgagattgatttcactcaatcacacatcaaatcttacaacaccccatcactcagtgtttcttcgtcttctttagatgttggaattgtaccagatggaagttcaatttccgaaatatcatacccatatataagaactatgaataacagcaacagcagtattgatttatcgaattctgcgaatcatcaaggtgaaaaattactgggtttagatagagaagcaagagttttgcgatacagagagaagaaaaaaaacagaaaatttgagaaaactattcgttatgcttcaagaaaagcttatgctgaaacaaggccaagaattaaaggtcgatttgctaaaagaacagacggaagcgccggcgccggcgagtttgatgacgttgacgggattttctccggcaccgatttcattgcggctgagtcgcgatacggcgtcgttccttcgtttttaacttaatttaattattatattaaaaaaaaaagaaaaatagttttattttctatttttagcttataagttgtactagtatttctaattacccgaaaatatccaatgtgtagtggggtttttatgtactaatggaagggtattttggtaactaaaataatagtcaaacttttttttttgtttataaaaaaa

SEQ ID NO: 7480 - DNA, 376 bp, Lycopersicon esculentum
  Predicted polypeptide sequence is orthologous to G1488
ttttttttttttttttttgctaggattgctaggaacattttatttttagctcctatctcttcatatcgtgatattttcaactttctaaaactagatggaattaggaaaatgggattgttaattcaaactttttttttaaaacgagaaaagtgcaaagtagttatcccctacactaggtgactgatactagatgaggtgcctgaaatttggaccacaattttggtgatgatgaagcagaaattcatcaccgccgtttgatacaccgaaaatagtgggttgactaagcaattgatgctggtggtgatgtgcttggtgtctctggagatccttttgcctccggagttccagaactttccgatgagaattcgagtctggt

SEQ ID NO: 7481 - DNA, 875 bp, Lycopersicon esculentum
  Predicted polypeptide sequence is orthologous to G1488
gcttcacactcaattccttcattctctcttcctttttatcagcttccgattctccatataaagaattagtctcaaacctaccgttactttgcgttttacactccaccattcttctcttacactacacaccaacaacttcttcttctaaacaatggaagcgtcggatttattcgtcagcggttttttctcgcatgccggagacgaacaaattccgaataacatcaacaataactgtaacaatttttctgtggatgatcttttggttatcccaaaggacgatgaagttatggcagacgcatttttcaacagtattacaggaaattctgctgattcttccaacgttaccgtcgttgacagctgtaattcctctgtttctggtggagatggacaatttaacggaaacctgagcggccgcagcttcaccgatgctcccttccctaacagcgaactctgtgttccgtttgatgacttggctgagcttgaatggctctcaaattttgtggaggaatcgttctcaagtgacgacgttcaaaacttgcaattcatccctgtagcaaacattaattcctcctccaccgtcaccaccgacagttcctcttccgcaaccacattttccaccggacctaactcgccacctgccttccccgccgacacctctgttcctggcaaagctcgcagcaagcgctcacgcgccgctccctgtgactggtcgtcacgccttcagctgctcttatcccctgccacatcatcatcagagagcaacaacatctcgcctccatctgttaacaacactactttcgccacggccaaagccaccaaagcgccgtcgaagaaacgagagagcgtagaaacgccgggacggaaatgcctgcact

SEQ ID NO: 7482 - DNA, 840 bp, Lycopersicon esculentum
  misc_feature (751)..(751): n is a, c, g, or t
  misc_feature (771)..(771): n is a, c, g, or t
  misc_feature (773)..(773): n is a, c, g, or t
  Predicted polypeptide sequence is orthologous to G1494, G789
tcacaactttggatcagcgcaacagaaacatcatatagtagggggggatcagaaaggtgttaactttcctccaccgataaggtcatccaatgtgcagcttggtggcaaagaagctagaagcaatctgatgctgcaagatattaaagaggggtctgtgatgacagttggttcaagccactgtggcagcaatcaagttgatactagccggttttcaagtagtgcaaatagagggctgtctgcagcaatgatcactgattataccggaaaaatcagtccacaaagtgatacaatggaccgagacacatttgaaccagctaatacatcttcgtcttcaggaagatcgggtagtagttatgcaagagcatgcaatcaatctacagcgaccaatagccagggccacaaaaggaagagtagagatggtgaagaaccagaatgccagagtaaagctgatgagctagaatcagctggaggaaacaagtcagcccaaaaatctggaactgcccgaaggagccgtgctgcagaagtgcataatctctctgaaaggagacggagggatagaatcaatgagaaaatgaaggccttgcaagagcttcttcctcactctactaagacagacaaagcatcaatgctggatgaggctattgaatacttgaaatcacttcagatgcaactgcagaatgatgtggatgggaagtggcatggcatcaatgatgttccctggtgtccaacactacatttccagaatgggaantggggatggggtccgccttncngtgccttccatgcacaatgctatgcatttagctaggctttcctttgggtgatccagcaatccctttg

SEQ ID NO: 7483 - DNA, 668 bp, Lycopersicon esculentum
  Predicted polypeptide sequence is orthologous to G1494, G789
gtgaaacaacggccacagagtttttttccctgacttggtttgttttcccattactaaaactttggtgtttctttctttttctgaacctaaaagggtttttgggttatttaacttctttgtttccttctttctgtaagtagttttagccatgaatccattatcttcctgaatggaatattgagacctgaacttcctgctccacatcaaaagaagcctatgggatttgatcatgagctagtggagttgttgtggcgaaacggggaggtagtattacatagccaaacacataaaaaacagccaggttatgatcctaatgaatgcagacagtttaacaaacatgatcaaccaacaataagagttgctggaaatcagactaatttgattcaagatgatgaaactgtcgcgtggctaaactgccctatcgatgattcgtttgacaaagaattttgttcccctttcttatctgatatttcaacaaatcctcacctgggggaggagcctgataagtcaattaggcaatcagaggacaataacaaggttttcaagtttgatcctttagagatcaaccatgttcttccgcaatcacatcattctgggtttcgatccaaatccaatgccacctccaagatttcacaacttttggatcagcgcaacagaaacatcatata

SEQ ID NO: 7484 - DNA, 498 bp, Lycopersicon esculentum
  Predicted polypeptide sequence is orthologous to G15
taagttcttttaatgattgtgaactgtcttgaactatataggagaagagaactatttgtaacggacaaaaacctcaacaactgaatgaagatgaagtctatgaatgatgatcgcagaagtagcaacaataatatcggtaataataaccgtgcggtagcttatcctaactggtggggtttttctctcacaccccacatgaaaatggaggttactaattcttctgatactcaacatcaacatcaatttgcacaaagttactatctttcatcttctcctcctccaccaatgaatgtatcaacaacctctgctctctgttatgaaaataacccttttcattcaaccttatctgtcatgcctatgaaatctgatggttctctttgcattatggaagctctatcaagatctcatgctgatgctatggtgcaaagatcttcacctaagcttgaggattttttaaggggtgcaagtatggggaatagtcaatatggaagtcatgat

SEQ ID NO: 7485 - DNA, 554 bp, Lycopersicon esculentum
  Predicted polypeptide sequence is orthologous to G15
gcctcgtgccgcggagttctagagagagagagagagagattgaggtcaaattgcttcatagttataatgagtaattggttggggttctctcttactcccgatttcagaatcgatgatgatgatgaagaagaagtaaaaaattacgaaaggcgaaacgaagctgctgaaaatacttctttgtcggtcatgcctttaagctctaatggttctctatgtatgatggatcctttcccacgctgtgaacccactgaagattgttggaggtatgagaatcatgaaatgagtactgctaataatccagaagaagagggtccgaaacttgaggatttccttggatgctgttactcaaattctcttcctaatgaagaacaacaaattgctgaaatcaacgttaatattccacccagcataaatcaatctgatcacgaacagcaccagttagaaattggagcgaacatgaaattgattccgtctccacagatgatgattcaaaatagtcaatttcagagctctcatcatgagtttgtgaactctactgatagtgtctatcatct

SEQ ID NO: 7486 - DNA, 329 bp, Lycopersicon esculentum
  Predicted polypeptide sequence is orthologous to G15
ctgtccacaggaaatccattgacacatttggtcagagaacttctcagtatagaggtgtcactagacataggtggacaggtaggtatgaagcacatttatgggataatagttgcaagaaggaagggcaaaccaggaaagggagacaagtttatcttggtggctatgatatggaagaaaaagctgcaagagcttatgatctagctgcactaaaatattggggtccttcaactcacatcaatttcccattagaaaattatcagaaagaacttgatgacatgaagaatatgaccaggcaagaatatgttgcacatttaagaaggaaaagtagt

SEQ ID NO: 7487 - DNA, 628 bp, Lycopersicon esculentum
  Predicted polypeptide sequence is orthologous to G1506
caaatgggaagcaatggtgccttcaaggaagagaacctgcataagtcgttcaaagcattcttcagttgaaaagctcactaaagacctgtgtacgatcctacatgaacaacaatcttcatacttctctggatcttctgaagaggatttgctttttgagagtgacaagcctatggtctctgttgagattggacatggaagtgtgcttattcgacatccaaactcaataggtagagaagaagaatcagaaggcagttccctgtcggttaataacaagcgacattatgtaaatgaggcttattcacgattgtctgccccacctgtaaatattaataggggtgtcaatttaccaaatctgggcacggagataaccaagaagcctaacagtcagggaatggaacaacacccgattaaaagggataaggatcaccttgaaaaattgcacattcttggacatcatacttcaccactgtgccatatagacctgaaggatgtacttaattatgaagagttcgtgacacatttctcaagcgatgaacagaagcaactactaaaatacttagctcctgttgattcttttgcacccccagatagtctcaaaagcatgttccatagctttcattttgaggag

SEQ ID NO: 7488 - DNA, 442 bp, Lycopersicon esculentum
  Predicted polypeptide sequence is orthologous to G1506
atccgttgaaataggacatggaagtgtgctcagtcggcatccaaggtctataggtagagaagaagaatcataacccagctctctgtcggttgacaacaagcaccattcttcaaatgaagcttattcccaattgactaccccacctgtaaatattagtaagggtgtcaattcatcaaacctggttattcagagaacccagaagcctactgttcaaggagtggaacatgaacagtttaaaaggagcaaggaccaccttgaaaaattgcagattctcgggcatcataattcgccattgtgccacatagaccttaaggatgtacttaattatgaagaattcacaaggcatctgtcaagtgatgaacaacagcaactactaaagtacttacctccagttgattctttttcacctcccgagagtctcaggagcatgttcgagagctct

SEQ ID NO: 7489 - DNA, 548 bp, Lycopersicon esculentum
  Predicted polypeptide sequence is orthologous to G1510
cagcagcagcatcaacaacaccaaataatgggacaaatttcactagtactgaaacaacaacaacaacgactatgaagataaaggtacaacaacaaaagcacaaaataacaaaagtgaatgccaatcatgttgtacccttcaagaaaaggtgcaaatttttaagtagtactactactcctgcacctgaacctggacttgtacctacacctgctcctcgtgttggttcatcatcatcgtcatcattttataataataataacaacgacgtgcaacaaaagaagaagatctgtttcgaagatttctttatgaatttgagcaataacttggcaatccatcgcgttttccctcaggatgagaaggaagcagcaattttgttaatggcattatctagtgaccttgttcatggttaatggcattataaaattttcttgagtttctattattagtttaagttattaattagatggagtagcaccaaattagttgtgtgaaactgagctagaattaatactagtgagagtgagagtttttataagtcaagctacaaa

SEQ ID NO: 7490 - DNA, 520 bp, Lycopersicon esculentum
  Predicted polypeptide sequence is orthologous to G1510
caaaatttactcttcttattgccatgattcccaattacacaaattcttcttcttcttcttcatttccttttgaacttactaatgaagttcatcatgattatctaagtcataataataataatatgtctcttgttagcccttataataataactatcaattcgcttcatcatctacaaattcatcttgtcaaaatttcttcaatatttcaactactactaatattcaagatcaaagtggatatgattatcaatttcatcagccacaacaccatcatgaggttgataattttgcttcaagatcaagtggatcacatgatcatgtagacaagaaaaacaagggactcaaattaaccttatggaaaaaaggggggcaaaaagtgaagaatttgaaagtagaagatcaaaagcaacaaatcatagaaactgattatagcagcaacagctcttccaacaacaatatcatcccaattagggtttgttctgattgcaacactactaaaacccctctttggagaagtgg

SEQ ID NO: 7491 - DNA, 756 bp, Lycopersicon esculentum
  Predicted polypeptide sequence is orthologous to G1521
attgtctctcttatggactccagatttaaggaaattgccgctgccgttgcccggcaatcatgtccgatatgcctctgccagatacaccatcggagcgcggcggttgttatcccatgtatgcacgcctactgcatcgtttgcatccgcagatggagcgatgtgaagagaaaatgccctctctgcaacgccgactttgattcatggttctccagaatcagcttctcctcccggaccttccagaaagagcaattatcagctcgtaacgagactaagaagttacactcaggttttgttccctctaggctgagagaccgattggcggaccgaagagtgattaggagaaggagagaagagttgaatacttttggctccagaacgaggccgttcccaaggcggcgatcctttgatcacaaaggagctttgaatccagatgatattactaggagaatcattctctggcgttccagcatttatgaagagagattgcaggctgttcctttttcatctaaaaattgccttatgcagcacatggataataggagtaccaaagaaaagatgttacagagaatagaaccttggataagaagagagctgcaggctatactgggtgatccagatccatccattatcgtccatgttgctacctcactttttatcactgagaatacacattcaacacagtggtgcgacagaaatgaatttcttgctccattgcggcccttcttgcatgaacgtgcagaagtgttttggcatgaa

SEQ ID NO: 7492 - DNA, 698 bp, Lycopersicon esculentum
  misc_feature (625)..(625): n is a, c, g, or t
  misc_feature (684)..(684): n is a, c, g, or t
  Predicted polypeptide sequence is orthologous to G1535
caagacatgcccaatggatactctagggttacatgggttgaacatgctgaggtggaggaaaatccagtgaatcaaatatttaatcactttgtaactagtggagtggcatttggagcacaaagatggttatcaatcttgcaaagacaatgtgaaaggcttgctagtcttatggctagaaatatatctgaccttggagtgataccatctccagaagcgcgaaagagcttgatgaatttggcacaaaggatgatcaagacattttgtatgaacattagtacttgttgtggtcaatcatggacagctctttctgattctcctgatgacactgttagaatcactactagaaaagttacggaaccaggacaacctaatggactaattcttagcgcggtttcaacttcttggcttccatataatcatttccaggtctttgatctcttgagagatgaacgtcgtagagctcagttggatgtactttcaaatgggaactcattacatgaagtggctcatattgcaaatggttcacatccagggaattgcatctctcttcttcgaattaatgtggctagcaattcatctcaaagtgtagagctaatgctacaagagaattgcacggatgattcanggagcctggtggtctacacaacagtagacgtggacgcgatccagctagctatgaacggngaggatccatcgtg

SEQ ID NO: 7493 - DNA, 811 bp, Lycopersicon esculentum
  Predicted polypeptide sequence is orthologous to G1538
ttagtcttcactccatctatataatttttttttcccttcaaaataaataaataaaagtcttctccatttcacttttacaccacaaaaaataaataaaaatataaacaccatgaaccatcaggttatagaagatgataatatggtacttatttcccagtactatcctgatatttacacccaacttgtaccacaacaaggagagtcaaagccgcggagaagacgtaagaagaacaaattaggagaagggagtgggaatgatcaaatgatgatgatgaggaagaggaagttaagtgaagaacaagttaatttacttgagcaaagttttggggacgagcacaaactagagtcagagagaaaggacaagctagccgctgagctagggctcgaccctagacaagttgcggtgtggttccaaaacaggagggctcgttggaagagcaagaagctagaggaggaatattcaaagttgaaatctgaacatgacaataatgttgttgagaagtgtcgtctggaaactgaggtgttgaagttgaaagaacaattgaatgaatcagagaaggagatacaaaggctattattagaacgatgtgatggggtatcgagtaattacacaagtccaagtgcttcatctttctcaatggaagcaccatttctaggggaatttggaatggatggattggacaatgtgttttatgcacaagagaataattatgttcaaggattagattgggtgaacttatatatttgatataaataattataaacatcatcatgtgattaatttctaaaaaaaaaaaaaaaaaactcgaga

SEQ ID NO: 7494 - DNA, 675 bp, Lycopersicon esculentum
  Predicted polypeptide sequence is orthologous to G154, G1797
gattccttaactattttcttttccatcctctttcctttttcccggaaaatcggaatttaaatggtgagaggaaaagtagaaatgaaaagaatagaaaattcaacgagcaggcaagtgacgttttcgaaaagacgaaatggacttacgaagaaagcttatgaattatcagttctttgtgatgctgaagttgctttcattattttctcacataaaggaagactttatgaatttgctagctccaacatgcagaagataattgagagataccgaggacgtgcaagagaaacaacgacggtggacaaaagcactgaactcgagcactacatggagaacttgaagcatgaaacagctaatatggcgaagaagatagagatcctcgaaatttctaaacggaagctaatggggcaaggattagggtcatgttcaatggatgaactagaagacattgacagccaactggagaggaccctcaaaattatcagggctagaaagactcaattgttcaaagaggaaatagaaagtctaaaagcaaaggagagactattgctccaacaaaatgcaagtttacgtgaaaagtgcgggcttaggccaatgctatcagagtcagcatctgcacccgaacccataccagcaccaccatcaacaccaccagctcaatcaaaagaaaggggaaat

SEQ ID NO: 7495 - DNA, 538 bp, Lycopersicon esculentum
  Predicted polypeptide sequence is orthologous to G154, G1797
ttacatttgtaagtgtattgtgtctttccattttagctccaaatagtccttttgcaaccaaaatcttgtctgagatttttctatatttgggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcatacctgaggtaattgaacgatataagaggcatactaaagataaagttaaatctgatgaaaatcaatctgtggatattcagcatactaagcaagagacagcaagtttgatgaagaagatagaactccttgaatcatctaaaaggaaactcttgggagaaggtttaggatcatgcagccttgaagaagttcaacaattagagaagcaattggagcagagtgtcattactattacggctcgaaagatgcaag

SEQ ID NO: 7496 - DNA, 518 bp, Lycopersicon esculentum
  Predicted polypeptide sequence is orthologous to G154, G1797
ttttttttttttttttttcggcgtaatttttataattacagagtaaaaaggacaaattattgtatacaagatcttaccctcaccttttgtgaggtaaatatgctatttctgatagaccttctcctctaactaatgattcaagacattaaaaaaaaactatatttaagtaatgtagtttatattattacaactctataaattataattacagtgttaatataaaacttgaaaccccaacaattttgacaattaaagtaatgtaggtagtgtgtttaaattaggacaatatgaactttttctagtctctggaagtcctataaagagctctgtctcaacttccattatttgtctttcaacatctttctctactagaggaactggtgttaaagtcaatggtagcacctgacacttttttttcaagtctacattttccttcaatagaattttttcctcttccttcagttgagcaatctgttccttgaataacagattctttcttgccctaatgttgcttaaac

SEQ ID NO: 7497 - DNA, 604 bp, Lycopersicon esculentum
  Predicted polypeptide sequence is orthologous to G154, G1797
tttcgaggaaggaaagtagtattagaaaagtcggggagaaatcaatgctcttcatttttttccccctttttctaaactagggtttctataacaacaactatttgtgtcttcactctattataatttaacttataaagttttttctaatttctttttctcttcatctttcagatctaagaaaccataaagtttttatttttaggggttattatccacttcaagatttagaatctttctatttttggaaacttctcatgaattggtggaaagaggatatttctgaaggacgtctaatacgttaagggcattttttcgcgaagaagaaaatggtgaggggaataactgagatgaaaaggattgaaaatacaacaagtagacaagtgacattctcaaaaagaagaggtggactacttaagaaggcatttgaactctcagttctttgtgatgctgaagttagtctcatcatattttctcaaaaaggaaaactttttgagttttcaagttcaagtactaacaagacaatagaacgttatcaaaagaatgacaagaatttgggtcatgaaaatatattacttgaacaaactacaaagcatttgaaggggga

SEQ ID NO: 7498 - DNA, 413 bp, Lycopersicon esculentum
  Predicted polypeptide sequence is orthologous to G154, G1797
aattaaggggattgatctaaagatatggttcgaggtaaaacccagatgaggcgtatagagaacgccacaagcagacaagttactttctcaaagagaagaaatggtttgctaaaaaaagcttttgagctttctgtcttatgtgatgctgaagtgggattgattatattttctccaagaggaaaactatatgaatttgctagttcaagcacgcaggagataatagagcgatataagaggcatactaaagacagagttcaacctgaaaaccaagctgggccacagtatctacagtatatgcagcatgaggcagcaaatttaatgaagaagatagagctccttgaaacagcgaaaaggaagttcttgggagaaggtctgcagtcctgtacccttcaagaagtaccacagatagaaaa

SEQ ID NO: 7499 - DNA, 510 bp, Lycopersicon esculentum
  Predicted polypeptide sequence is orthologous to G1549
gagatcgatggggaatgcatgtaatgattaaaacaaatggctccccaactgatgtaagctattcttttccctcataagctttttatttcactttgcttttttgttacttcttttcatttttaatcatgccgtgctagctcatcatcaaacacatagcattatatttaacctccatagagaatctaaattttttaaaggataacgatcacaagttttaggaaataagtgcaacttccattgtcacatgttatataattctatatttctcattgcttattggtttgtgctcttaccatgttttaattcacgtctcaattgccaccatgtttaaatcaattgtccgtaggaagtgtttctaaggtgctgttgctatttttacatctgttcccgagttcttttttttttctttttgaactttccactaaagctattatgtcgtccacagtgaattttcacgtctgttgttataggcaagtctttgagatgggactatcaaagaagggcgattac

SEQ ID NO: 7500 - DNA, 831 bp, Lycopersicon esculentum
  Predicted polypeptide sequence is orthologous to G156
aaaacacaagaagaagaacaaaggtgataacaataataataaataaatataatggggagaggaaagatagaagtgaagagaattgagaacaaaacaagtagacaagttactttctcaaagagaagagctggacttttgaagaaaacacatgaactttctgttctttgtgatgctcaaattggactcatcattttctcaaccaaaggcaaattgtttgagtacaccactcaacctcacagcatgggtgaaatcattaataagtatctgcaaactactggtgcctcacttccaattcatgatcatagggtggaacaatatgatgaaataacaaaaatgaaaagagaaacattgaatcttgaattaagtcttcaaagatacaaaggtgatgaattgaactcagcacaatatgatgaattaaatgaacttgagaagcagcttgaaaattctattaacaaaattagagccagaaagcttgaactcttgcaacagcagatggaaaacctgaagagaacagagaaaatgttggagaaagaaaatcatgatatgtgtcagtggttgatgaagtatgaaatgtacaagcaacagccagtagcaatgatggagcaacaagaagaagcagcaattactgaactgaatttacttggagaacaaccattgttgtctcaattttcattctttggagatcaacaccaacttggtactacaagtaattcttcagcatatcaccttcaaacttctcacccttttactccctctacctacgattgatgaggaggagctgcaattgctggggataattaattctacatttcctttggcatatttagaagc

SEQ ID NO: 7501 - DNA, 875 bp, Lycopersicon esculentum
  Predicted polypeptide sequence is orthologous to G157, G1759, G1842, G1843, G1844
gagagaactagtctctattttttttttttttttttttttcacaaaaaaatcataacaataatgtgtagggtaatcaatttcaagtactccattatacaacttaaaaagagggaaaaataggcatataagtcaccctctagtaaatatgtcaaagtagagaagttaactttaatcatcatccattagaaacaagaacaaggatgaataattattagttttattgaaactaattttgcaggttcctctggtgcagaagcaaggcttttcgacgaatacgacgataatcactagaagaaattcagggtaactttttgttgtccacaaatcatgtggggtgctggaaggtcagacatttcattcacttttgtgtttttcttgatactagctatattgtcctccagatgtttcttttcctctagcagcagtttttccttctcatgaagaaccttagcagattcaagcatcaaatgtgtctttctagctctgagatgtattagagcagtttgaagttcgttttccaaatggataaggtcagtcaaagtgagaccatcagcatttgtttcctcgagttgcctttctgttgtttgtagcagttctcccattgttgtgaaccccgacacctctgcgacctggatttctgcattgatctctttttctgctccaacatggctttcatatcgtcgaagcatcgctgtcatactgttattgctggagaattcatggagtctaccacgatttgagatgataacaacagcaacatcgacatcgcagagaatagaaatttctttagctttcttcaataaacccttcctccgtttacagaacgcaacttgcctgcaatttttatcttgaattcgcttaatttctaccttccc

SEQ ID NO: 7502 - DNA, 1238 bp, Lycopersicon esculentum
  Predicted polypeptide sequence is orthologous to G157, G1759, G1842, G1843, G1844
gtttaataaccatgggttatcctatttctgattcaatcctttacctagtaactgacttcaaaacatacagctccatctcctaatttctgaaaggaacttgtggtgtgttctttcgtaagcatttattaccctgttatcactgtttggcacaaaggcaagacttcttatttccccaaaagaaccaactcttccaacgacacttcaagatagaaaaccaacttttgggttattatgctcaaatagccaactaaaatttcagtggctttaataacctgtattttgtttatgactgggtttacagtgtaaaatgttgagttgtgttatttcttcatgcaatctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcgaagaaaatgagatggcaatgaatctaaataacatcgcaccaacccatatggattgtggacaacagagggagaccctgaattttctctagagtctagacacactaatggcatcacatatcagatagaagctcaatatataaataacagccttccaaaatatagcagagcagccactcctcgcgccatgggatatgtcctgccgaggttatatctggtgcatctaactagggagtgctactatgtagtcttctcttgtatgttgtcttggtatggttgaaacactgaagaactgtataaagggtaaataaataaagagatactgctgcagcgtctcgataacatgtgtgtaatgctatcatctaaatgactgtaaattagaggttattataatagtaagagggtgtagtccataagaatgacttgtccaagctgttcatgtttgatagtccgcatcggtctaattcatttcagcccattagaaaatgagacaaatgtggctatacgcagaggactattgcatcaacgaatgactttctagttaaaaaaaaaaaaaaaaaaaaa

SEQ ID NO: 7503 - DNA, 626 bp, Lycopersicon esculentum
  Predicted polypeptide sequence is orthologous to G157, G1759, G1842, G1843, G1844
gtatgaaattcgtgaaagtgatggagatggaggtacaaatcttcttatattcggtcattttcatttgtgagaattagttagggtttgggagattgaagaaatggggaggaagaaagtggaaataaagcgaattgaagataagagcagtaggcaagcaactttctccaaacggagaaatggactcatgaagaaagctaaacagctctctgttctctgcgatgttgatgtcgccgtcctcgtcttctccagtcgcggacgcctctttgaattctccagtaccaacagtctgacaggagttattcaccgatataacaaccacatgaaagcagaagataaggcctctgcagaagtcgatgacaccgaggaatcaaaatatgcaagtttcatgacaatggaagaactgctacagacggcagaaaagcaactcgaggagcctgatgttgatgatctcagcattactgatcttgtccatctggaaaaccaagttgagactgctctgacacaaaccagatttagaaagacacacttgttgattgaatcaattaagaatcttcatgacaaggaaaagcagctgattgatgaaaacaaagttctggaggatgagataggtaccataaagaacagcg

SEQ ID NO: 7504 - DNA, 489 bp, Lycopersicon esculentum
  Predicted polypeptide sequence is orthologous to G157, G1759, G1842, G1843, G1844
gacacacaaaagagaagagctgggtaggtgtaacgccgatgatagaagaatcttctagacatctgaaatttgtggattagggcttttcatcggcgaaaaaaaaaatggggcgaaggaaggtagaaattaagcgaattcaagataaaaattgcaggcaagttgcgttctgtaaacggaggaaaggtttattgaagaaagctaaagaaatttccgttctctgcgatgtcgatgttgctgttgttatcatctcaaatcgaggcaggctccatgaattctccagcaataacagtctgacagaaatgcttcaacgatacaaaagccacgtcgaagcagaaaaagagatctctacagaaatccaggtggcagagcactctaaatactcagggttcataacaatgggaaaactgctacaaacaacagaaaggcaactcgaggaaactaatgatgatgttctcactgtgactgaccttatccatttggagaacgaac

SEQ ID NO: 7505 - DNA, 272 bp, Lycopersicon esculentum
  Predicted polypeptide sequence is orthologous to G1634
agtagtagtcagttatgttgctcgaactcctagaaatgatgtcacagttgtaaagaaatctgacatgcacgtattgatattttggaagatatcaatatatgcattttctatttatcatctgagttgattcttgatgttaacattagtagtgttgttgttgcattataggcgatttcttatggggttagagaaatatggtaaaggagattggagaaacatatcgaggaatttcgtgatctctaaaacttcaacacaagtggcttgtcatgctc

SEQ ID NO: 7506 - DNA, 351 bp, Lycopersicon esculentum
  Predicted polypeptide sequence is orthologous to G1634
gcaatgtgaaagtgctattgcaatctatgaggagaaaactcctgatcgatggtttaaagtggctgccctcatccctggaaagtcagttattgatgtaatcaatcaatataaagaactcgtttcagatgcttatgatattgaagctggattggtaccaaatcctggctatttcgcctcttcgattacattggaattgattgatcattgtggattacaaacattcacaaaaagagggagtaaatcatctgatcaagagagaaaaaaaggtgtgccatggactgaagaataacacaggagatctctgatgggacttgagaagtatggaaaaggggattggaggaacatatcgaa

SEQ ID NO: 7507 - DNA, 2046 bp, Lycopersicon esculentum
  Predicted polypeptide sequence is orthologous to G1635
gctcttctcttcttcttcctcctttcttcaaaaaaaataaataaataatatttgtgtgttgtttcacacttgtttttagttttatctatcaagtgttttcttgggaattctagaactatttgtctatttattgaatttttggtttgatttaacaactttgatgttgtgttttggtgaggataaggatgaaagtttcgatctttaaaggggaaagattgtttttagtggttgtaaaagtgaacagggtgtgaagagctacagttctgtatgtgggggttgttagatcgtgtgattttttggaattaacggttgatatttctgggttttggaactgaagagaatttaattgggtaaaactgggtttcttctattttaggactcaacgagtactgattcagcagaaatgactataggggatcaaagcgagtcggactcgatacttccttgtaggaataggatgtcagttgatgttggagctccttctccaaggagtatccagatggatgagcaagttaatccaggagaagaatatgctcctaagataagaaaaccatacaccatttcaaagcaaagggagaggtggtctgaggaagagcacaaaaagttccttgaagcattaaagcttcatggtagggcatggcgacgaatagaagagcatgtgggaactaaaactgcagttcagattagaagccatgctcagaagttcttttcaaaggttgttcgtgaatcgagtaatggtgatgcaagctctgtgaaatccattgagatccctcctcctcggcctaaaagaaagccgatgcacccttatccaagaaaaatggcaactccacttaaaagtggaaccctggcttcagagaaattgaacagatctggttcacctgatctctgtctctctgagccagagaatcagtctcctacctctgtgttgtctacccttggttcagatgcatttggtacggtggattccactaagccaagtgagcagtcatcacctgtttcctcagctgtcgctgagaattctggtgatcttgtactttctgaaccattcgatttggttgtagaggagagcagatcgtcacctgcccgagcttatgctacttcaaatccggccaatcaggcttgtgtgaaactagagttgtttccggaagacaatgattttgtgaaagaaggctcggatgaggcatcatccacacagtgtctgaagttgtttggtaaaaccgtattagttactgatgctcatatgccaccgacagacgagacgttgactcgaagctccttccctgcaaaatatttgccctgggattcagaatgtcctcaaagtaccttttctatcgtccctcctacgccgtcatattactttaccacaccaaatggaagttcagggcctaaccaaagtggcgttgcaactactcatttgccgtggggatcatcatgtgcagttccttgcactcaggtgcatagcccaattccaatgaagggacgtccactctttaatgacagatatttggaaggaaaggaaactcaaaaggaagggtcttcgaccggctccaatgcagaatcagtagatgcagagttgagtggagaaaagaacatggaaattgaagctcagagtagtagaaatgtggtagaagagtcggttagagccagcgtaccctctttgtttgagcgaagagcaaattccacgaagcgtgtgaagggttttgttccatataagagatgtttagctgaaagaggcgtgagttcctcaacattaactggagaagaaagagaagagcaacgaacccgattatgtttgtagttttactttctttgtgcctgtttagtttttgtttgtaaaggttagcacatccctttttggttctacttataatatccgtatgccggataactggatgaagagaagcaacaccatggcagcaaaaggcgattcatccctctaatttttgctgaatggagaagcagtcttcgtaatttttttgaatgaattgttcaaatgtatgttgataaaaatcaagtcttgcaacttaaaaaaaaaaaaaaaaaaaa

SEQ ID NO: 7508 - DNA, 867 bp, Lycopersicon esculentum
  Predicted polypeptide sequence is orthologous to G1635
ccactgcatccataccctcgcaaaatggctgattcatctatagctaacaaggcagtttcaggtcagcctgaaaggtctccttccccaaatgcatcaggaagggagagttgttctccagattcggttttgccagcaattggtctagggattgctgaatattcagttgctgagcagcagaactctcgcttttcaccagtctcttgtactacggatgcacacactgcaaatataatttctacggagaatgatgatgagagtatgagctcaaactccaacaatgtggatgcaatccacgtcacgttaaaaccagtagctgctagtatcagtctgattaccaattcagagttcatggaatgtaatatagttcatatggagaattcttgtaatggtgaaaagctagctgttgaaccaccttctgcaagtatcaagctgtttggaaagactgttttcgtaccagatgccaataaccttgctccgccagctccatacaacacagaaaaggaaaaggagatcagctatgaagatgtacttcatggattccaagctaaccaagcaaattcaccatttgtacttgccatggttccaggcaatatgattccaccagcatcttggttgtcacaaaacatgcttgaaaacaatcgtgagagtactgcggccttccctgcagctacaatttcttggtggtcctggtaccaagatctcttatatcggtccatctcatcgtgtggccaaacaaccgtggaggctgcttctcattgtcagggactaaaagatgaagaacctcaaagagagggatcatcgactggttcaagcattggctcagctagtgaagttgacgatggaaacacgagttgtgaaacagttgag

SEQ ID NO: 7509 - DNA, 757 bp, Lycopersicon esculentum
  Predicted polypeptide sequence is orthologous to G1638
gctttctttctatgattctaagttcgactatttaagagtttatcggaaatagtctttttatttagagaaataagatcttcgtaaacattattatcatcatattcgacgtgtgagattacacggtttatagagttgatcaagaagtactcgtcgcgattctgatccagagtatgttcctatctaccgagaagattattagtttttgaagtttgaagaaaattgaggattcttgatttggatatggaaactttatatccaacttgttttgtaccaaattcaaattggattatgcaacagagtaagagtaatacagaatggactaaagaagagaacaagagatttgaaagtgcacttgcaatatacgacgagactacaccaaatcgatggtttaaagtagcagaaattatccctgggaaatcagttcttgatgtgataatgcagtataaagaattggttgcagatgttagtaacatagaggctggattgctcccaaatacgaggcgtggttatacgtcttcttttgcgttggaatttgttgatcatcgtaacattcaaacgtttaataagagaggcaagtcttatgatcacgaaagaaagaaaggcgtaccatggacagaggaagaacataggcgatttcttatggggttagagaaatatggtaaaggagattggagaaacatatcgaggaatttcgtgatctctaaaactccaacacaagtggctagtcatgctcagaagtactatttgaggcaacttt

SEQ ID NO: 7510 - DNA, 753 bp, Lycopersicon esculentum
  Predicted polypeptide sequence is orthologous to G1638
gctctgtttcttcaaagttcaaatctttttcataaaaatgctgtcttgaactatctttcttttaacttttttccccttctgtgaaactttgaccttttttgagtgttggggttatggagattctatcaccagctccttatctttcaaatccaagctggtttcttgatgagggtaagagcacaaaatggactccagctgaaaataaggcttttgaggatgcacttgccttgtttgataaagatacaccagatagatggcatagagttgcagaaatggttccagggaaatcagttgttgatgtgatgaggcaatataaagaattagaagatgatgtgagcagaatagaagctggattagttactattcctggttatagtacttcaccttttacattagaatgggggaatagtcatagttttgatggatacaaacaatcttatgttgttggaggtaaaaggcctttgtctaataggccaccagaacaagagaggaagaagggtattccatggacagaagaagaacataagttgtttctaatggggcttaaaaagtatggaaagggtgattggaggaacatttcgcgtaactttgttgttactagaactccaactcaagtggctagtcatgctcagaagtactttattagacaactttctggtggaaaagataaaaggcgggcgagtattcatgacatttcaacaataaatctcaacgataatcaaacactttcacccagattaccagaaaccaact

SEQ ID NO: 7511 - DNA, 567 bp, Lycopersicon esculentum
  Predicted polypeptide sequence is orthologous to G1638
taatcaagattctcttgttatgccctttttgtgtttgattaaatgcctgtgagaaattagatagtttaaaaagactcttcatttgtcaatcatttgccaagaaaaccaaaaggggttgataattaggtggtacatgatcaagaaaacatgaatagagaaatgggatatctatcccctgcaacatatatcaagaattcaagctggttgtttgaggaaaacaagggaacaagatggacacctgaagagaacaaagtgtttgaagaagcacttgctttgtttgataaagatacacctgataaatggtataatgtagcagcaatgatccctgggaaaacagtgaatgatgtgattaaacagtacagagaattggtagaagatattagtgatatagaggcagggctaataccagtacctggctatactactagtaattctttcacattagagtgggtcaataatcaagatgcttttcatggatttaagcaattttatggtcaatctgggaaaagaagctcgtcgaatcgatcttctgaacatgaaaggaagaaaggtgtgccatggactgaa

SEQ ID NO: 7512 - DNA, 508 bp, Lycopersicon esculentum
  Predicted polypeptide sequence is orthologous to G1640
tgctgggttattaagatgtggaaaaagttgtagactcagatggattaattatttgaagagtgatttgaagagaggtaacataacctctgatgaagaagctataatcatcaagttacgtgcaactttgggtaacaggtggtctctgatagcagaacatttacctggtagaacagacaatgaaataaaaaactattggaattctcatttgagacgaaaggtggatagctttagaattccaggtgatgagaagctaccacaagcagttgttgaattagctaaaaaaggaacacaagtaaaacatattaccaaacgaggacgcagtagaagaaaaataattactagagtgtcaaattctacgaatgaaaatatcgagtttgatcatattgatgaccagatgttatggcatgacgatattgtgccgatggacgctaactatgaagtgctagatcaagattttattacaaattgtttatgggacgatcaaagagaaaatctcgaaataactgga

SEQ ID NO: 7513 - DNA, 1125 bp, Lycopersicon esculentum
  Predicted polypeptide sequence is orthologous to G1646, G715
ggcaccattacacctttcccattttctctacacagatagtagcttccattttccgcaaaccgccatggacaacaaccctcaccaatctccgactgaggccgctgcggcggccgcagcagcggcagcggcggctcagtcagccacgtatccgtcgcagactccataccaccatctccttcagcagcaacagcagcagctacagatgttttggacttaccagcgtcaagaaatcgagcaagtcaatgatttcaaaaaccaccaacttccccttgctcgtatcaaaaagatcatgaaagctgatgaagatgttcgtatgatctctgctgaagctccagttctgttcgcgaaagcttgtgagcttttcattctggagctcaccatccgttcgtggcttcacgctgaggaaaacaagcgcaggactttacagaagaatgacatcgctgcggcgattactcgtactgatatttttgattttctggttgacatcgttcctagggatgaaattaaggatgagggtgttgggcttggacccggaattgtgggttctactgctagtggtgtgccgtactattaccctccgatgggccagccggctccgggtggagtgatgcttggtaggcctgctgttcctggggttgatccatcaatgtatgtgcaccctccaccgtcacaggcgtggcaatctgtgtggcagactggagacgataattcctatgctagtggaggtagcagtggacagggtaaccttgatggccaaatttaaaagatctcgctgctgccagtttggaggcttaacagcacatgtgaaactgatggttatgatagggaaatgtaatttcttcaaattgtgaatccaccttttatggcttctgtcatggatattgtttgactttaaccgacttgaaccttctgtctgtataaaacttgacttttgtgtatttctagatttctctttaaaatccttttggggttgctaactgccagttctaaatgctgataaaactatgttcacatgtagctgtattggttccacaataccttccctttcttgtttcaaggtccctaaaactttttccaaacaccaaaaaaaaaaaaaaaaaaaaaaaaaaaaaaaaaaaaaaaaac

SEQ ID NO: 7514 - DNA, 240 bp, Lycopersicon esculentum
  Predicted polypeptide sequence is orthologous to G1646, G715
gtttatagagaaagaaagtgtccctgtgtccataaaaagccatggaaaacagccctcagcaatcggcggcgaatgcagcggcggcggctgcatcggctcaggccgctgggtacccgactcagccaccttaccaccatctccttcagcaacagcagcagcagatacaggtgttttggacctaccaacgcaaggaaatcgaacaggttaacgattttaagaaccatcaacttccccttgccc

SEQ ID NO: 7515 - DNA, 214 bp, Lycopersicon esculentum
  Predicted polypeptide sequence is orthologous to G1646, G715
gacatcgctgcggccattacgcggactgatatttttgatttccttgttgacattgttcccagggatgagatcaaggaagagggtgctggtctggggcccggaattgtgggttccacagcaagtggtgttccctactattatccaccaatgggacagcctgcttcacctggggtgatgatgggaaggcctgctatgcctggggttgatccttcaa

SEQ ID NO: 7516 - DNA, 614 bp, Lycopersicon esculentum
  Predicted polypeptide sequence is orthologous to G1660
cggccatcaactccgggagctgcaccatcttcctcaccttttcgcccttcaaatgataatttggatgctcatacaaatgcattgtctgaccaggaattacagttgaaaactcgaagagaaatcatggcacttggaactaaacttggcaaaatgaatatagctgcctgggctagcaaagatggtgaggatagaaatgcatccagcttgctgaaaactgataagcaagaccaaccaaataccactggtactgagacactcgcagctgcttgggaggatgcagagaaagcgaagcacttagcctggtttaaacgagaagacatcaagatacaagcatgggaaaatcatcaacaagcaaagacagaagccgagatgaggaaaactgaggcggaggtggaaaagatgaaggcacgagcacaagacaagctaatgaacaagatagctgcggttaggtacaaagctgaagagaaactggcagcagcagaagccaggagaaacaaacatgctgtaaaaatagagaagcaagcagaatgcattcgtaaaactggtcgattaccacactcattctcctgctgccgctggtgcttctgaagagcttcaaatcactatctaatgcg

SEQ ID NO: 7517 - DNA, 503 bp, Lycopersicon esculentum
  Predicted polypeptide sequence is orthologous to G1660
ttttgtccatttggatgttgacaagattcatcactacaatttcactcttttctcagagatactgtcacacccacaagcttgaaatcatcctttatggagtatgaaagaatcgacaagagaaatttacagctgtctcctagaaaactgaggtctatgctactgggagcagaaaagaagaggaaacaagaagggaaggatgacgtagtagaagatcaagagcttgaatctgctactgtgtccttgagatcccatttgcctgagatccatgaatccggttgtaatttggagaattacaaagatgtaaatgttgtaagtgttgttcctgagagttcgacttccttagcacttgattcatcaatgtcattggagatgattaatgacacgagaatcaaagatcaatctttggttagtacaagaattacgtctcaagatgacagtagtttggactgtgatggtggaatcgatagtgttggtactgtatctactctctttgaatttcaaaa

SEQ ID NO: 7518 - DNA, 301 bp, Lycopersicon esculentum
  Predicted polypeptide sequence is orthologous to G1730
tttttttttttttttttttagacgtacttatgagtctttgttcatcataagtagtagtaatgagacaaggttaaataataaatgaagtaaaaatgaggcacacagttgattagttttgtcaaaatctattacaaaagagtcatgactcaaatgtttaaataataaaattagaagaagaatccagcaacagctgaaacaagaatgatggatgaaaccttcaatgtagtggcagtgctagcagtgggtgcctcagctgatgtgggagctgagtcacttgtggtggtagagtctgttggagagg

SEQ ID NO: 7519 - DNA, 541 bp, Lycopersicon esculentum
  Predicted polypeptide sequence is orthologous to G1730
ggttgggtattgtaaaatctgtttgaatggtagtaacagaacaagatttggaattttcttggaaatttgattattgggttgtcgattggaaggtaaagttgcaatcttggaaaaaaattgggaaaaaaagatgacatcttcagctgtaaatttggtgatgacagtgattgggtttacagtgagcattatattcatagtatttgtgtgtacaaggttaatttgtgcaagaattcagtatttgacaaggaggaggtcttctgcatatacttctagatctgatcttagcattttggaacgtggtttacatgggctggagcctcttgctgtgtcgaagttccccacgaagaagtacagtgatgcatttttttcatttgcagaaaatactcaatgcatgatttgccttgctgagtatcgggaggaagatacattacgtattttgccattatgtggacactacttccacgccacatgcatcgacatatggtttcagcagcactctacatgtcctgtttgtcggatttccttacgcgagactgctgag

SEQ ID NO: 7520 - DNA, 506 bp, Lycopersicon esculentum
  misc_feature (36)..(36): n is a, c, g, or t
  Predicted polypeptide sequence is orthologous to G1750
gagcagttgtctcccaccctttggtttttttttttntttttggtttgtgttgtttgtggggttgaaaagagaggatttttaagctgacccaaacaagtttcttgatttctcagttgatgaatatgggtttttgtgcttttagaaagctttttaaatggtggggttttcttagaccattttctgtaatgttgattgtagttgtaatggtgggtcgttttactaattggcacaaacaaaaatgaagaattttattcattaaaaatggtttttttgtttaatttgttggtcaagatgataggtggattgaataatttttaacccattgatgttaatattttttttttcccccagggaaattttgtcaatctagttgttgatttctttatgaattgggttttttttgactgtttttctgaagaatatttaatatcttttttatattttcttcccttgattcttaattatgtgtctcccttctctttttcttatattccacttccccccct

SEQ ID NO: 7521 - DNA, 542 bp, Lycopersicon esculentum
  Predicted polypeptide sequence is orthologous to G1755
ggctgctcttgcttatgatgaagctgcaagggcgatgtatggtccttgtgcaaggctgaatctcccggactattacgcctcgtcgaaagagtcttccaaggatgattcttcgttgcctactgtatctcgttccgactcaaatacagcatcaagtttctctgaggtgtgccctgctggtgacatgatgagaggaagagccaatgttcctgcggcaagacatgaagatagatcaatagaaattgacggtgctaggactggttctaatgaaattggaacgcctttgagctcattgagagaggaagcggaagacgagaccaaggaggtgtcagataaaagtgagacttttacacctctgagctcgttgagagagcaagcggaagatgaggctaagcaggtgttagataaaagtgagacctttgaaattaaagatgagcctgcggcttgtagttatgattcatgggatatcggacaagaggacctaggtaacttttgtttggatgatgagatgtttgatgtaaatgagctgttaggcatgatggact

SEQ ID NO: 7522 - DNA, 585 bp, Lycopersicon esculentum
  Predicted polypeptide sequence is orthologous to G1760
ctctagcaaattgtttctaccttgtgttaaattacaggtttatggaaacagagatgcaaatggagtgagcagaagtccccttgttgcgaacagtttaagcatcaatgaggaccttcatgctcctgttcatctccagcttagccagccacagcaacagaactatgagacatcaggaactactgaattggggctacaactgcattcgcagtgaaaaccagactcgtaagagtttttagttctcgtgttgaagaagcagctgtgcttacagagctatgttttaattttttaatggtagcaatgatatagaacccagagatgtcaggaaaaagtcttcagttcaaatggttaatgacatcaagtttgacaagtgtgaggtaatccttagcacaactactaaaaagtaagataacaacaaataaagtaatacattggcacagtatctctacatatctttatctttcttggcacttcatgcttatgatgtgtatgcctatatactaggattgtacttgatgacgttttcaaatagctataaatagttgactacttgatcaaaaaaaaaaggaaaaaaaaaaaactcgaggg

SEQ ID NO: 7523 - DNA, 955 bp, Lycopersicon esculentum
  Predicted polypeptide sequence is orthologous to G1760
gagaatattttaaattcattgaacatacagatatttttttctttctcctcctcctcctcctcctcctccattgttctaccaaatcactatttattgtcccacgttccacatcatggtattaatgcttgatcagatttgttagatctttggtgctgagtccagaaagttcttcacccaaaagctgcctgtggttcataaaaaaagaaacacatggaagaagacattgcaatttcccaatttcaaatcttgggtgtcatttccttaataattcttggatttgaattaatcgctctcatatccatgtcaaggagatatataccaactggaagtttcgaggaattgacaaatttggcatatacaaactaaaacctggtatagggcattgtccaatctcaggtgttcctttgatattcccagtccactcttgcgaccaaagaaagaacacaatgaagtaggttaaggtcagctaaaggatttgatggggctaaggatggttccaaaaagagcagctactttagatgaacgctactgtggttgcactatttatttgcatgcatgaaattgacatacgtgtatcctgttcgctcgagccatgataaagatgggtgaattcgatatcaaagggatgaaaagaagctgatagcataatacatgagtaggttggccaagaataaccttgatgatcaagagaactttactgaccatccctaaatcccaacgaaagccttctaccggggctttgctgggaaaacctgcttaaaaaaaatggacatgtgtgaagaccaagagcggttattcacttttcttcttccttagtctaagcaatcaatttgtgagataaattaattctccatttgtagttagatttttgcgtttgtataaccttttttttcgagttctaccttgaaaggaaacctacaatgagattgtacccgaaaaaaaaaaaaaaaaaaaa

SEQ ID NO: 7524 - DNA, 566 bp, Lycopersicon esculentum
  Predicted polypeptide sequence is orthologous to G1760
gagagagagagtatagagttctatattttcttgatgaataagattgccctgtagaagcaatattaatcatcttagtgcaaagataaaagacacatggaagttgttatagtttttctggtaagaccttctgatttagttctctgatttcatccatcagaatctgctcctgcaagaaagtaacacatttaggatccttataataaaaaaaggagtaatacgtttgggagaaatcgtagacttgattttagcataagtttcatgaacacagaagaatttaggattttaccttttgctttcgtactcctttcaaactcatttcaatttggttttccagatttgttagatctttggtgctgagtccagaaagttcttcacccaaaagctgcctgtggttcataaaaaaaagaaacacatggaagaagacattgcaatttcccaatttcaaatcttgggtgtcatttccttaataattcttggatttgaattaatcgctctcatatccatgtcaaggagatatataccaactggaagtttcgaggaattgacaaatttggcatatacaaact

SEQ ID NO: 7525 - DNA, 391 bp, Lycopersicon esculentum
  Predicted polypeptide sequence is orthologous to G1760
cagactgaacccaaaacgacgattgcgaagtcttcttttgtcttctccatcaacagcaacttttttgcccctctctctctcgatcgaaaaattcctccattgatttgttcttctgcttcttctcgtgaatgaaatttctctgagagaggaagtagagagagagagagagagtgagtgtgtgtgtgtgagagagatcggcgatggggagaggtaagatagtgataaggaggatcgataattcgacgagcaggcaagtgacgttctcgaagaggaaaaatggattgttgaagaaggcgaaggagctagcgattctgtgcgatgcggaggccggagttattatcttctccagtactggaaaactctatgaatattcaaacaccagcatgaagtc

SEQ ID NO: 7526 - DNA, 802 bp, Lycopersicon esculentum
  misc_feature (757)..(757): n is a, c, g, or t
  misc_feature (777)..(777): n is a, c, g, or t
  Predicted polypeptide sequence is orthologous to G1765
aaagagtagaaaaaatggaaaatactatagtatgtgagagtaagataaaaaatagtgatgatgatgaagaaaatgatttgttgcttcctggttttcgatttcatccaacagatgaagagcttgtagggttttatcttaaacgcaaagtggaaaataaaagaatcaaacttgatcttatcaaagaggttgatatttataaacatgatccttgggatcttccaatgatgggcagagtaggtgataataaggaatggtatttcttcagcatgagaggaagaaagtacaaaaacagtgtaagaccaaatagagtaacaggatctggtttttggaaagcaacaggaattgataagcctgttcattcacaaagcaatgagctgtgcattggcctcaaaaaatcattagtatattataggggaagtgctggaaaaggtactaaaactgattggatgatgcatgagtttcgtctaccgcctatttggaagacgaatacttcaaatggacaacacctcccgaatctcaagaacattgctgctgaagctgaagtttggactctctgcagaatattcaaaaggatttccaattacaaaagattcacaccagattggaagcagcagcagccagttgttaaacaaagtttcgttgacacaagttctaaggcatgcagtgttcaatccgaaatcagtgatgatcaatccaataatgtcatcaatttcaaaaagatggcatttccacaaaagagcattatgaatgcatcatngtggagaaatttaaactatncagttgatcaaagaaacagttacta

SEQ ID NO: 7527 - DNA, 525 bp, Lycopersicon esculentum
  Predicted polypeptide sequence is orthologous to G1767
ttttgagtttaatgttataagtggattgaaccatttgaaagaactcacaaaagagagtttgaatataaaagaagaggaagcattggctgtgaattgcattggagcactgagaagagttgaagtagatgaaaggggagcttttataagaatgattcaatcactaaaccctaaagttgtgacaatagtagaacatgaggctgatttttctagcacaaggaatgactttgttaagtgctttgaagaatgtcttaggttctacacattgtattttgagatgcttgatgaaagctttccaacaacaagcaacgaaaggctagtgatcgaaagggaatgttctaaatgcatagttaaggttttggcttgtgataatgatattggtgatgatcaaggatatagtgaaagaagagaaagaggaaatcaatggtgtgaaagacttaaggaatgttttaccccatttacactaaatgatgatgctgttgatgatgttaaggctttgctcaagaggtataaagctggatggtcact

SEQ ID NO: 7528 - DNA, 564 bp, Lycopersicon esculentum
  Predicted polypeptide sequence is orthologous to G1767
gatgctttgaaccaaaatcactaaaggtactactactagtcttgtacatttattgtttgatgtggcaagagagatacgtaacccttttagtgttaaatggatactttgtttaggttagttagccttcaacaacaacaacaacaacaatctgatcaatactcttttaactccagcagaacttcaagcagctctagatcttctaacaaacaaaacagcacatacaattatcatccacatcataatcatcaagacgaagaatgcttcaactttttcatggatgaagatgatttctcttcttcttcttctaaacacaacaactatcctcctcctcattacaatcaatatcaacaaatctccacacccacaactacaagcagtaccccaacacatcaatctcaatctcaatatgatcatcaattctccccagcacgtgatttaaatctcgaattcgcttcctcattttctggaaaatgggccacagacattcttctagaaacttctcgtgccatagccgataagaacagtacacgtgtccaacagctcatgtggatgttgaatgagctg

SEQ ID NO: 7529 - DNA, 1077 bp, Lycopersicon esculentum
  Predicted polypeptide sequence is orthologous to G1772
ttgcccaaactgtcaccaatgccgtggagaagaatgggggatgccaaccttgtaagatgtagatgtggacagccgttttgttggttgtgccggtggagctactggcttagaccacacatggagtagcattcgaggtcacacttgtggcatttataaggaaggggaagaggataagtcgacgactgtcagaaatgatctcttgcgctatactcattattatgagcgctatatggttcatcgtgattcgttggaggctgaagcaaacatgaagcaaaaactaaagtttgaagtgttgaaactcgaagcaagggaattgctatcaaaggacttcagctgggtagaaaatggatgtaatagactccttgaattgaggcgaattctctcctgttcctatccagtttcattttacgtttttgatcagacgctgttcaaggatgaaatgacacaaaaagatagggaaataaagaagaacctttttgaaaacctgcagcagcaacttgaaataaacgttgagagactttcgatgttcttggaagaaccatttgctaaatatcctgaagataaacttttggagactagaacgaagatcatcactctctccgtactaacagacaacctctgcaaagagttgtacgattgcattgacaacgatttactgcttcctctacagcaggcgaatcataccatagctcattatagatccgagggagtggcgaaagcatcagaacttcctaattgacattccaccaacactaggcatgtgagcactctcaatcagaggcaagaaaagatgcacattccttttctcatgagctgatctacaattttatgctagagggtttgattactacagcatctaatattcttttgctacacttgatatgaatttagtctagattcttaactacatatagtttgagttgaagacaatgtatgaacattggttttcgtttggccatatcatatcatatattattataagtgggaagattcaaactgcaaagttgaattatcattttgtccctctacagttaataaatgagtacattgatattgcttttaaaaaaaaaaaaaaaa

SEQ ID NO: 7530 - DNA, 698 bp, Lycopersicon esculentum
  Predicted polypeptide sequence is orthologous to G1772
ggaggggttacttgctttcccctccaaaaaaatcaatattggtgacgaattaaaaaaagagaatgtgcagaatcccattctaattttttttttctaagtttccatttttgtgcaactttgaggtattttgattttttgggttgtcataaatatggatgacatatatggcagtgatgaagactactataatggagaatacgaggatgattatgatcgtgacccggaacccgaatctgatgatgatttatcttgtggcaaagctccttcatgcagggtaataaggaaagaatcccttttagcagcacagaaagaagatctacagagagtagtagacttgctttctctgaaagaacatcatgcacgaacgttgcttattcattatcaatgggatgtcgataaggtctttgcaatttttgttgaaagagggaaagaaagattgtttgtagaagctggtataacactagaggagaaaaatgagaatccttcctccgacccctcaaccgaatatacatgtgaaatttgctttgaggatttccctgatgagcaaacgacgttgatggaatgcaatcataggttttgcaatgattgttggacagagtatttcgtagtaaagataaatgatggtaagagtagacgtgtaacatgcatggctcagaaatgcaaagcgatatgtgatgaaggaaagattagggatttag

SEQ ID NO: 7531 - DNA, 686 bp, Lycopersicon esculentum
  Predicted polypeptide sequence is orthologous to G1777
tagctatggaagcagcgatgatgatgaatgggacaatcaacagtgcaataatgacgatgaagacgatgatgatggtgaatttcttgatgggtttacggaaattgaacaagagagaaacggaatctctggaaagggtccttcatgcaaggtaatcaggaaagagactcttttagctgcacagaaagaagacttgcaaagagtgatggacttgctatctctgaaggaacatcatgctcgaagcttgcttattcattaccgatgggaagttgacaaggtctttgcggttcttgttgagagagggacagaaatgttatatgctgaagcgggtgtgacactggaagggaaagaggaacatacttccactctgtcgacatctgaagtgacgtgtcaaatttgcttcgaagatgcccctgttgagaagaccactgtaatggactgcaaccatatattttgcaatgaatgttggacaactcatttcattgtaaaaataaatgagggtcagagtaaacaagtaacttgcatggcccaaaagtgcaatgtgatctgtgatgaaggaaagattagggatctcgtcactgcaagagatcctgctttagcagagaaatttgatcgttttctgttagagtcatatattgatgataacaagaaggttaaatggtgccctagtgttcctcattgtggaaatg

SEQ ID NO: 7532 - DNA, 701 bp, Lycopersicon esculentum
  misc_feature (664)..(664): n is a, c, g, or t
  Predicted polypeptide sequence is orthologous to G1808
cccacccccctttagaagcgattttccggccatgttgtccactttcccggccactactctgtccgccgacggacttttttccaatttatttccggcatttgatggaggattcactccttgggaatgtatcgaaccggcttttctattttcacaacaagtggaatcggttgtttcacccaaggaatccccaccacctgaaccggttatttcaaactccgattcaggttctgatgactccaaacctaattctgttcactctagttccggttcagatgacccgaaccggaataataacaataataataagtcgaaccggtgtcctgacgagagaaagcggcagcgcacgacatcgaaccgtgacatggatgagaggaagcgtcgacgtatggtatcgaaccgggaatcagcaaggcggtctcgcatgcgaaagcaaaagcatctggaaaacctgcggaaccaagcgaaccggcttaaagtagggaaccgggaaataatgaaccggttacggttaatcactcaccagtgccaagtggtccagtgtgagaacgagcggctgaggaccgaatcggctatccttcggcaaagactttgagggtatacgtcaaatatggatcaaccggcaatttaattcttattctgcatgggcatgcaataatatggaacnaagacctcattaattaatcattgggaactatataatc

SEQ ID NO: 7533 - DNA, 476 bp, Lycopersicon esculentum
  Predicted polypeptide sequence is orthologous to G1819
ctctcttctctaaatatctcttaatttttcttgaaatcaaattttctagtacccccttttggagtaaaaatacaaattttttccccttaatttgaatatgaattcagtgagattattgaatttctcatttataattattaatttcatgtttatgacacttttcaaatttagttttggacaaggcatggctccttcttctgctccttctccttccaatgatggtatgtaaccattttctttctttaaaatcgatcgagaatctaaatagctcgtagctaatacatttttttaaaatttactcaaattactacattaattaactatatacgtaattctgagtttaacttatatacatgatagtataaaaaattatgaaattaactcatacgcgcatttctgtaaaaagtgaagttttttatttttgaaattaagatagactatctgcaataacgtgactaatacaagttatatatgat

SEQ ID NO: 7534 - DNA, 304 bp, Lycopersicon esculentum
  Predicted polypeptide sequence is orthologous to G1838
caagagacggataattcttttcttgttgtggcggtgacttgacgcttgatgaaaacgttgcaggcatcatcaacaaggccgttggcaagcgagaattggccgagttgctggaaacaaggatctttaccttggaacatttggtaaattattggtcttattattcaaattggagttagaactataaatgaaggtttaaaagtgttaatcgaaatctgtattatattggcaacagctactgaggaggaagctgcggaagcgtatgacatagcagccataaagttcaggggagtgaatgctgtgacca

SEQ ID NO: 7535 - DNA, 693 bp, Lycopersicon esculentum
  Predicted polypeptide sequence is orthologous to G1850
cccacacccactcacctctatgtggcgccggaaacttccagaatcaccgaaaattccgacggtcgtcctctctgtagttttggctccagatctgtgagaatagcttcatcgatcttcactcaattcgtcaggtaataagaagagatgactccacagccaatagaccggaacaaaggagagacgacagccggtgaaacgccgaggtctgtgccgacaccgtttttaacaaagacctaccagctcatcgaggatcaatctattgacgatgtgatctcttggaatgaagacggatctacttttatagtgtggaatccaacggagttcgctagggatttgcttcctaaatattttaaacataataatttttctagcttcgttaggcagctcaacacctatggatttcggaaagtagtacctgatcgatgggaattcgcaaacgacagcttccggagaggtgagagaagtcagttagttgatatccagcgtcgaaaggttgccacgccgattgctactccttccgcagctgcaacagcggtggcgattgtggcttctccgcctcagcctccacctccacctccgtctccgtctccgcctccgcctccgcctgctcaaccaccggtggctgtatctacctctgattcctgtgaagagcaagttctatcgtcgaactcatctgcaggtagcacagcggag

SEQ ID NO: 7536 - DNA, 764 bp, Lycopersicon esculentum
  Predicted polypeptide sequence is orthologous to G1850
gaagctctgcggcaatatatatggtatgatgtcgacttacgcacatccttcgagcagcggtaatcaatcggcggagagtagttcgccttcgttgaagccactggatctgttagggacggaacggtccgtaggtgaatctcaggtgaaggcggtagaggaccgggagagccatgaggtaccggaggaagcgcaggcgagattattcggtttctcgataggcatgaagcgtgttagggaaggggaacaagcaatgatggagcattgtcatgatttacggctgcggcaacctggaacaacggatgttaaagtagaaccgtctgatcaggaaagtaacggtgaaagtgaagagagatcgtggctgctacattgcggtggaagaaatcaaaggacttgtaattgatagtttgttggtgtgatgaaccttaattagatttagattagagattagctgtgatgataatcgagattatattagagattagctgatcaaaatcgaaagaggtgataattacgtgacggactaaatcttgaagaagcttcttcggcccctttttaatttataattatgtccttattgttacaaagtattttcttttgtagcagtaaaaaatagatcttttttgaaagagctgacggcggagaactgtttgagaaaaatgtgcaaaggaaagtacgtttatatccttgatccttttgtaattttgccagcccaaagaaaaattgttgattttttttctttcgggtaaaaaaaaaaaaaaaaaaaa

SEQ ID NO: 7537 - DNA, 412 bp, Lycopersicon esculentum
  Predicted polypeptide sequence is orthologous to G1855
tttttttttttttttttttttgagcatgaattgatcttctatcctattgatctgcaaatgaagttaataattccaactataagcaataacaagaaagaaacttaataaccatacacgacgatattgaatggttgattatctattctcgttttggttcaccggtccagtaagtttttacagcaataagaatcttctctgggttgaatggtccgctctcatgatccacgatacgactctgccatctcataccgtctgcaatacttttgattttcactaatgcttctactccgtctctgaatataactgtaccttcaggcctcaatattctatccatctcaagtagaatatacgttatatcacatctgcctgatataggctgatcaaaccaccagcatgaatgagatcataagtt

SEQ ID NO: 7538 - DNA, 969 bp, Lycopersicon esculentum
  Predicted polypeptide sequence is orthologous to G1888
taaaaactctctatttcttttctttttttctcttttcacttataacaacaatcttgatccattaaaaaaaaaggatataatttgaatttaaatttgaattcaaatgaagattcaatgtgatgtgtgtaacaagaaggaagctatcgttttttgtacagcggatgaggctgctctttgtgatgattgtgatcatcgtgtccatcatgttaacaaacttgctagcaaacatcaacgtttttctcttgttcaaccttctcctaaacaagctcctatgtgtgacatctgtcaggaaaggaggggtttcttgttttgtcaacaagacagggctattatgtgtagagagtgtgatattccaatacacaaagcaaatgaacacactcaaaaacacaataggtaccttcttactggtataaaactctcagcaaactctgctctctactctgctccatcacaatcacaatcacaatcacaatcagcaatctcctccgcggattcgtgtgtttcaaatttgaagtctaaggattccactagtaagcctgttgctggttctgtgtttgtttctcccgcgattattagcaacagtactaagggaggagcagtatcatccgctgtggaatcagtgaaagttgttaaagagaaagttggtggatgtaataataatgtgcaatttgtgaatggagggggaaataacttaacaagtagtatatcagagtatttagagatgttgcctggttggcatgttgaagattttcttgattgttcaactcctaatgtttactccaagaatattggtgatgaggatatgttgtcattttgggatactgatcttgagagtcaatttagttcatttccaccacaaaatgttggtatttgggtcccctcagcccctcctctttcagagtcaaagcaagagactcagatccaatttttcccttcacaaaatttgaactttggtgggcaaattggtct

SEQ ID NO: 7539 - DNA, 1101 bp, Lycopersicon esculentum
  Predicted polypeptide sequence is orthologous to G19
ctcgagactagttctctctctttcactcagaaaacaaaaagaaaaaaaaaagagttagaaaagatgtgtggaggtgccataatctccgattatgatcccgccggaagcttctaccggaaactttctgctcgtgacctctgggctgagctggaccctatctccgactactggtcctcttcttcctcatcctcaaccgtcggaaaacctgattccgctctgtcgccggtgactcactccgtcgataagcctaataaatcagattccggcaaaaaaggtaataagactgtgaaggttgagaaggagaagagtagtggaccaaggccaaggaagaacaagtacagaggaataagacagaggccatggggaaaatgggctgctgagattcgcgatccacagaagggtgtacgcgtttggcttggtacattcaacacagcagaagatgctgctagagcctatgatgaggctgctaagcgcattcgtggtgataaggctaaactcaactttccagccccatcaccaccagctaagcgacagtgcactagcactgtcgctgctgctgatacaccaccagcactactccttgagagttctgacaactctcctttgatgaactttggatatgatgtccagtatcagagccaaactccctactaccccatggaaatgcccatagttagtgaagattatgaactgaaggaacagatttccaatttggaatcgttcctggaattggagccatctgatcaattttcagggatcgtcgattctgatcctcttaatgtttttctgatggaggactttgcttcaactcatcatcagttctactgaacatgatcaaagtgttatttcgggagtattttatggctgagtagtttattaattagcttttgggtgtagtagtagtaatagtagtaatagagattagagagtacatatgatgataataataataagttgcgtgccttagcatgcaattgtaatagtattagtgtttgttgtcttgtgctgttgtttatgcttttctaaatcttggatttaccttataatgtttggtgcatgtattttaactatatatatatatatatatatatatatatatat

SEQ ID NO: 7540 - DNA, 571 bp, Lycopersicon esculentum
  Predicted polypeptide sequence is orthologous to G19
ctgaaactaaaacaaaacttttctatacatttttcatttctgtatcaatcaatattctttgtttctgctgttttgagtaaatcacactaagatgtgtggtggtgcaattcttgctgatatcattcctcctcgtgaccgccgtttgtcatccaccgacctatggccgactgatttctggccaatttccacccaaaatgttcctctcaaccccaaacgagctcgaccctctacaggtactagttaatcatatataaagcttaatttgttgattttgtttttatgctcatttaggcatttcaacaaacaggtggtgagcagatgaagaagaggcaaaggaagaatctttacagagggataagacaacgtccatggggtaaatgggctgctgaaattcgtgacccgagaaaaggggttagggtttggttaggtactttcaacactgctgaagaagctgcaagagcttatgatagagaagctcgtaaaatcaggggtaagaaagctaaagttaatttccccaatgaagatgacgaccattactgctacagtcatccagagccccctcccttgaaca

SEQ ID NO: 7541 - DNA, 1180 bp, Lycopersicon esculentum
  Predicted polypeptide sequence is orthologous to G194
cttcattaatgaaaaaatggaaagctacaaagacattaaaatggaagatcatcatccaatgtatttcattgacaacaacggttttggagttactaataaccactcattcatctcagattacagcattaacccatcatctctgggtttcatggagttattgggttttcatcaagacttttgttcagtttttgagttacctaaagaagaaaatcactatcctgctgtttgtgtatctgaagaagaactaaagccgccatcatcatcatctgtagcagcagctgagaaacaaaaaagtagtactactactgtagttgctacaggtaacgtattgaatacgccatctacccctaattgctcctccatttcctctgaaggacatggagatgctgatggggaagtagaaaatcatgaccaaaaaaacacaaacgctaaacaacagttgaaagcgaagaaaacagtgagtcagaagaaacagaaagagccgagatttgcgtttatgacaaaaagtgaggttgattttcttgaagatggttatagatggagaaaatacggtcaaaaagctgtcaaaaacagtcctttcccaaggaactattatcgctgcacaaatgcaacatgtaacgtcaagaagagagttgagcgatgtttcagtgacccaagcattgtggtgactacctacgaaggaaaacatactcatccaagtcccatgaatacgatgatctcccgtcctaactgctatccaataaatccagtactcccttcacttggaacctacactctgccaatgcagttcaacgccaatcagtccttcaacgacaacttaacgagttctaatttagccatcaatcatcagcttgatcatgctgcttttgttgctcaaggaaggcgtttttgcagtactaacgaaattctggaagaccaggagaatgatctacagaatcttatgccttccgcggtgctaaaacatgactacaacagatgatgatgatgatgtatatagagggtttatatagtcgataagttaaaacaattatatgcattatattactttgttataatttagctagtggtactcttactcgcatttctaatgtattcatatcggaaatctcatgggtctaacattgacattttcggattctctatgcatgtgtatacttttctaaaaaaaaaaaaaaaaaaa

SEQ ID NO: 7542 - DNA, 677 bp, Lycopersicon esculentum
  Predicted polypeptide sequence is orthologous to G194
attatctctttcgatggagaaagaaaataatgtaagaacagagattacaaatacttcaaattggagctccaacgccatgtttgatatcgaaaaagattattcgttaagttttttattagaaacaatgtttggtgttgacgaacatcgaaattattgttatgataacactacaactagttctattttcgatttgctaatgattccatctcatcagcaacaacttcaacctcaacgttttattacttgttcgtcacttccagaatcatcatcgatattattatctgatcatttgattaataacgtaccagtaacaccaaattcatcgtcgatttcttcatcatcaactgaattagctgctaatgatgatcatcaacacaagtataagaaacagttaaaacctaataagaagaagcaaaagggggaaaaggagccaagatttgcattcatgacaaagagtgaaattgatcatttggatgatggttttagatggaggaaatatggacaaaaagcagtaaaaaatagcccctttccaaggagctactatcgttgcacaacatcatcatgtggtgtgaaaaagagagttgaaagatcaattcaagatacttcaatagttattacaacttatgaaggtgttcacacacattcatgccccataacgccacgtggatgggtcggag

SEQ ID NO: 7543 - DNA, 653 bp, Lycopersicon esculentum
  Predicted polypeptide sequence is orthologous to G1944
ggagcagtttgcaaagcattaatatctgctgaaaaaaatggagtcaagggaagctatagctccagaagctccatcaaactatcatatggtatctagaacagaatctactcctataccacctggtacattggcggtgattccccctccggtggctaccgcctttccaattagctcagagaagaagaaaaggggacgtcctaggaagtatgggcctgatggagcagttgcaaggacaatttcacctacgcctatttcagcagacttcttgtcgaagaaagtgagtgttgcccgtcctgaatcggagaaaaaggctcgaaacaaagtgggagctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcagggggaactctaacttatgagggtcgatttgaaatcctttctttgtctggatcctttactccaacagagtttggggggttctcgtactactagcagaaccggaggaatgagcatttctttggcaagtccggat

SEQ ID NO: 7544 - DNA, 684 bp, Lycopersicon esculentum
  Predicted polypeptide sequence is orthologous to G1944
gcggacatactgaggaaagttagcaacccctaaattagtttttatttttattcttttaataacttatcaaaaactccatatttcacattttctcaagaatctcattacaataaagcctaaaaattcaatgttttccccataatttcatcttttaattctgaaaaaaatcttaaaattttcaacaaaaaattctgataatttccatcttcatttctgtttaactttcttgttttcttataagctctgtttttctgctaaactctggttagacttcaaaattaccactaattaagctttttttgagaatttttttttcttggtttcttcattgaaggaaaattatggggttttgaagaaaaaaagagggaaattttttaattttttttggtgattttttttttttttgggctatggaggggagtaacagtggagttacagtagtgggatcagatgctccatcagattaccatgtggcagcaaggaccactgagaatccgacaacacagactgtgacatcccagattgttgttgtttcaccaacgccggcaatagctgtgtctgtcggcgccggcgccggcttaacagctctgagtgtgaaaaagaagagagggagaccaagaaagtatgcaccagatgggtctgtaaatgttctttctccaaagccaatttcattatctgttccgt

SEQ ID NO: 7545 - DNA, 503 bp, Lycopersicon esculentum
  Predicted polypeptide sequence is orthologous to G1944
aagcttagcagaattttgtaaaatttgatggttgccgttagttgcgcatgcttagctgtagagttaacaatggcggcttcagatgcttcatcagactatcacatgactggatctgctcaaccaggagcagcaacccagtcgggtgcagcacggcagtgaccactcccaaagaagaagcgaggtagacccagaaataatggaccaaaagggtcagtggccacgccaatttcatccgtcgcaccttttctcaggtgattgatttttaggcgaaagtccagccagttgggtcagctattacagttgtatcagcccaagttgatgttgagaaatgagaagtcagcatgaaggttttatcattttttcaacaagggtctcggtcaatgtgtattctctcagcaactggtgtaatctctagtgtcacatttcatcaaacagatacttttggtggtaaagtgacatttgagggccggtatgatttacttacttccgctggatcatatgct

SEQ ID NO: 7546 - DNA, 620 bp, Lycopersicon esculentum
  Predicted polypeptide sequence is orthologous to G1944
cagatttcaccaactctctcaagaaattttgaaagcacaataaaaattagcaatacatattttctttccattttcataaaattattttgtttttttaaagctctgttctttcttttgcagtaacagagtatcagttagtcattagttttccagtgcacatggtcagatgatctttctgtagatacaattaagtctagcatttgcagatttctgagtttgtacttttcttggtatttttttgcttgtattagcatttgaaaaaagattgtatttttattatatttgttattatggggttttgagttcttgaaaaacaaatatatttttgctgttttgggagcttatgttatttggagttgtcttcagggtttaaggggttttgagttcttgaaaaaaaaaccattttttgctgttttgggggattaagtgatttggagttgtcttcagggtttaagggggcttgagttatttggggtttaaggggttttggttgttttattattgtgtatatgcatggaggagaaagaaggagttaatggttcaggggttacagttaaaggtgatgaagctccagagagctacagagtggctcccaggagtgaaagtaataatattgagtt

SEQ ID NO: 7547 - DNA, 541 bp, Lycopersicon esculentum
  Predicted polypeptide sequence is orthologous to G1944
aaatctaaattgaaaatcacaataaaatggtccaaagtacaaaatgtagcatttaattaagaggatgaatatgcctgttaaaactagacataaacccttaaaacactaagaacctagaacatggtaaccttcgtaaccaaagcgttatgacaacatcatacatctaaaactagtttggatttactgaacagacctcaaacaaacatcaaataggaggtgagaaggatcaatatgaacttcgttaaagacgcgtagtccttatggtctagtaaaatcacattcaaatttcaccctatgctggaagagatacatttatttcagctggcttattcctagaatcaggagctgaccaattatctacgcggaaagaagaggaagttggtgtagtttgttttactgaggactgataagggtcttccgtctcgggtagaggaacagcagcaataatgggctctggtttgtttttcttggttctctgctcatgttgatctccagcaagaaagctacctataacaatctgcacaggactggcagctactaa

SEQ ID NO: 7548 - DNA, 590 bp, Lycopersicon esculentum
  misc_feature (571)..(571): n is a, c, g, or t
  Predicted polypeptide sequence is orthologous to G1950
ccgcactgctcttcattatgctgctagcaagggtcaagtgaaaatagctgaacttttgatttcacgtggtgctaagatcaatgcaaaagacaaggtaggatgcaccccattgcatcgtgcagctagcacggggaactctcagctgtgtgaactattagttgaggaaggcgctgaagttgatgaagttgacaaggcaggggaaacacctctgatgactgctgttgtatgcggcaataaagaggtagctttgctcctcataagacatggagcagatgttgacattgaggacaaggaagggtacactgttcttggtcgagcttctaatgatcttcgtccagtattagtcgatgctgcaaagatgatgctcgaaggataaactccacgacctcatgatagctcatcagaaaacgcaagccaactctgtaaatgttcaacctgaagcgtgctcaactagacacataccgatgaatattctggaactatttagttgtagggcagaaaacctaaatgttgtacttaactcttggtgatgctcctttagttatgacaagtgcatccattttagaaaaanaaaaaaaaaaaaaaaaaaa

SEQ ID NO: 7549 - DNA, 597 bp, Lycopersicon esculentum
  Predicted polypeptide sequence is orthologous to G1950
caggatgctcaaggatggactcccttgcattttgctgctactcaaggctatgttgaagctgttggtgtgttactaaatcattccaattttgctaaatatgttgtaacgaaacaagggaagactgcgtatgagcttgctatcgataagggtcattctaaattgtatgatgttttacaattgggagacactttgcataaggctgcaagaaaaggagatgttgctgatatcaagaaatgtatcactgaaggggcgaatgtgaatggaaaggatcagaatggatggactcctttgcatagagcagcattcaagggtagagttgaagtggcgaaggtgttggtaaacaacggagctaagcttgatcttgttgattatgttggatatacgccgcttcatcttgctattgaggctggacaagaggatgtggcgatatatttgattgctcaaggtgctaaggctaatttgaagagcttcaaagctaaagaagtggtttcttgtgatttcagacatttacatacttacaactttgtatagtgaagagcaaagtacacttaactcaatttggagatcgctcttgtatatttttagctactgcagaag

SEQ ID NO: 7550 - DNA, 723 bp, Lycopersicon esculentum
  Predicted polypeptide sequence is orthologous to G1957
caaaatcttttaagccctaaaatcattaattttgtctatttttttttttcgattgaaaatatcaattcattactagatctgtttgatcatgaatttctttggtagtgttgtaggagaagaagaagcatcttcttcgtcttataacagccaacaacttaaaaggcctagtagtagtactactacggagcttatgttgatggattcatcgtctacttgtgatgcgttggttgaaagggaacatatgttcgataaggtagttactcctagcgatgttggtaagctcaatcgtttagttatacctaaacaacacgcggagaagtatttccctcttgattcgtctagtaacaataaggggggacttctattgaattttgaagatagtaatgggaagccatggaggtttaggtattcgtattggaatagtagtcagagctatgtaatgactaaaggatggagtcgttttgttaaggagaagaaacttgatgctggtgatgttgtttcatttcagcgcggtgctggtgagttgtctaagcaccgtctcttcattgactggcgccgtcgccctcatcatgagaatggaaataatcaatttatgttaccgcatcaattttctgatgggcggctcttttattacccaacaacattttcgagtaatttgttgctggaaggaggtagcaatatcgttcatccacctaattattataatcctcaaagttacatgta

SEQ ID NO: 7551 - DNA, 674 bp, Lycopersicon esculentum
  Predicted polypeptide sequence is orthologous to G1990
gaagaagccttcactaagccaaaagaaaatggcggtcttctctatgatgctttggcaagacctacaaagctttgattgtttaggtgtgtaaagaagacaacccatttgcccaaaaggagaataaattagcatgtgagctgaagtttctgaagaaattggcttcgcttgcctttataaccctctttcccattgtcaatttcaagatatttactacagttgtcttcttctcttcatttaatgagatatcagtgatgcctcatcagaaccagggacaaaatgggcagcagggtatgtggatgtaccaatgcatccattgtaaaaaaaacttcccttcaagccaggccatagcaggccatacaaagggtcatttcagagatggctgggttaaaggaaccccccagagcaaagtatttgtactattttctgagtatcagcaacagcagggttctatcactgactcttcaattcccgagaaacagattttttctgcagcaacttctgacactgacttagcagatgctcatcaattgcaaataggtgatgtgcagaattccagaagcctggtcgtgcggcctccatctccagcttcgtctagcagagaaccacgaatccctaggcatcatttgaggcttcgtgatctgaagatactagctaggctaagggctcgtcttacc

SEQ ID NO: 7552 - DNA, 1660 bp, Lycopersicon esculentum
  Predicted polypeptide sequence is orthologous to G2
ataagctgctttaggcttattcttccgaaactagcctcgtctatatccatcatctctctcttaatttttattttttttctttccccaacaacttcaacttctctataagtcataacttccatctttctttcaatttacaacaaaaaaataaataaatcattcttttcttcatttcatacatcaatataggtcacttgcaaccaaatatcgaaaaatacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccaggtaaaatattcggattttcgattaaagaccacaatttggaatcgccggtagttacccggcaattttttccggtagataacgagtctaccaattttccaagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggttttccaagaggaagttccaagtatagaggagtcactttgcataaatgtggtagatgggaagctagaatgggacaattcttaggcaaaaagtatgtttatttaggcctatttgatactgaagttgaagctgccagagcttatgataaagctgctatcaagtgtaatggaaaagatgcagttaccaactttgatcgtagcatttatgaaaatgaacttaactcaaccgaatgtactgataatgcaacggaccacaatcttgacttaagcttaggaggttcaagccaagaaatgggggacaataggggtcaaaattcttcatctaatttgcaattggatggccattggggccaccaagggtcatcaaggcataataataaggttcagactccgagcagcaacaatgtaggccaaattggtggaacaagtaattttcaaaataattatgagataattgcaactgctgcagcatcatcaggattcccccagcagataataaggactcaaaataatggcttccatcattattttatgagaccttgaccattcattaatttcttcatgttcttttattaatctttgtaaagagtaaaatcaattaatgttgagattataattaatattctcaaaacataaacaaacagattatattggtagtatataaaatggttgggaggaaattccaacttcttgggaaaagttaagtgtaccttttttttttttttttggtaaatttattattattattggg

SEQ ID NO: 7553 - DNA, 630 bp, Lycopersicon esculentum
  Predicted polypeptide sequence is orthologous to G2
ttttttttttttttttttgagaattatgtattggtaaataacaacatataagtcacaagatagaccaccaaaaaattaaaaacatttatttagtagctgtacttgtggatggtataaattggcagcttacatgagtaagaaatctagttcaatatctcttcttcagttagctttgtaccaactatatccatagagttggaatctctcaaaagcttttttttaccatcaagattaacccttgtaaatattatattacattatagtttacatcacaaccctccttcaggtgcgtgcggttcgctaactctcttagacgcaaaatattccatgcatcgatcgactgtctcgatagaaaattaattggatggtctggtgagagagtagttaaagccacttttgtgaggccagttttgatgtcttaatatctgctgagggaatcctgatgatgctgcagcagttgcaaataggtgaggaggaggaacagtattgctttgccattgttgagtatctcttctattgctgctgcttggaaactgaacttgataatttgaggaggtgaattgtggtggaatcatttgggagtcaccagctctcatatattggccaaacctttgcatttcattgctattt

SEQ ID NO: 7554 - DNA, 1228 bp, Lycopersicon esculentum
  Predicted polypeptide sequence is orthologous to G2
tcagaagaaggtaaaggtgttggatccatttcaaattcaagttcatcagctgttgaggaattatacggttcagaggaagaagatgaatttctcgaacaaaatggactaaaaggcaagaaaaagaaaaatattcctagtaaaatatttggcttctctatgattgctccacctaataataacaatcacaacgacgataacttgtcgtcggagagtgaaccgccggttacccggcagttttttccggttgatgagtcggaaatcggaagtggcaattttaatgatagatcttgtagatttccaagggcccattgggctggagtgaaattctaccaaccggagccatctgctaattcgccagcactattggggaagggtagtgagttgtcgcaacaagtgcagccaatgaaaaaaagccggcgtggtccaaggtctagaagctcacagtaccgcggtgttactttttatcggagaactggccgctgggaatcacatatatgggattgtggaaagcaagtttatctaggtggatttgatactgcacatgctgctgctcgtgcgtacgatcgggcagcaataaaatttcgtggaatggaggcggacataaactttaacctcgaagattatgaggaagatttaaaacagatgaagaatttaacgaaggaagaatttgttcatgtactgaggaggcaaagtactggttttccgaggggaagttctaagtatagaggggtgacattgcacaaatgtggtagatgggaagctagaatgggtcaattgttgggcaaaaagtacgtttatttgggactctttgatactgaaaatgaagctgccagggcttatgataaagctgccatcaaatgtaatggcaaggatgcagtcactaacttcgatccttgcatttatgaaaatgaacttaattcatctgaatgtagtaataaagcagcagatcacagccttgacttaagcttaggtagttcgagctcaaagcaaaacagccgtgaaatggaggatactaataagaatcaaaattatccttctatccaatttgatgttgattggcgacaccaagggtcgaaacccaagcaacctagtccacttgatatggagtatgggcgaagaagaaatgtgtacaatgagacggaaacgttgcaactctttagccaaacgcacctacattctccgggatccttcaagacaaatagcaatgaaatgcaaaggtttggccaat

SEQ ID NO: 7555 - DNA, 554 bp, Lycopersicon esculentum
  Predicted polypeptide sequence is orthologous to G2
tgagattgaagctgccagagcgtatgataaagctgccatcaagtgtaacgggaaggatgcagttacaaattttgatccaagcatttatgagaatgaactaaactcaattgaatctaccgataacgtggctgatcataatctggatttaagtttgggtggttcaagctcaaagcaaggaagtcaagaattgggggataatagaggtcaaaattcttcatcaataatgcaattggatattgattggcagcgccatggtttaaggcctgagaagcaatctgccttaattgatgctcgaagaagagaaaacaggtacaatgaaacagaaacgttgcaacttttaagccagacgcacttgcattctccagcctccttgaagcataacaataataataatagtcaagtgcaacggtttggccaatttatgagacctggtgatcaatcccatatgattcaaatgtttccacagcaatttggctcatcaaattatcaaattcaatttccaagtggcagcaatggtggaagaattggagctacaaatgtaagagatctatcgc

SEQ ID NO: 7556 - DNA, 989 bp, Lycopersicon esculentum
  Predicted polypeptide sequence is orthologous to G2
gttttttttttttttttttaataaattatagtatttcaaatactacatgagaagctagagcccaaatgtatacaagttacaatgagagagaatgggccaaattggcagttcatagtcagaataaactaatacaagtctagttgaaaagcttgccgatcagttagtattggacaaattaacgaggagacatattttccaaaacattttgtctaccttttttttttcttttctaatttcaaaccaagagccttaggtaatatatatggagtattaagaatatcaaccctttaatctacacattatcttaaaaaaaacacaaatagaaatatggcaagttattaaatgagtcaagaaggtctcatgagtgaatgatggaaaccattttctgaggaccaattctgaggtcttactatctgctgagggaatcctgatgatgctgcagcagctacaaatatctgaggaggaaaattggattgccattgtgaagaaccattactcgtcgccgcaagcgatagatctcttacatttgtagctccaattcttccaccattgctgccacttggaaattgaatttgataatttgatgagccaaattgctgtggaaacatttgaatcatatgggattgatcaccaggtctcataaattggccaaaccgttgcacttgactattattattattgttatgcttcaaggaggctggagaatgcaagtgcgtctggcttaaaagttgcaacgtttctgtttcattgtacctgttttctcttcttcgagcatcaattaaggcagattgcttctggaaattaaaacatgtttgcatcagaggtaaaaattgaatttcacaacgaaaacaagatatagctattgatcgtgtaaatatacctcaggccttaaaccatggcgctgccaatcaatatccaattgcattattgatgaagaattttgacctctattatcccccaattcttgacttccttgctttgagcttgaa

SEQ ID NO: 7557 - DNA, 558 bp, Lycopersicon esculentum
  Predicted polypeptide sequence is orthologous to G2
gaaagaaaagaatagagatagagagagaaaatagaggagaatatttaaaagtctaggaaactcaaaacaagtccttttgtagcaatagccaaaaaattaaattgttttctgtttttataatttggattgggtattttttgtagagagaaaaatgtgggatctaaatgaatcagaagaaggttgttcttcaccgatagagtttgaaggcgatgatgagaaaggtaaacgggtcggatccgtttcgaattcaagttcatcagctgtagctgttgatgatatatctgaagaggaattagatggagaaagagggaagaaaaagagaggtaaaattttcggcttctctatggtgggtctgggtaacggcgatgaagaacagccggtgacccgacagttttttccggttgatgagtcggaaatgggtggtgttgctgctgaaaatggatgcccgaattttcccagagctcactgggttggagttaaattttaccaaacggagacacttggcaacacgggattggccaggcctgtagatatggttcagcagcaacagcagcctat

SEQ ID NO: 7558 - DNA, 596 bp, Lycopersicon esculentum
  Predicted polypeptide sequence is orthologous to G2
tcggcacgagggttagttttaccctactgatgacagtgtcgcaatagtaattcaacctagtacgagaggaaccgttgattcacacaattggccatcgcgcttggttgaaaagccagtggcgcgaagctaccgtgtgctggattatgactgaacgcctctaagtcagaatccgggctagaagcgacgcatgcgcccgccgtccgcttgccgacccgcagtgattatcatgatgatttaaagcagatggggaacttttcaaaggaagagtttgtgcatatacttcgacgacagagcactggtttctctagaggaagttcgaaatacaggggagttacgttgcacaaatgtggacgatgggaagctcgaatggggcagtttcttggaaagaagtatatctatcttggactgtttgacagtgagatagaagctgcaagggcgtatgataaggctgcaataaaatgcaacggaaaggaagcagtcactaattttgagctaagcacatatgaaggtgaattaagtactgaggctgaaaatggaggtgcagaccataatcttgatctgaacttgggaatagccccctctgtattagctgatga

SEQ ID NO: 7559 - DNA, 542 bp, Lycopersicon esculentum
  Predicted polypeptide sequence is orthologous to G2
ttttaccggaagactggccggtgggaatctcatatatgggattgtgggaaacaagtgtatttaggtggatttgatacagcacatgcagcagctcgatattgcggagagactcaaggttttggaatgtgtgatacagtgcatatgatagggcagcaatcaaattccggggagcggaggcggacataaactttacctcgaaagattatgaagatgacttaaaacagatgagcaatttaaccaaagaagaatttgtgcatgtactaaggagacaaagtactggttttccaagaagaagttccaagtatagaggagtcactttgcataaatgtggtagatgggaagctagaatgggacaattcttaggcaaaaagtatgtttatttaggcctatttgatactgaagttgaagctgccagagcttatgataaagctgctatcaagtgtaatggaaaagatgcagttaccaactttgatcgtagcatttatgaaaatgaacttaactcaaccgaatgtactgataatgcaacggaccacaatcttgac

SEQ ID NO: 7560 - DNA, 575 bp, Lycopersicon esculentum
  Predicted polypeptide sequence is orthologous to G2
tacactcattttaattctatcgacaaaagaaatgtggaatttaaatgattcccctgatcagacaatggagtatgaatccgatgaaggtataacggttagatcggaatcaaattcaatttcatccgctctacttgttgtagaagacggtaattcatcagaagaagacggtgaaaaaggtaaaaaaaagaaaagtaataatacaccagggcacaatgggctggaattaaattttgtgaatcggaaccgccacttgtcaatggattagtggggaacaaaattgacgtgttgcaacaacagccaattaaaaaaagccgtcgtggaccacgttcaagaagttcacagtaccgtggtgttaccttttaccggaggactggccggtgggaatctcatatatgggattgtgggaaacaagtgtatttaggtggatttgatacagcacatgcagcagctcgtgcatatgatagggcagcaatcaaattccggggagcggaggcggacataaactttacctcgaaagattatgaagatgacttaaaacagatgagcaatttaaccaaagaagaatttgtgcatgt

SEQ ID NO: 7561 - DNA, 590 bp, Lycopersicon esculentum
  Predicted polypeptide sequence is orthologous to G20
ggcttcaaatgctactctgtttactttaatttcagcttccttaaattctttctgctccaggactgtgttgcttatggcttccctttcctctgagcctactgccaagactgagggtagcagtggcaatgatgctggtggtggagaaacatcagaagctatggggcatatagggactgatcaactgttattatatagaggactgaaaaaagcgaaaaaagaaaggggttatacagccaaggagcgcataagcaaaatgcccccatgtactgcagggaagcgcagctccatctatcgtggtgtcactaggcatagatggactggtcgttatgaagctcatctttgggataaaagtacctggaatcaaaaccaaaataagaaaggaaagcaagtgttattattgcatggacattgggacacttattgctgcttgatcgggatggacagtttatttaggagcatatgatgatgaggaggctgcagcaagagcatatgatcttgccgctttgaaatattggggtcctggaaccctcattaatttcccagtgacagattacacaagggaccttgaagagatgcaaaatgtctcaaga

SEQ ID NO: 7562 - DNA, 731 bp, Lycopersicon esculentum
  misc_feature (640)..(640): n is a, c, g, or t
  misc_feature (677)..(677): n is a, c, g, or t
  Predicted polypeptide sequence is orthologous to G20
accacaatcatgcttctatacattcttcataaactacatgtggagaactctatagcatggaatgataagactcttaaaaactcagatggacaaatggaattgctagagcaacattgcagcaacttgaaaaagataaataaactagagacttattttacaagtactggaacaacatttaggtctataaagttcataatggaccaaaagaaaaaaccctgtcaaaagataaaagtgtgtatgcctatgcttcacaagactgcaaacttacatgtacaggaaagtttgtatctcacttgtagaggcgaaggttaatcttcttgttgaaataaagtataatctgaactggcttcgctcttgtggacctcagcagtccgtgaagaacctgtatgaaaattaggaacaatagatgtccaaagaacagggtctgttaagggatctatgctgttgtagttagtgagaagtggtcctgacaggagtggagtaagtgggtgcaagtttctgttaatagataatcccccagcattgagaaatgcagctccaagcctctcacttccactatcaggacttgatttttctatcatcttcccacggtcgactctgttgatagtgcttttgttttcattctcatcattctcaactntttctttctttttagcaaccttctctactaaactctngtatgctgcagactgtgacaaaatgctcacagcaggataatgttgagcttttat

SEQ ID NO: 7563 - DNA, 1261 bp, Lycopersicon esculentum
  misc_feature (1246)..(1246): n is a, c, g, or t
  Predicted polypeptide sequence is orthologous to G2011
cagagttgtttacaggagatatttcttggtttgtatgtcggcgttacctatataaacctcccttcaaccccttttaccgactttttatctatcacccttatcgaaattttgaatcttttgatcacaaaaactattaaagtttcaatctttgatccataaaaaccacaaatctctttgtatgatatgaacccatttgataaaaaacaagaatctgatactgatacaaaaaccccatttttgactgaaatggactctgaatttgctgcgttttcaccaatttcactcccttttgctgacccatcttctccttttatcaattttggatcttttgccactcctttgagccaacatccagttggagaaggggaaggagaaggagaagggggagaaattgaacagccagctgagggaggattgggtgtgccgcagcctatggagtgtttacatgggatacaaattccgccatttttgtcaaagacttttgatttggttgaggaccctttattggatacgattatttcttggggtagaaatggagaaagctttgtagtttgggatccagtggagttttcaagattggttcttcctaggaatttcaagcacagtaatttctccagctttgttcgacagcttaatacatatgtgggtattaattttagcacactggccaactttttctggctaatgtgttaaatctctagttctctaactctgtctctctttttaatgatattttttccttgtatgtaatttctgttgtagtttttcatgtatctttattttttccctcatttttctgtagtttgtttgctcttttgttgttgatatactgtaaagataatgtcttaggatgtaaatgtaaatagatttttcgcgttgtaaacagtataggctcctgcgattgtaaatgagagttggagaactgttttttcttcttgatagttcaatgtttttggcatcttgtgtaaatgatgtcattgagatctttagtggatagtaaaatggtgggttcttaaggaaaatggtaaagaggtgcgctgttcatgatgtgggcttgtagataaagctccctgcattgatgcatctgctgagtttgggaggttcatctattgctgcaggtagaattcaaaggttctgattaaacagagtgtttaagctttgtagtttatatatggtctaacttcaaagatctactaattgtgtatttctagtgtaatgcagctcctggaactcatgaaaatttgancagtagcatcttgct

SEQ ID NO: 7564 - DNA, 1177 bp, Lycopersicon esculentum
  Predicted polypeptide sequence is orthologous to G2057
gctagctttctgcctccatctttagaatctgatgctattgctgatactatcaaatcttttttcccaatgggttcttcaacctcagctaactcttcagctatgcagttccatagcttccaagaaccccatatgttatcaagagccaatagccagaaccaagatttgagtctctctttacagtttcaagatcctattttgcttcaccatcaaaaccagcaagctcaacaccataaccaaactaaccatagggaacaagagcaagtgcagggtcaagcaccagcccactttggaggaaacaccccacttggttttgacacctctggctggtctatgcatcagagacttcgttcttggagtgacagtagagaaattggccctggtggtagtggtggagcagtaacaggacctggtgggtacttgttcaattcgccaccagcaccggcgctgctgcagcagctattcggtcaaaatcagtttttttctcagaggggaccccttcagtccagtaacacatcttcggttcgcgcatggatggatccgtcagcgatagcaattgcctcaggtgatccaagtaatcaccatcaagctgcattatcaatgtatccatcaacaattcctggctatggatttgcctctgaagtaggcggattctctgggtttcgtattcctgctcgaatccaaggtgaagaagaggagcacgatggcatttccgataagccatcctctgcttcctctgattctcgccattgaattagctccaaaaagtttgatctttctcaatccctgacagggaaatgctctacttgaatgcaattagaacttacagaagtaatgctgtcaaaagagcctggagatggagaatgagagagttcaaaatagagtctgattcaatggcatacaccgagtcgaaaagaatcctgatccttgtttcaggttcttcgatccggtctaatataattagttattcaccgttcttgattttccagttcttgtgtaattgagcttttctagctcaacaagctacattaggagtgttatgtgtttggccagacttgtcatattgctgctgtttgctttatttcatgattttggagactttcaacctagaattggtaatgttttgttagttatttttaagtcttgaaagccattcttaaaaaaaaaaaaaaaaaaaaaa

SEQ ID NO: 7565 - DNA, 1002 bp, Lycopersicon esculentum
  Predicted polypeptide sequence is orthologous to G2057
gtaccaaaaaacagtatcttttatcatatatttgatttgctctctgcaaactctattttgaataattaaataactagaattgttagatgaaagggaatgatgggttaggggtatttgttttgatttaaagttatggaatttgggaagttgaatggcagagagtttgagatttcagtgtaaacaatcaaaaactggaaagagaaattgcaaacaagggtttgagtctggatcctcagaggaatcagcagcaacattatcatctcaatcaaaatcaaaaccaaaatcaagattcagttggcaaagaagaagaagaaaatcaacaacaatcagaaaacgaacctcagctttatcttcatcctcacaaccagcaacaacagccatttttcaatcaacatcacttgatttatggaaggttagattcacagcaattgcttccaccacagccaacaccgaagaaacgttcgtatttgccttcgacgtcttcattggggcaaaacgtcgaacatgcagcagcattgcgtgggaaaatggcagaaacgtcaagattgggtataaggaatactgtaggagagattgtagaagtacaaggaggtcacattgtgaggtctacggggcggaaagaccgccacagcaaggtttgcacagccaaaggccccagagatcgccgtgtgcgtctctctgctcatactgctattcagttttacgatgtgcaagaccgccttggttatgatagacctagtaaagctgtggattggcttatcaaaaaggcaaaacccgccattgatgagctagctgagttacctgcctggaaacctacaattggtactgcatctgctgctgctgctactaacaccaatcttgaacaggaacaggctcaaaaacagcaagaagataacaactttgcatttcaacaaggaaatgttagtttgtttgataatgttgctggcccttcaagtaaagagcaatcgaaagtaatactgctagctttctgcctccatcttt

SEQ ID NO: 7566 - DNA, 538 bp, Lycopersicon esculentum
  Predicted polypeptide sequence is orthologous to G2057
gttttatgcctcattctttagattctgatgcgatttctgataccatcaaatcatttttcccaatgggaggtagtggttcaaatgaaggtaattctttccagagttttcaacaacataatttgatgtcaagaagccaagatttgaagctttctttacaatcttttcaagatccacaagctcagtttgaagcatcaaatttctttactggatttgatgcttcagtgtggcctcagcaccagcagcagccggttgaacttggtcgactggcggctgctcgtggagacattggtggcggggcaattgctggagcacgtagttatctgtttaactctcagcctgccccgccgctattacaacaattgttcactcaaaatcagtttttgtctcagaggggaccccttcagtccagttactcaccttcgattcgtgcatggatagatccatcagcgattgctatcgccacagctgatccaattcaccaaaaccaaaaccatcatcaagctgtgtttcctatgtattcaacatcactttctggcat

SEQ ID NO: 7567 - DNA, 823 bp, Lycopersicon esculentum
  misc_feature (509)..(509): n is a, c, g, or t
  Predicted polypeptide sequence is orthologous to G2057
gtttgatcatctttactttttttttttttttgttgtaaccaaatcaatcaggctgataaccattggcattcaagagaactttacttgttctaatgaacggatgctaataagcacacatcaacaacaacaacatggtcttagccacagaaaaacacacttgtacttgatcatttcgccgttatttaatcctagaaaaaaacctgagactatgctcaggattctttttccgcggtgcattctcactgaatcagactcgatcaaaagggattatcgcgctgtccctgacttgaattttgccacttccatcttcaaatatagtacttggccctgtcaggttataatgggagattgcgtttccgagctgcttcaatgacgagaatcagaggatgccttggatggtttgccggaaacaccatcctgcttctactatatttcaccttggattcaagtaggaatgccgaaagccaaagaatccgcctaattcttgagcgaattccatgccagaaggngtgttgaatacatgggaacacagctggtgatgggtttgctctgtgagtaggctagctgggggatagaatcgttgttgttctttcctgcccaatcgtagttgcaactgcctgagggtcctttaagcatacctgtttgggaacatgttgattcgggggtggtagagtacgttctccggtaaagtgccgcccattgttccggacggcgtttcagtccagtttgtggctggcccctactttacttagagtgttctactggttggcttaagtgagaagtattgtctgccaattggaacgagaactgtgccaccctgaag

SEQ ID NO: 7568 - DNA, 873 bp, Lycopersicon esculentum
  misc_feature (719)..(719): n is a, c, g, or t
  misc_feature (855)..(855): n is a, c, g, or t
  misc_feature (857)..(862): n is a, c, g, or t
  Predicted polypeptide sequence is orthologous to G2057
tggggcgatgagcgcatctgttttttttttttttttttttaaccaaaagaatctggctgataatcattggcattcaagagaactctactagttctaatgaactgaagctaataagcacacatcaacaacagcaacatcgtctgagccacagaaaaacacacttgtacatgaacattacgccgctctttaatcttagaaaaaaacctgagactatgctcaggattatttttccgcggtgcattctcactgaatcagactcgatcaaaaggggtgatcgcgctgtccctgacttgaattttgccacttccatcttcaaatatagtacttggtcctgtcaggttataatgggagtaaagcgttttcgagctgattgagatgactagaattagaggaagcctaggatggtttgtcgggaacaccataatgctcctactagatttcaccttggatttcagtatgaatgcgacagccccaaaatacgcctaactctgaggcgaatccgatcctgaaaggagggttgatacattaggaacacagctcgagatcggttagttctggggagtggatcactgtggcgatagcaatggtgctggtcttatctgcacaatcgacgttgcactgggccgagggtccctttagactaaattgatttgagagcatgtgaataacgggggcggtttaagtaacgtactaccgttcagagtgcctcccatgttttncggcggcgcttatcgtcacggggtgtggtcgccctagttaatcttagagtactaactggctggttaaagtgagaagtatgtttccaaattgggactgagacttgctctctgattgtggactaaaacggtacccccncnnnnnncctcccccccc

SEQ ID NO: 7569 - DNA, 370 bp, Lycopersicon esculentum
  Predicted polypeptide sequence is orthologous to G2057
gaccggtagaaaagacccggcatagtaaagtttatacggcgaaaggaccgagagaccggagggtccggttagctgctcatacagcgattcaattttacgatgttcaagaccgattgggttatgaccggcctagtaaggcggtggattggctcatcaaaaaggcgaaaaatgctattgataagttagatgagttacctccttggaatccgaatcagattccagggaataccactgaagctgatgctctggtgttgaagcaacaaccggagtatcagcttcagagggaattagaagaaaataaccaaagtcgggttaataattcttctaattcctacctgatgcaaggcggtagcgggggttggtggaggag

SEQ ID NO: 7570 - DNA, 610 bp, Lycopersicon esculentum
  Predicted polypeptide sequence is orthologous to G2057
gaaacagaatgggttaggctaagcttattcttgtttttttctttgatttttttttcttcttcttgttctagcattacaaagctggatcctcataagaagaacaaaaagaatcataattatcaaaatgtagaagaagatgaggaagaaaaagaaaaaaatcaaccacaaccacagttttttcaatttcaacaaccttttactcatcatgatcattttatgtatgaagatttagataccatcaaacaacaacaagaacaagctcgatcgaagaaacgttcgttttttcctcctcctcctcctcgtccttcttgctcgaagcaaaaaggtgtaacatcgtcaaaatttggttgtggagagattgttgaggtacaaggtggtcatatcataaggtccattggtcgaaaagatagacacagcaaggtgtgtacagctaaaggtccaagggataggcgtgtgcgccttgctgctcatacagcgattcaattttatgatgtacaagatcgacttggctatgataggccaagtaaagctgtggattggcttataaaaaagcgaaagcttcgattgatgagctagctggattgcctccatggaaaccaactaccactgg

SEQ ID NO: 7571 - DNA, 868 bp, Lycopersicon esculentum
  Predicted polypeptide sequence is orthologous to G2059
gtttttttttcccctcaataccaatctattggatttctcatggagaatcagtctctaaaatcagaatccatcatgcaaaaagaattgccaacttgttataaacaagtagccatagaatcattatctagatttttcaaggatccacacatttttagtgatttaaatcatgaaattacttttataaattcttctccaacaaaattttctgaatttcttccacttaatttccatcaaaatgaatcgtcattatcattatcatcatcatcatcatcattatcgacttcttcaagttatcaacatcatcaagatcaagggaataataacaacatttttcctttaaataattttcttgatcatcaaacatgtgcttcttcaacaaattcactatcaagtaattacccaactttagggttatttttgcaagagccttccattttagagatttcaaaaagggcagctgaatctctaagcaacaagaatcacaagtcatcatccgcggcgttattccctatgtcttcatcaataggtcatgagagccaaattcattataaagaggttgcaactacaaatccaacaaattggttgaaaatgaatcaaaccataacaaattgtaccacaacaaaaggttttagtgactattggctcagcactacaaaaactcaaccaatgaaattcaaaggatcatcaagaaaatcatcacttgttcattatgaaaagtcatcgtcgtcgtcatcatcatcatcttcttcttcttctatgatcgcttcccaagggaagctttttcgaggagtaagacaaaggcattggggaaaatgggtggcggaaataaggctaccaagaaataggactatggtttggctagggacat

SEQ ID NO: 7572 - DNA, 815 bp, Lycopersicon esculentum
  Predicted polypeptide sequence is orthologous to G206
gccaagtgaaaaatcaaaacaaagtatagagagagaaaaaataaaatggggagatctccttgctgtgagaaattggggttgaaaagaggtccatggagcaaagaagaagattatttactcatcaattacattaaaaagaatggtcatcctaattggcgtgcacttccaaaacttgcaggtctattaaggtgcggaaaaagttgtaggcttcgatggactaattacttgagacctgatattaagcgaggcaattttactcatcaagaagaagatacaattatcaagttgcatcaagttcttggaaacagttggtctgctattgcagcaagattacccggaagaacagataacgaaataaaaaacatttggcatactcgtctgaagaaaaaaaggaatgaatctcaacttaaagaaacccaatcggagcctgaaaatactaatgtagatgtacatttggaggaggccaacaattctaatgataaacattccgaaatatcgaatcttaaaataaacatcgaaatccaacaacaaccaagtccatcatcgtcagtatcatcatcaagtgaagattcatgttcaaatacaactgcaacgagttcagagtcgagaaatcaaataatgtccgataatttgttagaaattgatgacgatatttggtccgaggtagtatgggcacaagtcgatgacaattatgttgatttgtcattaatggaggataattaccacattaattctagctttgatgataattggttttgggatgatctttttacaagatctaatgagttgatgttagaattgcctgaattatgagc

SEQ ID NO: 7573 - DNA, 736 bp, Lycopersicon esculentum
  misc_feature (725)..(725): n is a, c, g, or t
  Predicted polypeptide sequence is orthologous to G206
ggatacatatgttatcccaaaggaggaagcttcaagtatttcaaggagatgggaaaatcagatgtcacacattgtatttgaacaaggtggataaaatagaagctcacatcatgtgaaaaacacgtatcatcgagacttagaaggaaagtccaatagggtggttattagacacactatgtagtatgaggcggagtgttgagtagtcaataattcacacattcagaagatgacaatagcggagatgaggatgcttagatggatgtgtgggcatagtaggagagattaaattaggaataaaaatatataaagcatcttcaactccccaaggatatgaccctatataaggaaggatggaagtcaaggattaaggtggaggtttacaagatggtcaagtgatttctttctcatgggagagcatggttctagcatagaacacttgtctactgcctctttttctcattagtattactccattattattttattcttctattgtattattactattgtttcttatacttgagttatcttaactattcttgtccgtattttcttctacaatattttcaccatagttcttctcttatatttgtcagatctgttttttttataacacttaccttcagacaagggttcatcagaaacaacctcgttacctcacacaaagtaggggtgaggtttgcatgcacctcctcctccctaaagcccattgtgggatacactangcatgttgttg

SEQ ID NO: 7574 - DNA, 271 bp, Lycopersicon esculentum
  Predicted polypeptide sequence is orthologous to G206
gcatcttcttagttctctctgttctgaaaatttttctttagaaaaaacacacacaaaaaaaaataaaaatgggaagagcaccatgttgtgctaaagaaggattgcgtaaagggccatggtctactaaagaagatttattacttactaattatatcaatcaatatggtgaaggccaatggagatctttgcctaaaaatgctggattgcttaggtgtgggaaaagttgtagattaagatgggtgaattatttaaagccagggattaaaagaag

SEQ ID NO: 7575 - DNA, 637 bp, Lycopersicon esculentum
  Predicted polypeptide sequence is orthologous to G206
cgatctttttttaagtttatttaataaatatatgtaaatccagatgggcagctatcgctggagaattgcctggaagaacagataacgaagttaaaaacttctttcacacgcatctaaagaagaatcttggacagataaataatattgatgcccctgtacagtgtaggagggtaaaaaaacagaagaaaaaggctcaagaaaagcccaaattatttgtggatatatcatcaccaacgatgggtagttcttcttcaatatcgagcattattacattcgatcaaaatgaaaagattgacatggaaaagacggttatcttggagagcaatccatcgttatcatcgtcacatagtaatatcgatggcttcgatcaatttgttgacacaacttcgttctggcttcatctacttaaccatgccaatcgtgaagaattatattatgaaaactcctaatccaaagtagagatggataatttaattaatgagatgaaattattttaccttattatcaaaatgtccaaaaggaattttaattatgtgagattcttaattcggaagataatgctacactaaatttaattttgatctaccataacgtcaattccattcgggtttcaatgtgtgtataggtaacttttgac

SEQ ID NO: 7576 - DNA, 489 bp, Lycopersicon esculentum
  Predicted polypeptide sequence is orthologous to G206
gcattaatcttgccaagggtacaacaacagcagcagaaaggtacgagcatggaggcgatcataaagaagggggcatggtctccggaggaagaccaaaaactgagaggttatatcatgaaatatggcatctggaactggagacagatgcccaaattcgcagggctttcaagaacggggaaaagttgtagactaagatggatgaactatctccgccctgatgttaagagaggaccctttaccacggaagaggttgaaattgtcatcaaaacttatcaggaacttggaaatagctggtcagcaatagctgcaaaattgcctggaagaacagataacgaagttaagaacttcttccacacacacttaaagaagcatcttggactgaaaaatcatgatgttccattgaaaactaggaaaatccgcaaacaaaccaaagaagatgagaagaaaattagtactcgaggaagacttgtacttgaaacgagcaataac

SEQ ID NO: 7577 - DNA, 521 bp, Lycopersicon esculentum
  Predicted polypeptide sequence is orthologous to G2071
aaaacttgtacctgccaaaacggattttgtttgtcgtaaccatgggatcttacctgaacttcaagaactttgctgacacatcacaaccagagagcagtgggaataatagtaattcttttttggcccaacaatcttccatatactcgtttacctttgatgagctgcaaaatacatgtggacttggaaaagattttgggtcgatgaatatggatgacctcttgaagaacattgaagagtctcaagcgttgtcatcttctgctgctttagggggtaatttgcagagacagggttctttgacactgcctaggacacttagtcagaaaactgtagatgaagtatggagagactttcagaaagagagtgttgttgctaatgatgcaagtgggactggaggatcaaactttgggcagcgggaatctaccttgggagaaatgacattagaagagtttttggttagagcaggggccgtgcaagaagatatgcaaccagctggatactcaaatgatgttacatttgctagt

SEQ ID NO: 7578 - DNA, 687 bp, Lycopersicon esculentum
  Predicted polypeptide sequence is orthologous to G2071
agtagtgtcatgcagggtggtgttatgaccatgccagtaaaaggagtatcccctggaaatcttgatacatcttctctttcaccttcaccttatgcatgtggtgaaggtggaagaggaaggagatcatgcacctcttttgaaaaagttgttgagagaaggcgtaagaggatgataaagaacagggagtctgcggccagatcaagggatcggaagcaggcatatactttagagttggaagctgaagtagcaaagcttaaagaaattaagcaagagttgcagaagaaacaggctgaatttatcgagaagcagaaaaatcagttattggaaaagatgaatgtgccatgggaaaataaactaatatgcttgcgaaggacagtgacgggaccttggtagtcagtagaagagcaaattcccgagtaaacactcggagaattggtagacaggagattgaagtgaaatagcttttccttcctcttttttgtttcaacaaacaagttcagagcctgctcctcgaccctcctcccagcctgtgaattaaaatatgttctaattcacatatgttggtcacaggatagataactttatgtatcgactatagtacaggacaggtgctgtgtacctgtacgttatgtaaacaatgttcttgcataaagtttcctcatgtgcttaaaaaaaaaaaaaaaaaac

SEQ ID NO: 7579 - DNA, 625 bp, Lycopersicon esculentum
  Predicted polypeptide sequence is orthologous to G2071
gaaagaatagagaaaaatggaaaagatccaaagtttgtgaaattataaggagcaatttgtgtatttttagagtaagaaaaggaaagggagaaacgagatccctacgaagtcggcaactatggcgtcaaaggtgatgccgtcagcatcaacaacgcctaattcggatcgttcattacatccccaaaacccatcttcttctctaaatcactctcatccttctagaaacttcgattctatgaacatggatgaaattctgaagaacatttactctgattccgacccttttgcttgttctgtatctgcaaccgccgcagtccatacaccttctgctaccgcagccggtgttggggatgtggggcctactaagactgtggatgaggtgtggagggaaattgtagcaggaggaggggtagggggagggagtagggagccggagatgactctggaggattttttgaccaaagctggggcggttactgaggaggatgttagagttccggtgatcgctcctccaccacctccgccaccgcctccagccacgggggctccgtctgccagagggtttgtggtggataacatgatgggtactgggaattgtcagtttccgggtgccatgcagaatgga

SEQ ID NO: 7580 - DNA, 861 bp, Lycopersicon esculentum
  Predicted polypeptide sequence is orthologous to G2094
gcttgtttgttgaggtggaggtagtttttatgatttttttctgctaatttgggggtaaaaagtgtttattccgctagtttttgctgttttgtcatctgggtcgtgctcagtttttggtgcaaaaaaacttgtttgtgagttgtgatcattgagcagtggttgatcaaggtgtttttttcttcattttacttgcgttttagctggtgtagaaggagtttctctgggttttttctgttaatttggggataaaaagtgtttattttactggtttttgctgttttgtcatcttggtcgtgcttggtttttggtgtaaaaatcttgtttgtgagttgtgatcgttgagtagattggttgatcaaggtgtttttttcttcattttgcttgagttttagctgatgtagaaggagttcctctgttttttctgctgatttggggataaacgttctttattcagctgttttttttcactttatcatctgggttgtgcctagtttctagtaaaaaacacttggttgtgagttgtgatcgttgaacagtggttaatcaaggtgttgttttcttcgattttcgtttttttcctgctaatttggggataagcgttcttcattcagctgttttttccgttctatcatttgggtttagtagatttgagctgtgattgttgagaagtggtgaatgcaatggtggatacaagtgacaaagttcaagaaactggtgagatgattgggcaaaatcaaaccccagaaagggttacatcagagactaaccaaaaaacttgtgttgattgtggaactacaaaaactcctctgtggagaggtggacctgctggacctaagtcattgtgtaatgcatgtggaataa

SEQ ID NO: 7581 - DNA, 568 bp, Lycopersicon esculentum
  Predicted polypeptide sequence is orthologous to G2094
gaaactcctctgtggagaggtggacctgctggacctaaggtcagtaatttggtctatttacctgatcaatttcgatcgcctagtttggtttgtttcatcttatatgatagtgtttgattgagcttgaaatgttgttttgacttgtataattgttatatgaatagttaaacaatgattattgtcgatatttagttgaaagttgtatatatagaaggattacttattgtggaattgtgtcaagataattgtggcatggtcaatcaaaattacttattgtggatagttgttttgtgcttgttgttttggatacgttgcttagactctccgaaatgttacctcactgacacctaaaaatgcattgctcttggatgatcgaacatgtacttagtgtctttttgaagagtttgagcaatagggtttggtcttagtggcttaactaagatttaaaatatacataattgaacctatgaagaagccacgagtttgatggtggtggtttggatatagtatctagtggctagtgttgatccacttggtctatagtctcaactcggcttgtaaatgtgtt

SEQ ID NO: 7582 - DNA, 797 bp, Lycopersicon esculentum
  misc_feature (4)..(4): n is a, c, g, or t
  misc_feature (797)..(797): n is a, c, g, or t
  Predicted polypeptide sequence is orthologous to G2094
tganacgatctgttcgaccccttttttttttattttttttttttttttttttttttttttttttttttttttttttttgggaccaaaatgggccaattaattagtaaaaaagttcccatgggtttctgcaccaattaaaaatcaaaagggttaacctagtaattttccaaccgatccccaagaaagagccctcaataatttccccgcttggccttcttctcttaattttcccccaaatcccatcaatttaccggtttctataccctttttctttattctccttttcttctcaacccccaaaaacgggccccccttcttattatactttatcccacatgcgttacacaatgacttgggacctgatggaccccttttccaaagaggcgttgttggggtatgacaataaccgcaggatttcattgcttctgcttcttttgaacctttttttttttctttttctgcctttcttctctttttttccttccgagttttttttttttttttttgggctaatcaaaagatttctatatttcccaaaccaaacaaaaccttaatataatgaaaaccccggtccccaaaatgtttgtttaaaaacttccccccccccctcccaaaggttttttgtttacacccccaaaggcccccaaggcgtattcttctttctttgtgggagagtgccctttaacccggtccctttttgggcgtttgcccctaaaaagggacttgccttagcccttttttattttttttttggcgcccttccacaagaaaaagcggtttccccttattaagcttcn

SEQ ID NO: 7583 - DNA, 575 bp, Lycopersicon esculentum
  Predicted polypeptide sequence is orthologous to G21
ttttgtttctattataatatatgatcctttctactttctttacttgctacaacaatacttcacaagaaagacaataagctacaaccactttagctaaagaagaaaaaagttatgaaaaatcaagaagaaataatcaacctcaaaaatcgtcatgatttcatttctaatggcttgagttttccttcaaatatcgcgacatcaccatcatcatcatcttcttcttcttctttttcctcgaataatgcattagtttcaaaaaagtgtcagagctcgaagaaaattgaagaagagaaaaagaaaaagaagataaataatgatgacgaagataagcacccaacctatagaggggtacgtaagaggagttggggcaaatgggtgtccgaaattcgcgaaccaaaaaagaaatcaagaatatggctaggtacttatccaacggctcaaatggcagctcgagctcatgacgtggcagctttagccatcaaaggatgttcggctcaccttaattttcctcatttggttgatcaatacccacatccggcttccacttgtcacaaggatatccaagcagcagccgc

SEQ ID NO: 7584 - DNA, 743 bp, Lycopersicon esculentum
  misc_feature (722)..(722): n is a, c, g, or t
  Predicted polypeptide sequence is orthologous to G21
catcaatctcccattattttcaataactatcaaacaatttcttcttcatctctaacaaaaagatcaatatccttgaaatcatcgaaacaacaaaccaatcaaaacaagaaaatcaaatccagtactgaaaaaaccaagaaaatggacgattcaaaacacccaatttaccacggtgttcgaaaacgaagctggggaaaatgggtgtctgaaattcgcgagccgaggaaaaaatcaaggatttggcttggtacattttctacagctgaaatggctgccagagcacatgatgtagctgcaattgccattaaaggtcacttagctttactcaatttccctgaattagctcatcaatttcctataccatcttcgaaatgcgctaaagatattcaatctgcagccgcaaaggctgcagctttgaatatttcaccaagaaattttatggaaaaacagagtacagatgagttaatggaaatgccctgttcttctgaagaaacagagtcagcagaatcatctttgacgagtaatagcgaagacccttttcttgatttgcctgatcttcttatggatctcactcaaaaatttgataaattctgttactataattcaccgtgggatttggctggagctgtaagcttttggcctcaagaagagctctattcgtgggattacaaccatgaaactgaaaccccactcgaagtttcacagccataatactataattnttcgatattccaacaattaaa

SEQ ID NO: 7585 - DNA, 440 bp, Lycopersicon esculentum
  Predicted polypeptide sequence is orthologous to G21
gccgccgctgccaaagctgcagccgccagcatatttcttgaggagaattcggttgagtcgagccagttaaccgggctgcacagctcgcattcctcgactaatttagcctcagataacgtacaagaattactaaattctccctcgatggatcacgatgacccgtttttcgatctaccggatcttatcatcgatagactcgaccaaaatgaccggtaccagtacccggtttcgacgtggcagctggctggagccgatagcgggatgtttcggcttgatgagccgtttttgtgggagtgctattagaggaaattataagtgtactcttgagaagagacctgtttatttttcttttcttcttttacacttgacaacaaaagtcataaaacatccatcgtgtgtgtatttctcaacgtatcataattaatgttcatatcatacgc

SEQ ID NO: 7586 - DNA, 394 bp, Lycopersicon esculentum
  Predicted polypeptide sequence is orthologous to G21
cacactccaatttcctctctcccaaaaatacttcaatttttgtctttttccatgtttcattcccattcttctctaaagtagaaattgacacatttgattatttttttctcccctgttttcataaaggaactcttcgatcctaatatattaatacagtatgtcagaattcaattgatcataaatatttctctttcttctcaacatccatcttataataattcgtatttataattataagattaaagttaaggtatttactattcgaggaaattatactaattaaatgtcaaagcgaataagagagagtgatgaaaaaggtaataaacacccaatttatagaggagttcgtatgcgaagttggggaaaatgggtgtctgaaattcgcgaaccgcgt

SEQ ID NO: 7587 - DNA, 562 bp, Lycopersicon esculentum
  Predicted polypeptide sequence is orthologous to G2107
caaacccaaaaacgtccatccatcgtacactactatattttactctctcgtcaaaatagtattatcatatcatggatatctttgaatcctattattcaaattctttcgttgaatcattattatcatcgtcattatcaatatctgatactaataatctcaatcactactcccctaatgaggaagttattattttagcttcgaataacccgaaaaagccagctggcaggaagaagtttcgagaaactcgacatccagtatacaggggaatcaggaagaggaattcaggaaaatgggtttgtgaagtcagagaaccaaataagaagacaaggatttggcttggtacttttcctacggctgaaatggcggctagagctcatgacgtggcggctatagcattaagaggccgttctgcttgtttgaatttcgctgattcagtttggaggttgcctatccctgcttcctccaactctaaagatattcaaaaggcggccgctgaggccgccgaaatctttcgatcggaagaagtttcaggagaatctcctgaaacgtcagaaaatgtgca

SEQ ID NO: 7588 - DNA, 573 bp, Lycopersicon esculentum
  Predicted polypeptide sequence is orthologous to G2107
ctttctatttttagctctcaacaacaatgaatatctttgaaacctattattcagactcgttaattttaaccgaatcatcttcttcttcatcgtcatcgtcgttttctgaagaggaagttattttagcttcgaataacccgaaaaagccagctggcaggaagaagtttcgagaaacacggcatccgatatacaggggaatcaggaagaggaattcaggaaaatgggtttgtgaagtcagagaaccaaataagaagacaaggatttggcttggtacttttcctacggctgaaatggcggctagagctcatgacgtggcggctttagcattaagaggccgttctgcttgtttgaatttctctgattctgcttggaggctgcctatccctgcttcctccaactctaaagatattcaaaaggcggccgctcaggccgtcgaaatcttccgatcggaagaagtttcaggagaatctcctgaaacgtcagaaaatgtgcaagagagtagtgacttcgtggatgaggaggcgatctttttcatgccaggattacttgcaaatatggcagaaggacttatgc

SEQ ID NO: 7589 - DNA, 647 bp, Lycopersicon esculentum; identical to SEQ ID NO: 7233
  Predicted polypeptide sequence is orthologous to G2107

SEQ ID NO: 7590 - DNA, 366 bp, Lycopersicon esculentum
  Predicted polypeptide sequence is orthologous to G2116
caggcagcacattccgtataaccaatcagcattcttttcgcatcagccacaatcaggggctagcgaatcccagaacatacagatgcagcaatttcattccctccaggatagcttgttgactcctcatcgccgtttacttgcagggcatgggcagggtctccctgacacaatgcaacaggatcccctaggtcgttttcaaggtctggatattggtggcaggggtctgcatcttgtgaaaactgaaacaccttcaatttctgccagtgagagcagcagtacattgtgattgacttgtgcaatcggccttatttattggaattgttcatagactgacacgtgtttaacatccaaaaacatgatattcaa

SEQ ID NO: 7591 - DNA, 615 bp, Lycopersicon esculentum
  Predicted polypeptide sequence is orthologous to G2132
ggaccaagaacaccaaattaacaaagaagaaatagtgggtttttgagaaatttatgtcggcaaggtttaatcttctagctgtgattgaatttagagcaccattaaacctctgtttttcactttcttcacttctctttgttgtctctgtgcaattttccccaattttatcgatgggtttgaggcccaaaaggaattgttctggagctgtattttttgagggatttcatataaagcaatttttacatcttattttgctgttgagaacgccacttgattttaaagtgtaatctttacattttctccttttatttgttagaaattttgaatattattttttaaagaggaaatttttgctaatattgaggttatgcttaagcctttgtcatcaaaatttgagaatcttggtagaaacatgaagaaaaaagttgatacaaacagattagtgaggaaaattaggattgtttgtaatgatcctgatgctactgatgattcctcggacgatgattcgaggtgtaagcgtttcgttagagagataagttgcaaattggcaactcttttaatcttagaaaagcctctgagattgaatgttcatttcaagatagtaaccatggagag

SEQ ID NO: 7592 - DNA, 869 bp, Lycopersicon esculentum
  Predicted polypeptide sequence is orthologous to G2141
ggtttctcctataatcttccttatactaactactatacattgcactttgaaaaattcaaaaagttaaaaataacaacaaaaaagacattgtataacatttaaaaaaaaagaaaaaaagtgtgtactgtgtacagactacagagtaacagcaaaataaggcacaaaactataatcttgttccttcaatttctctacctgtatggatgtgtaatgaagtggaggcatttcaccagctgaacaatcgatccctctcgtcggatctttgaaagtggccaattgtttgatgtgtatcttatagattgttaatcttgaggcaaggggatttttttttttttagtttaagtttgattcatttcccaaataatggatatgggtagcaagaatgatactcaaggacaaaagaggaacaaggatgctactaattttcagtcaccaaacatatcgttggactggcaattaagtggaagcaacttgacaaatgcatcaatggggatgatccctaatagcaatcctttagtagattcagtttttcccactatttgggatcggcctcccaattcgtcacacttaggtttctatggtaataataatgctaatgctcaaatcagtccttgcattatgaatcagcacgagactgcagcaattggctcggtccctacgagaggtagtatgagttggaatccactgaattcgatgctgaaaggggctatgtttgtaccacctattcctggaatgattcctcaaagcttagctcagcttccagctgatttgggtttcattgagagagctgcaaggttttcgtgcttcagtggaggaaactcaatgatatgatgaaccggcctttaagcgtccctgagtctactaagcct

SEQ ID NO: 7593 - DNA, 1035 bp, Lycopersicon esculentum
  Predicted polypeptide sequence is orthologous to G2144
gaaaagggcaaatcctttttatagagtcaaagataaggaagactacagtagtacacacagttgcagagaagaccgccattgaagctcttgataaaaactccatataagaaacaattaactctggaaaattccaaaaaagaagaagaaaagagaaggaagtatatagaaagcttcatttttcacttcaaatacttccattttttctcttttttttgttagtgttttgaacctcattggtggggttactgtggagtaatctctgtttaaattgtggggtttgtttaaaagtttcagttggagtttgcagcattaacgaaattcgagaaactgtagaaattgagcttggggttgtcttgttgagtctcattctggaattgggttagctgtgttgtatcaaagttgggtttggtttgttttttctgtgaaatggataatctgatagagtgtattgaagcaggagaagctagatccgagaattgcggagctagaatgggagaaattaaagatgggtttcatcaatttggtgaggaaattttgtctgttacgtcggaaggtggaagttctttcactgctttacttgggcttccgccgaatcaagcggtggagcttttggttcagtcaccggaaactgacaaaatagcatcagataagcttgctatcagtgaacctcactatcgttatcctcctcctcctccgatttttccttcagatatcgctttgatcgatagagcttctaagttctccgtcttcgccgccgccggtaactccccggagtccaattcaaccctttcgaattccgggtcgaaatcactgttcgtcaagcaagaacccctagattccgaatgtaaccacaactcatctccggcgacttccaatccactagtccatcagaaatcaacaaagagaaaggaacgcgagaaaaaggtaaaagaaacttctaaaaaggggaaaaaatcagctaacgatacctcagaagacggcggcgagaagctaccatatgttcacgtccgagcgcgtcgaggccaagccactgat

SEQ ID NO: 7594 - DNA, 511 bp, Lycopersicon esculentum
  Predicted polypeptide sequence is orthologous to G217
gaatagatgtccgtcaaaggaagagaaaaaggagaggtattgattacaatgctgaaattccctttgaaaagaagcctcctccaggtttctatgatgtcactgaggaagaccgtccagttgatcaacctaagtttccaactaccattgaggaactagaaggtgaaaggagagtcgataaggaagctcgcctaaggaagcaggatattgcgaggaacaaaattgcagagagacaggatgcccctacatccatattgcatgcgaacaaacttaatgatccagaagcagtgaggaagaggtcgaaactgaatcttccagcaccacagattccagatcatgaattggaggccatagcaaagataggtattgccagtgatctaattgggggagatgaactgtccgaagggaatgctgcaacgcgtgctcttcttgcaaattatgcccagacaccacaacatgctatgactcctatgcgaacacctcaaagaaccccttcaactaagcaagacgccat

SEQ ID NO: 7595 - DNA, 1092 bp, Lycopersicon esculentum
  misc_feature (1034)..(1034): n is a, c, g, or t
  Predicted polypeptide sequence is orthologous to G217
gcagaagagaagatcgaagaagacatgtctgataggattgccagggagaaggctgaagaagaagcaaagcgacaagcattactccgtaaaaggtcaaaagtattgcaaagggagctccctagacctcccattgcttctctagaactaataaagagttccttgatgagagctgatgaggacaagagctcctttgttcctcctacactaattgagcaggctgatgaaatgattagaaaggaacttgtgtccttgctagaacatgataataccaagtaccctctagatgagaagccagagaaggagaagaaaaagggggtcaagcgaaaaattgttgctgaacctgctattgaggattttgaggaagatgaattaaaagaggccgatggattgatcaaggatgaggctcactttcttcgtgtggcaatgggacatgagagtgaatctcttgatgaatttgtcgaaatacacaaagcaactttgaatgatatcatgtactttcctacccgaaatgcttatggtctctcaagtgttgctggaaacatggaaaagcttgctgctttgcagaacgagtttgagaatgtgaagaaaaaaatggacgatgatactaagaaagcaacaaaacttgagcaaaagatcaaagttcttactaatggatatcagatgcgagctggaaagctttggtcacagatagagtcaaccttcaagaaaatggacacagcgggtacagagcttgaatgcttccgagcattacaaaaacaagagcagctagcagcatcccacaggatcaacaatatgtgggaagaagttcagaagcaaaaggagcttgagcgtactttacagaaaaggtacggtgacctcatagcagatacgcaaaagatccagcatctcatggatgagtatagaatacaagatcaaatgcaggaagaagttgcagcaaaaaatcgtgctcttgagttggcgaaggcagaaatggcagaaaaagatagtgtaccatctgctgatgatgtggaaccttcaggtaccggacagaattnccatacagaggaaaattctgcttctgcctctcatgtgccaatagaagctgatgtgcat

SEQ ID NO: 7596 - DNA, 863 bp, Lycopersicon esculentum
  Predicted polypeptide sequence is orthologous to G2226
gtttatctttgcaaaaatcttggccttttgcttttctctttctcttttttggttataggaaacaaaagttcgcttcttttttatggggtcttgataaaaaatccagtgcattgagttcttccaaaagtttggcttgaagagaaattcctcacatctacactaggttcctattcataatgggactctcaccatatacgactccagcagatgcaggagtgttctgtgtgattctggttaatacagccatatccatctctattgtcaagggaatggttcgatctatccttcatgtgattggcatcaactttgcatcatgggaagaatattctattgaaggccctttggacccatttgagtgtcgtgggagcccctcggtatcatacatggaggagttccgaagcagaacccctgctgttcgttacgattcattgtgttctaatcaccctacacaagaatgcgtggtatgtctggcagagttcaaacatgacgaggagataaactgcctctcatgtggccacgtttttcataagctgtgtctcgagaaatggctaaagaattggaatgtcacctgccctctctgcaggaattacattatgcctaaagaaggtgaggaagatacttgtccaatgtgaattttgtagtttgtcaggcctgtttgatatgttctgatgtacagcttagttgggtaaaaatttattgatgactgcctgatctttgacactgcataattctgtaaccttttatactgtaatactttgcgtcctatcacagtgacgggtctctttgttgcgaccaacaattcatatattgttgtacatatgttacaaaattgccagttaaaaaaaaaaaaaaaaaaaaaaaaa

SEQ ID NO: 7597 - DNA, 669 bp, Lycopersicon esculentum
  Predicted polypeptide sequence is orthologous to G2226
cataatgtaattcctgcagagagggcaggtgacattccaattctttagccatttctcgagacacagcttatgaaaaacgtgcccacatgagaggcagtttatctcctggtcatgtttgaactctgccagacataccacgcattcttgtgtagggtcattagaacacaatgaatcgtatcgaacagcaggggttctgcttcggaactcctccatgtatgatcccgaggggctcccacgacactcaaatgggtcaaaagggccttcaatagaatattcttcccatgatgcaaagttgatgccatcctcatcaaggatagaagtgcccctccccgaagaatcttataattttaaagtacaaacaaccttaccaaaccttagtgtcatgcacctgatggaagggctaagataatgagtctctgaatcagtaacagaaaatgtaacaacttaaataatggaacagaaggataggtttcattcacccaacgaattaacccagctggctactacgtcctatagaagaaaatggaacaacataaagtgctatctcatcaaacccatcctagcacaagggactgcttctcaggagaaaggaagcagcaggcttaacgtaagtataatccctgaaaagggtccgaattatcctttggactcgaaattggagaatcaacc

SEQ ID NO: 7598 - DNA, 996 bp, Lycopersicon esculentum
  Predicted polypeptide sequence is orthologous to G2226
gttaacaaaaaagtctcaagttttcatatttttagatccagtatattgagctctttcaaaagtttttttgaagaaataatcatcattttaacataaggttccaatccattatgggcctctcacaatatccaactccagcagatgcaggagtactcggtgtaattctagtaaacacagccatatccatctccattatcaaggagatactccgttcgatccttcgtgtgattggcatccgtatcgcatcatgggaagactattctattgaaggacccttggactcacttgaatgccgtggaagcccaccagaatcatacatggaggagttcagaagccgaacgcctgcatttcgttatgactcgctacgtatctctaaccaccctgaacaagaatgctctgtgtgcctgacaaaatttgagcctgatgcaggggtaaacagcctctcatgtggtcatgttttccataagctgtgtctagagaagtggctcaggtattggcatgtaacttgtcctctttgtagaaattacttgatgcctcaacaagaagaggacgatacatgtccaatgtgagattaaacgttttacggtgccacttcatccatttgctgatgttattatgtacagcttagtagtgtacaggctgagtatgtgtatgcttgatctttgatgtgatatagtctgttagcttgtcatatttgtgatggtttgcgtcctctcagagtgacgggtctctttcgtgtgaccaaaaaacttatactatgttgtacatgatttagtcctgtagcttcttgtgtttgtaatgctttgcgtcctctcagagtgacgggtctctttcgtgtgaccaaaaacttgtacattatagtacatggtgtagtcgtgtagcttattaatgcttttcgtcctctccaagtgacgagtctcctttggcatcaccaagaacttctacattgttgtacattgttgtacatataacctaaaactttctcttatgttactt

SEQ ID NO: 7599 - DNA, 582 bp, Lycopersicon esculentum
  Predicted polypeptide sequence is orthologous to G2226
ctctctctggtatcctatgaatctaacaaccctacccttaagtctctaaaaacaataaatttctctcccaattttcttaatatttcaaatttcaaagaattttctaacatcttctagctcctactacacctataggcaataatataaagtccagttcagtcagctgttccagaagttgttgctagtagaaatctctaagtttcagcctagattccaatccagtatgggactctcacagtatccaactccagcagatgcaggagtgctctgtgttattctagtgaacacagccatatccatctccattgtcaaggagatggtccgatcgatccttcatgtgattggcatccacattgcatcatgggacgattattccatcgaaggctccttggactcgtttgaatgtcgcagaagcccatcagagtcatatatggaggaattcagaagccatacccctgcaattcgttatgattccatctgtatctctaaccacgctgagaaagagtgctcagtctgcctgacggattttgagcctgacgcacagataaaccatctgtcatgtggccatgttttccacaagca

SEQ ID NO: 7600 - DNA, 628 bp, Lycopersicon esculentum
  Predicted polypeptide sequence is orthologous to G2226
actcatattttagtctttcttgatgatggatgatgatttaccttggatcttcacattttattcaatattgaaaagttctggttttgggtgttttattacatgatttgtaatttgtggtctgagatttccttgttatcttgaaaagggttttttttttctcctttgtctatttacatttggtatcaggaaaatgaaattattacagttttttagcagaagtttttctggttcttggatccatgttcataaagatttgttttttcaaaggaataaaactgaacttttaaaggaagatgaggactttctaatcaatggggtttccatttcttgtttgagatgtgtaacatagctccaattttcatttcttgatgcttttcttggaggactgtgttccatttataattgtcttactgctgtgggttgtttaacttttcctcataattgacttatagattcttgtttctatgcaggtccagttcagtcagctgttccagaagttgttgctagtagaaatctctaagtttcagcctagattccatccagtatgggactctcacagtatccaactccagcagatgcaggagtgctctgtgttattctagtgaacacagccatatccatctccatt

SEQ ID NO: 7601 - DNA, 1842 bp, Lycopersicon esculentum
  Predicted polypeptide sequence is orthologous to G2239
ctcgtgccgaattcggcacgagggatccttctgcaccatccaccatttttgttttaatacccccaaacgaatcgaaccacagttatttcaatttctttgatattcaaaattataaagcttacttccccagattagtatgagatatgggcaattctatgaagcaagaatctcctcttcttagttatcttctctttgtgtttctcttcacatgttcttctttaattgacgaatcagtcgcacagccaccaactactggaaataaatttcaatatgcaaggctcagtcatcctttggcaattatcataattgttcttattgctgcgctctttttcatggctgctttttctatttacattcgacactgcactcaggcttctggattgagcggcagtgtccggcgagctctatccatgcgccgccgtgctgcggcggctcgtggattagatgcagcggttattgagacttttccgacttttacttatgctgaagtgaaggatcatcaaattggtaaaggagctttggagtgtgctgtttgtttgaatgaatttgaagatgatgaaacgctgcgtttaattccaaagtgtgatcacgtttttcatcctgagtgtattgatgcttggttggaatcacatgatacttgccctgtttgccgtgctgatctcaaccctcaaccggatgaaccgccggttcaagttccagaagatgaaccggcaacggaacagcaacagcaacagcaaaacgatgaagtttcaattcgcatagtgagcgacgacgaacaaagggaacaagtacagcaacagcaacaagaagaaggttctgttaattcgacggtgaagcggaatttgagcttcaacgtgccgaaccgggttcccaagcaagaagaaggcggttcagttaaatcaggagtaaagagaaacttgagtttcaacgtgccgattcaaccaccgagatcaatttccatgaggccaaagatgttcagcaaattcagatcacattcaaccggtcattcactagtactaccaggtgagaatttagaccggtacactctcagattgccggagggcgttcggaaagaggtaatgaaccgtgcactattgaaccgggctaaaagctttggaggcaccttaccaagagatacaagctccagaaaaggatacagaaccggtaccggagatggaagcaaccggggttctagatctaacaaaaggatggagtggtctgaaccggaaccgaaatcggaccggtggattttcaccatgacaccaccattcttttcaagaggttcatcaatgaaatcacccagagttggagctgaagccggcgagggttccacctcagggagtatgagaaccgccgtcaaattgccgtcgtttaaatgcttggaaccaaaaggcgatgaagcctcattgatgtcgactgactcggctcgaccgccggtttaataatccggttcgaagtcaaaccgtaatgattcgcaaagacttttcatgggctataggaaaggggaacgtgtttttcatgatagattgggcccccgctttgaattaacaagcccaaacttgactctaaatttattttttcgagaaaagcatttttgtttttatttttttgttatataattgaaaaatctttaagtttttcctttttctcgttttaaagatatagtgcatatcaatagttgatgtaagtgtaaccaaaaaatcacttgtaattttatttatttttccttattggataatgtcctatgatgatgtaagtatgtgtatttcaatttttggtgaaacagaaatgtaaaggaaaaagtagaggtttcgattggattaaaaaaaaaaaaaaaaaaaa

SEQ ID NO: 7602 - DNA, 933 bp, Lycopersicon esculentum
  Predicted polypeptide sequence is orthologous to G2239
gcggccggcgaaaattcccaccaaaagctgccatggttaattttaaagctctttccgttaatctcctcctattagtattactatgtccggcgtcagctcagccatcaaattcccctgattccgagaatcggttcgagtacccgagtgtcagtcctgctatggcaattatcatagtgatacttattgctgctcttttttttcattgccttcttctcaatttacatacgcaaccgcggtgcagttaacggaagcatcggtcaaaccttctccatgcgacggcgtactgctgctgctactcgaggacttgaagattccgtcatcgagacttttcctacctttacttacgtcgaagtaaaggatcatcatattgggaagggagctttggagtgtgccgtgtgtctgaacgaatttgaagatgatgaaatgttgcgtttgatccctaagtgtgatcacgtttttcatcctgaatgcatcgatgcttggctcaaatctcatgtaacttgccctgtttgccgagctgatcttactcctaaacctgatgaaccggtgccggttcaaactcctgaggtgaaccgggaattggggcaagaacaggagaatacacagcaaaataacgaagttacgattcaaatagatgtagatgagaatttgatgtcacagcaagaggagacctctgtaaaaccagaagttaaacgaaatttgagtttcaacgcggtgaaccggccgccgaggtctttttctctgaagagaccaaagatgttaagcaaattcaggtcacattcgaccggtcactcattagtggtaccaggggagaatttagaccggtatactcttagattgccggagaaggtgaggaaagatgtaatggaccgggctctactaaaccggacaaggagctgtgcagtcacgctaccaagacacggtagcaccaca

SEQ ID NO: 7603 - DNA, 399 bp, Lycopersicon esculentum
  Predicted polypeptide sequence is orthologous to G2239
gctccggccggggaaaattcccaccaaaagctgccatggttaattttaaagctctttccgttaatctcctcctattagtattactatgtccggcgtcagctcagccatcaaattcccctgattccgagaatcggttcgagtacccgagtgtcagtcctgctatggcaattatcatagtgatacttattgctgctctttttttcattgccttcttatcaatttacatacgcaaccgcggtgcagttaacggaagcataagtcaaacctttttcatgctacgggatactgctgctggtactcaaggacttgaagattccttcatcaagacttttgctacctttacttacatcgaaatgaaggatcatcatattgggaagggagctttggagtgagccgtgt

SEQ ID NO: 7604 - DNA, 506 bp, Lycopersicon esculentum
  Predicted polypeptide sequence is orthologous to G2239
ctaatgaagatgataatcgagctaagccatggtttctgctcgatttccctttgtttattcctgctcgcgatgcatgttatatcgcaatcagaaataacaccattaccaccatcaccaccaccattttcatttgatacgaaaataaaaatcaacccacctacggctatcattttagttacacttatcagtgttttcttcgctatgggaattgtttcagtctacgtccgtcaatgcgccgaccgccgcttcatcggcgacttcgaattagcagacgaagattctggacgacgcggcgctcgatcgcatggactagacccagtcgtaattacctctttccctatgtttttttactctgatgttaaacatcacaaaattgggaaatcagtgttagaatgtgcaatttgtttaaacgaattcgaagatgctgaagctcttcgacttcttcctaaatgctctcatgtttttcatccaaattgcatcgacgcttggttattttctcatattac

SEQ ID NO: 7605 - DNA, 1711 bp, Lycopersicon esculentum
  Predicted polypeptide sequence is orthologous to G227, G242
gctcaaacatagagagaaaccaaaaaataaattaaaatggcgattactacaaacagttctaagagagatatggatcgggttaaaggtccatggagccctgaagaagatgagcttttacagcaacttgttcagaaacatggcccgagaaattggtctctaataagcaaatcgattccggggagatccggaaaatcttgccgcttgcggtggtgtaatcagttatctccacaggtggagcatcgggcttttacgcctgaagaagatgagactattattcgggctcatgcccgattcggtaacaaatgggctactatagcccgacttcttaatgggcggactgataacgctattaagaatcactggaactctaccttgaagaggaagtgttcatcgcttagtgccgatgaagggaacgaactcgccgatcaactttttgagaatcagcagccgccgttgaagagatctgttagtgccggatccgctatgccggttactggttttcatttcagtccgggtagcccgtcgggttctgatagcgattcgagccttcatgttacgtcgtcgtcccaatctcaagtgtttaagcctgttgccagaaccggcggcgtatttccgccgtcgattgatatttcatctccgcctgttgatcctcccacttctctaagcctttcgcttcctggtgttgacttggctgaatcctctaatcgttcggccgattcgactcagtcgaaaaatccttttcagtggctgcttccaccgatgcagattcctccaccgccaccaccaccgccgcctccgctggcaacaacggtgccgttcgaacgagtttctgcaattcaacagtctcttcagaaccctgattttgggcaaaactcaggaggagaacagccagacaaggtatttgtgccgtttagccaggagttgttaggtgtgatgcaggagatgataaagacggaggtgaggaactatatgatgggagtcgaacaaaagcaacagtatcagcggcagcattatcaacaacaacaaccgcagcagtttcagcaacaaaaccatcaattgccaagtggtttagggcttggattgtgtatgcaacaagcttctgattgtttcagggatagggctgctaatcgaatgggactaagcaaattcgattagtgaatgggaggaagaaaccgcctttgtttcattctctctttgtttttagggcacatgttagctctttaagcttcaactgtggaatcgtcaaaagaagaaaatagttttggtggagtattgtacagggccagggagattataaaaccatgttccaatggcagaaatgcaaaggctgggactaataagagaaaaaaaatactaaaaaaaaaaaaaaaaaaaaaccttttgttaatttatattcaggcatatttagaaaccaagaaaaacttagtttaaagtaaatattatgttttgagaagacatctacggcaaaggctgggaaggatttgaatgaagcaaagttattaactttattattttccgaagttatttagtatctctttacctcttcaaattttggatgttatgattgacctgaaagtttcaaaacctgaattggagaggtacgaaatgtatgcaccaaaaattaagtttaactctatttttaaccaataaaaagaaatacttgttaacccataaaaaaaaaaaaaaaaaactcgagactagttctctctct

SEQ ID NO: 7606 - DNA, 1391 bp, Lycopersicon esculentum
  Predicted polypeptide sequence is orthologous to G227, G242
ggctccgcctcccaccaccgtctaatttgtaaatatattcgccggaaacttctctatccacgctttctctatatctatcataccctttttcttaattaatcggttgctattcctttgatggcagcgattacgcagagaaaagattcggatcggatcaaaggtccatggagtcctgaagaggacgagttgttgcagacgcttgttgagaaacatggacctagaaactggactttgataagcaaatcggtgccgggtcgatctggtaaatcctgtcgtctccggtggtgtaatcagctttcacctcaagtggaacatcgtgcttttactcctgaagaagatgatacgatcatcagggctcatgccaagtttggtaataaatgggcgactattgcccgtttgttatcgggtcggactgataacgctataaagaaccattggaactctactcttaaacgtaagtgtccttccatgtccgaagatttaagctttgaaacccctcaaccgcctttgaaaagatcgtctagtgttggtccctgtaccaatttttcttctgttatgaatccgggtagtccgtctggatccgacttgagtgattctagtctttcgggttttccccaatcgcatgtttacagacctgttccccgtaccggcgggattttccctcttcctcctcctcctccggttaagcagatcgaaattcctccatctgtacccgacccaccaacatctctctgcctttcgttacccggatccggatccggatccatcgaaaagccaacccagtcccctaaatcaccaccactaccaccgcctcctttgccggcggttgataaaccgattcccccatccgtacccgtaacttgtccaccatcggctttcatgggtcatcttgctcaatctaatcaaagttatgattttagtgctgcacccaaatcaggagagaaacagttttttactccagagttcttatcagttctgcaagatatgattagaaaggaagttaagagttacatgtctgggtttgaacaaaatggtctctgcatgcagactgatgcaataaggaatgcagtcattaagcgtattggcatcagcaagattgagtaatccatctatgattactgttgaactgttctatagtcatcaacaatggctgccgctgctcagcgaaatgacaccggagaagaaacaatggaagatcggagcagtcttcctcccccttttttttattgcttaattacttccttagaattccaatcaaaaaaaataattttgcagtaatgtacagatgaatgagaggatgagagaagaaaactaaatttaaaaatgcccgaaaagatgaaaaaattgagaaaaatctcattctcttgtctaatgtcgcatgatgatctcgc

SEQ ID NO: 7607 - DNA, 732 bp, Lycopersicon esculentum
  Predicted polypeptide sequence is orthologous to G227, G242
gcttcatcttcttcttctgaatcatcttcatcagaatcttcgctttcgggtaaaaacccgaataaatctgaaaggataaaagggccatggagtgctgaagaagataagattttaacgaaacttgttgagcgttacggagctcggaattggtctttgattagtaaatatataaaaggtaggtccggaaaatcctgcaggctccgttggtgtaatcagttaagccctaatgttgaacaccggcccttttctccggcggaggatgaagctattttagctgctcatgctaaatatggaaaccgatgggccaccattgcccgattacttccgggtcggactgataatgcggttaaaaatcactggaattcgacattaaagaggcgtcatcagcaattaattcagcagcaaaatcaaaaccccgttgggttttctgacgtgaaaattaatgggtcaggatccggatccggatctggattcgggtcgtgtatggagtatttgaatgtggatgagagtccaaaagtgaataacaataacaataattacgctgttacgaataattgtagcggtgaatttgatgatccgatgacgactttgtcactagcgccgccgggaatgagcggagatgagttgccggagaagaaacggagagttttccggcgggattttgggatgtgatgagaggtgttattgctagagaagtgagagaatatgttgcttctacggggtttcctaatt

SEQ ID NO: 7608 - DNA, 1540 bp, Lycopersicon esculentum
  Predicted polypeptide sequence is orthologous to G229
gtgcttctccattttgtgataataataataatgggaagaacaccttgttgtgaaaaagtgggcatcaagagaggcagatggactgcagaagaagatcaaattctcactaattatattatttctaatggagaaggctcttggaggtcgttacctaaaaatgccggattattgagatgcggaaagagttgtagactacgatggattaattatttgaggtctgatctcaagagagggaacattacttctcaagaggaagatataattataaagttacatgcaactttgggtaacagatggtctcttatagcagaacatttatcaggtagaacagacaatgagataaaaaactattggaactctcatctaagtcgaaaagttgatagcttaaggataccaagcgatgagaagttacctaaagccgtagttgatttggctaaaaaaggtataccgaagccaattaaaaaatcatcgattagtcgaccaaaaaataaaaagtcaaacttattagaaaaagaagcattgtgttgtacaaatatgccagcttgtgatagtgccatggaattaatgcaagaagatctagcaaagatagaggtgccaaattcttgggcaggacctatagaggccaagggaagccttagttcaggtacaaatttcgatgttttgactattttttattgtgaaatttgattttaaaaaatattttttgatattaaagtgaaaaataatattcaaaatttatttaagttgtgtttggttatgaatatgaattagagttgtttttttcattttttcctcaattatttcgagtaaaccttttttttttctttaaagaattgaaattttattgtcaaatatgattctctgagttttaactatcgaaaaaagcgaaaaagatcaaacaccctctaatagtttttattaatcaattaaatacattttcaatagtgactatgacgacataatatttatatattgaaatatatgattattttatcaaaaaacttaaaatttaattttcacgtctttcttttcttttgaaacgtcattttttatatgtaccttttagatccaatatctatctatggatagacgttgcgaagtactttttgttattttcaattattaggcacaaataattgaatctagcacctcttgtatgtacaaaattttaaactgtagcaataaataaatatattttttaatttttttaaatttttatttttttttgtctgagcagatagtgatatcgaatggccaagactcgaggagattatgccagacgtggtgattgatgatgaagataagaacacaaatttcatattgaattgtttcagagaagaagtaacgagcaataatgtagggaatagttattcatgtatcgaggaaggtaataaaaagatatcaagcgacgatgaaaaaatcaaattattaatggattggcaagataatgatgagttagtatggccaacgttaccatgggaattagaaacggatatagttcccagttggccacaatgggacgatactgacactaacttac

SEQ ID NO: 7609 - DNA, 431 bp, Lycopersicon esculentum
  Predicted polypeptide sequence is orthologous to G229
ccggattattgagatgcggaaagagttgtggactacgatggattaatcatttgaggtctgatctcaacagagggaacattacttctcaagaggacgatctatttataaagttacatgcaactttgggtaacaggtaattagtcaattacttgattggactttttagcttgctgattaaaccactcattttgtttctttttagtctaggtccagaaaaaaatgtctgctttacaatcgagtgctttcttcgtttaaaaaataataattttatttttatttagtctgttttataaagaatgactttttttttagtaatatgttaaatttaattcttcacatgacatctttaaaattataaaattagagatagtttgatacatttgacataactttaatgtagaatcacttctttcttttcttaaaatcccgtt

SEQ ID NO: 7610 - DNA, 421 bp, Lycopersicon esculentum
  Predicted polypeptide sequence is orthologous to G2343
tatcttcatcgggattattggccgtcttgaaggtggttttatagaaggcattaacccgcctggcggtaagagtcggaaacccaccacgtccacggccagctataatcagcaatatgttcaaagagttcggcaacaaaggccttccggctgttctttttgcaaccgaagctaaagccggccagcgttttttcattctcgctattaacctgcttgtaagacgcctgccatgattgctgaccaatatcgtcaatgacctcaaccgacccattttcccgccacccattttcagtgtctgcgtggtcttttctttatcatctttaaagataccgaaagccccaccaaccggcatcggcatgatccggcgtcagtttgggttatcgcaacccctttctacccccagatcgccaaaatcctgaccatc

SEQ ID NO: 7611 - DNA, 1174 bp, Lycopersicon esculentum
  Predicted polypeptide sequence is orthologous to G2344, G929
gaaaataaaggatgacaaaacgtaatagtaacagttacaaacacgtagtaaagctctctctagagaaggaaattcaacagagaacaccaaaattaaagctgcttattggttttcgtatacacgaagctcttcccgaaaggtttgttactttggagattctgtggcaagcagcattatgacgtcctcgcttcattatcattcagatggtagtgagaatgaacagtcagaaaatcaatcagaagcccacagcgagtcttcatcgcctgcagctggaatgtctgtccctggcactgtaacaacaaatatgcactatgttatgcccaatcaacttgggaatggaaatcctatgttgcaggctcaaacagcttatccatatccagacccatactataggagcatctttgcaccgtatgatgcacagccttatcctccacaaccttatccagcacaaccaatggttcacgttcagctaatgggaattcaacaagcgggtgttcctttgccatcagatgcgatagacgaacctgtttttgttaatgcaaaacagtatcatggcatcttgaggcgtcgacaatctcgcgcgaaagctgagtcagaaaagaaacttctgaaagctaggaagccttacttgcatgaatcacgccatttgcatgcattgaaaagagctagaggatgtggaggtcgtttcctgacagcaaaggaaactgataatcagcagaaacaggatgaatctggtgataaatctcaagtcaacattaatctcgagtctggaaaagacaaggtcgcttcttcagagaatgcctcttgatctatgcaatatcaaggactttgtggaccatagtatgttgttactgtttgtagaaacagcagtgcttttgtttaaatagaattgtggtagctgggcaaaatcagggtaattgtggtgttctgtatgtttatctgagtgtagatagatcggaataggcctactcgtttgagagctacaaagtggccgctgggcgtatgttctctaaataccatctctctgagcttgtttgtagacattctttcttgtcctttcgtaattgccttgtgattccttcaaaatgttgttctggtaagtgtatggaatatcgagtcagaaatttgagtaataacgtttggcccttaaaaaaaaaaaaaaaaaaaaaaacaa

SEQ ID NO: 7612 - DNA, 761 bp, Lycopersicon esculentum
  Predicted polypeptide sequence is orthologous to G2344, G929
gcctgccagtagtcatatgcttgtctcaaagattaagccatgcatgtgtaagtatgaacaaattcagactgtgaaactgcgaatggctcattaaatcagttatagtttgtttgatggtatctactactcggataaccgtagtaattctagagctaatacgtgcaacaaaccccgacttctggaagggatgcatttattagataaaaggtcgacgcgggctctgcccgttgctgcgatgattcatgataactcgacggatcgcacggccatcgtgccggcgacgcatcattcaaatttctgccctatcaactttcgatggtaggatagtggcctaccatggtggtgacgggtgacggagaattagggttcgattccggagagggagcctgagaaacggctaccattgaatttggcttctgatgaaggtccgatattcgtaaatgccaagcagtatcatgggatactaaggcgtcgaaagaccagggctaaggaaatggagaaaaaagctcttaaaccacgcaagccgtacttgcacctctctcgccatctccatgctttgcgccgacctaggggctgtggtgggtcgtttcttgaacacaaggaatatgaatggaactatgaaggctggaaaaaccaccatatgttcaagacgggcgatgttcaaaacttttaccccaccggatcccagaattctgaagtgctgcagtctgatagcagcaatttgagctcaccaaaagaaacatctggcagtaggttcttcg

SEQ ID NO: 7613 - DNA, 1035 bp, Lycopersicon esculentum
  Predicted polypeptide sequence is orthologous to G2394
tctgaatttactgggtgattgtgaagaggagaagaatttttcatctggtgaactcatacttcactgcttaagacttttgcatcccatgtttcctataattatctctcagtcagtggacttagatggccatttcctcattggggctacaccggaaaagccaaactaaccagtttcaattattaatggagcaagcagataaccgtagcaacgatgagcatgtaattgacataactagtagcaatgatgcatcctcatcaagcaacccccatgatagaccagttaataatgtgcttcatgtccaagctgaacatcccccatcaacaagcacaacagtgcccgtctcccaacatgcattttcttctgctagtagatccaacttgaggaactcatcatttgctcgaagaggaagtgggcgccgccatcggagtcctctgaattctgtgctctggatatccattgaactagtcttgacattgagccaaataattgcagcaatcgcggtgttggccatatcaagggatgagcacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggttgtgtatagtatttctgacctttagctgtatcgggtatgccatgccatttattctatgtgcaacaatatgctgctgcctcccctgcattatttcagtcatgggcttccgagaagatctgactcaaa

SEQ ID NO: 7614 - DNA, 1052 bp, Lycopersicon esculentum
  Predicted polypeptide sequence is orthologous to G2394
cacccacgagctcctctagcccaatggatagttggttatgcatctgggtgtgtagcaattctccctcttctctactggcgttttcgtcatagaaaccaaaattcagatcaggattcatctcagcagccacagatttcttcccaggttgaactctcagccagaccatcctcaagtacaaggagttcagaaggtgaaggtcgtcagacaactgctacagcttctacaggtggtcaaagtaatgaaatactgagcacaaggataaaatcatttgttgagtacttcaaaatggcattagattgtttttttgcagtgtggtttgtggttggaaatgtgtggatatttggcggacactcctcttcctctgaggctcccaacttgtacaggtgatctttcactgttgttttcattttggggtgtttccttactttctatcatctctaccagcatcatatttgctcatgtttctattcatccgtaggttgtgtatagtatttctgacctttagctgtatcgggtatgccatgccatttattctatgtgcaacaatatgctgctgcctcccctgcattatttcagtcatgggcttccgagaagatctgactcaaaacaaaggcgccacaccagaatcaattaatgctcttccgacctataaatttaaggtaaagaaaaacaaaagtggcaacaaagaggctgctgaaggtggggttgtggctgcaggaacggacaaggagcgtgtgatttcaggagaagatgcggcatgttgcatttgcttagcaaagtatgtgaacaatgatgagctaagggagttaccctgttctcatttcttccacaaggactgtgttgataagtggctgaaaatcaacaactcatgtcccctttgcaaagctgaggtgggtgagacccttttgagctctctaacggaagcaactgcaagtttgcgtcagagttccgcgttttaagttacgactctgcccacatgctagtatagagatgctttttaaaggaatagtagttaccttcatatatattttattttcttccatcactcttct

SEQ ID NO: 7615 - DNA, 919 bp, Lycopersicon esculentum
  Predicted polypeptide sequence is orthologous to G2394
ccaatctgtacagattatgtatagcttttcttaccattagttgcattggatatgctatgcctttcatcttgtgtgcgatgatatgctgctgcctgccttgtatcatttcaatcctcggtgtgcgtgagaatatgcatggagtgagaggagccacagaagagtccatcaacgctcttcccacactcaagtacagggtcaagacagatggaactggaagtaatgaaagtaaaaatctagaagaggaggaaggtggttgtgtagctgctggcacagagaaggaacgtgccatatcaggtgaagatgcggtgtgttgtatttgcttagcaaaatatgaggacaatgacgaactgagggaattgccttgctcgcatttcttccatacacagtgtgtagataaatggctgaagattaatgcgacttgccccctctgcaaatctgaaattgacgccaagaacagagatctaccttctgtagaagaggaacccctccaacaatcctaaggtgatgcagaaaccaacttcttatggttgaaacacagatcatcgcggctagcttgttgcatggggaaccaggagagtatatcccaactgttacttcttctgctgttgctgctactgctactgctgtttctaccacacgaatttcagtttgtatagttgtagctcataccaggtatccataacaagcttgaaagaagaggtaattccattgttgatacccttacatctctctcctgcctcaccagctatatgttgctcggaacttccaaaaaaaatgtcagttgcactcgtgttggatcttcaaaaaatgcatagcttttggaagatctaaaccgggcgatatttttgaagtgtccatcatctaatgcaaacatagcacactgtataaatagatttaagggtaaagctgggtgtacacc

SEQ ID NO: 7616 - DNA, 516 bp, Lycopersicon esculentum
  Predicted polypeptide sequence is orthologous to G2394
cgcataaaaaagttaaaaaaatcgaagccctaatttcagagaaatcttcatactgacgaactttatcgatcatcaaatataatcgctggtaggctttgcttgtgagtataaggtggtagctgaaccagtagcaatattttcttgagatttatggttgaatggctgttacctcggaagaacttaatcaagagaacccaaccgacagatttcctttgctcatggagcaagcagaaagtcgtgagaggaatgaacatgttattgatgtagaacaaggaagtagcccctcatcatcaggctcatctgataatgattctcctcatgaattggaaatacccaaccatgaaaatagaccatcaaatcgacattccgtctcttcttcgtccaacgaatcagattctcatagcccttctagtgctaggagagctgatggttctgatcgtcgttggagcccatttaatactctgttgtggctttccattgagctaatattcaccttaggacagattggtgctgccg

SEQ ID NO: 7617 - DNA, 873 bp, Lycopersicon esculentum
  Predicted polypeptide sequence is orthologous to G241
gttgtgagaagatggggttaaagaaagggccatggactcccgaagaagatcaaattctcatctcttacattcaatcaaatggtcatggcaattggagagccctccctaaattagccggattattgcgatgtggaaaaagttgcagacttagatggacgaattatttacgtccagatattaaaagaggaaatttcacaagagaagaagaagatagtattattcaattacatgaaatgcttggcaatagatggtctgcgatagcagctagattaccgggacgaacagataatgaaataaaaaatgtatggcacactcacttgaaaaaaaggcttaaaaattatcagcctcctcaaagctccaaaagacactcaaaaaacaaggattccaaagctccttgtacttctcaaattgccttgaaaagttcaaacaattttagcaacatcaaagaagacgggcccgggcttgggtccggcccgaactcgccacaattgtcatctagcgagatgtcgactgtcacggccgattcactagccgtgacaatggacatctcgaacagtaacgaccaaatagactcatctgaaaattttattccagagatcgatgagagtttctggacggacggtttgtccacgagtggtggtggtgaagaattacaagttcaatttccatttcatgacatgaaacaagaaaatgtagagaaggatgttggagcaaaattagaggatgatatggacttttggtacagtgttttcataaagtctggggacttattagagttaccagaattttgaggggttaatttggttgttttcaaaacttgaagtagtggaatgcaactaatttagtggtgtttttttttttgggatcttttgg

SEQ ID NO: 7618 - DNA, 774 bp, Lycopersicon esculentum
  Predicted polypeptide sequence is orthologous to G241
cttgttgtgagaaaatgggattgaagaaaggtccatggactcctcaagaagacaatattctcatatcttacattcaaaataatggacattccaattggcgtgcccttcctaaacttgctggactattgagatgcggaaagagttgcagattgcgatggactaattatttgcgtccagatataaagagaggaaatttcaccaaagaagaagaagacactataatcaagcttcatgaaaatcttggcaatagatggtccgcaatagcagcaagattaccaggacgaacagataatgaaataaaaaacatttggcacaccaacttgaagaaaaaactcaagaattatcagccttgtcaaaattccaaaagacactccaagactagtcatgtttccaacaagggtcctacaacttctgaatcctccaataactctgatcttagtacaagtactaaacaacacattaagattgcacctaactcaccacaactttcatctagtgaaatgtcaagtgtgacgttagttgttgatgataatcagatggtgattataaaggaagaaaaaatcgagtcatcatcgtcggagtattttccaaagatcgatgagagtttctgggcagatgaattatcgacggagaataatatgattattggtcatgatcaagaaatacaagtgagggaagaaaatgtagacatatttactactagttcagaaatggaggaggacatggacttttggtacaatgttttcataaagacaggggatttgccagaattac

SEQ ID NO: 7619 - DNA, 708 bp, Lycopersicon esculentum
  Predicted polypeptide sequence is orthologous to G241
gctttctttccactgaaactgaagagtgagacttctaataatttctctcacccacaaaaatttggagaaaaaaaaagaagttaaaaagttattttttttagtctgtttcaaaaaaatgattgagaaaaaaaaatgggcagagcaccttgttgtgagaaaatgagcttgaagaaagggccatgggatcacgaagaagaccaaattctcatctcttatattaacaaaaatggccatggcaattggcgcgcgctccctagacaagctggattattgagatgtggaaaaagttgcagattgaggtggatgaattatttgagtccacatattaagaggggaaatttcaccaaagaagaagaagataatatcatcaatttacatgaaattcttggcaatagatggtcagcaatagcagcaagattaccgggaagaacggataatgaaataaaaaatatttggcacacccacttgaagaaaaggctaaaaaattgtcagtctcctcgaaacttcaaaagacacaataaaattaatcaaataaataattgcatgcatgctcctaactcaccagaaatatcgtctagcgagacgtcaatcatgacaaccaattcatcatcaagtggtactttcgatacgacgatcgacgatcaaatagtgattaaacaagaagaatggactcatcggagtatttcgccaagatcgatgagagctttt

SEQ ID NO: 7620 - DNA, 539 bp, Lycopersicon esculentum
  Predicted polypeptide sequence is orthologous to G241
ggaaaattagcagcttatattactaaatatggatcatggaattggagacaactacccaagtatgctggcttagcaaggtgtggaaagagttgtagacttcgatggatgaattacttaagaccaaatgttaaaagaggaaactacacaaaagaagaagatgaaatcatcttgaacctccatgctcaacttggaaataagtggtcagcaattgcaattcacttaccaggaagatcagataacgagataaagaatcattggcacacaacactgaagaagcgcgctcattataactcaagtgaagtaagcaagaaatgcaataagaagaggagtgaaagtaatattactaaaagaaagagtaatgtggaaaatcaaaatgcaagtgctaataacattaataataatatgcatgagaatatagtattggaaagctcagaatggtcaccaaatgagtcatcaagtgaagcattatcctctattgattatcaacaagacatttttcaagaagaattggctaatttggaggaaattacaagtggaag

SEQ ID NO: 7621 - DNA, 643 bp, Lycopersicon esculentum
  Predicted polypeptide sequence is orthologous to G2457
tttttttctcttcaaataaacaaaaaaaataaaatacatcaaaaaatggcaagttgcattgatgttgcttctgatcaactttgctatatcccttgcaacttttgcaatattgttcttgcggtgagtgttccatgcagtagcctatttgatattgtgactgttcgttgtggacattgcacaaatttatggtccgttaatatggcagctgcatttcagtcctcttcttctgcttcgtggcaaaatcatcaggttccaaactacactgctcctgagtataggatggattttggttcatcaaccaaatgcaacatgaacaggatgtcaatgagaactccaatcacaaacaatgttcacgaggagaggattgtcaatcgacctcccgagaagaggcagagagtaccttctgcatataatcagttcataaaagaagaaattcagaggattaaagctaataatccagatatcagtcacagggaagcatttagtactgctgccaaaaattgggcacacttccctcatattcactttggactcatgttggagagcaacaatcaagccaaacttgcttgtgggagcagaaaactataaattactttgcaagacaaataaaagatcttcatttcatgaagctgtgtgtgaactt

SEQ ID NO: 7622 - DNA, 467 bp, Lycopersicon esculentum
  Predicted polypeptide sequence is orthologous to G2535, G961
cctcgtgccgaatcggcacgaggtgtaaatgtacaatctcaagtcccaccagggtttagatttcatccaacagaagaggagctattacaatattacttgaagaagaaagttgcaaatgagaagattgatttggatgtaatccaagaagttgatctcaataagcttgagccttgggatattcaagacaagtgtaaaattggatcaactccacaaaatgattggtatttcttcagtcacaaagacaaaaagtatccaacgggtacaaggacaaatagagcaacggctgctggattttggaaagctacggggcgtgacaaagtgatctattcaaattgtccaaggattggtatgaggaagacacttgttttttacaaaggtagagcacctcatggtcaaaaatctgattggattatgcatgagtatagatttgatgatcatattgccgaagaagaaggttgggttatttg

SEQ ID NO: 7623 - DNA, 1115 bp, Lycopersicon esculentum
  Predicted polypeptide sequence is orthologous to G255, G664
ttctcaagcatcacaacaaagccaaaaaaacttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaagctgaattcgttgaaacaagcaaagaatcagataataatgaaataattcaagaaaagtcatcatcatgtcttcctgacttaaatcttgaactcagaattagtcctccacatcatcaacaactcgatcatcatcgtcatcatcaacgatcaagctctttatgttttacatgtagtttgggaattcaaaatagtaaagattgcagttgtggaagtgaaagtaatggaaatggatggagtaataatatggtaagtatgaacattatggctggttatgactttttgggcttgaagactaatggtcttttggactatagaactttggaaactaagtgattcgattcgattcgaatttatgcataaatcatcttaatttgatgtatatgtagaaaagaaaaagagtttgaggatattatttcttctagctaataattttctcatggttgtaaactttgcaatatagtaattacatttaattcaaagcagtaaaaaaaaaaaaaaaaaaaaa

SEQ ID NO: 7624 - DNA, 831 bp, Lycopersicon esculentum
  Predicted polypeptide sequence is orthologous to G255, G664
ttctcttttagtaccaaaaactcaaatccttgaatactcaaaggacaaaaataaaaaaaattcaaagtatgggacgttcaccttgttgtgaaaaagcacatacaaataaaggagcatggactaaagaagaagaccaacgcctcatcaattatatacgtgctcatggggaaggttgctggcgttctcttcctaaagctgcaggattgtcaagatgtggaaagagttgcagattgagatggataaattatttaaggcctgatctcaaaagagggaattttacagaagaagaagatgaattgataatcaaacttcatagtttgcttggaaacaaatggtcagttatagccggaagattacctggaagaacggataacgaaatcaagaactattggaatacacatattaaacgaaaactcattagtcgtggcattgatcctcaaactcaccgtccactcaacaacaacgccactaactcccacaccaccaccaatatcaccaccgcagtcacaaccaaaaacatcaacttggatttcacaaacgttgaccaaaaacaacccaatattatgattgccacgtcatcgtcatatgatgaaacaaaatgcaacagtggtacaactgaggaaacaaagccactagaaattattattccaaaaataccctcacaagttatgattaatcttgaactttcaattgggttgccgttacatactgatcatatttcttcaccagagtcaacggcctcatacaacttcttgaccaccgtagcaccgccgccaactgcggcggtaccggcggcggagatgatggcgaagactgtttgtttgtgttggc

SEQ ID NO: 7625 - DNA, 692 bp, Lycopersicon esculentum
  Predicted polypeptide sequence is orthologous to G255, G664
gagatcttccatttcttttgtctttttttttttttacacaaaaaaaaattgtctaaaaattaaattataaatttgtgaaggaattaggaatgggaagaaaaccttgttgttctaaagaaggtttaaagaaaggttcatggactaaaaaagaagatttgcttcttactgaatatattaaggaatatggtgaaggtactggatggagatctcttcctaaaaaagcagggctactaagatgtggcaagagttgtagattaagatgggtgaattatcttaagcctggactcaatagagggacctttacacccgaagaggacgaccttattgttcgactttatactcttttgggtagtcgttggtctctcattgccggaagaatacctggtagaacagacaatgacatcaagaattattggaacacgagtctcctcaagaaactcaaagctcaaggaaatgagcctcgagaacacaaatctcaagccaaaaaaaaggagaaggaaagaggaaaaagcaaatgtctcttcccaaattaatcgaaaaaataacaacgaaaataagaagaagatgaagaaggagaagattgtcgaaaaacataacattgaagatgaagaggcaacaaagatagaggagcaaccacatgcacaggatttcgcacaaccagtatcagatagtaatcacaatttcactagttc

SEQ ID NO: 7626 - DNA, 584 bp, Lycopersicon esculentum
  Predicted polypeptide sequence is orthologous to G2552
gaatggaaaataataatgttaatgatattgggcttattaatttcttggatgaggataattttgaacaattcattgagcttattaggggtgaaactgctgatcctattgtaaatttttgcccaaactatgattgtgaacatatgacaggttgtttttccgcagccaatgcccaatttgagccaatattatcgtcgatggatttctatgatacaacattgccagatcctatttcgctatataactgcgaaatcaagctggataataatgatgatgaagacgatgatgaatcttctggcacaacggctaccaccaaaatgactccaacaagcaaaggcacgaggactgaccggtccagaactttgatttcggagcgcaaaaggagaggaagaatgaaggaaaagctttacgctttgcgatccttagttcctaatatcacaaagatggataaagcctccatcattggagatgcaatattatacgtacaaggactacaaaccaaagcaaagaaacttaaagttgaaatagcagagtttgagtcatcaagtggaatatttcaaaatgcaaagaaaatgaatttcacaacc

SEQ ID NO: 7627 - DNA, 636 bp, Lycopersicon esculentum
  misc_feature (298)..(298): n is a, c, g, or t
  Predicted polypeptide sequence is orthologous to G2552
caggtttgtttcgttttaaaagatttcgacttttaggagtcgccacttaatttttaagaaaattaagaaaacttgtttccaaataatttaaacaggaaaatcgtttgaaaacatttttaagggttcgggattcttattaacatcttaggaaggttttgacggcacctaagacattccgcttaatacggctttgcggcaactaaccatttgacttctattcattttaaaattttcgaatccgttgaaattaaactacctaaatttcaatctaggcccacaatttgacttctattcattntaaaaatttgcaaatctgttgaaattaaacttcctagatttcaatctaggcccacttacgaattcgaaacattttcgttttaatatttaatttagttttggttttataaaatagaatgacgtataaccaggggattggtgtttttctaaccctaaaactaacgacattcaacgaaagtgtataaacaagtaaaagagagagagagagagagagagacagaaacccatattctcatcattatctccattgatacctaaagacgagtaacttgatgattgaagattagtaggtacacttcatacattagtccacgaaattgaactcatttgaaatcaacc

SEQ ID NO: 7628 - DNA, 1056 bp, Lycopersicon esculentum
  Predicted polypeptide sequence is orthologous to G2574
tagaactcaaagaaaatagagaagaaagaaaaagataaaagcttgtgtatgcatatggagactgttttcagaaaatcaactcatggaggtgtagtcaaacaggacataaagattaaagctagtgaagaaggttttgttgaagatataaatgatcttaaggttgaaaaggagagaaaatcaatacataacgaggacgataattcgaagtcctctcagcaaaaggatctcactggggacaaaaaggacgatcagctggaatcagccaaagccgatatggaagaagtaatggaagaaaatcaaaggctaaagaaacacttagataaaatcatgaaggattatcggaatcttcaaatgcaattccatgaagttgcacaaagagatgctgaaaaaactaatactgatgttaaacatgacgaagctgaacttgtttcccttagcctaggaaggacttcaagtgacacaaaaaaggagttatccaaattaattttgagcaaaaaagagaatgatgagaaggaagaagataacctaaccctagcattagattgcaagtttcaatcatcgaccaaatcttcaccatcaaatctcagtccagagaatagtttaggagaagtgaaggacgacgaaaaaggaactgatcaaacatggccacctcacaaagttctcaagacgatgaggaatgaagaagatgatgtgacacaacaaaaccctactaaaagagcaaaggtttccgtcagagttagatgtgacaccccaacgatgaacgatggatgtcaatggagaaaatatggacaaaaaattgcaaaagggaacccatgtcctagagcttactaccgttgcacggtagcaccaaattgccccgtaagaaaacaggtacaaagatgcattcaagacatgtctatattgatcacaacatacgaaggaacacataaccatccacttcctcattcagccacatcaatggctttcaccacttcagcagccgcttccatgctattatccggttcatccagctccggatcgggacccacaagtagtacagcctctgccacaacctct

SEQ ID NO: 7629 - DNA, 794 bp, Lycopersicon esculentum
  Predicted polypeptide sequence is orthologous to G2574
aagccttgatttaggattggattgcaagttcgaaacaacgccaactgaatgttcaccagtgaattatagtccggagaatagcttagatgatattcaagctaataaggatgaaaatgaagagacgtcgaataaaaatctcaagacgatgagaaataatggagatggagatgatgtttcgcaacaaaaccctactaaaagagctagggtttctgttagagtcagatgtgatgcccctacgatgaatgatggatgccaatggagaaaatatggtcaaaaaatagcaaaaggaaatccatgccctagagcttactatcgttgcaccgtagcaccaaattgcccagttagaaagcaggttcaaagatgtgccgaagacatgtcaatattgatcaccacatatgaaggaacacacaaccatacccttcctctttcagccaccgcaatggcttctaccacctcagcggccgctagcatgctgttatccggttcatctaattcatcagacccaaacccacaagtaactgccaccaccaccactacccctactaccactacttctgccaatatcaacggactcaacttctatctctctgatacctcaaaacatcataaatcgccatattactttcctaattcatccatctcagcatccgcacctaattccctccctacaattacactcgatttgacttccacctcgtcctcgtccccgtcctccttatctcatctaaacagaatgactcagaattttcctcctagatataattacaataacaataattccaccacaaacctca

SEQ ID NO: 7630 - DNA, 513 bp, Lycopersicon esculentum
  Predicted polypeptide sequence is orthologous to G2574
ctatacatggagaacaagaacaaagctgaatattatagtcctgatgatgaagatcgcgatatcgataatcaagaaaatattatccatcaaggaggtgctgttaatgttatggtaaagagagaaagatccccaccggaacacaactcaatggcttcttcatctactcacaaagaacaggacgatcagctagcatcagccaaagatgaaatgcgagaagtaatggaagaaaatcagaggcttcgaatgcacttagatcgaatgatgaaggaatatcgaaatctccagaaccaatttcacgatatcgttcaaaaagaaactgatcaaaaatcaagcagtactactgtcaacactagtacaacacatcatgatcatgaatctgatcaagaagctgatcaacttgtgtccctcagcttaagaagaactactagcgatatgaagaaagatgatttatctaaaatcttaaagaaagataaagttcatgacgatgaaggagttagtaataataataaaagc

SEQ ID NO: 7631 - DNA, 532 bp, Lycopersicon esculentum
  Predicted polypeptide sequence is orthologous to G2574
gagagttcgattttccacattgtaatccccttttccacaccccaaaattgtatatgaccttagatagaaggatatgaaggttgcggataaagaatatagggttagtaggtagttgagatttgtgttattattagcctattcacgtctttggttgggtggaaatgtagagctccgtgttggtcgtagtattagtatattcatgtagtctatttttttgtggaactaaaatatgtagattattgcgtgtaggtaatctcaccttgttgttgttgttatggtcgcactactttgctattagctatcattcttttattttaattacggcattgacttgcttggtggatctttcgaaaaacaacctctgtaactcggagaggtagtgataaggtctgtgtacactgtaccctccccacaccccactttgtggaatttcactgggtttgttgttgttgggagaggttgaattaagaagtccttatttggcatcgttagttttatagtatcactttgtggttatgaatctacttatgct

SEQ ID NO: 7632 - DNA, 538 bp, Lycopersicon esculentum
  Predicted polypeptide sequence is orthologous to G2574
caatggattctactaagaaggatgaagataagcctaaattcaaccaaaatgtgagatatatgaagcccaaagaagaaaatgaaaggctaaaaaggatgttatctaaaatgatgaatgattataaatctttggaaatgtattttcaaggcatattaactcaaaaaaataccaaagaatattattgcaaccaagtaataatattcatgaagaaaaagaacaagtggaacttgtttctttgagccttagggagaaatagtagtccttcaagagagttgatcaagaaggagttattatatgatgatcaaaataaaagtaataaaaaccatagtaaattattatttgatgggccttgaccttggattaggttgtaaattcactcaagaaaatagtttcgaggggccaaagaaggagaatataaataatgaacgacgagtattgataccaaaattaccttccatcggattactgtggcgaagaatttttgcagcaaattcctcaaaagaaggctagagtatctatccgggctgtgtgtgacact

SEQ ID NO: 7633 - DNA, 522 bp, Lycopersicon esculentum
  Predicted polypeptide sequence is orthologous to G2574
aacacataatcatccacttccagtaggtgcaacagcaatggcatcaacagcatgagcagcagcttcattcatgttagtggattcaagtattagtcctcttcttaatcacaattccaatttaaaccaaccacttaatttccctaattaccaccataatctagcacctaattaccatcactcttcttcttcttcaccttataataatttctccaatttaagaaccaatattcttaattctagtgatcctaataattcttcacaagggaacttagttcttgatctcaccaaaaatatgtcaaataataatcatcaattcccctttgcaagttcttcttcaaataatcatgaaattggacattctaattggatgtctaaattatctaattatgaagggaataaccttttttctggtcctaaattacaaggtgaacataataataataataataataataataatattcctcctatgttggctcatgaaaatatgagtgcaattgcttctgatcctaaatttagggt

SEQ ID NO: 7634 - DNA, 1125 bp, Lycopersicon esculentum
  Predicted polypeptide sequence is orthologous to G2575
attcatttctattttccctaaacaagttactttctctttttccactctaaactatagtaatacatacacacttcccaactcccaagaaaagaaaaaaaaaagaaaattcaagaatcaatagctcttgttaatattgcataaattcaagaatcttgagttattttctcttcatcattttgttcaagactcttttttgtgttttagatcccaacaacaaaaaagaaaaccccctttttttgcttctctatgtctgataataacccttttaatcatgattatgcatttcctttctttggtgaaaatccctcaatttatggtaatcaagccaataacacacaaaaccctcatcataatcatcatgattttgactattcttcatcttatatgagtaatctcacagagtgtttacatggagggtcaatggatcattacaacactttgtcaagtgcttttgggatgaataattgttcatcatcctctgaagttgtttgtccacaaccatcaatagatcatcatcaagaatgttctagaaagaatattaatagtgttgataatcaaattccattaacacctaattcattaatctcttcatcttctaatagtgaggttggtggatgtcatgaagaagattcttcaaaaatcaagaaagatgatgatcagtgtgaattagatggagatgatgatgatgatgataataagtctaagaaagtggggaaattggcaaagaagaaaggagaaaagaaacaaaaggaaccaagatttgcatttatgaccaagagtgagattgataatcttgaagatggctatagatggagaaaatatggtcagaaggcagtgaagaacagtccttttccaaggagttattataggtgcacaagtcaaaagtgtagtgtgaagaaacgtgttgaaagatcatatgaagacccatcaattgtgatcactacatatgaaggccaacataaccatcattgtccagctactcttagaggaaatgctgctgctgctttattatctccatcctttttatcctccacacaacaacaattatatcataatccaaatgaacaacaaattttctataatccaaatattcctataaataattccttctataataataattat

SEQ ID NO: 7635 - DNA, 722 bp, Lycopersicon esculentum
  Predicted polypeptide sequence is orthologous to G2575
ttttttttttttttttttaagagaaattagatatagtatatatatgatggtgaagtactaaaatatatatatattacatgagataattaaggaagagtccatctataatatctctaaattattactaccaaaaaagaaagaaagagaattaagtagctataaagtttcaagtagggttaattagtgctcaaagcctcatggttcttgtttaagattaaacatagaaggaaccatgtcttgtagaagtccataatcatgatgaggatgaggtagctgcatctgttgatgatgatttagattttgatgatacatagaggaatttgcaaaaacattggcatgtccataaaattgaggcatttgtgacatgatgaactcttgatgaaaacttgcttgtggtgccattaatggtgatggttgtgctaacatggaaggattcaacatccttgcgacgctaccgcggagagtagctggtagatgatggttgtgttgaccttcatatgttgtgataacaatggatggatcttggtatgacctctctacacgcttcttcacttgacatttttgacttgtgcacctataatagcttcttggataagggctatttttaacagccttttgtccatatttcctccatctatatccatcttcaagatgatcaacttcactctttgtcatgaatgcaaattttggtggcctttgcttcttttctcctttcttttttc

SEQ ID NO: 7636 - DNA, 600 bp, Lycopersicon esculentum
  Predicted polypeptide sequence is orthologous to G258
gaaaacagagaagattgagaatgggtcatcactgctgcagtaaacagaaagtaaaaagaggtctttggtctccagaagaagatgaaaaactcattaaacacatcaagacccatggccattcctgctggagttctgttccaaaactagctggactacaaaggtgtggaaaaagctgcaggcttaggtggataaactacttaaggccagatctaaaaaggggctgttttagtgaacaagaagagaggattataattgacgtacacagaattttggggaacagatgggcacaaatagcgaaacatttacctggtagaactgataatgaagtaaagaatttttggaattcttgcataaaaaagaaacttatttctcaaggctttgatccaaacacccacaatcttctttctactaagaaaaaagccaacaaaaacaattataccaaatcatcaattttcactattgaaactagtttatcgtcatcatcaactaaagagttggtttcaatggacatgatcaaagcaagtcttgcagcattgtcaacttttcctaattacgctaataatatgagtatgcctcagtaccaaacaagtttgagtcggc

SEQ ID NO: 7637 - DNA, 630 bp, Lycopersicon esculentum
  Predicted polypeptide sequence is orthologous to G258
ggtccataaggaaattttacagcagcttaagagagaaaatatataagcacacccatatatatatatatatatatatatatccatcaaagtcgtgttcgaagtagagatattgcccgattcttggttgtcgttcgaattcaagtcatgtggtaaagacacatcccctgctcgcatcgtctctagctcgctgccccggagaaggtgaacttccttaatctcaactcactcgttattttattttgttatgtttctgcgagcatgaagttctccgttggtttttcctcctcttgctcgtttgttttccattctctgtgagttatctttgatagtgatgagagtttcatttggtttcgaatagcttgtttcgtgtttaagttctatatatgttgttgatgtgggctgctcgtcttcaaacacccatgaagattgaggatagaatgataggtctgtcggtcttgttcataggatttggataaggtatgttattgttggattgatttttgaaatcttttgagcttgttttcgttcattcacagtgatggactcgaatatatggtccaagaatgcatatgagggttgtgtatcttcttcggaatgttgtcatgagtggtcgttttcgtttcgcattca

SEQ ID NO: 7638 - DNA, 692 bp, Lycopersicon esculentum
  Predicted polypeptide sequence is orthologous to G259
ttcaaacatagcaacttttcaagctttgttcgacaacttaatacctatggttttcgtaaaattacaacaagtcaatgggagttcagtaatgataagtttaaaaagggcgaaaagaatttactccgtgaaattcgccgaagaaaagcatggacaaataggcaacaaccaaacaacaagaaagacaatattatagaagaagatcaaagatcatcatcatcaacttcatcatcatctgagtatataaatcttgtcgacgaaaataaaaggttgaaaatggaaaatggagtccttagctctgagcttttactcatgaaaaacaagtgcaaagaattaatgaatattgttacaatatttgctaaaaatccagagaaagaagaagatgaaaaaaaaccaatgttatttggagtaagattagaagttaaagaagaaatggagaagaagagaaaaagagttgaacttaatgaaatggctagtgtttttctctctcaattatgcaaataaagtagaaatttagagagaaaaaatctatatgtaatagttgtactatgctattttgtattatttcatccaaaaattaatggtcttaattagcatgtagtgactactaattaagtggagatatatacctaaagtgtattaattatgcaagttttattttcacgtgaaatggtaaataatcattttgcttttct

SEQ ID NO: 7639 - DNA, 808 bp, Lycopersicon esculentum
  Predicted polypeptide sequence is orthologous to G2604
gtaaaggtctgtgtctgcctcactcctaatgcttgactaagctcctcttatgtttcaaatgctcagaggatgaaccagtaacaatcatgagacagtaaagatggaagcagctgctctgttagaagtttttgaagcactaggcttttgagatctcaggagaggactacctctgttagcttcacaatgccagttccgcttgctccatatcctacaccaccaacaccatttacaccaccttctaacggtacgcagagccagcttgtgtgctctggatgcagaaatcttttactctatccagttggagcaacatctgtttgctgtgcagtttgcaatgcagtaacagcagtaccacctccgggcactgagatggctcagttggtttgcggaggctgccacacattacttatgtacattcgtggagcaacaagcgtgcaatgttcgtgctgtcacacagtcaatttagctatggaagcaaatcaggtagcacatgtgaattgtggcaactgccacatgctgctgatgtaccaatacggggcacgatcagtgaaatgtgcagtttgcaattttgtgacatcggtaggggttgcaacgagcacagctgagcaaaagtttaacagctaactttaaagctgctgagccagtgctagaaacttctacaactaaagttgtcgtgttatgtgtcagcggcatttcagctgcatcaactggaggaaatttctagttgctactagtatagagctattacagagctttttttccctcgcgtatctgtaatagaataagcagttttgcaggttgagcctacaaa

SEQ ID NO: 7640 - DNA, 507 bp, Lycopersicon esculentum
  Predicted polypeptide sequence is orthologous to G2604
caaatgctcagaggatgaaccagtaacaatcatgtatgaaattgaagtagcaaatgctaaatatgctactagatgaatatgcaaagttcttcgttatagctttcaccatttattcccctttttcctaatcctattttatactttgtactcaaatccatctttcatcacagaaattccaggtccttcagttgctaactcaatcatgtataaatttccgtgtttttttcaggagacagtaaagatggaagcagctgctctgttagaagtttttgaagcactaggcttttgagatctcaggagaggactacctctgttagcttcacaatgccagttccgcttgctccatatcctacaccaccaacaccatttacaccaccttctaacggtacgcagagccagcttgtgtgctctggatgcagaaatcttttactctatccagttggagcaacatctgtttgctgtgcagtttgcaatgcagtaacagcagtaccacctccgggcactgag

SEQ ID NO: 7641 - DNA, 1259 bp, Lycopersicon esculentum
  misc_feature (1214)..(1214): n is a, c, g, or t
  Predicted polypeptide sequence is orthologous to G261
gtgcatagtcatggataactgtaatggaggatcaagttcttcttctccggcgccttttttggtgaaaacttatgaactggttgatgattcgcatactaatccagttgtttcatggagccataacggacgtagcttcgttgtttggaatccacctgaattcgctagagatttgcttccgaaatactttaagcataacaatttctcaagttttatcagacaacttaatacttatgggtttagaaagggtgatcctgaacaatgggagtttgcgaacgaggattttttaagaggacgtagacatttgttgaagaatatttatagacgaaagccgatccatagccactctgctgcagcaggaacagggcaatctgtagctccattgacggattctgagagacaggagtatgaagatgaaatcgagaggttgaagagagaaaacagtcttcttcagtcgtctgcggagaatcaattgaaattcaatggggagtacgaaagtggaattaagtctatggagcaacgtttacagaacgttgctcatagacaggggaaattgatttctcttttagctcaattactacaaacacctggattttcatctgatttcactcaaagcgcgagcaggaagagacgattgttgatatcaaattacttgattgacgaggaaaactcaccaaaattcgacttggaaatggttaaaaagttggattcatcaatcaatttttgggagcggtttctgtatggtgttcaaacacaagatttcgagcatacacattccccaattgttacacatacatcatctaatgattctgccaaacgaaactctcccatcgatcattcaccatcctcctccgagttagggccattgaatcctgtcatgtcatcaacttatgaaaatttagaacgtcaacttaagccatctgataatcagattgagtgtaagaccagtaaaacatctgaattagtatcaaactcgggtaatgatgtattttggcaacagttcttaacagagacgcctggttgcactgagccacaacaagttgagaacaaagggataaacgaatcaacgcgtgatattagattaggggatagccatagatattggtggaatcgcggagttaatttagaaaatcttgctgaaagaatgggacatcttagtagtccagcaacaggaagctgagttgattcagtatttgacattttatagctattggtgnttttttttttttttcttctagttttgatgatcagatatgtcacat

SEQ ID NO: 7642 - DNA, 666 bp, Lycopersicon esculentum
  Predicted polypeptide sequence is orthologous to G261
tcaaagtaaacttcatctttctatgtgcttcttcttgttaaggactattcttgattttttcttacaggaaagttcggaaatttctgagttttagagggtgaaacggctatcttttgaattcaagctagcatttgtttgagcacttgtgggaactcatgatgggccgcaatctcttttaacaattctttagcaaatttgtgtgttttgaaagctatccagagctgggacttgaatggaaatgtgtatttgctaagaatttgtatgatcaggtgggagctgcttcaattgaatttatcgaaggaaatcaaggtgataacacttttggttggttgtatctgtatgttgggaatctgataagttgatcttccctgtcagtaaggatttgtcacttgtagttgagcttcgccttgtgagtttcatttcaaggggttgtgatttggatttgaatttaccatggatgaagctccttgcagcgtcaatgcactgcctccgtttattgcaaagatatatgaaatggtggatgatccctccactgatccaatagtctcatggagtttaaacaataaaagttttattgttcgtaatcctcctgattttgcaagagatttgttgcccagatactttaagcacaataatttttccagctttatccgacagctgaatact

SEQ ID NO: 7643 - DNA, 1016 bp, Lycopersicon esculentum
  Predicted polypeptide sequence is orthologous to G2632
gcttccccactcccaccactttttctctatgatacacacaaataaataaataaattaggcctagatatctacttctatatatatatatatgttgatacagatgtatgtataatcttgagaatctttagtgaaaagaacttcctttttagcttaagcatatgtatgtaatagacacaagctaaacttgtgagtttttcttgaaaggggtttttctttaactgctgtcatccccagaaaaagaaagatcataattacttggggcaagtctaataatgcctactattgctaaacatgatggtcggcagctggagactgggctgcgaattacctcactatcaactacccaaatgcaaccatggtggcacggttatggtgataatactatgcctttggctagtgagaatgccgttgcccaggagaaatctgaaggtggcaaccaggataaagaaacaaaggctctagccatggaatctggatcagatggaaataacgagcaatacaagcagcacctcaagcattttgcacccacaactgctgccatcatggctgagcagcagaaggaactcacaggtcattcagctatgttggcgtcatatccatatccagatatgcagtatgggggaatgatgacttatggcgcacctgtacatccccacttatttgaaattcatcatgcccgaatgcctttgcctctcgacatggaagaggaacctgtctacgtgaatgcaaaacagtaccatggaatattaaggcgaagacagataagagctaaagcagagcttgagaggaaagctattaaagcgagaaagccatatctgcatgaatctcggcatcagcatgctatgagaagggcaaggggaactggaggccgctttctgaatactaaaaagctcaatgacatggactgtacaccaacggagactcaaaaatatggggcaaccattgcaactcactctggcaactcttctgggttccgggaagtctgatcaggggggaaaggaaggatctacagttca

SEQ ID NO: 7644 - DNA, 1080 bp, Lycopersicon esculentum
  Predicted polypeptide sequence is orthologous to G2632
cctttgcatgcagatgggagttatgggaaggcggatcagaattttcagccagctgctccagccatacctccaagacttgatggaagcctagcacagccccagcagcttgaacttgttggacactctattgcgtgtgctccaaacccatatgttgatccatactatggcgggatgatgacagcttttggccagcctttggttcctcctcatgtacttgatatgcactatgcaaggatgcccttgccacaagaaatggctcaagaaccagtttatgttaatgctaagcagtatcgaaggatcctgcagcgaagacagtcacgtgctaaagcagaacttgaaaagaagcaaataaagggtagaaagccatatcttcacgagtctcgacatcagcatgcactgaggagggtaagggcctcgggtggacgttttgccaaaaagacagatgcttctaagggtactggttctgtgagttcatcgggttctgaacctttgcagttcaatgctgctgatattcaaaagaggaatgaaaatggaaggttggccgagcttcagcagtcttattcaaatggtagcagttatggcaatcaaagtagctttcaagaatccaaggatgagtcccagtttgctaaaagcagggaaggaggtttttttgtcaagtaattggagatacgttcatgtgtaaactagctcttgccctgcaacgagggtagagtatgagcaagaggagtttacagggattgtttcatttcttggcttttcaagataggcggcaattcattcttggctttttactttagtgttaaagggagcaacagaggtgacgagggtatcagtgttgcagcatttgcttggagattacatcttcccttatgtacagagatggatgaacttagaactaggattagaaagtttttcagtaagtttatgtttggccagttactgtagttttagtttaggagaccatgtaaaaaggttgttagttttgcaaaaggatcttttttctttccctaattggtgcattaatttctggaaaaaaaaaacaaaaaaaaaaaaaaaaaaaaactcgagactagttctctc

SEQ ID NO: 7645 - DNA, 673 bp, Lycopersicon esculentum
  Predicted polypeptide sequence is orthologous to G2632
gcatcatccgaggatgcctttgcctcatgaaatggctcaagagcctgtttatgtcaatgccaagcagtatcatggtattttgcggcgaagagagtcacgtgcgaaagcagaacttgaaaagaagctgataaaagtgagaaaggttagtatatgcctcatccactgggctgcttgttgggtgttcttttctcctgttatctaaagaatgcatgatgcacctttttagcagcatatttttgttacatgtgcctggctgttctggagatattccgttgtcccggattggagatgtacccactctttggctgagctcacttttctttaaaaaaaattaaactgttaaagaattttatgttacttaagtaggaggaaatgaaaggtaaaatctgatattacttttatctgtgtagaacacggtcaattcacctttttaaactgatccgtcaaatacaccactcataagtataatttggtgaaaggagttccttatgccaatgtttgggctattaataaccaatatcagtttctccactgctatatttttattgtgaagtcacaggattggctgacatgattttgcacgaatgttatgctgatgatatgcaacatatgctcggtttattctgcttactcatcctcagttgttgatactttctgtcttcctcgtaataca

SEQ ID NO: 7646 - DNA, 745 bp, Lycopersicon esculentum
  misc_feature (643)..(643): n is a, c, g, or t
  Predicted polypeptide sequence is orthologous to G2639, G2640
ccaaacacaaattcccaaatttaggaacagagaaacttaacaacaaaaaatacttaagcatttaaagaagggaaaaccaaatggtaaaatcaactgaaattagtggtgtatttatcgtaaaagaagtaattataacaacgattaatagttcgagatgatgaggagggaagaagaagaagaaggaagagtatcgtcatcattaagtagcagtagatgtcaagattgtggaaatcaagccaaaaaagattgtacatatattaggtgcagaacttgctgtaagagtcgagggtttcattgtgaaacacatgttaagagtacttgggtccctgtctccacaaggcgtcccaggcaccatcttcttcatcacactactattcagcaacagcagcttcaaaatgggccaaaccctaaaagatacagatcaaatgaagtgataggtgatgatcacgaaggaggtaattttccgggggaagtgagttctccagcagtatttcgatgtattcgtgtaagttcgatagataatgtggttgatcaatatgcatatcaaacatcagtgaagatagcaggacatgtttttataggaatattatatgatcaaggaccagataacgagagtcctcgttacaacaattatatggctggnagaagttcgtcaagtggctttcagcttcatcaacctcttattttacctcctactactactacaacttctccaccaccatcaacttcgacttatcccaatcta

SEQ ID NO: 7647 - DNA, 748 bp, Lycopersicon esculentum
  Predicted polypeptide sequence is orthologous to G2639, G2640
caactctaattttgtaaagccaaaaaaaaataaaaaagttccttttttgagataaaaaaatgaagaaatccaagggattcaaacatcatatttgtgtcataagttggtgcacttttgtgctatggattgtgattaatcactaatcataatcaacaacaacaacatggctaatttcttttcattaggtggcagccaagaacaacaacatcaagaaattagcagcagccaagcaatagtacccacagatcagagtaataattggtttttgtacagaaatgatcatcatcataatcaagaaatacccaacacttacaaaggtttcgagttatggcaaagtggtaacactcctcaacaccaaccagaacaacaacaacaacagtttcgtcatccaatttatcctttgcaagatctttattccactgatgttggattaggtgtcgggccaagccgaagtggctttgatatatctgcaggtgatcatgaggcgtcgaggtcgggattcgtgatgatgaggagtggtggaggaggaataagttgccaagattgtgggaaccaagctaagaaagattgtcaacatatgaggtgtaggacttgttgtaagagtagagggtttcagtgtcaaactcatgtgaaaagtacttgggttccagcagctaaaggagagaaagggcacaacaacttactgctttgccgccaccacccacaacaccacccacaggacataattattataagcataaaaggcaaa

SEQ ID NO: 7648 - DNA, 1743 bp, Lycopersicon esculentum
  Predicted polypeptide sequence is orthologous to G264
ggaagactcaaaagggagtgcaaaactttgaagtcaagttcggacggctaaagccttttgcctttaaaagttcattcgtcgtccgtcgccggcgtatttctctcagttcaataaaatggatgtgatttcagcggcggtggcggccggcggcggtggaggtccggcgccgttcttgtcgaagacatatgagatggtggatgattcgcaaactgatgacatcgtatcatggactccgactggtcacagcttcgtcgtttggaatcctccagaattcgctcgaattcttcttcctacttatttcaaacacaacaatttctccagtttcattcgacagctcaatacttacggcttccggaagattgatccagaaagatgggaatttgccaatgaggaattcttgaaggaccagaagcatctacttaagaacatccatcgtagaaaacccattcacagtcatagtcaccctccaggttccacagttgatccagaaagagctgcatttgaggaagagattgataaacttacacgtgagaagtctggactcgaggctaatgtctcaaggttcagacagcaacaatctgctgcaaaactccagctagaagaactgactgggcgggttggcagtatagagcaaagacaagagagtttactgatatttgttgagaaggcaattcaaaatcctgactttgttgagcgtcttgctcagaaactcgagtccatggatatttctgcatttagtaagaagagacgattgcctcaaatcgatagcactcaaccagtccaagaaagtatgtcggtggacaaccatagcagttctagagttgagtttgggaacctttcccatcaagacttctcaaataagctcaggcttgaattgtcacctgctgtttcagatatcaatgtgctttcatgcagcacccaaagttcgaatgaagatggcggaagccctgcacataggagaatatctgaaggatggtccagagaagtgcaacttcggacggtaggagctatttatacccctgaagcaatagaactatcagatacagggacgtcttttatgttgaagatggattcatctctacctcatgcttcaagcaatgctgaaagctcaagactgcattccttgccacaaagcctgacatccaacgaggaagttgacggtcacatttcctgccaactgaatctttctttggcttcatgtctttcacaagtcgataaaaatcaatactcagcgaggatgcctcaaataggtcaagagataggtaaatgtttcgaatcacagtctgatgccaatgacaaaatccctcctactgatgacaaatctttgccaccttcacatgatgcaactaccaacaagcaagtgcctgcagctgctcctgttcgtgtgaacgatgtcttttgggaacagttccttacagaaagaccaggctgctcggataacgaagaggctagctctagctacaaagggaacatttacgacgagcaagacgagagaaaatcaaatcaaggagtagctagtaacacaagaaaggtggaacacctcaccctttgagtatatgaagttgtcattaactatcaatccctgttaaagtttattttttcctgttgttgttgttttggaatatattattatatggctttgtatgcatgtatacaaataatattatgataaatatacttctgagcaaataagatatgtatttggtgatgaaaaaaaaaaaaaaaaaaactcgagactagttc

SEQ ID NO: 7649 - DNA, 1096 bp, Lycopersicon esculentum
  Predicted polypeptide sequence is orthologous to G2650
gaagagatcgtcgtgtaaggctttcagttcctactgctattcaattatatgatcttcaagacagattagggcttaatcaaccaagtaaagttgttgactggttgcttgatgcagctaaaaatgaaatcgatgaattgcctcccttgcaaattcctcctggaagtttgaaccctaatctttatcctatgttaggtaatgctcctcaaattactactaataaagaaggtcgcattaattgggataataacattccattggaaccacctaataataatgctttgggctacaatcccaatttttttaaatgggatccttcaaatttatccttagctcattcagaaaattcattatctcatcaacatgatcatcatcaaaacttcaatttgatgtctagtatgccattaacttcacatcatcaacctgttgtttatccaccaggattgcctcaatttttccatcaacataataataatattaatgttggagcatcgtcgtcatcagaatttgatcccaaagaaatcaacttccaaatgttgagtaacaattccggttcagaaaatcccttgtcaactagtactaattcctttagacattctattgactccacaaaccaatctataagacctttccattttctgccttctcaaaattgtgatgacacggagccttccaattaagatcatttacttcctctctgctctttataacaacttaagtttttacacaaagtatcgtattggtcatataatttcaacatgataacagagcagatcaacatattattggttgatcggatgtttcattaagctattccactttcaagatcagagcaagttatcaactgtatgttccccggtgagtactgaataatttgatactagtatatatatatatatatatatataacaacaattgtatgttcttttggtcataattattcctatagctacaagactcgtgattggattgtttgggatgcttcaatgtactccaatttcaaaatgtattatgctatataaagttgtacgttcggttattaaaagacaatataatatatatatttttggccccaaacaaaaaaaaaaaaaaaaaaaac

SEQ ID NO: 7650 - DNA, 628 bp, Lycopersicon esculentum
  Predicted polypeptide sequence is orthologous to G2650
acagaagactttaatgccattaagagattcttgtgagctgcaaaatctgacttgagttcaatttcatccttcctcaattccttatacatagatatcttttcatcctcaacgcgtcccaagaaatagtgtatcagatcaacagcaacaacaacaacagagacatcgaggattcagtcttttatatatctattgatcaatgatgaagaaaagagtgattagtacttgatcattatgaactcaagaaagcaagaaactggttcaggggttgataccaacaacagtaaaacaacgtcaacgactactgctactactattccatcaagttcttcttcaaggcagtcatcttcatgggggaggagggtttaaaaatccaagaatagtacgcgtatcgcgtagttttggagggaaagataacacagtaaagtgtgtacagtaaaaggattaagagacaggagaataaggctttcagtaccaacagcaattcaattgtatgatcttcaagataggcttgggttaagccaccaagcaaagttgtagattggctaatagatgcaactaaagatgaattgataagcttccacctttacaaataccaccaccatcactctctcatttcttcagtacgaaa

SEQ ID NO: 7651 - DNA, 555 bp, Lycopersicon esculentum
  Predicted polypeptide sequence is orthologous to G2655
tcggcacgagatttttatctaaatactccttttcccttttagtcaatttcaaaataaaacttctcaggctatactcttagacttcatcgatcgataatggctctagaagctataacgcaacaacaacaatatctttatgctttactcggaactacaaattggagtattgattctggctctgattattacaacaataatgaatttgttccgaatcatcaaaatgtaacagcacctcaagagtacgaggactactcaaattggaatttgccagctccattattagtagattcccaaaatgaatttcatcaatggggtcaaaattgttcctctgttttagatcataattttacaattgtggatcaacaggaacagttggagtctccaatcgaaatgtctagtagtacaactagaccacgaagaagaagaacaagaacaaagaagaatgacgaagagattgagaatcaacgaattacacacattgctgttgaacgaaatcgtcgaaaacagatgaatgactacctctctgttctccgtactctcatgcctgaatcttat

SEQ ID NO: 7652 - DNA, 479 bp, Lycopersicon esculentum
  Predicted polypeptide sequence is orthologous to G268
gctccctgaaattgcatttggccatcatgtccgagttgctttagatattggctgtggtgttgcgagctttggtgcttatttactatccaggaatgtgctcaccctgtctgtggctccaaaagacgttcatgaaaaccagattcagtttgctcttgaacgtggcgtgcctgcaatggttgctgcaattgcgacacatcgtttacgtcatccaagtcaggcttttgaactaatccattgttcaagatgtaggatcaattggactcgtgatgatgggattttactactggaggttaacaggttgctccgtgctggtggatattttgtttgggctgcacaacctgtttataagcatgaagcagccctggaagaacaatgggaagagatggttaatcttactactcgtctttgctggaatcttgtgaagaaggaaggttacatagctatatggcagaagcccttaaataacagttgctatttaa

SEQ ID NO: 7653 - DNA, 295 bp, Lycopersicon esculentum
  Predicted polypeptide sequence is orthologous to G268
gtttgtgtcctgacagtatgagggagtatattccatgtttagataacgtagaagcaattagtaagctgaaatcaactgaaagaggtgagaaatttgagcgacattgtcctgaaaaagataaaggattgaattgcttggttcctccgccaagaggttatcgagctccgattacatggcctaaaagtcgcgacgaggtttggttcagcaatgttcctcatgcacgtctagctgaggataaggggggtcaaaattggatattgatagacaaggacaagttcaagtttcctggaggtgg

SEQ ID NO: 7654 - DNA, 762 bp, Lycopersicon esculentum
  Predicted polypeptide sequence is orthologous to G268
ggcccgtacaccctttgccaaaggaaaaacaggcaataagtgggtagtaaggaagggtgacaagtacatatttccaggagacatgacacaattttcccagggtgtaaatcaatacttggatcagatttctaagatggttccagaaattgcttttggccaacgaacaagagttgtcatggatattagttgtggaatagcgagttttggggcatatctgatggaccacaatgtcagtacattgtctattgcaacaaaagatgtgcataacaatcagattcaatttgcattggaacgtggagtgcctgctatgttcgcagcatttactactcaccgtcttttgtaccctagccaggcatttgacatgatacattgttccagatgtagcataaattggacccgtgatgatggcattctgcttctagaggtgaacagaatgcttagggcaggaggatattttatctgggcagcagaacccgttcacaaacatgaagagaacttgtttgcaccacttaaagaaatggaggatcttactcgacgcctatgctgggagttattgaagaaggagggtgacatttatatttggaggaagccattgaataatagttgctatctcagtcgcgctccagcagttcaaccttctctatggtcagctggtgatgatccagataatgtctggaatgtaaatttaacgaaatgtattacccaattacctgagaatggctatggagctaacgtgactgcttggcctgcacgccttcactc

SEQ ID NO: 7655 - DNA, 568 bp, Lycopersicon esculentum
  misc_feature (544)..(544): n is a, c, g, or t
  Predicted polypeptide sequence is orthologous to G268
caaatttccagatctacacaggaacacttcttgctgtcactattttttagtataactctgcaatttctggttttgcttatgatgatttgattctgttaacttcattgtcgaagaagaaggagagaacaatgaagggagatgcattgaaatctgctacagtaatcaaagttttagcctttacgttactctctatagcttttttttacttcggcaaacactggtctgatggatctcaacagcttgttttcttcaattcacgtcaagattcagcttcactcacaaacccaacaaacccctcttctcaatttgtatcaatttcccctaatttcaacaaatctttcgatttatcgtccgtaattaatgacaccaccgtttctgataagccacaggaaaaaacgccgtcggtcgaagttgttttatctcctccaccgccaccaccgtcaccgcctccggcggttcagaagatgggggtgttggatgagaatggggtgatgaatgataattttgaagtgggggaatttgatccggaagttgtggataattnggggtgttgggaatgagacggagg

SEQ ID NO: 7656 - DNA, 598 bp, Lycopersicon esculentum
  Predicted polypeptide sequence is orthologous to G2682
tcagaaacgttggttttgttatctgttcttttgtctttctcaatgttagtggacagagtagtactgaaatgagtgttttttgtcccttttgatggtagtggaaattttggtaaaggatagttatgaggaaatggagaagatggtaactaagtgattacatagcggagtggatatagcgttagactccgaatctaaaggccgtgggttcgaatcccactgtgatcactgcctacttttttttcttttataatttgtgtttggttttggagatcggtgtgagtttatatatacttggttcctgtttagggagtagattttcaaatttttgtttgaatgcgttgtttgttcatgatttttggtgaagtttcatttcgattcacaaaacttcaacttttttcttagtagaaagtgcatgtccaactacaacttcaagtttcaaaaacaatttttgcaataaactttgaaaattcattctttttttaagttttaagtaaatatatggttaaacgctaggttagttagattctttcggaattgttgaaccgttgcttttgttattgtctttctcaatgttagaggagagagtagtactgacatg

SEQ ID NO: 7657 - DNA, 994 bp, Lycopersicon esculentum
  Predicted polypeptide sequence is orthologous to G2699
catgcacgtacataaaacaaaaccttacatatttttttaattccttatatataatacttagtcatacatcactccatcatgaaaaaggaaatcctatttcagtaagacttgatctgatcaatcgtatagtttagattcaagttggtcgttgcttccattttattgtgtttatcattatacatagtagagtcaagtttcaatgaactctacaaccattcccctccaaaaccctagttttttcaacaactctcaaagttctctagcaggagcactacaaggatgcattgggagccttgatggagcatgtttggagaaactattacttcattgtgcaagtgccttagagaacaatgatgtaactttggctcaacaagtcatgtgggtgctcaacaatttggcttcttctaatggagatccaaatcaaagactcacatcatggttccttagggcattaatttcaagggcttctagggtttatcctaatgccacaaatttacatggaagtagtaaccttgaaaggagattaatgagtgtgactgagctagcagggtatgtggatctcatcccatggcatagatttggattttgtgcatcaaatagtgttatttataaggccattgaaaggcaaacaaaagttcacatattagattttagtatcactcattgtatgcaatggccaactctcattgatgcaattgctaagaggcctgagggtcctccttctctccgaatatcggtgccttcatggagaccacaagttcctccattgctcaatgtgtcaagtgaagaagttggccaacgtttggcaaatttcgcgaaatttagagatgttccttttgaattccatgtgattgaagacttgaactatgacatgttctttgagccattgaatcccttcactcttcaaattagagatgatgaagctttggttgtgaattgcaaaattggttaaggtacttacatgatgatgaacaaattaagggtgcactttcgt

SEQ ID NO: 7658 - DNA, 473 bp, Lycopersicon esculentum
  Predicted polypeptide sequence is orthologous to G2699
agtaagtacgaaacccttttctgtaaatccaaaaaaaattccgatggcgatgaggcgtgtagcttctacagcagctcgtgctattgcttcaccttcatccttagtttttaccagagaacttcaggtaactagccatttctcctcaatagccactttttgttgcttttgttttatatgacctagttttcgccctttgatgaattatcggaaaccggcacggatcaactccgatttttcgagaatcaagtgagttggagattggaacagaggaaactaaaggaatttaaccgtgtaaaggaaaaaattaaacacactgtatttggtgctctacccctcgtctcttctttttggctttccccgtactctacacaccaaatgaaatggctcggatatgaaaggactaataacttttcagttttcattactgcgtccttttttaagctttcagttttaatttgcgtgaatatacctaa

SEQ ID NO: 7659 - DNA, 374 bp, Lycopersicon esculentum
  Predicted polypeptide sequence is orthologous to G2699
cgaacagctacgtgttcaaaatctaatacgtccggataatggcgaagcactagtaataaactgtcacatgatgcttcattacataccggaggaaacaacggtaatttccaactcattccgtgccatgtttcttaaggccattcggaatttggacccaacaattgttgtgctagtagatgaagacgcggattttacttctaataatctggtgtgcagattaagatcggcgtttaattatttatggataccttatgatacagtggatacatttcttccgcgagggagcaagcaaaggcagtggtatgaagcggatatttgctggaagattgagaacgtgatagctcaggagggaatacaacgactagaacggctgg

SEQ ID NO: 7660 - DNA, 598 bp, Lycopersicon esculentum
  Predicted polypeptide sequence is orthologous to G2719
agatgaatgaaaaggcggagcaaaacggttacgccgccgccggcgaaggccatggcggcgacggaggatgtagtttggttgatgccggtgatgcgatgttgaacggaggaagaggaagtagagttagtagtggaagagtgaaagagccttggtcgccggaggaagatgcagtactgactgaacttgttaataagttcggtgcaaggaattggagtatgatagctcaagggatcgcaggtcgttctgggaaatcgtgccgacttcggtggtgtaatcagcttgatccggtgcttaaacgcaagccttttactgatgaagaagaccacattataattaatgcgcatgccgtccatggaaataaatgggccgcaattgcaaaattgctccctggtagaacagacaatgcaattaagaaccactggaactctacactaaggcgtcgatttgcaggggtatggagggttaaaccaatacgcagcatgatgttagatgatagtagcatttacaaagccagggcattatctgaagaaactatgtcatgtgaaggtgttaaccaaattaagcccctggaaatgctggaagttagtcgtacagagtg

SEQ ID NO: 7661 - DNA, 645 bp, Lycopersicon esculentum
  Predicted polypeptide sequence is orthologous to G2724
tcgagttttttttttttttttttttttacccagaatgtaatatattaaacatcttaaatcacattacattctatgtcatcaatcatctccaagtaagagattgaatatgatgatataagataaatcaaacttcattgggagttctttttcccttctaattttttctttttaccaattataatcataatgatctagatcaaaggaggaaagaaattcatgagatataaaaggtgaaggtggacatatgagtccacaataatcaattgaaggagctacaaaatcaattttagtatccacttcaaatggttgtgtccaaaaacttccacttgtaatatcctccaaattagctaattcttcttgaaaaatgtcttgttgataatcaatagaggataagtcttcacttgatgaccattctgaattttccaatattacattttcatgcataggattattattattattattatcaccaattgcattttgattttccacattactctttcttttagtaatatcactttcactcttcttattattgcatttcttgcttccttcacttgagttataatcagcgcgcttcttcactgttgtgtgccaatgattctttatctcgttatctgatcttcctggcaagtgacttgcaat

SEQ ID NO: 7662 - DNA, 2520 bp, Lycopersicon esculentum
  Predicted polypeptide sequence is orthologous to G274
gctggtgttgtgagtctgtcgggtgaatctttcatttttactgctcaatcagtgtaattgccaaatacccatttcttctctttgactattacttctactgatctactcgattgattcaaccccactgattttttttaaaaaaaaattctatctttttcaagaaacagtgcatttatagcatagtatgtggagggtgcttctcttctgttaaaacccccttagtttcagatctctcacttgtctagtgaggactgaggaaccttcacttcagatttctcacttgggagcttctggtgttgccgcaagcacataatggcgtccaagtatcatggaccaatcaacagaacacggcgaccgatctctatattaattgtaattggtctttgttgtttctgttatctaataggaatttggcagaaaagtggatccggaaagggagataaattagcactacaagtgactgagcaaactgctgactgcaatgtttttccacaaaccactctggattttgagtcacaccataattatgtggaaacggttgaaacttcagaactaacagttaaaagattcaaatcatgtgaagctaaatacactgactatactccctgccatgaacaagaccgagctatgaaattcccaagggaagatatgatatatagagaaaggcattgccctccagatgatgaaaagcttcgttgtctgattctagcacccaaaggatacacaactccatttccatggcccaaaagccgtgattatgcctactatgctaatgttccttacaaacacttgacagttgagaaggcagtccagaactgggtgcagtttcagggaaacgttttcaaatttccgggaggaggtacaatgttccctagaggagcagatgcatatattgatgaacttgcttccgtggttccaattggaagtggcatgatacgaactgctcttgacactggttgtggggttgctagctggggtgcttacttgctgaagaggaatattctggcgatgtcatttgcacctaaggacaatcatgaagcacaagtgcaatttgctttggagcgaggtgtacctgctgttattggagttcttggttccataagccttccattcccatcaagatcatttgacatgtctcattgttctcggtgtctgattccctgggcatcaaaagagggtatgtacatgatggaagttgatcgagttctgagacctggtggatactggatactgtctggtcctccactcaattggaagacctatcacagagtctggaacaggaccaaggagaattgtagagccgagcaaagaaggatcgaagagcatgctgagcttctttgctgggagaagaagtacgaaaaaggtgatgtggctatatggaggaaaaacataaatggaaagtcatgcagaagagcatccgccaacatatgtcaaacaaaggatgctgataatgtctggtataagaaaatggatgcatgcataaccccctaccccgacgtgaagaattctgatgaagtagctggaggagaattgaagaagtttcctgctaggctttttgcagttcccccacgtatagctaatgacttggtttctggggtaacagttgaatcttatgaagaggataataagctttggaagaaacacgtcacttcttacaagaggagcattagcctacttggcaccactagataccacaacataatggacatgaatgccggacttggaggatttgcagcagcactagactctcctaaactgtgggtgatgaacgttgtgccaactattgctgaaaacactcttggtgtcgtatacgagaggggcttaattggcatataccatgactggtgtgaaggcttctctacatacccgagaacgtatgaccttcttcatgctaatcgcttgttcactctgtaccaggacaagtgtgaatttgaagatattctcctagaaatggaccgtgttctgcgtcctgaaggcgcggtcattcttcgagatggagttgaagtcttgaacaaggttaggaaaatcgccgcgggcttgagatgggacactaaattattagatcatgaagatggacccttggtacctgagaaaatctttgttgctgtcaaacaatatttcgttgaaggcgatgaagaccaaagcacgccaaatgacgattgagtgatgccaatattcgattacatcgagagaaacctgagaattctgaattgggaaggtaagatctccaggcagagatatgaaggttttttttcttctcaaatatggcatacaacaagtagtgcaagttcccatgtagagcaattttagttatttttcctttaatgtgtgatttttggagatcttttttctccaaataatgaagcaaagcaagagttcattagagtgatatgtatgtttgggagcaaatttaatagttgtttccactaattacagagttgaattttgaacaattgtaaaccctatttttttttttaatcttggtaatttaatttatttaaaaaaaaaaaaaaaaaaaaa

SEQ ID NO: 7663 - DNA, 1681 bp, Lycopersicon esculentum
  Predicted polypeptide sequence is orthologous to G274
ggagcagataaatatattgatcagcttgcttctgtaatcccaattcaaaatggaactgttcggactgctctggacactggttgcggggttgcaagttggggtgcttatctttggaaaaggaatgtcatcgcaatgtcatttgctccacgagactcacatgaagctcaagttcagtttgctcttgaaaggggtgtacctgctgtaattggcgtcctaggaacagtcaaaatgccatatccatctagggcctttgatatggctcattgttctcgctgtctaatcccatggggagctgctgatggaatcctcatgatggaagttgatagagttcttcgacctggtggctactgggtgctttctggccctccgatcaattggaagactaattacaaggcctggcaacgccccatggaggaccttcaggaagaacaaaggaaaattgaagagattgccaaacttctttgctgggagaagaaatctgagaagggtgagactgctatttggcagaaaaggatggatgccgactcatgccgttctacgcaagaagagtctgaagctacactttgtaaatcgacagatccagatgatgtctggtacaacaaaatggaagcatgcataacaccaagcaaaggcaatggtgatgatgaaggtctaaaaccattccctgagagactttttgctgttcctccaagaattgctaatggactagtttctggagtccccgttgaggcatatctggaagacaacaggaaatggaagaagcatgttagtgcttataagaaaattaacaaactcatagacacaggaaggtaccgtaatatcatggacatgaattctggacttggaggttttgctgcagctcttcaatctcccaagttgtgggttatgaatgttatgcctacgatagccaagaaaaataccttgggagtcatttatgaacgtgggcttatcggaatttatcatgactggtgtgaagcgttctctacatacccaaggacttatgatctcattcatgctcatggtcttttcagtttatacaaggacaagtgcaactttgaagacattctcttagagatggaccgtattttgcggccagaaggcgctgttattctgagagatgatatagatgttctaattaaggtaaagaagataataggaggtataagatgggactccaaattgatagatcatgaagacggtccccttgttcccgaaaaaatactggtagcagtaaaacaatactggactgtgggggatgataattccacatccacacgataagatgccagtgaagacagtgatggtttaatggatcccaaggaccaattcttccataatcgaagttcagtgagtagcttattacagaaccttcaacacaagaaatttttggtcgatgagacgaggctatatggtgtctgtgtgtttaaccttttctattgatggatccatacattatattgtatgatattatgctttgtaaaacttgcattcatttatttttctttcttctctttgaagccccacactacatgatggatcttttctgaaacttttgatgtattcttaggagcattttcatctctgatgaaaaaaacagatgttgtaatgtgttcaattcaagtggggagaaaccacttagctttcctggtaaaaaaaaaaaaaaaaaactcgagggggggcc

SEQ ID NO: 7664 - DNA, 630 bp, Lycopersicon esculentum
  Predicted polypeptide sequence is orthologous to G274
gataaaatggaagcatgcataaaaccaagcaaaggcaatggtgatgatgaagatctaaaaccattccttgagagactttatgttgttcctccaacaatttctaatagaatagtttctgaagtctccatcgaggcaaatctggaagacaacaaaaaatggaagaagcatgttagtgcttataagaaaattaacatactcatagacacatgaaggtaccgtaatatcatgaacatgaattctccactggaggttttgctgcagctcttcaatctcccaagttgtgggttatgaatgttatgcctacgatagtcgagaaaaatatcttggaagtcatatatgaacgtggttctatcggaatttatcatgactgttatgactttctctcttctatgctcaattatatacttatgtggtatagttgtggctttgataacttatcaaggatttttccttcataggaagttcaagtactattgccactcgattttctctgtgtgattattaatcttgtatttttaagtctttgattttaaatgcaaaaaaccatcaaaggaaacctttgttcttcattaatgacttcagaaatgtcatatgaaaagacaccttgatctaaaaaaaaaaaaaaaaaaa

SEQ ID NO: 7665 - DNA, 737 bp, Lycopersicon esculentum
  Predicted polypeptide sequence is orthologous to G274
tttttttttttttttttttttcatatcagaaatcaactagatcaaatttccactttaattaaacaacacattacagagtctatatatcgagggaagaaatgtttataaaggactttcaaaaagcttcataataatcccatgtagctcagtttttagagtcattatctaacgagacatggaacagagaagaaaatgaagacagttataaacgctaaatcatctggtataatttatggatccatcaagactaaagatgtgccgtggagtcacctgtcaagggaccctgctcgatcaaaattcctaggggtgaaacgtcttgcataaccatggattttgtattcataagatgttggtcttcctgatccatacgagttcatatggtcagacaacatcttcggtggcatctcattgtgaggatgtggagttggtatcacccagagtccaatattgtttgacagcaaccagtattttttcgggaacaaggggaccgtcctcatgatccatcaatttgaagttccacctcatgcctcctattatcttcttcaccttgatcagtacatctacattgtctcttagaatgacagctccttctggacgcaaaatacggtccatctctaagagaatgtcttgaaagtcacacttgtccttatataaactgaaaaggccattagcatgaatgagatcatatgtccttgggtatgtagaaaatgcttcacaccagtcatgatagataccaa

SEQ ID NO: 7666 - DNA, 1332 bp, Lycopersicon esculentum
  Predicted polypeptide sequence is orthologous to G274
gcacggcttgaatcatgtgttagctgtgatctgtttatttaatcattggaactttgtgatttggatttgatttcttgtttagttgattcatttgacagggctgcaatggcgggcaaaaactcaggggataataggactaggacttctgtatcaatatttataatagctggtctatgctgcttcttctatttacttggagcatggcaaagaagtggttttgggaaaggagatagtatagcagtggctgtcaccaagactgctggtgagaattgcgatgtactaccaaatctcaattttgaaactcgtcatgctggcgaagcaggtggtactgatgagtcggaagaagtcgaggaacttaagccatgtgatcctcagtacactgattatacaccatgtcaagatcaaaagcgtgctatgactttcccaagggaaaatatgaactaccgagaaaggcattgtccacctcaagaagagaagttacattgccttattccagcacctaagggatatgttaccccatttccgtggccaaaaagtcgggattatgttccctatgccaatgctccatataagagcttgactgttgagaaagctattcagaattgggttcaatatgagggtaatgtgtttaggttcccaggaggagggacacaattccctcaaggagcagataagtatattgatcagcttgcttcagtcgtcccaatcgagaatgggacagttcggactgctttggacactggttgtggggttgcaagttggggtgcttatctttggaaaaggaatgtcatagcaatgtcatttgccccaagagactcacatgaagctcaggctcagtttgctctggaaaggggtgtgcctgctgttattggtgtactaggaacaatcaaaatgccatatccatctaaagcctttgatatggcccattgttctcgttgtctaatcccatggggagctgctgatggaatcctcatgatggaagttgaccgagttcttagacctggaggctactgggtgctttctggacctcctatcaactggaaggtcaattttaaggcctggcaacgccccaaggaggatcttgaggaagaacaaaggaagattgaagaggctgctaaacttctttgctgggagaagatatctgagaagggagagactgctatttggcagaaaagaaaggatagtgcctcatgccgttctgcacaagaaaattctgcagccaaagtttgtaaaccttctgatccagatagtgtctggtacaacaaaatggaaatgtgcataacaccaaacaatggtaatggtggagacgagagtctaaagccattccctgag

SEQ ID NO: 7667 - DNA, 550 bp, Lycopersicon esculentum
  Predicted polypeptide sequence is orthologous to G274
tgggtaagactgttggagaaccacctccaatagagataggaccaaagaggctgaaagtttggaggaagaactgaataactcataaaatccaacttcagtgacacccattttctccaatggagggacctaacaaaaggatgaaaagttaaatatttaggggaagcagctatgtaacttttaaccaaaacttagattcaggaagtacattctatgtacaggcctcaaaagggggcaaatggagcgctgatgattcttatggttctcaggccagggtgttttccgtctttggcaggagaacatatcaatctgcctcgtgggcagagttagctgatatttgtgctgctaggaggtagcaatacgtagtgtaatagccgataatggtactttccttcccttgccacgagaagatagtagattcaggttaggtacttcactcatgtacattttgttcattaacaaattggtcgattcttgtgaggtcaaatgtccaatatcaggtcaggtctctgatttaaatgtgacatctactatctatctccctgtcattatt

SEQ ID NO: 7668 - DNA, 585 bp, Lycopersicon esculentum
  Predicted polypeptide sequence is orthologous to G274
ggtttctgttcttgatttaatttgaaaggcatatctgagttgtggacttacaaagcaaaaataaagcaggaaagccagtaaaaggaagtattgattttttttttcatgccactggacagcaatggcaaacaaaagcatgggggacaataggaccaggacttctgtgtcaatatttattgtagctggtctctgtttcttcttctatttgcttggatcatggcagagaagtggcgtcgggaagggagatagtatagctttggcagtcaccaggagtggtgagaactgcaatatcctaccaaatatcaattttgagactcgtcatggtggccaagcaggtagtattgatgattcaggaacggaagtcaaaaaatttaagccatgccgtcctcgttacactgatcatacaccatgtcaagatcaaaagcgtgctatgcacctcccaagggaaaatatgatctatcgagaaaggcattgtccgcctccacaaaagaagttgaattgccttattccaccacctaaggggtatgtcgccccatttccatggccaaagagtccggattacgttccatatgtgaatgcccccta

SEQ ID NO: 7669 - DNA, 602 bp, Lycopersicon esculentum
  Predicted polypeptide sequence is orthologous to G274
tggtattgcagctcctttattgaaggtcctattgttggccgtgcctagttgctaattaagtaaaaaggtctaaataattgtgatatgataagagcaaaggtagcttaagtaaatatacactgatagtagatgatcatacacttaaaattttaggatagtaaccttctcagtatatggtataatgactgatatttgaagtaccgacagaagtttgcgtgtgttgtggctaaatccaccatcatttctcctttttgctgctgtgacttaatatgctgttattcgtaactgcactgttcttgttgaaatagaaatgccagctcgtcactctggcaactcatatctcccccgtctactgatccccagccaggaaaagaaaaaaatacccagttaaagggtgctacaggaagaaaaataattggtatcattgactaaattagcattttctaattttataggtgtgactttcaagacattctcttagagatggaccgtattttgcgtccagaaggagctgtcattctaagagacaatgtagatgtactgatcaaggtgaagaagataataggaggcatgaagtggaacttcaaattgatggatcatga

SEQ ID NO: 7670 - DNA, 789 bp, Lycopersicon esculentum
  Predicted polypeptide sequence is orthologous to G274
ggccaacattgctgcttctctgatatccagttgatcatggcaaccaaaaggaaatccaggggataacagaaataaaagctttttaccatcattacttgtcatagctgcactttgttgtttcttctatgttcttggagtgtggaaaagaagtggttttgggaagggagacagcatagcacttgaaataacaaagaaggcagaggactgcggtatccttcctaatttggagtatgaaactcaccatgggaatcaaagcacctcgttcgatgatcccaagcaagatgtcaaggagattgagccatgtggcgagcaatacattgattatacaccatgtcatgatcaaatgcgagcaatgacatttcctagagaaaatatgaactatagggagagacattgtcctccagatgaagagaagctgcattgtcttgttccagctccaaaaggatatgtcactcctttttcatggccaaagagtcgtgactatgtaccttttgcaaatgcaccacataagagcttaacagtcgagaaggcagtgcaaaattgggttcaatatgaaggagatgtatttagatttcccaggtggtggaacacagttccccaatggggcagatgcatatattgatcaacttgcttctgttataccgatggaaaatggtactgtaagaactgcattggataccggatgtggggttgcaagttggggtgcataccttttcaagaaagatgttctaaccatgtccttcgcacccagagactcgcatgaagctcaagttcaatttgctttggaaa

SEQ ID NO: 7671 - DNA, 640 bp, Lycopersicon esculentum
  Predicted polypeptide sequence is orthologous to G2747
catgaatttcttctcagatggacgtggcttcaacgatcaaggcccattttctcatcctgatttctcccatcagcaaagaagcaccactaatagtagtgatatggcagatgaagtgggtgaaagtaacacgattgaacgagaacacatgttcgacaaggtagtcactcccagtgacgtcggcaagctcaatcggttagtcatccccaaacagcacgcagaaaagtattttcctctggattcctctaccaacgagaaaggcctccttctcaatttcgaagacacgaacggaaagccttggcgcttcaggtattcctattggaatagcagtcaaagctatgtaatgaccaaaggttggagccgcttcgtcaaggagaagaagctcgatgctggggatattgtctcatttcagcgtggagtcggtgaattgggcaaggatcgtctcttcatcgactggaagcgccgtccaaacgcccccgatcatctccacttcatgactaatcatcatctccataataacttgtaccgctctaatattcagtacccagctgctgcttgggatcgtcctctctttttgcagcctcctgaccaatcacatttacaatattccctgggacctgcacctggcagcatgtctcagcaa

SEQ ID NO: 7672 - DNA, 699 bp, Lycopersicon esculentum
  Predicted polypeptide sequence is orthologous to G2754
gaactgagacagattatgtgttgaaaacagaaattccaggtgagtaaagagatttacttatttacttgagtttgtgttcgtttttttaggtcaaactcataaacagatttcttgttaggttttttttctttagatattttacctacgccatttttctattgaatcataaactactcatattttattcctttaaaacactgctaactgattttgattatttttcctattgtaaatgtattcaactgtgtttgtattgtaataattttgattgaagaaatgaagacaaattgtttgttagtctcatttgttttctaatgtgttcaaatgatttcgagtaaatacaattattctcgaacaatttcactatcaattggtctaatgagttctagaacaacatatgcatatctaccaatacccctaacaaaatctgatccacatcgatcaacggtgtttaaaaggaacaaaattatgggtgattcaataatttaataggaaaatagcctagttaaagtatttgagaaaaaacccaacaagtttataaatttgtttatatacttggccttttttttaatgtacgaacgaatttaaaatttaaattttataaattctgaattttatgagccccgactttacttgaatgtcatttagtggaacaatagcgttaaaattttaaaaaatcctatatctgacaatattttt

SEQ ID NO: 7673 - DNA, 1157 bp, Lycopersicon esculentum
  Predicted polypeptide sequence is orthologous to G2766
gccctcaccccacccacccacctctctctctattaacttctcaacctccaaatcttaacaatccaattcgaacaaattatcaaatgtatccatcatcaacatcttcttcatcacaaggttcaatgagccacaccagcaccaccgctggcggcgccggcggtggtctcactcgctacggttcagctccgggatcatttttaactacagcagttgaagccgtcgttaacggtaatcacgagttcgcttctcacggatctcatcactcacaccttggtccttcacggttttttcagtccaatctagcatctacttcgttaaattccgaatctacaagtaaagcgaaggaacaatcgaatttacagaggtcaattggtttcaatgacttaacaatcggcggcggaagcggcgctggaggaggagttttgccgacgacttcaacgacgccgttggttcgacatagtagctcaccggcgaggttccttaatcaacttgctactgctgcaggtgatactgtttcaatggggagaggaagctataacccaaaaggcggtggagatagtggccggggaataacaaggctgaactctcagctcagcttcacaacgcaagaagctctttctcaaatagcagaggaaaatgaggatattgaagggaccagtatagccaatggccacagaaagtcaacacattcttatgccagtgcaagtagtttcgcgatgggttcttgggaagataacaactctataatgttctctgtcacacctagcaaacgatccaagcagattagcaatgacattgtcaatgggctcgatgacggggaaactcagctaatatgaacttgaaggtcactatcagaaaacacataaaccttcaccgtttgacatctgtgttttcaacatgtaaacggcgatagatatacttcctttacatttttccccttaacaaccttacaactacattctgtgtatgtgtttcttttctttctgcagaagtatgtaaaataaaatagacaaaataatccatgttggcatactcaatcatgtttctcgtgtgtaactcacacaaaaattgatgaaaactgcatttttattacttgtgggaggatgaactgatgtttttcaaaaaaaaaaaaaaaaaaactcgagggggggcccggt

SEQ ID NO: 7674 - DNA, 411 bp, Lycopersicon esculentum
  misc_feature (408)..(409): n is a, c, g, or t
  misc_feature (411)..(411): n is a, c, g, or t
  Predicted polypeptide sequence is orthologous to G2766
caagcaaacgagctatgctgacatgctggatctagcagtgcagcatattcgaacccttcaagatcaggttcagaatctgaatacagaacttgaaaactgcaaatgtggatgtaggaaatcaagtcaataacaaaatgggaggaagcactttagctgaagattgacttaaaaggatttttgtcaccattattttgcttcttagaaactcaaatttgtacatatggaagtaaatttcatactagttttttaaagctaaaaagtgaactctctttgtttttttttcttttcccttttccagttagaagactacgtatatgattgttttggattatttctagttttcttttttcatctaacatttacatttttaatttatttttgagtttattttgcttgaagatcattttnnan

SEQ ID NO: 7675 - DNA, 1111 bp, Lycopersicon esculentum
  Predicted polypeptide sequence is orthologous to G2789
gtcaaattttatactcgctttctcctttttgctttgccagaagtcatacagcagcggtcagtcgacttgttcagtctgcagttcacgtattcgtccttgggggctgggagattgacccacgtcgcgccctaaagacgatggaattgattccagccgttcaaccccctcccccccctttcctcttttgaagcgggttgaattctcaaagaaaaggtgttcatcctaaaatggtgaaagattttaaaattcgaaattgaaatggatcttttctcatctaatttcattcactttccccaaaaatcaactctagattttccctctctatataagcgcctgttttgctccattagaggggttggagatttttgattgaaaaaaaaggggtgttgaagaattttgtgttggtgaaaatacaggaagttagctaagtgatgaaagaaaaagatatatttaagccaaaggtttcctagaaaattttccgattcggtctttctgtcatctgttttgctttgttggttcaagtttttttggagtcgttcttcggtgtagtagttgctgtccatctcttcgctccaacccagttcgctgcccacaaaaaggtaaacacctctaaccccttttatttagatttcatgttcaatatgttggatttgaggtggcttatgttttgttttcaagtcgtttaaatgactgattagagcatgttttctctgtctctttttcactcatcctgaacttgtggtcactgtatttgcttcaagtatagtttgtttactggtttgtcatcgttttatgcttgttttttttattgtcgtaatattcgtgcttccgtcatatgttttgagagtatagggtgcattatgcagtcacacatttagttatttcagatgtacttcaaaatagcatgcctgcaaatctgtctagttttgaatggaaatttcttttgttcgtccctttgttcattcgtcacccgatatttttaaattctagttgtagtcgagaatacatttgtctcctttacttactaaagcacgggtcaatttttgttggtgttatttaaataactatcttaataactattaaagcatgttcatacctttcttcctctttg

SEQ ID NO: 7676 - DNA, 914 bp, Lycopersicon esculentum
  Predicted polypeptide sequence is orthologous to G2791
gcttttagaaccgaactttcacacactgaagaaatcggcaaaatctcagacagaagaagaagaaaatgcaagccatgaattcacttcttagtcaacaacagcagtcacagatatcacttcaagaccttcaaaatggcggaaatggcggttctaccggtggtgttggtggtttaagtcaacacagtatgggtcactctcactttgatccgacgtcgtctcatgacgattttctcgaacagattctctcttctgttccttcttcttctccttggcctgacctttccaaatcatgggatccacatcaccatctctcatctccgccgcataaccctagctccggcgaagatcaacctccttctaatccatttcactcacagttccattacgacgaccaagcttcttctctactagcttcaaagctccgtcaacatcagatcactagcggcggcggcgccgctgcagctgctaaagcacttatgctacagcaacagcttttgctctctagaacactcgccggaaacggactcaggtccccaaacggagcttccggagataacggcctcctttccctacccctaaacctcagtaatggtgaccaaaacgacggcgtcgctaatccaactaatgacaattccgttcaagctcttttcaatggattcaccggatctcttggtcaaacctccaatcaacctcaacattttcatcatcctcagggaggatcgatgcaatcgcagagtttcggagctccggcgatgaaccaaactccggcagcaagtggttcagctggtggcggtggaggttcaacgccggcagcacaaccaaaacaacaacgagttagagctcgtagaggtcaagctactgatcctcacagcatagctgaaagattacgtagagagagaattgcagagagattg

SEQ ID NO: 7677 - DNA, 585 bp, Lycopersicon esculentum
  Predicted polypeptide sequence is orthologous to G2791
atttcaaagcaccgttgaaaatggtgcttcgtccggcgagcacatgagtcattcccatttccaccccgtcgtcgtctcacgacgacttcctccaacagattctctcttccgttccttcttcttctccctggccagaaatctccggcgacggtcacccctacaatttcgacgaccatcagtcaactcttctggcttccaaactccggcagcatcagatcaacggcggtacctctgctgctgcagctgctaaagcgttgatgcttcagcagcagcttttgctttccagaggaatcgctggtaatggcggctctgggataaacggcgatcaaaacgacgacggtttgaattcggggaatgatatttcagttcaagctctttacaatggattcgctggatctcttggtcaaacctctaatcaatctcagcattttcaccattctcaggcccagagtttcggagctccggcggcgtcggtatcgatgaatcaaacgccggcggcgagtggttcagctggtggagcgcagccaaagcaacagaaagttagggctcgtagaggacaagcaactgatcctcacagcattgctg

SEQ ID NO: 7678 - DNA, 115 bp, Lycopersicon esculentum
  Predicted polypeptide sequence is orthologous to G2791
gcaccaagtagctaaattaatggaggaagatatgggatcggctatgcagaatctgcaaggaaaaggcttatgcttaatgcctatatccttaactacagccatttccacttccacc

SEQ ID NO: 7679 - DNA, 1028 bp, Lycopersicon esculentum
  Predicted polypeptide sequence is orthologous to G280
gacactcttttctttcttgtagggacatctctagaacacacacacacactctctctctatccatggctactcaaagcttcaaccagttcccttcataccctgagatgatttatgaagctcttgatgaactaaatcaagaagggggtgcaaacaagtcatcaataagcaagtacattgaaacaaagtatggagatctgaatgaagatctttcaaagatgctacctttacatttggacaacatgaagcaaaatggagatctgattttcctcaagaacaattacatcaaacctggtccagatgttccagcaaagaggggtcgtggtaggccaccaaaacccaaagctccattgcctcctggtgctgttgaatctgttgaacctgcatcaccaaggccaagagggcgcccaagaaaagaccctaatgcaccacctagttccaagaagccaaagccagaatctgttgctggaggtcccaattcaacaaatcttggttctactactggaaggcctaggggtaggcctaggaaagttaggccacagcctgctcatgatgatgatgatgatgatattgaggaatgctgaaaacttttaagacttgttattggactcttgctgatggtgatgactctaatgacttagttgtcttaatatcctctttttttttaggtgttagtagtattatcttatgtaatagtttcagtttgagttgccctagtgtgactagggggtcatggtttcaaagttaagactgcgtagaatagactaattgtcgttatgcgactagggtcatggtttacagtgtgcaatagactaattgtggtccggttcttttctgaaccccgcacatagtgttagcttagtgcactggtcttttttattagtatgtttaatgcccctattagttatacaggttgttaggggtttgtgtgcttgtgtgttttaacactttgtttcaagattcactgtgtagtctgtgtaattgttgcacttttcattatgttgatgaatctttttgttaaaaaaaaaaaa

SEQ ID NO: 7680 - DNA, 830 bp, Lycopersicon esculentum
  Predicted polypeptide sequence is orthologous to G280
gagaactagtctcgagtttttgtttttctctgtaacaaaaatggctactgaagaacataatctaactttgcctagttatcctgatatgattatggaagctatagatgcgttgaatgaagaagaagggtcgaataaatcagctatatggaagcaaattgaagcgactcatggtacactaccaccagcgcatggtacactccttgcacatcatttgaatcaaatgaagcaagctgggcaattagttatgttgaagaacaactacatgaagccaaatccaaacgcgccgccgcgccgtggtagaggccgtccgccgaagccgaaaagttcagttccggtaccggatgggtatcctagaccacgtggaaggccaccgaaggagcgggatccgtacgcgccgataacggtacctatgaagaagacgagtgagggtagctctgggggaagtgggaagaagcgtggaaggccaaggaagtatccgatgacggaggatacgccggtggtgaagccaattggtgctccgagaggaagaggaaggccgccgaaggtgaaaactccggtagctgcaactgtaggggcttaattgaagaaagacgaattaaattagggacttgtatggcaaaatatgctaacttgttgtttttcactttttatctgttttgaattttcatgtttagtccctgtagttttgttttaattacaatttgtaggaagaattgtgtgactttgtgagtgatttttatcatgtaattgggccaatgtaaatccaaattgagggctttttatttatatataaaaaaaaaaggttcagtattaaaaaaaaaaaaaaaaaa

SEQ ID NO: 7681 - DNA, 829 bp, Lycopersicon esculentum
  Predicted polypeptide sequence is orthologous to G280
gctcactctctctctctctctccatctctttgtggggacatttctctctttctctctctgcaagtttcaatggctactgaatttgtcaacaagattcatcctgaataccctcagatgatttatgaagcccttgatgcattgcaacaaaaagaaggctcaaacaagtcatcaatatcaaagtacattgaatctaagtatggaaacatgaatgatgcacactcaaagttgataacttaccatttggatagaatgaaacaaactggtgaacttattttcctaaaaaacaactacattaaacctggtccagatgcaccccctaagcgtggccgcggccgaccacctaaacccaaacctatattgccacaaggaacagatattgcagctccaaagccaagaggtcgcccgaaaaaagaccccaatgcaccacctactcccaagaaaccaaaaccaacaagtgtccctagtgacttagctcctgtttcgaaaaccggaaggcctagaggtaggcctaggaagattaggccgcagccaccacaaaatggtttagagtgaagctgaaaatccgcagacttggttgatggtgacgacttttataactctgttgtgtttttaagttttcttggttgatgttgtagttgtaaggggttgtgtttcttctagctgtgtaatgtagattgttaggagatcctgtacttgttttaatgcttgttgattcgcgattcacagtagatagggaagttgagccacagccagcacagaatggtgtaaagtgaagctgaagatttgttgactttgttgatggtgatgactctcaatgactgtgttatgt

SEQ ID NO: 7682 - DNA, 817 bp, Lycopersicon esculentum
  Predicted polypeptide sequence is orthologous to G2826, G2838, G362
ttttttttttttttttttttttttttttttatttagaccatgcatgatcaagctctttaatttccaaaaataatctaaattagaacactacaaatattaatgaattctatctttaatttgctttgactaatacaatataatattacaaacttaatcccaattgaagatccaaatgtttacatgaacttttttgtttagtagatgaagaattatccaaaatagttgatggaggcttcatataattatttcctccatgtgtaagagtaaatgtacaattatttgaatcttgatgaaatggccaatttgttcctcccccttctgatgagacttgataatcataattagggttaaaactaatttgggattcttcataaacattaaattgaggatcatgaaattgataattaataatattgttgttgttgttgttgtaattttgattatgaaaaggctgaagatagcaacttaaacttgcttttcttgcttgaagttgtagtctttttttcctcattctttcctttttatgagcattttgatggcctcccaaagcttgagaatttgcaaattgtttcaaacaatattgacactcaaatttcttcattatttcttcatgatttgatgatattttttcttgattatgatgaatatttcctgatgatactgtggaagctgatgatgaatttacactttcttgatcttcttttgatgaattattttggactttttttggagatctttttggattatcaataagctcaaaaccaaatattttgagcttcttgttgttgttgttgttgttttctatacatgatttagc

SEQ ID NO: 7683 - DNA, 780 bp, Lycopersicon esculentum
  misc_feature (729)..(729): n is a, c, g, or t
  Predicted polypeptide sequence is orthologous to G2826, G2838, G362
gcttctttatcctttctctctcaatatactgtatcttcttttacacatggagaaaaccaaagataaagaaactcaagatttcatgaatgttgaatctttttctcaacttcctttcatgagaccaacgaaagaaaaagccgcgattaggctttttggtaaagaattactaggtactactattcgtcatgaagatcaatcaattgagattcatgatagtgttggagatactacagaaatcaacaataacaacagaaaatttgaatgccaatattgttgtaggaacttcccaacatcacaagccctaggaggacatcaaaacgcacataaaagagaacgtcaacatgctaagagagctcaatatgcaaaatatcagtacaacgcttattttaattcagcgttgtacaatactagtagtacaagtagtactactagtggtggtttgtatgtgaataataacggccatagccattattattcacaacaaattaatcgcgatataaatgaaaatcaccgttcattgtcagcgttatggagagtacctcatgttcatcatagtagtattagtagtagtagtaattcttactctcctaataatgtttctaattttgttaggccaatagtttataataatgttaatggagatttgaagaagattaacacaaagagtagctcaatttctttaaccagatttgggtatgaattgaaggaaggagtacatcaagatcatgntagttttagatctacacttgtaaagagtacaatccaagctatagtatcgac

SEQ ID NO: 7684 - DNA, 501 bp, Lycopersicon esculentum
  Predicted polypeptide sequence is orthologous to G2826, G2838, G362
gctcactttctccttcatttatttcacatttacacttgtagtcacacaaatatatatataaagaaaaaaaacatctatatggcggaactggaatatctcgcgggttctaatactaacagacgattaaaattatttggtttcaacgttatagaggatcaggaacaagaggttgagtctacaaaaacgtcatcgggatcaccggaatccggtgactttccggcgatcgatggccggaaatatgagtgtcaatattgttctagggaatttgcaaattctcaagctttaggtggacatcaaaatgctcacaaaaaagaaaggcaacaattgaaacgtgcccaaattcaagctagtagaaatgcttatatgaggaaccctattatttccgcgttcgctccgccatctcacctcctcactccgccgggtactgtagtgtacccggcagggtcaactccatcgtgggtttatgtaccacgcgctccaccatccttccacgtgtcacat

SEQ ID NO: 7685 - DNA, 542 bp, Lycopersicon esculentum
  Predicted polypeptide sequence is orthologous to G2885
ggggattcctgcatctttggagcttgatcaactgcagcagagcaagtgtgccacacacataggagagttgaatcctttggatgagtcaggactgcatacagtggccagtacattcacgaactctagattggttggtagcgcaaacagctctatgcccaatgtatcaaataatcctattttgcttcaagtaaattcccagcaaccactgacggggatgggatttggaaatcagacttctctcaacgtagcctcttttagctctgaggccttcaatactggtgtaagtggttcttccaattttctggaccatgatagatattctaacgagaattggcaaacttctctccagcctctgaagttccagtcaacctcctttccgttaaatgaacctttcagcaacagccatttgcctcaagacagagtacgagacaatgatacttcaactggccctcatttgcagaacaatcctgttgatttttcaacctccaccatagtttccgtacctttcgaagcttcaagaggagaaacacaatgccgtgaaa

SEQ ID NO: 7686 - DNA, 740 bp, Lycopersicon esculentum
  Predicted polypeptide sequence is orthologous to G2887
gagaaacttcgctgcattgaagtaaacgcgttcaataaaaccctatttcccaattttgatcctccttcctccctctaatcgtcgtctacgcgtccgccttctccttcgtttgccatcttcggttttgtattgcacaccagatgtctgttagcatcaaccagaagcatcactattttgtttgggctgcgttgaatcgaagaagacattggtgctctgggaagatattgtttaggcattggacttgactcttgtgtgactttcttttgttagaatttgcttcactgagacctactagtgctgtggtcttttcattttatttgtctgtgcggttttttactatttccaatggcgaagcttccaccagggtttcgctttcaccctactgatgttgagctgataatgtactatctaaagcggaagatcatggtgaaaaagatcctttttgaagtcatatcagaactcaacatttataagttctccccatcagatcttccagacaaatgttgctacaaaagtaaagatcttgaatggtatttcttttgcccaagtgagagaaagtatgcaagtggattcaagatgaatcgcactactgatattggattctggaaaattactggcagggatagacgtgttctttatgatgaaaagtttgttggatctgttaagactttggtttttcaccaaggtaaagcaccacgagtgcagagaactgattgggttattcacgagtatagatttga

SEQ ID NO: 7687 - DNA, 635 bp, Lycopersicon esculentum
  Predicted polypeptide sequence is orthologous to G2887
gccgccttccccttcgcttcccccaccaccccatcatcgttttttcgccttctccggttcggtcggtatctgggtttttgattgtgcaccagatgtctgttggctccagcaagaagcaccatttctttgtttggagcgcattccttttcatgaaccgcagaaggttgtggtgctcagggaagatactgtttcggcattggacttgacagcagttgagattttttttgttttaggggtcggttggaggctctggtgtgttgtgcagatagctcgtttagtctagatttcgtcaggcgcaccccttttgggctgctttgaatttagttcctttttttttttgggatcatttgatggcaaggcttccacctgggtttcgttttcaccctactgatgttgagctgattatgtactatctcaaacgtaagataacaggaaaaaaacttcattttgaaggcataacggaactcaacatctacaagttctccccatgggaccttccagacaaatgttgctataaaagtaaagatctagagtggtacttcttttgcccaagggagagaaagtatgcaagtggagccagaatgaatcgcgctactgatactggatactggaaaactactgggaaagatagacct

SEQ ID NO: 7688 - DNA, 500 bp, Lycopersicon esculentum
  Predicted polypeptide sequence is orthologous to G2887
ggaaagatatgacctgttacttactgtgagaagattgttggatcagttagagcacttgtttttcacctaggtcatcccccgcgagggaaaagaactgattgggtaattcatgaatataagtttgaagataaagaatcaattgatgcaggatttgctcaggattcatatgtgctttgtaaagtattccagaagagtgggccaggtccaaaaaatggtgcacagtacggagcaccttttaaggaggaagattgggaagatgacaagattcctgctgagccttgtacttcagatgtttttccagctccacctggtaggactgataaacccagcggctcaaatgcaatcagaatggttgacccaagaagcacatctgactggacttcaagtgaacagagtccatctcctattcaaccttctgttcaaaaactgcctttggatgagccagatgacgaggagttacctggtgaaccaaatctgtccaatgtatcttctatcaattg

SEQ ID NO: 7689 - DNA, 613 bp, Lycopersicon esculentum
  Predicted polypeptide sequence is orthologous to G2893
aagatattggaggcaagtaatttcactttttcttgtaattcacctcatgttctgttttaactttgcagggtaaacacaaaagtctatgcagtctaccagataacatgaaattcttttgcagaaagctgggattgacatgcaaggtcttggtgctcctgagatacttcaaaattttcactcccaaccgagctgcatagaggttagtggcacatggagctgccgttcctgaatatttctatgcaaacctaaagcagtaaagcgaaggatgccaatctggttgaatctccatgcaaattcaatcccttaaagcatgctaatagataccaggttgattctgttccatgtgttatgcctgatgtgcaaacggtcaaatgcaagttcttagattgtagacagaagcaaaggcaaaaaaaggggttatttcctatccgcctaacccctggtgagaagaattatcgatacctttgctggtggaggtgacaggttttgtggaatagtcgaggtgtgcaagttggcctacacaccaccagtgctttcacaaaggaattcacaagagcaaatacatttgagagttgacactgtgataaggggtatgtgaacttcactacacgaa

SEQ ID NO: 7690 - DNA, 491 bp, Lycopersicon esculentum
  Predicted polypeptide sequence is orthologous to G2898
gccctaatcagcacagaaaaaataattctgaacgcctgaatatccctgaggccgacgagctcgaccccgtctcgtcgtctatcaacttacgtcaccgttcatagcttctggaaccctagtataatcgacatggtcgaggttgaggcttctacacctgatctcaacgacaaagcctcatctcctcaccacacaatgacaatggtgcctactgaaggagaattttcaataggaaagaggaaggatcaaggtattagtgaacctgaagggagtagaaaaaagaagaaaaaacaagtagccactcctcgtcctgcttgctcttgggtgcacttcagccgtgactttattaaagagtatagtgctacacatcctgaatcttcaggcctgaaagttgccacaaaggcagcatcagatgcatggaagctgatgggtcctgaggagaaggcaaagtacactactcgtgctcgtgaagtgtgggataagtacctgagctc

SEQ ID NO: 7691 - DNA, 579 bp, Lycopersicon esculentum
  Predicted polypeptide sequence is orthologous to G2898
gcaaaagctccatgacatcaaccaaaagggtaaaattagcggagaaagtaaaggcaggtggagtgaagcagagtaaacccacatcagggaagaagaagaagacagcaaaaacagatgcaaagaagcctaagaagcccccaactgccttcttctatttcttgtatgtaccacatatctttgttttttctgttctatttcaaggaacccttgctttaaactccatagcgttagttattgtcatagtagcatctaaaattttgatacaccaatctaatttgtgtttgtacttggtcaattcatgaaactccactttgggttcaggtttggtctgtcaaatcatcagcttatgagtaggtcaagggaaaagctcatgtctgttgtaaatacccccacactaggttgtcgaatttgtacttgtatttacaaattttaataagttgttttatcttcttagaataaaaatagggcttagtgtaataattagtttatgcatcttattcatatttttggactctttatttcccccatgatatcattgtttggtgaggaacaatcggaaatatagtcacagttctggtg

SEQ ID NO: 7692 - DNA, 956 bp, Lycopersicon esculentum
  Predicted polypeptide sequence is orthologous to G2979
gctctctttcttcaaagcttgagcggtttatctcgaattttccgtagggttcttctctgatcgctttcaactttcgataacagagaaacctagcaatgtcatcgtcactccatactgaagattctcaatggaaaaaccctagcatttatagccgcaaggacaaatcgctcggtcttctttgctccaagtagaaatgtgtggaggaagctgatgatatgccttaaaaacataaaaacccaatttcttgaagctatgtgatcgggaaggggtggactccaccattggtttggacaatgctgcagatcaattaggtgtcgagaggcgtcgcatttatgatattgtcaatattttggaaagtgttggggttttgtcaagaaaagctaagaatcagtatagatggaatgggtataatgcaatttctaaggctgtagatttgcttaagaaagaaggactaaaagatctgtccactgtctcctccacttgccacaatgtttcaaatgtcatagcttgtaacaattcagatgttaaggaaaaaggagaaggcaagactgctggatcacataaaattgacaaccggaaggagaagtctttgatgattctagcacaaaattttgtaaagcttttccactgttctgatgttgacttgatatctcttgacaaggctgcatcagctttgcttggtgatgtccacgatccgatggctatgaagacaaagaccagacgcttgtatgatattgcaaatgtttttgtgtccatgaatcttattgagaagatacgcagcccagataatggaaaaccagtgtttaggtggatagcctggaaagaaaatctgaggagtgggtcccttgcatctgctaaatcagatgattcaacaaggagaacttttggggcagagatcacgaatacaactcccaaacgatacagggatgattcttcatctgatgtaatgtcaaatg

SEQ ID NO: 7693 - DNA, 1153 bp, Lycopersicon esculentum
  Predicted polypeptide sequence is orthologous to G2982
ggtcatggggaactactgtttctggtcaatcggtttctactagtagcagtattgggtctccatcgagcagaagtgaagccgccatggctacccctgccagtgacaacacttttcttaggctaaacaatcttgacattcatgctgatgatgcaggatctcaagggacagctgggaaaaagaaaagagctcagcgtgctactggaggggataagagtggtagaggactcagacagtttagcatgaaagtttgtgagaaagtggaaagcaaaggaagaactacgtataatgaggttgcagatgaacttgtagctgagttttctgatgctaccaatagtgttgcaggctcagatcagaaacaatatgatgagaagaacatcagacgacgagtctacgatgctctgaacgtacttatggctatggatatcatttctaaagataaaaaggaaatacagtggaagggattaccacgcactgatgcaaatgatattgaggagctaaagactgagcgtcttaacttgagaaataggattgaaaagaaagcagcttatttagaagaacttgaagatcaatatgtagggcttcaaaacctcataaaacgcaatgatcagttgtatggctcaggcaatgctcctagtggtggtgtggctttaccgtttattttagtgcagactcgtcctcatgctacagtcgaagtggaaatatcagaagatatgcagctggtgcatttcgacttcaacagcactccgtttgagctgcatgacgataattatatcctcaaagcaatgaatttttgcggaagatcaaatgacggttctgtcccacagaatgtatctgctgatggaggtgaaggtccgagttccagtatggccaacatgtttcagcatcatatccctaatccatctgccccaaactcatctggcaggcttccgacctcacctcctctccccggaatactaaaggctcgtgtcaagcatgagcattagtcttctggcttctttcttgatcgattactgtactcattaacgcatagtatttctgtacattatgtaaagtatttttactggaagcagcctcctctgttgactaaatacttctcttgacccttgtctcaatttgagggaggttactagttgagcttttaaatttttttgct

SEQ ID NO: 7694 - DNA, 993 bp, Lycopersicon esculentum
  Predicted polypeptide sequence is orthologous to G2983
ggctccatgtacatgggatcatcatcaggaagcttaagtatgaaggtgcatcaattcacacgtggattcttagagcatgaagctgcttctccttcacttacacttggttgcaaacgtttaagaccacttgctcctaagctcaacacaaccaataatgataccacaactaccattgttactcctccttttgatcttaagagtttcattaggcctgaaagtagcaatagccctcctaaacttgcttacaatgaagacaagaaagactcctctcaggtggaatcacacccaggaggaacaagatggaatccaacacaagaacagatagggatacttgaaatgttgtatagaggtgggatgcgtacacccaacgcacaacaaatagagcaaatcacagcacaactaggaaaatatgggaaaatagaaggcaaaaatgtgttctactggtttcaaaaccataaagcccgtgaaagacaaaagcaaaagaggaatagtcttggccttagccaaagtccaagaacaccatcagccatagtcactagtcctttgtcatttgacactaggggagaagtagtgagggatgaagatagtccatacaagagaaagtgtaggggatggacatttgaatacatggaggaagaacaacaacaacaagatgaagaagaaattataaattgtagagaaaatggtgataggactcttcaactcttcccattgcatccagaaggcatgagatgatgaatttattataagaatattcttttttcctttttaattatgatctgactagcttccttttttttttttacttattttcgtcatctttaatttttactttcttcatttgcatgctttgtttccttttcttttatttttttccttgttttgggaaagagaaaagagaaaagagagacatatgaatcatcaaatctatgtagtaccaattcacttctcttgaattttgggcattttagtgaaaaaaaaaaaaaaaaaaaa

SEQ ID NO: 7695 - DNA, 561 bp, Lycopersicon esculentum
  Predicted polypeptide sequence is orthologous to G2989, G2990
gcataaacaaaaacctaaaaaacatccttcatttctttttcatccttttgtcttctcacttactaaagtccccctttcattttttttttcttccttcttattaacctttttttcctatgaataaagataattctttttatttttttttggtatgaaatcatcttgaccttaaatttaatcatctactaactcttttaactcaaaaacaaaaaaaaagaagataaaaaagagtgttagatgtttcagccatggagttaaccaacaacaacaacacaactattagtactattactactactactacagtgaaaaccccagaagctgaaattgaaaccccaactcagatccagaaactgaaaccttttccttttagtaatggtgttctgaaaaggaaaagttcatttaaccataacaatcatcatcaccctgttgtggttatttacagagagtgtttgaaaaaccatgctgctagtttagggggtcatgctgttgatgggtgtggagaatttttgccgtctcctgcagcgaacccatctgacccaacttcactgaaatgtgctg

SEQ ID NO: 7696 - DNA, 639 bp, Lycopersicon esculentum
  misc_feature (591)..(591): n is a, c, g, or t
  Predicted polypeptide sequence is orthologous to G2989, G2990
caaaaaccaagatttttgttatctatagtcataaactctcatcatcatcaaaactcaaaatcccaaagaaaaacaaacccactttttttttttcttctctttcttaacatgctttttcttttcattttcttaatcatctaagttctaagagtgaggggaaaaaaagaaaaaagataagtagtagatgtgtttcaggtatggagttaaacataaacacaaacacaacagctgctattactaccgtgaaaacaccagaattagctgaaactgaaactccgagtcggatccagcaaccgaagcctttttcgttcagtaatggggttttgaaacggaaaaatcatcatcatcctgttgtggtggtgtacaaagaatgccttaaaaatcatgcggctaatttagggactcatgccgtggatggatgtggagaatttttgcctattccagctgcgaacccagctgatccaacttcactaaaatgtgctgcttgtggttgtcaccgcaattttcaccgccgtgaaccggaagaaccgccgcctatcgctaccgcggctattgagtaccaaccacatcaccgccatcatcctccgccgnctcgtggggaccacggtagcccgaattcaccatctccaccgccgattt

SEQ ID NO: 7697 - DNA, 382 bp, Lycopersicon esculentum
  Predicted polypeptide sequence is orthologous to G2993
ttttttttttttttttttttttttttttagctgaaaattttcagatgaataaaggttccaaagtacaacaattaataaaaataaaaatctaattaagtggttccatatagttacaataatactacatagacccccccaaaaaaaaaacaaaaaaaactagctacgtacgattcctagtaagattacataagcataaaccaaatcccaagaaatttaatttcattttttccctcaaaaccttaattaaacaaaattaattaaggttgatcttcttgtattatattttttttagcagaagaagggttcttattattatgcatccaaaccttaaaaacctgtctcttgactccaacttgtgagcaaaatctttgtacttcagcat

SEQ ID NO: 7698 - DNA, 672 bp, Lycopersicon esculentum
  misc_feature (672)..(672): n is a, c, g, or t
  Predicted polypeptide sequence is orthologous to G2996
tggagactgatctttttttgtttttcaacaacgaggaaaacagctccatggtctcactagatagaaataaggtcttatctgcatacattttatcatttttcatatcttatttgggagattatactgaatatattatcattgcaaccagcttatttacatacatagtgccccaaatacaaaataagtgcttaattactcaatatctaacattaatattaacaaaaatacctaaaaataatgggatctttttttttgtttgtttggttctagggttttttaccaagtgtatgcttgttgttatgcatccaaactttgaacacttgccttgtaattccagtctcattgcacaatggctgcaccaattcttcatcttccctttggatcctccaacctaatttatcacccaactcttgcattatatgcttctgaacttggctaaatttcgcccgaaaacgctatttcgaacctcccgctgaattcgggcgggaaatgagctactgaggctcacgatttcaccggaagtcgttttcacagctaccggccgttgtttggccccccgggtactgtaataccgccagtggcggtagggtctgagtacgtcgaagtgattttggggggtaacaaacgatcggttaccgccatccgctaggatgtgtaaaggcggggcatttn

SEQ ID NO: 7699 - DNA, 1059 bp, Lycopersicon esculentum
  Predicted polypeptide sequence is orthologous to G2998
ctccgattgaacaaacatcgccattcattaatttattaaagatgatattaaaaaattcaacatactttcaatttttcttggtcatgaatcttaaaaacaatttattgacgtttatttattttcacaaaaatctcaaaacaaatggagaataacagatgataggagattaaatttgaaagggaggtttttatttttgttatggtggccggggttactgggtagaggaatggataaaggaagaagaaaggttaaaaggttaggtgggggtggggattttcttttgttaatatttttgtgattaataaataaagggaaactatttttcatttttttaaattaaaaaattatattttattgctagattgggtccatgtgccaagtgtcataattttatttgtcatttttttaagtcaaagcgcgtgaactacacacaaaatatttttaaaaaaagttttcgttttatgttcaatagacacatattctttaatattaaagtgtctaataggtaatagtcttagttgaggtgtctaagtgaattatgcgaacaactttaaggggtcgcatatgcattaagccttgaattagtgtagtactatcctatctcatcaccaacccttcagtgttcccatatttttatcatatcttgatttatatgtcatctttcaaaattacattagcacccatctttcatttaaagtgaaagattagtcatgacaagagaatgaaaatcttgcacaagatgaaggttagtgatctgaataattttgttccttgttttgattgcttaagctatttttagatgcttaaccgtattactgaatgatacagggtatacatgtcaagtgtgtgtatgtatttgactggaagaaggcccattttgtgttgatctcaaggttttgtgtcgttggtcattgagttcttgttgaatttatatgatgaatcaacatcagtagaataaattagataatagcagcaagtctgtactgaattctctggtgtatgctattaaacatgagtgaaaataacctatttgtacagtaaaaaaaaaaaaaaaaaaaa

SEQ ID NO: 7700 - DNA, 642 bp, Lycopersicon esculentum
  Predicted polypeptide sequence is orthologous to G2998, G2999
cagaggccaagaaaaggatatgggcttgcctaatcccaatcccatgagttataacccatctcaacttaaccagcaagaatcatcttcctctgcagcaaacaagttccttaccgcaccaaatagaacaacaaatgaacatgagaataccatttttagccctaaccaaaccctagatcagcataatattactcaaaattcagatccagatccagttcgacaactatctactagttcagcaagtgagaggaatattacccccgtccggtacaaagaatgtctcaaaaatcatgctgcaaatttgggaggatatgtactagacggttgcggagaattcatgccaagcggagaagaggagacactagaatacctgaaatgtgcagcttgtgattgtcaccgcaattttcataggaaagagactgaggacgaatcacaaacacctggtgtgcatagaaataaccaccgtatacccaaccaaactccgccttctcttccagctgtgcctacgcagcaacaacaccatcataaataccctcacagctatccaagaggtcacatggcaccagtaatgatgagtttcggcgggaacacgggagttgcagctgaatcatcaagtgaagatctgaatatgtttcacggaggaca

SEQ ID NO: 7701 - DNA, 584 bp, Lycopersicon esculentum
  Predicted polypeptide sequence is orthologous to G2998
gggtcgtaggcctcagaatagctagccgtatccgtaggcgaccccgtacaactgaagctcctgctctgaacactctcccgttacgctggatgaggaagccgccgatttaaaggtgataccagaagcaagccgtaagttcaagcgcgcaaggtaatcaaaggagcactaggtacgcatcaaaaggacagaaggcgacgaactagggtataaataccgtatcggatagcaccccgaccaccggtatcgtactgataaacgcgccgtcgtgaagccgcccgattactctaagcaataaggacacaagccgccgactttccgtaacccactcctcccccggccgccgaataagctaccattacaccaccttctatcgcgtcgaagatccgcaatttccctaactaatccggccgtcgtacggaaaaccccgaatcacgtatactccaaaaagcgaccaacaaactacatctgcgggccgaaccggatttccccacctgcctgaaaaaaaaaaaaaaaaaaaaaaaaatctgagggggggtttggtatttaacctgtttcacagcgagctgcaccataacctatcggtt

SEQ ID NO: 7702 - DNA, 724 bp, Lycopersicon esculentum
  Predicted polypeptide sequence is orthologous to G3032
gctcctctctctcttccctcccgtctctcctcttcccgttcctctcctctctctcttcccctcccatctctcctcttcccgttcctatcctcttccctttccttttctctttgcaggtagcagcaaccggcgacagccaccacgcagcagcagccggcgacagccaccagcagctgcaacaaacagcgcacgcagcagcgaccaccggcgaaaccaggagcagcaacagcttcttcagcagcccagcgccacccgtctctcctctcttccccgtctctgcctccctcccccttcttttaccttttctctcttctattttttttaaaggaccagcagcagcttacatcggccagcagcagcagcgacaaaaactataaagcagcgacctcctatgtcgcgatatctccggtcaacgagcaaggcgaactccggatgaacccattgaaggctccaagttggtcgaaagacggatcttttaacagattcgtcaggtacattcttacagtttgttattttatctcttgaccaattcattatttaagttgtggtataacctttggtttaacaattatttgcaccgtttagtacatataaaaatcattttagtcttcaatttgaattgctagttagaatgacaaggttttttttttcatgtttgatttttttttgatactttgattgaatatagtcattctgttggctcagtggtttagttgatgcaaaa

SEQ ID NO: 7703 - DNA, 594 bp, Lycopersicon esculentum
  Predicted polypeptide sequence is orthologous to G3055
ctgaccaggcagtttgggctactgaggatgattataaagcctggaacagtggtccctattgtgaaaccccttccaattccagtcaggatggtaggcattcacaaaaccggtcaggcagtgagcctcccaacaagaagtcaaggaatgtgcaggattcagatgctcgcattatagtcaccagtagctctaaagcaatcggaaagatgttctttaaaacgaagttgtgttgtaagttccgtgccggtgtctgcccctatgttactaattgtaactttgctcatggaatagaggagcttcgcaaaccaccacctaattggcaagagatagtagctgcacatgaaaatgagcggggagtaatggtggaactgagagaagaacaccagataccaatattgagctctcctgatttacgtggagagtctcaaaggtccgctaaagggaggcactgcaagaagttctacactgaagagggatgtccttatggagatagttgcactttccttcatgatgaacaatcaaggtctagagagagtgttgcaataagtgtgactcctactgttggtggatttggaaataatgctactggagcaaccc

SEQ ID NO: 7704 - DNA, 644 bp, Lycopersicon esculentum
  Predicted polypeptide sequence is orthologous to G3060
gctctcttctccttcaccgataaaccctagaagtagggttagggttttagcttactgttttttttttcattcgtctacttctactgctttgcttagggttctgcaggccgtagttatatttttcttttgttttttgttttcagagtttttttttgttcatttgttcgaatctgagtgttttaagtagctatggatttccggaagagaagcaggaatggagctggttcgaacttcaatggaggtttgaagaaatcaaagccagaaatggactccttatcgggtggtataggaagtaaaacgaagccatgcacgaagtttttcagcattgctggctgcccattcggtgagagctgtcatttccttcatcacgtccctggtggctacaatgctgtggcccagatgatgaacttaggatcagctccagcatcaagaaatgtggctgcaccacccatgtccaatggaaatgctcctgctgtgaaaaccaaactttgcaacaaattcaacacagctgagggatgcaaatttggagacgcatgcaattttgctcacggggaatggcaaattggtaagccgattgtgccatcacaggaagatccacgtgccatgggtgttggacctgctcctagtcgttttggtgggcggac

SEQ ID NO: 7705 - DNA, 355 bp, Lycopersicon esculentum
  Predicted polypeptide sequence is orthologous to G3060
agagttttttccccagctcttttctcctgctctttgttgtttgattgtttcgtaattttggatcgtctttagatctgtgagttgcttgacatggaaatccgcaagagaaacaggaatgaatctggctttaatggcaatgctggtttcaaaaaggctaagccagaaatggactcactatcaagtggtataggaagcaaatcaaagccgtgcacaaagttcttcagcactgttggctgctcttttggtgagaactgccattttcttcattatgttcctggtggctataatgttgtggccaatatgatgaatattgcaccatctccagcatcacctattcccagtgggaatactcctg

SEQ ID NO: 7706 - DNA, 400 bp, Lycopersicon esculentum
  Predicted polypeptide sequence is orthologous to G3060
agatgatgaaattgacaccagctccatctttgagaaatgctgcagcaccgccttattccaatggaaatgctccttctttgaaaaccaaactttgcaacagattcagcacggcggagggatgcaaatttggagacaaatgcaattatgctcatggggagtgggaacttggaaagcctaccattccttcacaagaggatccacgtgcaatggggtttggatctatgccaggtcgttttggtggtgggcgggtggaatctgctgctagttttggtacatcagccactgcaaagatcagtgtagatgcttccctggctggagccatcattgggaagggtggagtgaattctaaacagatttgtaggcagacaggagccaagctggcaatccgtgatcatgaaac

SEQ ID NO: 7707 - DNA, 329 bp, Lycopersicon esculentum
  Predicted polypeptide sequence is orthologous to G3060
ctgctaagattagtgtagatgcatctcttgctggacgtattattggaaaaggtggcgtcaactcaaagcatatctgtcgtgtgactggagccaaattttccattagggataatgagtcagatcctaacttgaggaacatagaacttgaaggtacaattgatcagattgaacaagccagtcgaatggttcgcgagcttattcagagcgttacaacatctgcagcacccccgatgaagaacagcagctcctccgtaacaagtaactacaaaacaaaaatttgtgagaacttcaccaagagtacatgcacttttggagaaaagtgccacttt

SEQ ID NO: 7708 - DNA, 553 bp, Lycopersicon esculentum
  Predicted polypeptide sequence is orthologous to G3060
tgccactttgctcatggcgagatggagattgggaagcaagtgcgtccagcgtacgatgatttccaagccaaaggtcctccgagtgggttctcaggttaccttgaaccgtcccaacctggtctagctgctacaaactttggagcatctgcaacaactaccattagtgtagatgcatctcttgctggaaacatcatagggaagagtggtgtgaactcaaaacacatatgtctggttactggtgtcaagctctttataagggagcacgaaacggacactaacaaaagaaatgttgaactccaaggaacctttgatcagattaaccaggcgagagccatggtgagggagctcatatcgaatatcagtacacctacaggcgggctgaagaatgctgccccattttctcgaggtcctcctggcccacttaaaacaaagatgtgtgcgaatttttcaaaaggtttgtgcacatttggagagaaatgccattttgctcatgggcccagtgagttgcagaagccattgacttgatttcatggcattcatactgtgtattagc

SEQ ID NO: 7709 - DNA, 823 bp, Lycopersicon esculentum
  Predicted polypeptide sequence is orthologous to G3067
gctcttctttctcttttgcctcaagctttttttttcttcttcttcttcatgggtttctagttagattttctgaagtgactttaatttttttttgtaaagttttgatttttttttctctggcattttgaatgttgttttggggttgtcttcttgagagtaatgggtgttcactgttgttttctgatagctaaaaaaagggatttttactaacttttttggtgtttgtagttgggattttcttgaagtgagtttaatttgtgtaaagttttaatctttttcaaggcattttgaggaatgctgtgtggggtttgttttctgatagttaaaaaagaagcatttttcataagtagataatgtcagtcaagaatagaaagatatcttcttgactaacttttttgagtttcagggggggtggaaaaagatgatagctttaggaaagttcatttcttttagaaagttatctgagtataagtagaggaaaagttacatttttttagttatattgaagggttgttgaaaagatagaatcttgaaaatgggggagaagaagaatatgccagcagtttggtttactttaaagagatctttgcattgtaaatcagggccatcagatgttcatgacccaaaaacaagaaaagagttgagcacaattttgaccaaaaagggaggaggaaggtctggttgttcaaggtctatagcaaatcttaaagatgtaatccatggaagtaaaagacatttggataaaccacctagttgtagtcaagatctattggtagtagtgagtttattaatcaataactcatgaaagtattctgagtaattc

SEQ ID NO: 7710 - DNA, 478 bp, Lycopersicon esculentum
  misc_feature (466)..(466): n is a, c, g, or t
  Predicted polypeptide sequence is orthologous to G3067
ggaggaggagatttaaaaaaaaaatgccagcagtttggtttgctttaaagaaatcattgcagtgtagatcagagataaaagatgtgtatgatccaagaagtgaagggaaaaatttaagcaagatatcgacgaaaaaggcgacgacaggtaggtcaggttgttcaagatcaattgcaaatctgaaagatgttatacatggaagtaaaaggcatatggagaagccaccattacagagtccaagatctattggaagcagtgagcttttgaatccaattacacatgaagttgttttgagtaattcaacttgtgaactcaagattactagttgtaatttccaagatggtaatggtaatgggagtagtgggaataatgttgagagtatttctgcttttatgggtactttaaaaccagggacccctggccctggaggacaccatattggttcatcaaggaaatacagaggctntggtagtcctat

SEQ ID NO: 7711 - DNA, 1385 bp, Lycopersicon esculentum
  Predicted polypeptide sequence is orthologous to G3074
gtcaagtctaaaaaaataccttcgttttgcactttccccaaatcttctcctctctctctatctcacttcgaacaatgattgtcttcttctgattcttccaatttcagaaagaaatttgttcactagattctctaatttagtattttatatccttagattctctctatttttgaatggacagaatctgatttatcatgaggaagaaacttgatactcgctttcctgcggcccggatcaagaaaattatgcaagccgatgaggatgtcggtaagattgcaatggctgtgcctgttctagtgtcaaaagccttggagttatttttacaagacctttgtgaccggacatatgacataactcttagaagaggagcaaagactgttaattcactgcacttaaaacactgtgtacaaagctacaacgtgtttgactttcttcgggaagtggtcagcaaggttcctgattatggccattctgatgctgctggtgaaatgccaaaaagaaggaaagttgctatagaagaacatcatgacagtgaggatgaatacaaaaagagcaggacggagatgtctcctgttggcagtagtggtaggggaagaggtaggggtagaggaagaggtcgtggtcgggtaagccgtgctgataaggagctctcacgacctgatatgcaacttgaatcctgcacttctgctcagcagagtgttcaacaaaatccaaatcctggaactcagacagagaactgctcagaaccgaaagaatcacctacacaggattccactgtttgtgacaaagaaaactcagttgtaacaactcctaatctgaaggtcaatgtagatgataatactgataaaccagctgcaccggaaatagcaccctgcaatccatcaccaaggcctgtgaacgagaaagcagaggaaggccctcagtggtccctcgaaatggacagaatggtcattgaccctgctcatatgtcacaactgaatacaagtgtagcagaagaggaagaagattatgatgaagaagagtaggcagatgaaataacaaacaaatggcctatttgacatatgctatttattgattacagttgcctgtaggccttgacacaaagggcccttgtgatttattgacatattagtgtccgtctatttcttagttgtctttgtgactttaagtctttgtaatggtctctaacccttcccttttccactagtaataagtaggaagtgtgttcgttgctccaaccagcactccatgtatcaattactgtgtgaaattaggttaagtccattttgaatcttcactttttttattttataacctagaaatcgacgcggtagctgactaagtttcagtgtctattttacaaagcaaaaaaaaaaaaaaaaaaa

SEQ ID NO: 7712 - DNA, 478 bp, Lycopersicon esculentum
  Predicted polypeptide sequence is orthologous to G3074
ctttctgcaagatctttgtgaccgtacatacgagattaccctcaagaaaggagcaaaaacaatgaattctttccatttgaaacattgtatccagagctttaatgtgtttgatttcctgaaggatgtagtgagtcgggttcctgatctaggcgggtcagatgctggtgctgaatcggccaccaaaaggaggaaagttgctgaagaagatgatcatgacagtgatgatgataccaaaaggaatcatgcgaatgagactgcaaacaacagtggtactggaagaggacgaggtaggggtaggggtagaggccgtggaagaggttcacgagcagtagagaaaggtgactaccatgctcacagtgagaaactggaagacgctgctgctgatgtttcacatcaaaaggatgatgagaaccaaaaacaaaatgatgaaagaatggtagactatgtagcagaatcagcagtagattcaaagaacatt

SEQ ID NO: 7713 - DNA, 545 bp, Lycopersicon esculentum
  Predicted polypeptide sequence is orthologous to G309
gcttcggctcacaggaattcgtggccactctcagcctgaggacactaccgatgccttacaagaagttggtcgggagctcgcccaacttgcagagtcaacaggtgtagaatttgagtttcgtggattcgtggtccatactttagctgatcttgaagcaccaatgttgaatattagacccagtaatgtggaatcagtggccgtgaactctgttttcaagcttcaccgtctgttttccattccaggagcaattgagaaagtgctggatttgataaaacaaatagacccgaagattgtgaccattgctgaacgtgaagtgaatcacaatgagactgtttttatgaacaggattaaggaagcatggtattactattcaacaatgtttgatttgctggagaactcagagtggactaagcgcagcactatagacttggagattgcggcagagcacctagggagggagatctataatttggtggcttgtgaagggactaagcgagtagtgagacacgagacgtttggtcaatggcgagtgaggtttaattctg

SEQ ID NO: 7714 - DNA, 417 bp, Lycopersicon esculentum
  Predicted polypeptide sequence is orthologous to G309
gggtcatggaaaagcagtgcctagatgtaatggtgtcagagatctataatttggtggcttgcgaagggactaagcgaattgtgagacgtgggactctgggtcaatggcaagtgaggatctactctgcagggttcaacctggttcccctgacttcagatacttacaaacagggagctatgttattggcctctttcccaaatgcagagggatataaagtagaagtgaaagatgggtctcttatgctgagctggaatagtctccctctcatagccaactccacttggcggctatgtagccaagtctagggagtctggtcaatggctgaggttgctcggcagctgtcctggaatagcttgctgctctgcaactgtcctgcatcatccagtacgtagttttatatgtcaactaactcagagc

SEQ ID NO: 7715 - DNA, 870 bp, Lycopersicon esculentum
  misc_feature (847)..(847): n is a, c, g, or t
  Predicted polypeptide sequence is orthologous to G3111
ctcaaccacaccattgtcctctttcttctatattgttcaatttttattatgactcgtccttctagatttctgcttagcaccaactcatcttcaacgccggcggcggagccaccgtcgacggtgacagtggagtctgatttcgttgtaatactagctgcgttgctctgtgcgctgatttgtgtagtaggactcatcgccgtcgcgagatgtgcgtggctccggcgaggaatcggggccggcgggaacggtggtagtcaaccgtcggcgaataaaggattgaagaagaaagtgttgcaatcgttgcctaaattcacctacgatccaagtagtacggcgaacggtgcggcgttcacggcggagtgtgcgatttgtttggcggaatacgccgtcggagatgagatccgtgtgctgccgcagtgtggacatagttttcatcttcagtgtattgatacttggctgggctcacactcttcatgtccttcttgtcgtcaaattctcgtcgttgctcggtgccggaagtgcggtgagttcccggcagtttcctgtaaatccgacggagctccggttacaactccggccgagtctcgttcatgcggtacatctactagctcaaataatttcttggtctagcgtaacaataaaaaagaggcattagttttttaagttatatactctgacaaatcggtgtaaacgataaatgtaatttacaccgtcagtgcagttttacctgtggtaacatgtcagttactgtgttgatgcaggttagggtaaagttacatgtaattaatcttaaattacatcgttgaaatgatgtgtgcaaattttcttttaatctagtgaaagatgncataaaaaaaaaaaaaaaaaaaa

SEQ ID NO: 7716 - DNA, 633 bp, Lycopersicon esculentum
  Predicted polypeptide sequence is orthologous to G3111
gagagagagagagaactagtctcgagttttgtttctctcttttaattaagctccgacacattcctcatgagtaattctgatccatcaccgtcgcctccgtcgccgtctgcaaccaccgggatcggtaaagtcgattctgacttcgtcgtcatcctcgccgccctcctctgtgcgctcatttgcgtcctcggacttgtcgctgttgctcgctgcgcctggatccgaaggatctccgccagagcaaccggaaattccgttttttcgtcacctccagctaataaaggtttgaagaagaaggttctcaagtcgcttccgaagttcagttactcagctgaacacgccgcgaaattctctgaatgtgcaatttgtttagcggaattcgcagtcggagatgaaatccgagtgctaccgcagtgcggccatggatttcatgtaggatgcatcgatacctggttaggctcgcactcgtcctgtccttcttgccgacagattttagtagtgacgagatgtcataagtgcggcgagttgccggtagcaagctcctcctcgtcagctcccgtagctgaacccgaaagccgattaccttgaaattatcatgtaaatgcatttctacccgtaaaattaagctgggtg

SEQ ID NO: 7717 - DNA, 560 bp, Lycopersicon esculentum
  Predicted polypeptide sequence is orthologous to G326
gttcacaaagatattttcacattccaaccctaaaaaatagaaaggggattttggtagtcttctctgtccattctcatttctggatatatcttagaacaacaatcatcaagattcactagtactttgaattgtgataatgagtcccggggaaagccgtccctgtgatttctgcaatcagcagattgccgacctttactgcccttctggtacagctgagctatgtctctgttgcaaccatagtgttcattcagctaacgctctttctaagaagcatcttcgttctcagatctgtgataattgtggctctgaacctgtttctattcgttgtgataccgacaaacttgtactctgtcaagaatgtgattgggatgctcatggaagttgtgcagtttctggtgcacacgatcggagtcctgttgaagggttttctggatgtccttctgcttctgaccttgcttcaacttggggtttggatattgaattcaaaaaaactacatcagcagcattcccgttttggagtatccttcttggatgtctaaagatgctccttcttctgtttt

SEQ ID NO: 7718 - DNA, 833 bp, Lycopersicon esculentum
  Predicted polypeptide sequence is orthologous to G328
gcagtgctccaactacaagttttttacaacacaaaatagagagaaagaaaagagaaaactaaagttagtccaatgttgaaaaaagagaacagtaacaattgggcaagggtgtgtgacagttgccattccgcaacatgtaccgtttactgtcgggcggattccgcctatttgtgtgcgggctgtgatgcccgcattcatacagcaagtctcatggcttctcgccacgagcgtgtatgggtttgcgaagcctgcgagcgtgcccctgcagcctttctttgcaaagcggatgctgcctcgctttgtgcctcttgcgacgctgacattcactctgcaaaccccttggcacgtcgtcaccaccgtgtcccaattatgcccattccaggaaccatttatggtcctccagctgttcacaccattaccggtggttctatgatgattggtgggaccacaggggaaggcaccgaggatgatggattcttgagtttgaatcaagatgcagatgatacaaccatagatgaagaagatgaagatgaagcagcttcatggttgttgttgaatcctcctgttaagaataacaataagaataacaactatgggatgttgtttggtggagaagtagtggatgattacttggatcttgcagagtatggaggggacagtcaatttaacgaccagtacagtgttaatcagcagcaacaacattactctgttcctcagaagagctatgttgaagatagtgttgtgccagttcagaacggacagcgaaaatctctgattctttaccaaacgccacaacaaccaccaagtcaccacctgaattttcagcttggaat

SEQ ID NO: 7719 - DNA, 669 bp, Lycopersicon esculentum
  Predicted polypeptide sequence is orthologous to G328
tgcaggaattcggcacgaggctggaatggtaataattgggatacggttgtgacgatgtgccaaggggttggcataagggatgtcatcatcgcaggaggcacaaagtgaggcagcatccgccttgcaaagaaaggctgcaggggcacgctcgcaggcctcacaaacccacacacgcttgtgacgagaagtcaccagacttgctgcatgtatgcgggcgtcacagtctgcacacaaataggcagaatccgcctggcagtaaatggtacagaaatagatacataaagtcctaaggatctgaaagggcctcacacccacaacaaactgagaaatttgtgagctttgtaaaaagtgctgagtttcaggctttcagcgaatggaagagaagaaataggtactaaagtgtcatggatcaagagggacctcaaacttgaaaggtttagccaggctctattgacttctgtggaacaacttcaatgttcttgctgagatagaatctactcttttcacctttatgaattgctccatgatgaattgcttggctcttatgagctgcggaaaaagtgctgatgttcagcaaatggtatggcataaatagattgctaaagtacccatggaatcagagggacctgatccaacttgaaaggctcaggaataactcaaacaatctga

SEQ ID NO: 7720 - DNA, 1423 bp, Lycopersicon esculentum
  Predicted polypeptide sequence is orthologous to G351
attaaaacttgtagtttatttatttttacacgaatttaatttggtcagccttattaacacaaacatttggtaaataaaactacaatggctgctgataaccctggacaaattattaactttatttgactccaaaccacagtatatataaattgacaatttttttaattcttttttttgtatttgttcaaggaatctgaacatcagtttcataaatagagccaggtttccaataatctggaatcacagttttgtctgagttaatccatttggtctattcacataatatttttttttaacactctcgataactctgaacgaacaatttgaattaaattgatatcgaaatggctcttgaagctttgaattctccaactggtactacttcaaatccgcaaacgtttcaatttgagagcaaaggccagcagcagcttcggtaccttgagaattggactaaagggaagagatctaagaggtcacggagtatggatcgtcaaccgactgaagaggaatatttggcgctttgtttgattatgcttgcaaggagcgatggctctgttaatcacgtacggtctctaccaccgccggtgccagtgatgaaaattcacgagacggcggagaagatgttgtataggtgttcggtttgtggtaagggattcggatcttatcaagctttaggaggacataaagctagtcaccggaaactcatcgccggcggagatgatcagtcgactacctctactactacgaacgctaacggaactacaagctccggtaacggtaacggtaacggtagtggaactggaaggactcacgagtgttcgatttgtcacaagtgttttccgactgggcaagctttgggaggacacaaacggtgtcactacgacggtggtaacagtaacggtaacggaaatgctaacgctaacagtagcattagcgctagcgtcggagttacgtcgtcggagggcgtgggttcaacaatcagccaccgtgattttgacttgaacattccggcgttgccggaattctggcctggatttggttccggcgaagatgaggtggagagtccacatccggcgaagaaatctcggctatctctacctccaaaatttgaattattccaacattaatgtgactttaattgctaggatttacgaaatttgtagacaaattatatgtaattttttcttttcattgtgggtgggatcaaaattttaaattatatatgtatataggacctagctagctatagtgaaaattcaattgattgattaatttttcttggaattactttgttcacttgcactttggtttctttaataaaaacatataagttttagctaatcacactttaataataattttttgtttaattcaaattcatgtaatataaaaaaagttttctgttaaaaaaaaaaaaaaaaaa

SEQ ID NO: 7721 - DNA, 1212 bp, Lycopersicon esculentum
  Predicted polypeptide sequence is orthologous to G351
gcaacttccaattctccaaaccctaaccccttatatatatcacacacttctctttcagtcctaattcactcaactttcatctcaattttactctctctctctgtatatctttgtacttttattctcgatgtcgattgaagctttgaagtcacccatggcggcgaagctgtcacccacggtggcggagctaccaccgcttgaagagattgatgatgattcacataatttggattcgtgggcgaaaggtaaacgatcgaaacgaccacgtattgaaaatccaccaactagagatcagtatttagcgctctgtttactcatgctcgctaacgatgacggtactggattcgggaaaggaaaaggaaacggaaccggttcgattggtgttgaacaaacggagaaaaaaccggccgagttgaagccggtttttattgaagagaaaacagagcaattactgaagccggttgttgataaagaaaaaacagagcaattactgaagccggttgttgttaaagaaaaaacagagcaattattcaggtgtagcgagtgtcctaaagtttttacttcttatcaagcacttggtgggcataaagcaagtcaccgtaaaattaacgttcccgccaccggagacgatgatagcaatccgtcgacgtctacttccactagcggcggcggcgttaatatctctgctctgaatccgagtggccgttctcacgtgtgctctatttgtcaaaaggcttttccaactggacaagctttgggtggacacaaacgccgccactacgaaggaaaactcggcggtaacaatcgttatatcggcggtggcggagaaggcggaggcgttcatagtggaagcgttgtgactacatcagacggcggaagcggcaacggcggcggcggcgcgtcgactccgattgcgcgtgactttgacctaaacatgcctgcctcgccgggatggcaattggatctgacaatcgactgcggaggtagaactcaacatccgattgaacaagaagtggaaagtccaatgcctgctaagaagccgcgtttatttttcgagtgaaaatttgattgaattctgttttaagtcaaattagttaattggttttacatgtgatgatattattttaatatatacattttagggaaaaaaaagtaaaaacattgataagtactactttttattattattattattatggatagaagcaaaca

SEQ ID NO: 7722 - DNA, 628 bp, Lycopersicon esculentum; identical to SEQ ID NO: 7299
  Predicted polypeptide sequence is orthologous to G351

SEQ ID NO: 7723 - DNA, 668 bp, Lycopersicon esculentum
  Predicted polypeptide sequence is orthologous to G354
attcaaactcagtatacgattatcgaaagcatcttatttgtatcaactcttcataatgataaaaattagagaagacaagggtgaagtggaagcacaagcaatggctaactgcttaatgcttttatcatccatagatcgagatcgtcgtaattcatttgaatgtaaaacctgcaaaagacgcttctcatctttccaagcgcttggtggccatcgaacgagtcataaatcaacgattgatatcggaaaatttcttcacggtaaaatatccaaaaaacgcaaggtacatgaatgtttaatttgtggaatggagttttctatgggtcaggctttaggtggacatatgaggcgtcaccgtgccccagtaaatgaaattgaacattcggccaaaaggataccagttttgaagaaatcgaatagcaacgagagaatattttgcgtggatcttaatttaactcctgatgagaatgatgactttcacttttggcctatgccacctgtacctccattcttatcctcttaggacttggctagaactataaatatcattcattttaattcttgtgggtagattcacaaattttgttatctatttaccttaattgatcggatttctttattgatgagtatatttattcacaataaattttattaaaaaaaaaaaaaaaaaa

SEQ ID NO: 7724 - DNA, 731 bp, Lycopersicon esculentum
  Predicted polypeptide sequence is orthologous to G354
aaaaaataaaaaaaaatctcaaaaattgcaaaaaaaaatcatggtggttttaccaatgaaaagagaaagagaaggagaattcgatataacaaccatggcaaattacttgatgttattttcacgtcaagaaaatcatttcaacactatggtaaacaactctcctagtcgagttttcgagtgcaagacttgtaatagacaattttcatcgtttcaagcactaggtggtcatcgagcaagtcataaaaagccgagattaatgggagaaatgaattttcatttgccgatttcaccgcctaagccaaaaacacatgagtgttcaatttgtggacttgaatttcctattggacaatctttaggtggacatatgagaagacatagaggtatgttaaatgaaaataataataataataatcaagttcctaatcacgatgttatgaagaaatcatcaaataatccaagagttttgtgtttggatttgaacttaacaccattggaaaatgatttagagttcaagttgaagaaggcaaatcctatagttgattgctttttgtgatcaatcaataatattggatcggatcgcgaatctacgataggagttctacgagttcaaagttatcaatccaatcatttacatatgctgaactcgctgattcaaaattctgaattcatatcgatatatttttgcacatatatatctaaaacatctagatgtttcattattttaatttttt

SEQ ID NO: 7725 - DNA, 715 bp, Lycopersicon esculentum
  Predicted polypeptide sequence is orthologous to G363
tgatcttatctcctcttcttctttttttcttctttctgttatcttttgtaattctgcctcaccatatttagtaaaaaactaaaaacacacacacaaaggaggagaagaacaacaagtcttgtcatatcattgaaaaattcatcaataaaattaaaaaagagaaaaaagcatgaagccaccgaatttcaatcttgaatcggaagacgagtccgaagtcagcagcagccaagttgcctccaacacttctgcccaagaaatttctcctgatccttacaaggataacacgaccaattcgtcctgtctgacaaactctctcaatcttcagcaggagtcgaaagccgttacacttgacttgactcttggcttcaacagcggtgctgataccgagtcgaagggcaatcccgaggctggcagtgaagtagtgcctcatcctccagctgcacaagtatcgaggatattctcgtgcaacttttgtaggcgcaagttttatagttcacaagctttgggaggacatcaaaatgcacataagagggagagaactctagcaaagagggcgatgcggatgggaatgctatcagagaggtacgctagcttggcatcgctcccccttcacggatccccatatcgatcacttggcatcgaagctcatgcctccgtacatcaacgtgcctctcaacaacaagaaaggcatatgcatgctattagaggcggggca

SEQ ID NO: 7726 - DNA, 505 bp, Lycopersicon esculentum
  Predicted polypeptide sequence is orthologous to G363
tttttttctcattctctctctatatctaatgatcttatctcctcttcttctttttttcttctttctgttatcttttgtaattctgcctcaccatatttagtaaaaaactaaaaacacacacacaaaggaggagaagaacaacaagtcttgtcatatcattgaaaaattcatcaataaaattaaaaaagagaaaaaaggttagtcaaggactggaagtcatcaccgctcagttatttttcgacttgttgttatctaagtatcaaatttgcactgcgttttttcgggagcagcatgaagccaccgaatttcaatcttgaatcggaagacgagtccgaagtcagcagcagccaagttgcctccaacacttctgcccaagaaatttctcctgatccttacaaggataacacgaccaattcgtcctgtctgacaaactctctcaatcttcagcaggagtcgaaagccgttacacttgacttgactcttggcttcaacagcggtgctgata

SEQ ID NO: 7727 - DNA, 515 bp, Lycopersicon esculentum
  Predicted polypeptide sequence is orthologous to G385
cgagaaggtattcaagatgtttaatagccaccagcacttgctcgatatatcgtcctcagctcaacgaacacctgataacgagttggatttcattcgtgatgaagagtttgatagcaactctggtgctgataacatggaagctcccaattcaggtgatgacgatcaagctgatccaaaccaacctccaaacaagaagaagcgttatcatcgccacactcagaatcagattcaggaaatggagtccttttacaaggaatgcaatcatccagatgacaagcaaaggaaggaattgggaagaagacttggtttggagccattacaagtgaaattttggttccagaacaagcgtactcagatgaaggctcaacatgagcgatgtgagaacacacagttgaggaatgaaaatgagaagcttcgcgctgagaacataaggtacaaagaagctttgagtaatgcagcatgcccaaattgtggagggccagcagctataggagagatgtcatttgatgagcatc

SEQ ID NO: 7728 - DNA, 1366 bp, Lycopersicon esculentum
  Predicted polypeptide sequence is orthologous to G4
gagagaactagttcgagttttttttttttttttttttttttttttttttttatgaaaacaaggatacatacttacatatatcaaacgagtaaattttgaataaattaatacaacacatatatagtcttttagtttggtgataaacgtaaacgcaggcgcaaacttcactcaaatgaagcgttatttacaaaacttagcaagggaagatgtgtatgcagcttagtaggcacctcccattaaagaaggtacatcatcgaaggaccaaaggtccatggcgtttccaccatcctgaattgcacttgtattgaggaaggcatcaaccgatgcatcccaatttccctcgagatatgggatctgcaagaacttcatctgggattcaaaagccgatagctcttcagatagcgtgttcacagtgttaccgtcaactgtcaatgaagtgctggaacaggacttcagttttttctctggtctggaatcatcatcaaaatgagtctcattggtttccagaacttccgacagaacagatgagatctctggagtccttgcacacggttcagggtttcctcacgaagtgccttttggggattttgcttaatagcacgtcttgaaacagacactggagcttcatcaggaaagttcaccttagctttcttgcctctgatccttcgcgcctcagcatcataagctctggctgcctcttcggctgaattgaaagtaccaagccagactcgaatacctttccttggatcacgtatttcagctgcccacttaccccaaggacgctgtctgatcccccggtactgattcttcctctttctcttggaggatctgtcagcttcgcagtttgaatcaccagatctcacggatttggggcctttagaatttaaaaagaattaaccatctcagttagtcataaatgaccaaaatttggaacaatcaatcagataaattgacaaacagataccatgaaagtgagaaacatagaatacgcacgaaaagcaggttcttttatatcactagtactaaagattaccaaaatcaatttatttgaaagttatctatcagtgatcaaaactaaggtaaccaaaatcaatttattcgaaagttatctatcagtgatcataactaaggagagaaatcaagatcaaaatacatgcaaaaatatgttctctgctgttatttacgccaaattatttctctttagctatcaacatcacgtagcacattctccggagataaaaagtttatcatccagagaatcagagttcatcatctagaaaatctgctatatgaatgaccatatcacagtcaaattgagttcaaattaggaaactatgatccaaaaatctctgactcttttgggggc

SEQ ID NO: 7729 - DNA, 1226 bp, Lycopersicon esculentum
  Predicted polypeptide sequence is orthologous to G4
gttttctcttcaaattgagctttttctccattaaaattctctctgcaaatttatagtttttcttttttcactttttgagaagaaatcaaaagctatgtgtggtggtgcaattatctccgatttggtacctcctagccggatttctcgccggttaaccgctgattttctatggggtacatccgatctgaacaagaagaagaagaaccctagtaattaccactcaaagcccttgaggtctaagtttattgaccttgaagatgaatttgaagctgactttcagcacttcaaggataattctgatgatgatgatgatgtgaaggcatttggccccaaatccgtgagatctggtgattcaaactgcgaagctgacagatcctccaagagaaagaggaagaatcagtaccgggggatcagacagcgtccttggggtaagtgggcagctgaaatacgtgatccaaggaaaggtattcgagtctggcttggtactttcaattcagccgaagaggcagccagagcttatgatgctgaggcgcgaaggatcagaggcaagaaagctaaggtgaactttcctgatgaagctccagtgtctgtttcaagacgtgctattaagcaaaatccccaaaaggcacttcgtgaggaaaccctgaacacagttcagcccaacatgacttatattagtaacttggatggtggatctgatgattcgttcagttttttcgaagagaaaccagcaaccaagcagtacggcttcgagaatgtgtcttttactgctgtagatatgggactgggctcagtttccccttcagctggtacaaatgtttacttcagctctgatgaagcaagtaacacttttgactgctctgatttcggttgggctgaaccgtgtgcaaggactccagagatctcatctgttctgtcggaagttctggaaaccaatgagactcattttgatgatgattccagaccagagaaaaaactgaagtcctgttccagcacttcattgacagttgacggtaacactgtgaacacgctatctgaagagctatcggcttttgaatcccagatgaagttcttgcagatcccatatctcgagggaaattgggatgcatcggttgatgccttcctcaatacaagtgcaattcaggatggtggaaacgccatggacctttggtccttcgatgatgtaccttctttaatgggaggtgcctactaagctgcatacacat

SEQ ID NO: 7730 - DNA, 1330 bp, Lycopersicon esculentum
  Predicted polypeptide sequence is orthologous to G4
gcaattatacattttccgtcaaaacataaatcatgtgtggtggttctataatctccgattacatagaccctagccggacttctcgccggctcaccgccgagtttctatggggtcgtttcgatctcggtaagaagcaaaaaaatcccaacaattatcactctaaagctaagcatttgcgatctgaagttgttgacgactttgaagccgattttcaggacttcaaagagttatccgatgatgaggatgttcaagtcgatgtcaagccatttgccttctctgcttccaaacactctactggttccaaatctttgaaaactgttgattcagacaaggatgctgctgctgataaatcctctaagagaaagaggaagaatcaatatagagggatcagacagagaccttggggtaagtgggcagctgaaatacgtgacccaaggaaaggggttcgggtctggctgggaaccttcaatactgcagaagaagctgccaaagcttatgatattgaggcgaggaggatcagaggcaagaaggctaaggtaaactttcctgatgaagctcccgcccctgcatcaagacacactgttaaggtgaatcctcagaaggtccttcctgaggagagcctgtattcacttcagtccgactcagcaatcatgaacagcgtggaggatgaccattatgattcttttggattttttgaagagaaacccatgacaaaacagtatggatatgagaatgggagcagtgcttctgcagatacgggatttggttcgttcgtcccttcagctggcggtgatatctacttcaactctgatgtaggaagcaactcttttgaatgctctgattttggttggggagagccatgctccaggactccagagatatcatctgttctgtcagctgctattgaatgtaatgaagctcaatttgttgaagatgccaattctcagaaaaagttgaaatcatgcaccaacaaccccgtagctgatgatggaaacaccgttactatggtacctgaagagcttccagcttttgaacctcagatgaatttctttcatctcccatatatggagggaaattgggatgcatcaggtggtaacttcctcaacacaagtgcaactcaaaatggtggtgaaaatgctatggacctgtggtcctttgatgatgttccttctttaatgggaggtatcttttaagtcaacatgccttgagttttgtaaataaggcttcatgtgagtgattttttgctgttgtataatgtacttagtgcaaatatttgatatgttaatttgatctccgttaacttgttaaaaaaaaaaaaaaaaaaaaaaaa

SEQ ID NO: 7731 - DNA, 613 bp, Lycopersicon esculentum
  Predicted polypeptide sequence is orthologous to G4
ttttttttttttttttttgaaatattaaagcattttgaaccatcaattatcatccacattgatgcaaaatttggaaacttcagcttgttgtcaacagttgttaataaactaattacccacctattggtctatacaaccaaaacagctactcagtacaccatccatggaatcctaaacatgcttgaatggttgtcaacttgtcatcctcctccttaacacagacaccttatcttcacatgaagcccttatttacacagaatctgcaggtaacacatttctcagatgcctcccattaaagaagaaagctcatcaaaggaccaaaggtccatagcattttcaacaccctgagtagcatcagcatcgaggaaggcatcgactggtacatccatatttccttctgagtatggtgtctgatagaacttcaactgggattcaaaagttgaaaatacttcaggtggcttgtgttcagtgttcacattattaggcaccaaattgttggtacaagattttggtttctcctccaggtcgacaccttcaataaattgagcttcatcgcattctatagcagctgacagaacagatgatatgtctggagtccttgaacatgtttctc

SEQ ID NO: 7732 - DNA, 677 bp, Lycopersicon esculentum
  Predicted polypeptide sequence is orthologous to G4
ttttgacagtacttttcacttctcatcggtaccggaaaaagcatgtgtggtggtgccataatctccgattggataccgccgtctcgatcttcgagccgactcaccgccgaccagttatggggttgcgccgatctgcaaaacaagaagaggaacaagaagaagaggaatccttccaattatcactctaagcgcttgagatctgagaatgtagactttgaagctgattttcaggattttaaggatttttctgatgatgaagaagcttatagtttggatatcaaaccatttgctttctctgcttctgaactctctggaacctctgctggatccgaatcactgatatctgttgatgcaaacaaggaagttgagaaatctgccaagagacagaggaagaatcagtatagggggatcagaaagcgtccttggggtaagtgggcagctgaaatacgtgatccacagaagggggtccgagtttggattggaacttttaatactgcagaagaagctgccagagcttatgatgctgaagctcggaggatcagaggcaataaagctaaagtaaactttccagatgaagcttcagtgcctgcctcgaggcaagctggtaaggtgaatcctcggaaggttctttctgatgagagctctaacccaattccacccaacaccatgcttatgaa

SEQ ID NO: 7733 - DNA, 778 bp, Lycopersicon esculentum
  Predicted polypeptide sequence is orthologous to G4
ctccattaaaattctctctgcaaatttatagtttttcttttttcactttttgagaagaaatcaaaagctatgtgtggtggtgcaattatctccgatttggtacctcctagccggatttctcgccggttaaccgctgattttctatggggtacatccgatctgaacaagaagaagaagaaccctagtaattaccactcaaagcccttgaggtctaagtttattgaccttgaagatgaatttgaagctgactttcagcacttcaaggataattctgatgatgatgatgatgtgaaggcatttggtaatttctcctctcatctgttctttttttcagcttctagtaggtaggagttccttttagcttttgaaattgttaccatgattttctgaaagtgtgttttttatttgcgtgtctaaatacgtttcatgctctaaaaatcacctcgaaatgatttgattcaatgatattaggaaggatttttggtctgacctaacaagcttgagttggttaatgtggtatggttcatttgtagaacttaatttagttttaagtagtattttggtgttgaatatactgatttaggtgatttggggtttataatcgcggtttcgattgatttttcccctttttagtatgtgaatatacatttaagaggagaaaaaagataacttttgggtataagatgtttgcgaattgtaaaatgaagagtaagatgctgttgttcttcctaattggtcgagaaatgatattttagggcacagcgcatcctaagtaatt

SEQ ID NO: 7734 - DNA, 602 bp, Lycopersicon esculentum
  Predicted polypeptide sequence is orthologous to G4
caaaacataaatcatgtgtggtggttctataatctccgattacatagaccctagccggacttctcgccggctcaccgccgagtttctatggggtcgtttcgatctcggacttcaaagagttatccgatgatgaggatgttcaagtcgatgtcaagccatttgccttctctgcttccaaacactctactgacaaggatgctgctgctgataaatcctctaagagaaagaggaagaatcaatatagagggatcagacagagaccttggggtaagtgggcagctgaaatacgtgacccaaggaaaggggttcgggtctggctgggaaccttcaatactgcagaagaagctgccaaagcttatgatattgaggcgaggaggatcagaggcaagaaggctaaggtaaactttcctgatgaagctcccgcccctgcatcaagacacactgttaaggtgaatcctcagaaggtccttcctgaggagagcctgtattcacttcagtccgactcagcaatcatgaacagcgtggaggatgaccattatgattcttttggattttttgaagagaaacccatgacaaaacagtatggatatgagaatgggagc

SEQ ID NO: 7735 - DNA, 1597 bp, Lycopersicon esculentum
  Predicted polypeptide sequence is orthologous to G409
ggtcacatctcttctctgctccaacacaccctctttgctctgctttattcccaaaaaaaaataaatcaacaaaatttctgtttttggttctggaacttggctatcttttttttttggttcataatcatatccttgtattgaatttgtaagcaagggtgatgatgtttatggtgatcggcagtaggtgctctcacacttcccacatcactgaaatcataatcacaagcttctttcgccacaagctatagatctttactaattccatatagtatatagttttaatacaagaaaacaatatatatatatatatatatattaaaggggggtatttatcaagaaccccaaattcttaattacataacgaaacgagcggatatgggtgtttcttgaaaagatctctgttttataatttaaaaaaatttgtctgtagaattcgaagctatgatggctccagggattctctacggtggttcttctaatttcgatggcgtttttactcaaaaacagagagacgtgttttcttcatctactgcaccgaaagggcatcttggttccctttttgcccctgcctcttcttcttctaatttcttgggatccagttctatggtgagttttcgcggtgttaatggagggaagagatcattctttgattcgttcgatcaggatgacaatgaagctgatgaattgggggaatatcttcatcaagcggagaagaagaggcgacttactgacaaccaagttcagtttcttgagaagagttttggggaagagaacaaacttgaaccagaaagaaaagttcagcttgctaaagaacttggtctgcagcctcgccaaattgcaatttggtttcagaatcgtcgtgcgcgatggaagactaagcagctcgagaaagattatgatgaattgaggaatagatacgatactctgaaatcaaattacaataatcttctcaaggaaaaagaagatcttcgaactgaagttttccgtctcaccggtaagctgtttatcaaagagaaaggaaatgggcaattggatttgcgcgatgaacacaaacactccaatgcattggcaaaagaaaccgtggttgatccaatgtccaatgtaccagctctggttgttaagcaccagcaggaagatttaagctctgctaagagtgatgttttcgactcagaaagcccacgttacaccggtagaatgcattcctcagtcgtagatcaggatgattctgctcgcgcatttgaaactgatcagtcggattcatctcaggatgatgatgaaaacttcagcaagaatatgctttctactgccaacctacttggcaaagacgcggatgatgattatcccgcgacatcatcaaatttgagttactttggatttccagttgaagaccaaggttttggtttctggacttattaagttaaaaaaaatgtttgtatttgattagtagtaatgcagaatactatttaatgtgtcctagtaatatgtcatatatttggagacattgtatagaaagcacatttctgtaataaataaagtccaagaacagtaatgagttctggtcacaaaacagtttggaactaaaaaaaaaaaaaaaaaa

SEQ ID NO: 7736 - DNA, 1009 bp, Lycopersicon esculentum
  Predicted polypeptide sequence is orthologous to G409
cttatttcctctttcatctacttatgcatactcattttcttcactcaattttttaactcttttttttttcttggataatggcactgacccttcttcattctccccttaattatcacataaaaattttccaaatttcaagattcaatcaaaaaaccccatttcccactgcttaaacaaaccccacatagtttttttgttttcacaattcttgcaccttagagaacttaagggttgaaagtaaaataaatatggaagttggaagggttattaatgaaaaactttctcattgtctctggatgtccaattcttccccatcttttcatggttctgtatcaatggttaatttcgaagatgttggtcgaggagaagtgtctaaagagaggtcatttttcccaggaattgacaaagaagaaactagcaatgatgattatgatagctgttatcatcagccagagaagaagagaagacttttgcctaatcaagttcagtttcttgagaagagttttgaggtagataacaagcttgaaccagagaggaaagttcaattggctaatgaacttggcttgcagcctagacaaattgctatttggtttcaaaataggcgcgctcgatacaaaactaaagtacttgagaaggattatgatgctttgaaagctagctttgataagcttaaagctgattatgacacccttttcaaagagaacgaggatttgagaaatgaggtccatttgcttacacaaaaattgcatataagggagaaaggaaaggaaaactcagagcaaagtgaaccaattagtccaatagacacacaagaggctcaaaaagcaacaactccaattgttgttacctcaaatgtaccaaagttaatgtgcaaacaagaagatgcaacatcagcaaaaagtgatgttattgattcagatagcccacattacactgatgggaatcattcatcaaatgtatttgaacaagagccatctgatttttctcgagatgaagatgacaacctaag

SEQ ID NO: 7737 - DNA, 1452 bp, Lycopersicon esculentum
  Predicted polypeptide sequence is orthologous to G409
gtacaaaacagcacatatatatagagacaaaatcacataatacgccctcgccggaatcttattttcactgtcgccggccgttaaaactttttttttctagttcggaggtcaaataattaacctccgatcggaagaagtagttattctaactgcttctatttaatctgaaaacgggaaaacccctgagctggttaaggtggatttcgtgatgggattttgtatttgtcctttggaaactcctgctagattactgtggagtactagtttcttccgccacaagcttatgctcttctaaaacttagtcaactctcttttttcatacacatccctgctaaaaaagaagaactctgtgctggagtttttgttttcctttttctgtttcgccggaaacatataaataatcttctgtgtgtaaataggcgattttccagatagttgaaaatatgggatctgggcatatatttttcgacccgtcgtcgtgtcacggcaacatgctgttccttgggagcggagatcctgttttccgaggaccaagatcgacgatgatgaagatggaggactcctcgaagaggcgacccttctttagctcgccggaggatctatatgacgaggaatactacgacgagcagtcaccggagaagaagcgccgtctcactcctgagcaggtgcacttgttggagaagagctttgagacagaaaacaagctggagcccgagcgcaaaacccagctggccaaaaagctggggctgcagcccagacaggtggctgtatggttccaaaaccgccgtgcccggtggaagaccaagcagctcgagagggattatgatcagctcaaatcctcttatgactcccttctctctgattttgactccgttcgcaaagataacgataagctcaaatctgaggttgtttcattgatggaaaagttacaggggaaagtggttggaggagcagggggaaatgaaaaatctgacatcttggaggtggatgctatgacgatccttcaagtgaaggtgaaggctgaggaccggttgagcagtggcagtggtgggagcgcggtggtagatgagcatagtccacagctggtggacagtggggactcatattttcacactgatcatgaggagtatccagggcctggaggatgcaatgttcctccacccatggatggtttacaatcggaggaagatgatggtagtgatgatcatggcagttgccatggctacttctctaacgtctttgtggcagaagagcagcaccatgaacaaggagaagagcctattggatggttctggtcttaattgaattttagaatattatattacagtttttcttatctacgcgcgctttgtatgatgaaataagtgtcgtaattccaacttcttatttaaacatctattaatatgcttttgcagcttttattctcttaaaaaaaaaaaaaaaaaaaaactc

SEQ ID NO: 7738 - DNA, 964 bp, Lycopersicon esculentum
  Predicted polypeptide sequence is orthologous to G409
ttccttgtctacttctacttctttttctcaatattaaatgtgatcctcatttatagtactcatcacaaactttcttagtaacaattcaatagtccaatttttcctattcttgatcctcctctcaactccaaataccaaaaaaataaaatttagaggataaaaaatggaggtagcaagagttcatgaaggttctaacaatggctttatacttccaaatgaaattcttcctcctacttctaattggatatctaattcttcctccattttccatggctctgtatcgatggtaaatttcgatcaagatcgagtacagaagtctaaaaagaggtcatttttagcacaacttgatcaagacgacagtagtagcaatgatgacaattacaattatcatcaccaaagtgaaaagaaaagacgattgttaccaaaacaagttgagtatcttgagaaaagtttcgaggtagaaaacaagcttgaacctgaaaggaaagtacaattagctaaagaaactggattgcagcctagacaagttgctatttggtttcaaaatcgacgagcacgatgcaaaacgaaacaaattgagaaggattatgatgtccttaaagctagctttgatgaattgaagactcaatatgattgtctcttcaaagagaatggaagcttgagaaatgaggtacatttactcaaagagaagttgatcaacagagtaaaagggaaggaaattttagaatttattagtccacttgatcatgtagaacctcaaaatccttctattggagttgattcaaatttagcaatggtgaagtgcaagcaagaagatgcaaaaagtgatgttcttgattcggacagtccgcgttttactgacggagattacacttcatatttggagcctgctgattcttcaaatgtatttcagacagaacactctaatttttctcgagaaatgacacattatgcttgccaaaac

SEQ ID NO: 7739 - DNA, 712 bp, Lycopersicon esculentum
  Predicted polypeptide sequence is orthologous to G428
cttcccccaactaattactagtaacatagaagagtctggtctggtctttatcacctttttaaattttaaaagtaaaaatataattaaagtagctgtctagctagggcctttttccaggtgtcgatctatatatatatttttatttgggtttaaagaaacgtattccatatatatatatatatatatataccgctgagataacaactagagatttttaattgttcacatactgttttgatgatggatgaattgagcaaacttcattctgctattgtttgttcacacagtagacgacaacaagaggttgaggttgaggctgaggccgggccgacaattattaataacactactactagttttgctgctgttcatcatcattattgtcaattagaagcagcggttgctgctgatcataatcatcatcaaaataatactaaatccaccaccaatatgtcagatcttattaaagctcagattgctaatcatcctctttatcccaacttactttctgcttaccttcaatgtcgtaaggttggagcaccgcaagaaatgacatcaattctcgatgaaattagcaaagagaacaacttaatatccagctcacgtcacagtagtgaaattggagctgatccagaacttgatgagtttatggaatcatattgtgcggtactagtgaatacaaagaagagttttcaaaaccgtttgatgaagc

SEQ ID NO: 7740 - DNA, 521 bp, Lycopersicon esculentum
  Predicted polypeptide sequence is orthologous to G435
ttcatttaaaatgtcacaagaaaagactcaaccaagatcaaatgaggctcttagagattagcttcagctcgaataacaagcttgattccgatagaaaatttcaacttgcccaagaactagggttgccacctaggcaaatcgcaatatggtatcaaaacaagcgagcacgatggaaaagtcaaagccttgaggttgactataagaccttgcaacaaagactagataatgcccttgaggataatgagaagttgaaattggaagttgagaggctaagaaaagagctaaacaaaaatcaagaagtgttgttgggattcaacaccacaactactaataattattcatcaatttcaagttcttgtgatgaagttgggagtacttcatgtttgcaacttcatgatcaatccaagcataatcatcttgataaggatttttatgcttgtttaattggtgatgaaggtcactttgggacacatgatgggcataatttctttgcttcatctttgtcttgataagctacatat

SEQ ID NO: 7741 - DNA, 1034 bp, Lycopersicon esculentum
  Predicted polypeptide sequence is orthologous to G450
tttttttttttttttgttactattaactatacttatattatttttgcattttctctctcaatatttttctctctctctctctataatatttgcattgtactactactactacatattgaagaaaaaagagtttgatttttgatggatttgaaagaaactgagttgtgtttgggactacctggtggtggtggtggcggaggtgaattaattcgcgataataataataataataacaaggttaatgggaaaagagggttttctgagactgttgatttgaagctcaattttcatcaagctagtgatgatatttcttgtgctatggagaataataagatgaagagcagtgttactactactaaagaagttgtttgtaacaaagatccaatcaagccacctgccaaggcacaagttgtgggttggccaccagtgagatcatttaggaagaatgtaatggctcaaaagagcaacactgaagaaagtgagaagactactgctgcatttgtcaaagtttgcatggatggtgcaccttacctacgtaaggttgatttgaaaatgtacaaaagttaccaagaactttctgatgctttggctaagatgtttagctcctttactaatggaaattatgggtcccaaggaatgatagattttatgaatgagagcaaattgatggatctccttaacagttctgaatatgtaccaacctatgaagataaagatggagattggatgcttgttggagatgtaccttgggagatgtttgttgattcatgcaagcgtttacgcataatgaaaggatcagaagctattggacttgcaccaagagctatggagaaatgcaagagcaggatctaaggcaattgatggtgtgcaagctccatagataatgcttgaagttgaaggttttgtgagattaatatattgttgttttcatgtgcttgtatttttaattttaattagtatatagttattaattaaagaagtggtctttaatttggacaatatttgtaatgaacatgatgcaataaacttaaaac

SEQ ID NO: 7742 - DNA, 702 bp, Lycopersicon esculentum
  Predicted polypeptide sequence is orthologous to G450
gagcactatccatacattattaatcccaaaactttgtgtgagtacatctctctctctattttcaatttccataaaccattgcccatatagtattattaatttgtatagtggagaagaaaaacaagtaatggacttgaaaactgagttatgtttggggctgcctggtggtggaggagatcacaatattaagaaaagaggattttctcaaactgttgatctcaaactcaacctccatcataatgataatattccttctatgaacatcaacaatcctccaaaggataattcctccaacaagccaccaactaaggctcaagtggtggggtggccaccagtaagatctttcagaaagaacatgttgtctcaaaaagggaataataataataataataatgaagaaattagtgagaaggatgaaaaaacaatagcatttgtgaaggtttccatggatggtgcaccttaccttcgtaaggtagatttaaagatgtacaagagttaccaacaactctctcattctttgaccaacatgtttagctccttcactatgggtaattatgggtcccaaggaatgatagattttatgaatgagaggaaactgatggatgtcctcaatagttctgactatgtaccaacctatgaagataaggatggggattggatgcttgttggagatgtaccttggcaaatgtttgttgattcatg

SEQ ID NO: 7743 - DNA, 900 bp, Lycopersicon esculentum
  Predicted polypeptide sequence is orthologous to G450
ttttttttttttttttttacaaataaaaatacaaatacagtattaataaaatcaatcgtcttcactcacacgggaagcatcgtagcacaaaatacacttctaagtaattgcctaattatatattacttatcctataattaaagaacgcaaaaggtaaaaataaaaaaacttattcactcaagccagttggtatctgtacatgcagttattaagcttctttatttagcttcaactcgacgatctcccaggtgttcttggagctaatcctatagcctccgtgctcttcatcaatctaattctcttacacgtatcaacaaacattttccatggaacatctcctacaagcatccagtctccatctttatcttcataagtaggtacatattctacaccatttgtaaggtccataagcttgctttcactttgagaattacagattgttaggcaagtaaacatgttttctaaagcattcaacaacttctggtaactgtcgtacatctccagatctacttttctcaagtaaggagctccgtcaactgctaccttcacgtatttgcacttttctatcacgttttttctgtatgatctcaccggcggccatccaattacttgtgcctttgctggaggtttgtttccggtagagatttcgtttttcgagtgattaacttcgcagatatcacggcggcgttcaccggaagttgagcttcctaggcttaattccataccgtcggaatttccacgttttgcaccggagatttgcttccgcgattcgccgggtaagccgagagttagctcagtttcattgaaattaaggccggaattatttgtttccgtcaaaccgttcgctgatttggctgtctccgatgacattttccccctttttagatagtttggtgaaat

SEQ ID NO: 7744 - DNA, 438 bp, Lycopersicon esculentum
  Predicted polypeptide sequence is orthologous to G450
gagagaactagtctcgagttttttttttttttttttacaaagaaacttttataaacaaaagtgagaccatttacattttctttcacaagccttggagactcaagcagtaacaatacagaaaaaaaaaagaacaacatactactatggctataaattggaatacttttgcatatattatgaatatatatgtaacacaaatagttatactaaagatttccaagacagaaacactcgaaatcctggcgtcgatcttcaaatccacagatttggtgatctaccttaacatgaataggaagaaacatgtgaatttcgacttctcattgcttatagagaattgattgaatgtttgcagcgaaagtactgcagattctaacgatctttgcacttctccgcccctcttggagctagaccatttgcatctgaactcttcatgatccc

SEQ ID NO: 7745 - DNA, 531 bp, Lycopersicon esculentum
  Predicted polypeptide sequence is orthologous to G450
gcagaattaaagctagggttgcctggtggagcaagaaaaaatgtttatggtgataatgatacttgtaatgttaatggtaaaagaagctttgtagatttgaagcttaatctttcttctgatattaacaacatcaagaattcaacacacaaaaccccagctgccaaggcacaagttgtgggttggccgcccgtaaagtcctttcgaaagaatattttgacttctcaaaagcttgatcgagagaatgataatattttggtgaaggtgagcatggatggtgcaccttaccttaagaaagtggacttaaacatgtacaagagttatcaagaattatttgatgccttaaccaagatgttcaattccttcactattgtccaaggaatgaaagatttcatgcatgaggggaaactgatggaccttttgaatagttctgattatgttcctacctatgaagacaaagatggtgattggatgcttgttggagatgtcccatgggggatgtttgttgattcttgcaaacgcttgcgcatcatg

SEQ ID NO: 7746 - DNA, 723 bp, Lycopersicon esculentum; identical to SEQ ID NO: 7315
  Predicted polypeptide sequence is orthologous to G450

SEQ ID NO: 7747 - DNA, 1106 bp, Lycopersicon esculentum
  Predicted polypeptide sequence is orthologous to G451
tctatatacagctctcttatttcactttctccttatatattacagcaagctaccatttagcatcttcaaaccaatcttggagaagaaaaatcatcagttttggagaaggaaacttgaattgcaatccaattttgtgaaaaagaaaaatggagtgtgttttggctcatgagaaagatttgaatctcaaggcaacagagcttagattgggtttaccagggaggacagatgaagaatctgacaaagaaattgtatttcatttcaagaataacaagagggctttgcctgaggatgaagattgtgaatcaaactccatttcagatcccaaaactccacctgttgccaagacacaaatagtagggtggccaccagtaagagctaacaggaaaaatagctttccatcaaagaaagcagaagctgaatgtgggatgtatgtgaaagttagtatggatggagccccttatcttagaaaaattgatctgaaattgtacaagggttatccagaactgttgaaggcattagagaaaatgttcaagctgagtatcggtgaatattcagaaagggaagggtataaagggtctgaatttgctcctgcttatgaagataaagatggtgacttgatgcttgttggagatgttccttttgaaatgttcttatcatcatgtaagaggctaaggataatgaaaggatcagaagcaagaggattaggatgtggagtttgagaagaagaataataacaagattatgaattcttctctgttttaaacaggaaaaaaaaaggggtctttttgagcttgggttgtcgaattgcaaagaagctggaaatttgttttacactgattgggaagtgcaaaacagaagaaagagcagtttttgttttgaaggggttgaaaaaaatgaaactcttattcctatatgttgtgcaggcttttagaaaccatggtggtttttatagatcctgcagtgtgttaaatagcatatgaagtatgaagaatgtatttgctctgaaagcaattgtatagacacagtattctcaaatgtaatgagtttttttcctttgtactacttttaatctacgggttttaacacaaaaaaaaaaaaaaaaaaaa

SEQ ID NO: 7748 - DNA, 814 bp, Lycopersicon esculentum
  Predicted polypeptide sequence is orthologous to G451
acaacttcttctgagatagtaaataaaggagcaatcttgatcaagaaagtgtttaaagaatttctgtgtgtgtgtgttttgagatttgaggatttcatttggtgttttgggtatttcaagattcaatttttaattttttttggaggagagaaagaaaatgacaagtatagtgggcaatcagaaagatctgaatttcaaagccactgagctgagattaggtttgcctggtacagaagatcaagaatctgaccaagaaatatcaaattccaagaataacaacaaaagggctttacctgaatcaactcatgatgaagaagattgtgaatctaagtcaagttctgatcatgtcaaaaccccaccacctgttgccaaggcacaaattgtgggttggccaccagtgagatctaacaggaaaaacatcatccaaccaaagaaaacagaatctgaatctggaatgtatgtcaaagttagcatggatggtgccccttatctaagaaaaattgatctgaaaatgtataaatgttatcaagaactactaaaagccttagaaaacatgttcaaactcaccataggtgaatactcagaaagagaaggctataaaggctctgaatttgcccctgcttatgaagacaaagatggtgatttgatgcttgttggtgatgttccttgggaaatgtttatgtcttcttgtaagaggctgagaataatgaaaggatcagaagcaagaggcttgggatgtggagtttaacttataaattataaaaattcccaaatagaatattatgatgatgaagaagttttttttcctcttttt

SEQ ID NO: 7749 - DNA, 729 bp, Lycopersicon esculentum
  Predicted polypeptide sequence is orthologous to G451
gattcaaatcaatcattctttctaaatcatgagaatttacgagaaggatatcaatgatcttgaggcaactgagctaagattaggtttgcctgggataataaacgatgaatcttcaacatcaactagtacttctaaaaatagcagaaaaagaccttcatctagtagtgtaaatgaaaatgaacaacaagactcagctcctgcaccaaaagcacaagttgttggttggccaccagttcgatcatacaggaaaaatcatgtgtctaaattatcagaatctgataataattcctcaggaatgtatttaaaagttagcatggatggagcaccttatttgaggaaaattgatcttcaggtttacaaaagttatcaagagctactcaaggctttacaaagcatgttcaagtgcactattggagtgtattcagaaagagaaggatataatggatctgattatgcaccaacatatgaagacaaggatggtgattggatgcttgttggtgatgtaccatgggagatgtttataagttcttgcaaaaggcttagaattatcaaaggatctgaagctaaaggtctagcatgtctataaaaacatggaaatatatataaacatacatacaaatctgctagggatgaacaagtttcagttttgtaaactatctcgatcttctattagtttcacgggatatatagatctagatctacatgtacaaatagttttatccttctttt

SEQ ID NO: 7750 - DNA, 384 bp, Lycopersicon esculentum
  Predicted polypeptide sequence is orthologous to G451
tcaagaataacaagagggctttgcctgaggatgaagattgtgaatcaaactccatttcagatcccaaaactccacctgttgccaagacacaaatagtagggtggccaccagtaagagctaacaggaaaaatagctttccatcaaagaaagcagaagctgaatgtgggatgtatgtgaaagttagtatggatggagccccttatcttagaaaaattgatctgaaattgtacaagggttatccagaactgttgaaggcattagagaaaatgttcaagctgagtatcggtgaatattcagaaagggaagggtataaagggtctgaatttgctcctgcttatgaagataaagatggtgacttgatgcttgttggagatgttccttttg

SEQ ID NO: 7751 - DNA, 1165 bp, Lycopersicon esculentum
  Predicted polypeptide sequence is orthologous to G489, G714
ctttgattgaacgctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgtcgatcaagctctgtatgcccagcagccccgcccatatatggcacagccaatttggccccagcagcagcaaccaccctcagattcttaagcagctcaaagcttagattacaggaatccagaagctaggagcagtgagtagtctgagtagcgaagtactggagaacacatagcagtctgcatactttgaactttattttaatatatatcgacatgaagcactagttattaaaagtcgagtgttcccttagtgtagctaaaactttacaccatgagcttgatgttcttggtgatgtttatgaacaaatatgtttttaagtgtgtgatttaaaagtaaaacctgttgtaggtatattatgggtttgaaaaacgtgtaataaaagaacactcaaga

SEQ ID NO: 7752 - DNA, 603 bp, Lycopersicon esculentum
  Predicted polypeptide sequence is orthologous to G489, G714
ctttgattgaaccctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccaggtattggagtcgttactagctcagctccaatatatggtgctccataccaagctaaccaaatggcagggccctctcctcctgcagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatg

SEQ ID NO: 7753 - DNA, 1366 bp, Lycopersicon esculentum
  Predicted polypeptide sequence is orthologous to G519
ctctagccacgtgtccctttcaccttctctatatttgcttctcctcctctgttttctacgtttcaactttcaaaaacacctctttctctctgtgtaattacaaaaacaaattaaatcaattctttttcttgaagacaaagtaatggtggaattgcaatttcctgctggatttcgattccatccaactgatgaagagcttgtgatgcattatttatgtcgaaaatgcgacgcacagccaattgctgttccgattatagctgaaattgatctctacaagtacaatccatgggatctacctgatttggctttgtatggtgagaaagagtggtatttcttttcgccgagagatcggaagtatccgaacggttcacggccgaaccgagctgcggggagtggatactggaaggcgacgggtgcggataagccgattggtcgtccaaagtcgatgggaattaagaaagctttggtgttttacgcaggaaaagctccgaagggagaaaaaacaaattggattatgcacgaatatcgacttgctcatgttgatcgatctgctcgtaacaaaaacaacagcctaagactcgatgattgggttttatgtcgaatctacaataagaaaggtacaattgagaagaatcaactgaatatccgaaaaatgaacggtgaaatgtcgccggcggtgagtgaaggtgatgtaaagcctgagatcgtgccgatttcagtttcaacaaacccatcttcgacgtcttatcacgtttacaatgacttcacgtactttaattcaccagattctcttacgaaacttcacgccgattccagctgctcggagcacgtaccttcgccggagttcacatatgagaaggaagttcagagtgagccgaagccgaaaccgagtgagtgggaaaaaactgcccttgattttccatttaattacacagatgccactgcttctgagttgcagagttgttatgagatgtcaccgctacaagatatattcatgtatctgcaaaagccgttttgagtgggcctcgcattgttgttcgcacgtgcgaatgagactgaagtcgatgacttggcacgtgccgatgatttgtaggaattgaaatattagtatttttgggttttttcatttgctttcacattagctatttttttttgttttggagaaaaaaaagcatatttggtcgtatatagttttattttttcgaagaaggaagaaaaattagtagaaaacaaagttgtgaaatgatatatttattggatttattagaatacttgtggaagttttggattagtactcataatttcatgtatgtatatgatttagaggtattacaaatgagctcaattagattttcttaaaaaaaaa

SEQ ID NO: 7754 - DNA, 1200 bp, Lycopersicon esculentum
  Predicted polypeptide sequence is orthologous to G519
ttttcctattccttcaattctattcaaagaattcagaaaactctgtctttagactgaaataagaaatttatatttaaaagaaaaagaaaaaatgacagcagctgaattgcagttacctccaggattcagatttcatccaactgatgaagaacttgtgacgcattatttatgcagaaaatgcacttcacagccaattgctgtaccaattgtagcagaaattgatctctacaagtttgatccatgggatcttcctgatttggcattgtatggagaaaaggagtggtacttcttttcacctcgagatcggaagtatccgaatggttcacgacctaatcgagctgctggaactggatattggaaggctactggtgcggataagccgattggaaatccgaaagcggtgggaattaagaaagcattggtgttttattctggtaaagcacctaaaggagagaaaactaattggatcatgcatgaatatcgtctagctgatgttgatcgatctgctcggaagaataacaatagcttaaggctggacgattgggttctatgtagaatttacaacaaaaagggatcgattgagaagaacaggaaaatgaacactacctgctacatggataaagttggatctccagaagatcggaagccggagattctaccaccgctacctccacatcctcagccgcagcaattgcacaacgatttcttctacctgccgtccgattcagttccgaagatgcactccgattcaagctgctcggaacacgtgctctcacccgaattcacatgtgaaagagaagtgcagagtgagccgaaactgacagattgggagaaagctaccctcgatcttccatttaattacatggatgccactaccggcgccacaacggtggataatagcttgttaggttctcagtttcagagcagttatcagatgtcgccgctgcaggatatgttcatgcacctgcacaagcctttttgagtggggccaccaatggattattttcagccgcaagtgtcaaacgagactttaacgtccgtgactttgcacgtgccgccgtagtagaataataggagtagcatcttctgcgttcacattggcaaattgtgaaaacaacatttgtacatgtagtagatgatggggaaaaaaaatattattattagcaattaaaataaaattgcaaatatgaaaaaaaaaaa

SEQ ID NO: 7755 - DNA, 541 bp, Lycopersicon esculentum
  Predicted polypeptide sequence is orthologous to G519
ctgaaactaacacaaagcaggagcaggagcagcaacaaacagagagaagaaaacagaggaagataagaggaaaatttatcgaattcgaatcgagagaaaaggggaagtgaagttgcgaagagtgagaatttcaaaggaaatgaacaaaggagcaaacggaaatcagcaattggagttaccggcgggattcagattccatccgacagacgacgaattggtgcagcactatctctgcaggaaatgcgccggacagtcgattgctgtatcaattatagctgaaattgatctttacaagtttgatccatggcagttgcctgagaaggctttgtacggtgaaaaagagtggtattttttctcaccaagggatagaaaatatccgaacggttcacggccgaaccgagcagcaggaaccggttattggaaggcaaccggagctgataaaccggtgggaaaacccaaaaccttagggataaagaaggcacttgtgttctatgccggaaaagcacccagaggtataaaaacaaattggattatgcacgag

SEQ ID NO: 7756 - DNA, 931 bp, Lycopersicon esculentum
  Predicted polypeptide sequence is orthologous to G519
gtccttcttcagctttaattttttattttcggagatgagattcaagattcgagtaatatagtatggtaaaattactgagtttacgtgaactatactcacatctctaatagtgatatctcctaagatttacaatgtttcaaatgaaaaatagtggaagatttcactttaattatcaacaattaggtgtggcacccatttaacatatagtaataagtaaaataaaatggtcattatattctgtaacttatgagtgcaaaatacaatttgtaaattgtttattgattatgtgatttgacattattgcagcttgatgattgggtattgtgtcgaatatacaacaagaaaggcacacttgagaagcattacaatgtggacaacaaggaaactacaagctttggagaatttgatgaagaaataaaaccaaaaatattgcccacacaattagcaccgatgccaccacggcctcgatcgacaccagcaaacgactacttttatttcgagtcatcagagtcgatgactagaatgcacacgacaaactcgagctctggctcagagcatgtcttgtcgccatgtgacaaggaggttcagagcgcgcccaaatgggacgaagaccacagaaacacccttgattttcagctaaactatttggatggtttactaaatgaaccatttgaaacccaaatgcagcagcaaatttgcaactttgaccagttcaacaatttccaagacatgttcctatacatgcaaaaaccttactaaaattgtataaattcattggatctaaattgagtgtgatccatgacattttctttgttctttggtggggtaggtcaactttttattaagtagtttagagaagtacaaaatgctagtcaaatttggtgggctacagcacaaatgagccttgataagcatagccaaagagtcgtat

SEQ ID NO: 7757 - DNA, 816 bp, Lycopersicon esculentum
  Predicted polypeptide sequence is orthologous to G519
ggagatcgatccgatcgcacctccaccgacgggaatggaagggcgccggggccgcggtacgatgtacaagcacgctcgagtttttttttttttttattaaataatatacacttagtattaaaaaactttcatatatacatacatatatcccctaattgagacaatcaaactttccccgaccacttatgcttttttttctccaaaacaaaaaaaaatagctaatgtgaaagcaagtgaaaaaacccaaaattactaatatttcaattcctacaaatcatcggcacgtgccaagtcatcgacttcagggtaattcgcacgggcgaacaacaatgcgaggcccactcaaaacggcttgtgcagatacatgaatatatctgggagcggagacatcgaataacaagcttgcgcctcagaagcaggggcatctgtgtaattaaatggaaaataagggcagttttttcccactcactcggtttcggcttcggctcactctgaacttccttctcatatgtgaactccggcgaaggtacgtgctccgagcagctggaatcggcgtgaagtttcgtaagagaatctggggaataaagtacgtgagtcattgaaacgtgaaagacgtcaagatgggtttgtgaactgaatcggacgacttagcttacaaccttactaccgcgcgcattaccgtattttggaatagtgatctttaatgacctctatggatcaataacccacatggctagcgtgttgacagcgggtaaaggagggatcggcaacatgtttttctgggttcggaaaacagttaacaggatgcgcaggtcc

SEQ ID NO: 7758 - DNA, 726 bp, Lycopersicon esculentum
  Predicted polypeptide sequence is orthologous to G522
gatttcatccaacagaggaagaacttgttggatactacctcaagagaaagattaattcactcaagattgatcttgatgtcatcactgatattgatctttatagaatggagccatgggacatccaagataggtgtaaactgggatatgaagaagaaagtgaatggtattttttcagccacaaggacaggaaatatccaacaggaactcgaacgaatcgcgcgacgggggccggattctggaaggcaacaggaagagataaagcagtgttatcaaaggagaaaataatagggatgagaaaaacacttgttttctatagaggaagagctcctaatggaaggaaaagtgattggatcatgcatgaatatcgtctccaaacttctcaacatggacctcctcaggaagaaggatgggtagtatgtagggcattcaagaagccaagtccatcaaacaacaattattatatgagaggaaccaacacaagttattcaactagaccacctccatccctttcacaaatgccaagttattatattactaatattaatcctctcaaccaaacatcaaatttcaatcatcaattccctttaaatcatcaaatctcaagccaaaataatattggttatgacaataatcaactactaattcatgaactcccacaacttgatagccctactaccatttcaacaagtttggctacaaatgatcatcaaagccaaaattccatca

SEQ ID NO: 7759 - DNA, 1326 bp, Lycopersicon esculentum
  Predicted polypeptide sequence is orthologous to G525
gaaagtatagagagagaaagccatcaagaaagaagtagatcggaacgctagcttttccagctttgatctatttcatcatctgtctaccatgcgtcctctgtctccgtcagcttcacctccaggcttgatgagttcctgtgggactgatggtgaaatctttttggtcctccaccagattaaccgtggatcgcccatccctgatgatttgattgagtttaatccctatcagtatgatccttcaaatttgccagatggagcatggttcctagtgagaaaaactgaggaaaaatcgacggaatatggactctggagagtgaaagattcagcctgtgaaatttttgcaaattctgatatcagtggttggagaaccacttatgaattttttcaagtccaagcctctatcgagcagaaaactgtctatataatgcatgagtataaagtaacaccgaaagggcagcgtgatctgaccaagtcacaggagtcttcaatttgtagattttttggtttgtggaatgatgcagagcacgacgatgtacgtcacctattgagctattttagctttatcccatcagttaacccagacactagcggtaacgatgggcaacgttcaattgctgaaccccaggtaaacggacagatagaaggggctgggtcatcactcgttgacaaatggatagatcagtctgagatagattgcattatgcgaggggactacctggaattgaatgaccttattgatggagcatcacatgattcgtctagttcagagaatacaagtcgccagagcttcgtatctgatgaatttttcaactctcgggcacttcttgcggaactagatgatgagaagaaggaagatttgagtggaaaaggttcacttcttgcagaactgaatgatgagaagaaggaagatttgagtggaaaaggttcaaccagcaatcatcataccataatgatgtgtcaaatagcaaatgatgtagttgtgcagcctggacctttagggtttgtatttatagggaatgatgctaaagccaaagaaactcaacaaactcctgataatcacaaatcgaaatctcaagatcaggctgttaagaaaatgaaggtggctaagaaactgaaggatgaaggtccatcacatgctcgtagagccacaacatcatccagcagcagcaacagcagcagtgatgaacctggacgtgcagctcgaagggaggagaaacgttcaaagaagctaatgaagttcctgtgttttatgcctttctagtttctacatacttgttgtttcaactcttactagtatagttttaaccaaaaaaaaaaaaaaaaaac

SEQ ID NO: 7760 - DNA, 680 bp, Lycopersicon esculentum
  Predicted polypeptide sequence is orthologous to G525
attatttcttgttgtttttttgaacggttaggtaattaacgacctgattattttttaaaaaaaagatcataaaaaagggtgtgtaggttgtttttgatgatgatggagaatttttctgcaagtgttaagatggatgatcaacagcagatggaacttccgccgggatttcgctttcatcctacagatgaagagctaattactcattatttgtctaagaaagtggttgatatgaatttctctgctattgctattggagatgttgacatgaacaaaattgaaccttgggagcttccatggaaggcgaaaattggggaaaaagaatggtactttttttgtgtgagagacaagaagtatccaactggtttgaggacaaacagggcaactgctgcaggttactggaaagctacaggaaaagacaaggagatttttagaggaagatctcttgttgggatgaagaaaactttggttttttacagaggaagggctccaagaggtgaaaaaacaaattgggtaactcatgaatatagattagaaggaagattatcactaaacaatcttcctaaaacagtaaagaatgattgggtgatttgcagagtatttcaaaaaacaactggtggaaaaaaaattcacatttcagggcttgtgagagctaattctgatgaaaatgaaatggtcaatac

SEQ ID NO: 7761 - DNA, 618 bp, Lycopersicon esculentum
  Predicted polypeptide sequence is orthologous to G525
gaattcaggagggaaaaagatagcaatctcaaatcttacgagaagcgatagtataacagataattcaaggtcttcaaatttgccaccattaatggacttgtcaccatacaacaagattacaacaacagcgagaagtagtggagagacatgtaattcacatgtgacgtgtttctccgattcaatggaggatcaaaaacctcaaacttatgatcatcatcatcttctatcaagttcccctgtttcagtcgatttcccccaaaacgtaccgaacgattcgatgacctacatgggaaatttccagtatggagattctggattgatgcaagataattcgattatgaggcttttgatagataacaattatgggtcagaatcaaaacaaagtttgagaggttacgaagatcatgacatcaatatcagttcaactggcccagtggacatcgattgtctatggaattattgatataaacatttagtgagggacttggaaaaaaatgcattagaaatagaaatgggaagaattgaatgtgggacacaggaattatgttaattattctcagatattgttttacatcatttgcaccagtactacatatctgttgtgtataaattcgtctc

SEQ ID NO: 7762 - DNA, 503 bp, Lycopersicon esculentum
  Predicted polypeptide sequence is orthologous to G559
agttagacatcagcatagccagtccatggatggttcaactacaatcaagccagagatgctcatgtcaggagtggaagagccttcttgaggtgaaactaagaaagccacgtcagctgcaaagcttgctgaacttgctcttattgatcctaaacgtgccaagcggatttgggccaacaggcagtcagctgcaagatcaaaggaaaggaaaatgagatatatagcagagcttgagagaaaagttcagactctgcaaacggaagcaactactttatctactcagttgaccctattgcagagagatacaaacggcctgaatgctgaaaacagtgaacttaaactgcgtttacaaacaatggaacaacaggttcacttgcaagatgcgttgaatgatgctttaaaggaggagatacagcatctgaaagtgctaactgggcaaggcatagcaaatggtggacctatgatgaacttcccagcaacctttggaggcaatcagcagttctact

SEQ ID NO: 7763 - DNA, 544 bp, Lycopersicon esculentum
  Predicted polypeptide sequence is orthologous to G559
ggtttgtatggataaggataagtcttcttcaagccatataggaggttcgttgcctccatcagggagatactcattattttcacctcccggtagtagctccaatgtaaagtcagaacaacctggattagcaaatttacctcccttaggacctggaaatgcttcagaatcaggtcattttggtcatggtttgtcggcagattcaagcctgtttagtcttgatataagccgaatgtctgataacccaccaagaaaatttggtcataggcgtgcccactcagaaattcttactcttcctgatgatattagctttgatagtgatcttggcgttgttggactagatggaccgcctctgtcagatgagactgaggaggacatcttgtcaatgtaccttgacatggataagttcaattcttcaactctgacttctgaattccaagcgggtgagtcttcttcagctgctccaggttcatcacaaacaacagcaatggcttcaggaacaaataaatctgctcctactgttagtgagaagccaagagttagacat

SEQ ID NO: 7764 - DNA, 506 bp, Lycopersicon esculentum
  Predicted polypeptide sequence is orthologous to G559
gtgagagagatataagtgattgatgtccaaaaaaactaccaccaacaatattggtaacatgaagaaaatcatgttgatagttgacaaaatgacatatgcatagaatgggatttgaacaatttcaactaaaagtcaaatgaccctacaaaagtactaaaatgcagatgaaggagctaactgaaagcaagagaacctgagctagatgttgtttcaacacgtgatgattttgaaacacaaaaatgagctgctagatgggaaaacacatgatgatttttaaaacatacaccatctcctgtctctctggccatcagctgttcaatcctttgctacagaactaacatcagaagcgttttcattttgaggagatgacagagaacctcttgacatcacatctccggcttgtgaaagttgatcttgcagctggactgcctgttggcccaaatccgcttggcacgtttaggaatcataagagcaagttcagcaagctttgcagctgacgtggcttt

SEQ ID NO: 7765 - DNA, 823 bp, Lycopersicon esculentum
  Predicted polypeptide sequence is orthologous to G562
ggttgccttggcgctcctcctctttcttccccctttcagtttctctctctactatcttttgctcacgccacacgccctttctctgttctttttttgaagttccttttagagagagaaaacatacacagagaatgcacaaacactgaaacttttcactactaaaatttgcctctctctttctgctactctcttctacagttttttgaagggttgcttttctgaagctagttgggacaacactcttatcagtgactataaaaggaaattctgattgcacctctaatttagtacgacatcgacttggttcctattacatgggaaatagtgaggatgggaaatcctgtaagcttgagaagccatcctcgcctgcagcggaccagagcaatcgccatgtctatccagattgggcagccatgcaggcatattatggtcctcgagtagctgttcctgcatatttcaattcagcagttgcacctggtcatacccctcacccttatatgtgggggccacagcctatggtaccaccttatggtaccccttatgcagcaatatatgctcatggtggggtttatgcacatcctggagttccaattggatctcatcctccaggtcatgtgatggcgacatctcctgttgtcagccaagccatggatggtgcttctttgagtttagatgcgtctgcgaagtcctcgggaaattctgatagaggattgatgtctaaactgaaggaatttgaggggctggcaatgtcacttggaaatggcagcactgacaatgttgagggtggaacagacattgcacattctcaaagtggggaaactga

SEQ ID NO: 7766 - DNA, 974 bp, Lycopersicon esculentum
  Predicted polypeptide sequence is orthologous to G562
gctgagaaggcaatcgttgttgcagcgaaaatgacgggaacagtactttctccttgcatgacaactttggaaatgagaaatcctgctagtgcacatatgaaatctagcccaactaatggtggttcaccactcagccctgcactgcctaatgaaacctggttacagaatgagcgtgagctgaagcgggagaaaaggaaacagtctaatcgggaatctgcaaggcgatcaagattgagaaaacaggctgaagctgaagaattggcaatacgagttcaggctttaacaggagagaacttgacactcagatccgagattaacaaattaatggagaactcggagaaactgaagctagacaatgccactttaatggagagactgaaaaatgaacagcttggacagacagaagaagtaagtttaggtaagattgatgataagagactgcaacctgtaggcacagtaaacctgctagcacgagtgaacaactcatgttcctcggatacaacgaacgaggatggtgaagtttatgagaacaacagctctggagcaaagcttcatcaactacttgataccagccccagaactgatgcagtagcagctgggtgatcccctaaatttaatttgagatgttaaaacttagtctgattgtgtaattttggcgtaattttaagtccaaaattgctactaactacgggagaggaacaggtgaataggattacgagatttctaattttacctacctaattgtagtttacaggtcagtagaaccgatgtgtgctcttttttctgttttgcatttctgagttgaatgaatgtggctataatagcgtatgtaaagtttaatgttcgacatactaaagacttgatttgaggaaatactatagaaccgaaatgttttcggtttggacgatgaaagtgaacttcatatttgataaataaatgtggtatgtttatgatgttaaaaaaaaaaaaaaaaa

SEQ ID NO: 7767 - DNA, 402 bp, Lycopersicon esculentum
  misc_feature (376)..(376): n is a, c, g, or t
  Predicted polypeptide sequence is orthologous to G568, G580
caagaatccaattatgtggtcatcaagcagtgataacaggggactctctgcttcttcttcttcatcttcatcctcatctcattcaccattttctccaagactcaaaacaatggaagaagtgtggaaagatattaatctttcttcacttcaagatcacactacgaattactctagagatcatcatcatcttcatgatcataatcatcaagctgctaattttggtggaatgattttacaagattttttggcaaggccttttgctaatgaatcttcaccagcagcagcagcagcagcagcctcccctgtttcagctacaactatgctgaatttgaactctgttcctgagcttcatttctttgataacccattgaggcanaactcaatcttgcaccaaccaaatgc

SEQ ID NO: 7768 - DNA, 737 bp, Lycopersicon esculentum
  Predicted polypeptide sequence is orthologous to G591, G793
ttccatttcagttcctcaaaacccttaacttcttctcgccgggaaaaaaattaatttcgccggataaatctccggcatggcagcaaaccaaccggaaggctatgccgacgatttcctcgagcaaattctcgctattcctccctactctggcttgccggttgctgatgttggcactccatcagagacgacgtcgtttacctcggcgtctgccgtatctcatcttaactctgccgctgctgctggcctacagcaacctttgtttccgctgggattaagcttggataacggccgtgatgacgtcggcgatgcaggtccttatgcagtgaagcatgaaagagatggaatgaatatcggaaatctatatgcaggtctagaacacttgcaatctcatgcagttcgtcactctgtgccttctgttcaccatgtccagccttttcaaggcccaccaacaacgagcacaacagtaactgtgccacacccaccttcaattcgtcctagggttcgagctcggaggggacaagccacagatccacatagcattgctgagaggctgagaagagagaggatatcagaaagaataaaggctttgcaggaactggtacccagctgcaataagacagatagggccgcaatgcttgatgagattctggactatgtgaagttcttaaggcttcaagttaaggtactgagcatgagtaggctgggaggagccagtgcagtggcacaacttgttgctg

SEQ ID NO: 7769 - DNA, 652 bp, Lycopersicon esculentum
  Predicted polypeptide sequence is orthologous to G591, G793
tagagagaggatagcagaaagaattagagcattgcaagagttggttcccagtgtcaataagactgatagagctgtaatgcttgatgaaattgtagattatatcaaattcctacggctgcaagtgaaggtgttgagcatgagtaggttaggaggagctggtgcagtagcaccacttgttacagacattccaatatcatcagtagaggaagagagcagtgaaggtggaaataataaccaaccagcttgggaaaagtggtcaagtgatggcacagaaaggcaagtggctaaactcatggaagaaaatgttggtgctgcaatgcaatttcttcagtctaaagcactatgtataatgcctatttctcttgcatcagcaatttatcactctcagccaccagatacatcaagtcttgttaagccagaaacaaatcctccttcatagatgaacacccttatagaaaaaggtgacataacatgctaatgaccttaaagaattttcttgcagtggatggttcctacttttatctattcaagtaatatttagctttttgttgaaaaaacagggttcttttttaaaaatatttatgtataaagtaaaccattttctatcatttatatatttgagtaggttttgttcttaaaaaaaaaaaaaaaa

SEQ ID NO: 7770 - DNA, 1339 bp, Lycopersicon esculentum
  Predicted polypeptide sequence is orthologous to G591, G793
gctcattttccgttcctcttaaagctcaataaacctatacgccggcaaactccggcatggcggacaacccaccggaggtatatgctgccgatgattttctcgagcaaattctggcgattccctcttatgctagcctgccggtaactgatttaaccgccggtgcctcatcggagaattcaacatctggtgtctctcagctccagcagcagccgttgttcccattggggttaagtttggataatggctttgctgacgccaacaacactggaggttttcaagtgaagactgaaagagaagcaatgaacatggggaatttgtatccaggtctagaacatttgcaatctcatgctgtttgcctaagtgttcctcaagttcaccaagtccagccttttcaaggccaccctacatcaagcgcaatagtaacaataccacaccaacctgcaattcgtcctagggttcgggcacaaagaggacaggccactgatccacatagtattgctgagcggttaaggagagaaaggatatcagaacgaataaaggctttacaggaacttgtccccagctgcaataagaccgacagggcagcaatgcttgatgagattctggactatgtgaagttcttaaggcttcaagttaaggtactgagcatgagtaggttgggaggaactagcgcggcggcacaagttgttgctgatattccattgcagtctgttgagggagacacctgtgaaagtcattccaaccagcacgtctgggagaagtggtctgattctgaaacagagcaagaggtagcaaagctcatggaggaagatgttggaacagccatgcagtaccttcaatccaaatcactctgcatcatgcctatttcacttgctgcacttatctatccgactcagcaaagtgacaaccaatcaatggtcaagccagaacaagcggccccattgtagacttctaaattactgcagtagatagctagcgatgtattataaaagaaaattgtcccagcttgcatttggtggactgtgcggggagaaagaaaccaagtttgtttgaagacaaagccattagtatacagaaactaaagatggaatgtttagggcttttctttttttggtgtaaccatagcttaatggatgatttagaatcaacttatgatgtactagattccttgtgagaagattaaggattaggagcttcttcatttctttatttctgttcttttgctcatctggatgtatatatgggggattacacaccctttgtgtagtttgttattaatacacaaaaatgttacctgttccctctctctctctctctctctctctctctctctctctct

SEQ ID NO: 7771 - DNA, 495 bp, Lycopersicon esculentum
  Predicted polypeptide sequence is orthologous to G591, G793
gatttaagcaaagctttaggtgactccctttcctttattttcttcatggctctcactgctctttagaaagtagcaaaacacacacacaaacaacccaaaacacacacttccatttccattttttgcctatatatatatatatatatgtaacaagtacttgttagagtactaatttgtacaccctcttatcaattccgttgtaaagaacacttttttaactagtatttgttcaattgaatgcttttctgaggaattaaggtggtcgaaaacagctccgatccaagaaagattgaatctttatagtttctgctatggctaacaacccttctgagggaccttctgatgatttctttgaccaaatcttgggatttcctgcttacaatggagcagaacctaatttggcgggaaatgatgccggagctataccgccggcgatgatgctccagcttaactctggtgatgggtcaagtcagtttactggagtgggtcttgggg

SEQ ID NO: 7772 - DNA, 361 bp, Lycopersicon esculentum
  Predicted polypeptide sequence is orthologous to G598
tttttttttttttttttatataaatttaaaagaaggaacgttttgttggagctctaccaacagctctcatcaaattggctaattcaacaactctagctacttttgttcctctttttgcttctgctgatgcctttctttcctctgcttttcttcttgcatttgctatatcattttgcatcttttctagtgcttttgctcttttttcctctaacttcctctcaactttcttcatccatgaagtagccttttggacttcttcattttcccatccattaatcacagcatcttcacacttaaacctattattaatctttgcaatttttgcagtttgccatgcactaatctttgattcaacttccct

SEQ ID NO: 7773 - DNA, 663 bp, Lycopersicon esculentum
  Predicted polypeptide sequence is orthologous to G634
gtgcctcaatcttatcccttggcatagagagtgaaattcttatgttagaaatgttgctaatgtgattaataatcaagtaagcatggtgaatgcttcaaatagttctagaaaaaacaactaaaccccctccccccccgccaccccacacacacatacacaaaaaagaaaaaaaaaaggaaagaagtgggggtgaacaaatttcttacaaatgaatctatggtgcaaattgaaccagcataaagtgattaacatttgactttgtttctagttgatttaagggcctacacactgattctgctgcaacattcaaaacttagttgcattgttaccgcaattgagaaattacttcataagtatgtagttcaaaagattttgttatggttaacagacatctgaggatagtatacaattctacaaggtggttgatgacttacatagaaatctgttagtgttcttgctgaaaaaccaaattcttcaagtgcagttataaatatattaccaacaatgagctagtgtttatgctaaatgtcattcttgagaagttccttttaagtacgcaccgttgccgaattaaagatgaaagattggagtttgaaaatctagggacacagatatgtgttgtaccatcttaaacatatgacaacactttttttctatttcttg

SEQ ID NO: 7774 - DNA, 569 bp, Lycopersicon esculentum
  Predicted polypeptide sequence is orthologous to G635
aggaccggtaccttgttcagctgaatcaataagatcaactcctgtcaaatcttctaaggaatctgacggtttcagtaacagctttgtaaataaaccatgtacgacgtccccatatacaagggtgatggataaggtttatagtagtagcgaccagaagccgaggaaggtagccaatggagcggagccaaggagatgacagaatgttgaagagcgaactgattatgcagtgaatcagacaagaactgttactgttgcatttgtctattccttctaactgctgttcgacatgcaaaatatggtagaatctgtatagcctgtcacatggaagaaatgaatgttgtaatcttatgctgggctgggtgacttgggatcattgtgcttgtaccattacatgttacatggatgccagacacatcgatacgctttcagcattgcctcagtgtacatcattgatgaggcaatatggtagaaaagttctctatgtagtctctggtattccggaggtattcgttacgtgtgtgtaaatgtattcattatgtgatatctatggtcaggacattttcatactc

SEQ ID NO: 7775 - DNA, 917 bp, Lycopersicon esculentum
  Predicted polypeptide sequence is orthologous to G653
gaataaactaaagatatttctctgctttttttttttctcccattcatcattctctctttggctcattctcccagaaaaaaacattctcttcatccgccattaacgctcgccgcatcacaagcttcgctccatcaacagcaccatttttttttgatcttccaatagtcaaagaggttggaggatcagatctaggagttgaaatcatgtcgtttacagggactcaacagaaatgtaaggcttgtgaaaaaactgtttacccagttgagcttttgtcagctgatgggattagttatcacaaatcttgtttcaagtgtactcattgtaaaggaactctcaagttgagcagttactcctcaatggaaggtgttctgtattgcaagcctcattttgagcagctctacaaggagtctggcaacttcaataagaactttcaatcccctgtgaagtcagctgagaagttaactccaatgctgacaaaatctccaagcaaagctgccggcatgttttctgggacacaggaaaaatgtgccacctgcggtaaaacggcttatccacttgagaaggtgacagtggagaaccaaagttatcacaagtcgtgtttcaagtgttctcatggtgggtgctctttaaatccttcgaattatgctgccctagatgggatattgtactgcaaacctcatttttcacagcttttcaaggagaaaggcagctacaatcatttaatcaagtctgcttcaatgaagcgtccagcagcaactgttccagattcttaaactatatctccatcaactattttatccagggagcttggtcttttaatatttgtttcctcccttcttttccgtatatctccaattggtgtgccatttttgtttactgtgtgatctgatttacacaactgtgaaaacttatccttt

SEQ ID NO: 7776 - DNA, 412 bp, Lycopersicon esculentum
  Predicted polypeptide sequence is orthologous to G653
tttttttttttttttttttttttaaaacaagagatatttggttgtatttggataacataaaagtggcatccttatagagttagaacactctgaagaaaattacaatgagtatgatacagaacaactgctacacgattagttgataggaaaaattgcagctgcgcgttttttggctgcaaactcagtttcgtgtgcagctgaaaaatatgaaaggaaactaaaagaatgttgaaaaagctacagagttgagagtgtcgcggagctcctgaattagattatctgcagacctaagactcctgaacagccattggttaataaaacagaaacgctgtgcagaacaccagaacttctggcaggtcaggaggaaactgtaccaaaaaagtgctatgaacacacgcgaaccctttgagat

SEQ ID NO: 7777 - DNA, 352 bp, Lycopersicon esculentum
  Predicted polypeptide sequence is orthologous to G653
gcccgaacacaacaagatgtcgaaccccaagtgcggtgtttgtgccaagaccgtgtacccgatggagctggtgacggcggcgagcaagagctttcacaagttctgcttcaagtgcgagaagtgcaagaccacgctcaacttgaagaactttaaggcgcacgacggcaagatttggtgcgccgtgcactacccgccggcacagaccaagatcacgtcgttcaacaacgacaagtcggccgactcgggcacctacgagaacgaggcgcagcagtcggtcaccgacgccggcggcgcgtggggtggtggtcaggcggacgccggcgagtacgccaacgagccgcaagccggctac

SEQ ID NO: 7778 - DNA, 515 bp, Lycopersicon esculentum
  Predicted polypeptide sequence is orthologous to G663
gtaaaactatatattatagaaaaaataatgaatactcctatgtgtgcatcgttgggagttaggaaaggttcatggactgaacaagaagattctcttttaagagattgcattcaaaaatatggtgaaggaaagtggcatcttgttcctgctagagctggtttaaatcgatgtcgaaagagttgcagactaaggtggctaaactatctaaggccacatatcaagagaggtgactttgctccagatgaagtggatctcatcttgagacttcacaaactcttaggcaataggtggtcacttattgctggtagacttccaggaaggacagcaaacgatgtgaagaactattggaatacacactttcacaagaagttaagtattattgctcctcatctacatcctcattctcgtcctcgttctcatcctcgtctacagattaagcataagagcatcgcggttactaagaatgaaataataagacctcaacctcggaacttctcaaacgttaagaagaatga

SEQ ID NO: 7779 - DNA, 318 bp, Lycopersicon esculentum
  Predicted polypeptide sequence is orthologous to G664
aattaccaacatagcccctcaaggtgttttgcatgcagtttgggtatacaaaatagtaaagattgcaattgcagtaaaaataatattgcaagttataactttttaggattaaagagtaatggtgttttggactatagaactttagaaactaagtgaatttttattataaatctttttttccctcgtgtatttgggttaaaaaaacaagaagagagaatcgagaaagatattcctattagtttaagttctttcgaattttctcttatttgtaaaatttcaagtattactatatacgatatattatattaagttgaaaag

SEQ ID NO: 7780 - DNA, 919 bp, Lycopersicon esculentum
  Predicted polypeptide sequence is orthologous to G666
ctacttttttttcccaagaaaagaagaattccacaaaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtcagctttctgaattacgtgatcatcttatttaaaagtttaaaccgtcacataaagtcatagagcacatgacttttaattttcttttcaatttgtcttattttatcgcg

SEQ ID NO: 7781 - DNA, 1038 bp, Lycopersicon esculentum
  Predicted polypeptide sequence is orthologous to G666
cttcactgaacatgaagaaaaaatgatcatccatcttcaagctcttcttgggaatcgatgggcagctatagcttcataccttccgcaaagaacagacaacgatatcaagaattactggaacactcatttgaaaaagaagcttaataacaacaagaaggttgaaggtcatgatgatcatcaagaaggaacttcagcatcatcatcatcatctcaatcaaaaatcataaaaggacagtgggaaaggaggcttcaaactgacattcacactgctaaacaagctctttgtgatgctttgtcacttgatacaactccaaataacaaaaacaacaacaataatccacctcctcatgatcaggatcaacaaccaccatcagttcaaacacctactacctatgcttcaagtgctgaaaacattgctaagttgcttcaaaattggatgaaaaattcacccaaatcgacctcgtctagtagctcgaaaattactcctatgtcatccttgaacaacaatttatcaatcggtgcagtttcaagttctagccctagtgaagggacggtaaatgttactcctggacaaggtttggactctatctttagctttaattcatctaataattcggatgtttcgcaatccgtatcggtcgatgagggtggtaatttcagtacacctgagaatcataataataacaacaacaacaatgctgggatttatcaagttgaaagcaagccaaatttgcctgatttcaagccagaaaatgggaattttcaagaggagagtaagcaaaatatggagacacaacaagtgcctttaactatgctggagaaatggctacttgaggatgctaatgcacaagctgaacaagaagatcagttaatgggaattggaatgggaatgggaatgaccttagctgaaactaatgatttgttttgaagaaaaaaaaaattgtttactagtactcccttcgtttcaatttatctgccttgatttgaccgaacatgaagttgaagaaaaaaaataagtaaaacggataaattgaagcg

SEQ ID NO: 7782 - DNA, 395 bp, Lycopersicon esculentum
  Predicted polypeptide sequence is orthologous to G666
ctaggagaagaaattactaacgggtccttatataaccaatctcttcttccaggaacaaaaagttagtgatgatgacgaatttgaagctggtgatgatggtgaaaactagaaacgtaactgatgtctattcctcccatggtagctagtctcaagatgttcttcgagaacacgaaacatatgatcgtttttcaaggtatgtatactaataatatacataatttgttctgcctttgtaataatatatatcgagattaatgcaagtatcctttcattttctcatgtaaatttgaattcctttggtaataatgtgttcaacatttgtatgcattttatgtaaagatttttttttaaaaaaataaattaataactattgaatatagaaaaaaaaaagaaaa

SEQ ID NO: 7783 - DNA, 553 bp, Lycopersicon esculentum
  Predicted polypeptide sequence is orthologous to G666
aatttcctataaagagagtaaagcaatacctaaaaacgaaagatacatccttttattttcattgatcttcaagtcataaaaagaagaaaaagatcattttgttcctagatatcgatcgatcgtgtaggtagaatgggaaggccaccttgctgcgataaaataggggtgaaaaaaggaccatggacaccagaagaagatatcatcttggtttcatacattcaacaacatggtcctggtaactggagagctgttcccagtaatactggtttgcttagatgcagcaaaagctgtaggctcagatggactaattatctccggcccggaattaaacgtggaaacttcactgaacatgaagaaaaaatgattatccatcttcaagctcttctaggcaacagatgggctgcgattgcttcgtatctcccacaaaggacagataacgatataaaaaattactggaatactcatctgaggaaaaagctgaagaaacttcaagggaatgatgagaatagtactcaagaaggagaaagctcatcatcatcacaatccaatttct

SEQ ID NO: 7784 - DNA, 694 bp, Lycopersicon esculentum
  Predicted polypeptide sequence is orthologous to G666
gagaattcaaaattgagatgggtctcttcttttccgtttcccccctttttcttttgggagaatcctatttcaccttctatatattattgttctccactgttaagaagggggattttttttgaaagcttaaaagttttcggcaaaagattttatagaggaaagaaagttgctaacctaaaacgttcatataagaaaatacattctgaatatatacttgatttctttgttcgtggtttgctgggaatttgccggtttctttgaagttattccttgaagttggtggaaaagtcacgttctccaagctcgtcagcctttcttggtcgccgcaccttaaaagctatgtgttggtttgcttcagcgaccaatgtggatggaccttaaaataatcttgcagaaaaaaatctgatgtattcaaagtgagatatttcaacagtgaacatacatgtccgatgcgggataggataccaacaaaagtacaagcaacaattggatttattagtggtgtgactgcccctaaattggtaaatcataaaagaatccatacacttcgagatgtaattgaagatattagagaattgtatggggttgaggtatcgtaccaacaagcatggcgtgctagagaacgtgcactagaaatgctcaagggtaagccatccgaaggatataaaacagatgccgagatacatatggatgc

SEQ ID NO: 7785 - DNA, 918 bp, Lycopersicon esculentum
  misc_feature (18)..(18): n is a, c, g, or t
  misc_feature (768)..(768): n is a, c, g, or t
  Predicted polypeptide sequence is orthologous to G675
gaaatgatcagtccgttnctgactcttttttactagttaaataattaataaactttttctatcaacatatatatatggtaattaaaacagctcaattatttgtaaaattaaaggtgtagtgtgataatattacttcacagggaatgaaacatgtgattagtaaaagcaagtggattatggctttcttcttcttcctcctcctcctcctcctcacggagttgatgaattgggtcaaaacttggagagttattagcagtacaggtaactgatccatgcagttgatgatcaaaaatattattagtagtaaagttattgaaattgttgatgaggttaatattgttgtttgaaatagaagaattgtttgagtaacttggctgtagaaatgcaatgtgttggtcttgggaaaaatttggatacgcatttgccattgcatatttgctgttcataaccttgtgttcactattggtagctctgattgaacgatgccacctcttgtttccaaaagaaattgtttgaacaaccaagacagtgtccggagcctactttggcttaaaaggatactaccccccgtttttccccgttttcccatgtgcccaatacttatccaatgttttccaaaccctttgccccgtttaaaccccccccctggttgacaaaggggggaaaaccccctgtttttttttttttaaaagaggaaaaaaggccggtgtggacaacacccgttttttccccccccacttaattttgctttccgggggcaaattattnttttggtatttttaatattagcggggcgcccactcttttctcaaccccttggtggaaaagtatttcttgattctaaatccaatcagggattattttcttctatttctctttttctaccccctcacccccccctgctttttcttaactttt

SEQ ID NO: 7786 - DNA, 1007 bp, Lycopersicon esculentum
  Predicted polypeptide sequence is orthologous to G707
gatgtttgattgctagaacctcaacaacagatgttatatcaagtggtatgggtggaaccagaaatggtgcacttcagctgatgcatgctgaactccaagtgctttcaccattagtaccaattagagaggtcaatttcctgcgtttctgcaaacaacatgctgaaggtgtctgggctgtcgttgatgtatcgattgataccatccgtgaaacttctggtgcaccaacgtttccaaatagcagaaggcttccttctggctgtgttgttcaagatatgcccaatggctacagcaaagttacatgggtagaacatgccgaatatgaagagggtgcaaatcaccatctttaccggcagttaattagcgcgggtatggggtttggcgcacaaagatgggttgcaaccctccaacgccagtgtgagtgtcttgcaattctcatgtcatccaccgtgtctgccagggatcatacagcaataactccaagtgggaggcgtagcatgttgaagctagcacaacgcatgacaaacaacttttgtgctggtgtttgtgcttcaacggtacacaagtggaacaaactttgtgcaggtaatgttgatgaagatgtacgtgtcatgactcgaaagagcgtctatgaccctggtgaaccagcagggatcgtcttaagcgctgctacttccgtttggttgcccgtttcccctcaaagactctttgatttcctccgtgacgaacgcctccgtagcgaatgggatatcctatccaacggtggccctatgcaagaaatggctcatattgccaaaggccaagatcatggcaactgcgtctctctccttcgtgctagtgctatgaacgcgaatcagagcagcatgttgatacttcatgagacttgcatagacgcggctggggcgcttgttgtatacgcgccagttgatattccggcaatgcacgtggtgatgaacggtggaaattcggcttacgtggctttgcttccttcgggattctcaattgtaccc

SEQ ID NO: 7787 - DNA, 593 bp, Lycopersicon esculentum
  Predicted polypeptide sequence is orthologous to G707
gtgcaatttctcagccaagacttcttcctcaatctcttgccaagaacatgttcaactccccaggactttctcttgctcttcaaacaggtatggaagggcaaagtgaggtaacaagaatggctgaaaactacgagggaaataacagtgttggtagaaggagtagagaagaagaaccagacagcagatctggaagtgataacttggaaggtgcatcgggtgatgaacaagatgctaccgacaaaccaccaaggaagaaaagataccaccgacacactcctcagcaaatccaagaacttgaatctcttttcaaggagtgtcctcatcctgatgagaaacaaaggttggagttaagcaaaaggctttctttggagactagacaagtcaagttttggttccaaaatcgtagaactcagatgaagactcaactggaacgccatgagaattcgatactaaggcaagagaatgataagcttcgtgcagaaaacatgtctataagagaggcaatgagaaatccaatttgtactaattgtggtggtccagcaatgattggtgagatctctcttgaggagcaacatcttaggattgaaaatgct

SEQ ID NO: 7788 - DNA, 890 bp, Lycopersicon esculentum
  misc_feature (867)..(870): n is a, c, g, or t
  Predicted polypeptide sequence is orthologous to G720
gcaaattttgccaaaggaagtagaaagaagatggcctaatccgcaaccaatagattcagtccaaagaagttactatcctcataaacctatcatgacattcccacaatatcattctaatcatgttgccccaggtggtcagttctatcctgcttgggtaacaccagcaagttatccgaacggtttacaagtgtggggttcactttactatccgggatggaaacctgcagagacttggcactggacgcctcgtccagagctgcatgctgatacatggggctcccctatcatgtcaccgtcgcttggatcatatccaccatatcctcagaatgctggagtgtaccggccacatggaacacataacagatatagcatgctagagaagtcgtttgatcttcacccggcggatgaggtgattgataaagtagtaaaagaggcaataaccaaaccatggttaccacttcctttgggcctaaaagctccttcaacggagagcgttcttgacgaactttctagacaagggatctcaaccattccttcacaaatcaacgactcccgttgtcggagatgagatgacatgtcattctaattttttttgggtcccatagttggtgcatgtcaaaaaaaaataataatctccaattacttgatggacatatgtaccatgacattacccagtgacccgagtgacccacgcgtatggcattgactcgacggtcaaaatcgagttgttgtaaataatggacccaaatatgggttttcccttttttgttggcccaattttagatgtttgggccgatgagtgtgctccattaatttctttggaaaataatgaataaaccattcttagtttatgggttataaatcccnnnnaaaaaaaaaaaaaaaaaaaa

SEQ ID NO: 7789 - DNA, 790 bp, Lycopersicon esculentum
  Predicted polypeptide sequence is orthologous to G720
ggttttttgtttttatatgctgcagcatgtcctctatttttctttgaaaaaatttcttgtgactaactaaaaagtgtacagttttttggtgattaataaatttgttcatgtgtgcagatgctgaaaagtgagcatcataattaatggcttgtttgggtgcctgaaaaggatgccaattcagaaatggtttgcactgagaatgaattattggagtggaaagatttcccaaaaggacttaaagttcttcttcttgatacagactccaattttgcctcacagatgagatcaaggcttcaacaaatggactatatagtttacacattctgcaatgagaatgaggctctgtctgcaatatcaagcaagtcggaggtgttccatgttgccattgtagaggtaagtgctggcaacagcgatggaggattcaaatttctcgaaagtgctaaagatctaccaactataatggtttcagatattcactctattaacatcatgatgaagtgtatagcacttggtgcagttgagttccttcagaaaccattatcagatgataaactgagaaatatatggcagcatgtagttcacaaggcatttcattctggaggaaagagtgtctctgagtcactaaagccggttaaagaatctcttttgtccattctagagctccaaccagtaaaacacgaagcagataatgagaatactaatgaagcagaacccttgatatcagtggtggaaaaccaaaaagcatcatcatcctgctgcgataaatatccagctccttcaaccccacaac

SEQ ID NO: 7790 - DNA, 1261 bp, Lycopersicon esculentum
  Predicted polypeptide sequence is orthologous to G720
tatactaatttattattgaatttacatgcattacatgtatcactgtgattcttctttacatgttcatgcatctagaacaagaacaaagttaacaactttcttgcttgtgctttttcttcacctaattttgaaaactaaaggttttcttgaaattgtgatgttggtgttttcacattttggtgttaatatgttgaagatctctcacatggggttttctgtttttcattttttgttgcttttatgttttttttcttcttcttcttattttaagataaaaatacagtctttacctcttcccttttttgttatgtgatgttaaagattcaagctttataaggtttgttggaaaaagaagatgattttgtattttttaggttttctgttgattctatgacattttttttctaaagattgttttttttttagcataaatcggaaacaacctctttagttcaaggtatgcgtacattctaccctctgcagaccatggattatattgttttaatgtctgaggggaattcatttttgggtgtgcagattgaatagttaatgactgattaaaaagtgaccgagttggagggactaaaaaggatgcctttttagaaatgatttgcattgagaatgaattattgggttggaaagatttcccaaaggggcttaaagtcctacttcttgatgaagatagcaactctgctgctgagatgaaatcaaggcttgagaaaatggactacatagtctactcgttctgcaacgagagcgaagctttgactgcaatctcaagcaaatccgagggctttcatgttgccattgtggaggtaagtgcaggcaacagtgatggggttctacggtttcttgaaagtgccaaagatctaccaactataatgacatcaaatatacattctcttagtaccatgatgaaatgtattgcgctaggcgcagttgagttccttcagaaaccattgtcagatgataaactcaaaaatatatggcagcatgtagttcacaaggcattcaatactagaaaggatgtgtccaaatcacttgagccggtaaaagattctgtcctctcgatgctgcagttacaactagaaatgggtgaagcagatgacaaaagttcaaatggaacagaacctcccactgcagtagcggaaagcaatactgaacagtcatcgggctgtgataaataccctgctccctcaaccccacaattgaaacaaggagtgcgatccgtcgatgatggtgactgccatgatcatactat

SEQ ID NO: 7791 - DNA, 467 bp, Lycopersicon esculentum
  Predicted polypeptide sequence is orthologous to G720
caaaggaggaacactattctgctgctgatcaacatatggaggatcctattgctacttgttcaccaagtaatgacaatggcagtacttgttctgctgacccgaacaaagcttctggtctccatagttcaagtgggacaaaagctaataagaagaaaatgaaggtagactggacacctgaactacacaagaaatttgttaaagcagtagagaaaattggtatagatcaagccattccttctcgaatactggagctgatgaaagtagaaggcctgacgagacataatatagctagccatctccagaaattcaggatgcagcggaagcaaatcttgccaaaggaagacgaaagaaggtggcctcgtcctcaacctagagatcctgtacagaggacctattatccacataaacctgtcatggcctttccaacccatcattccaaccatgcaaccacagctggtcaattctat

SEQ ID NO: 7792 - DNA, 578 bp, Lycopersicon esculentum
  Predicted polypeptide sequence is orthologous to G720
ctgtcatggccttcccaacccatcattccaaccatgcaaccacagctggtcaattctatcctgcctggataccaccaggaggttacccgaatggtgcacatatgtggaattcgccttattatcatggatggcaaccgcctgagacgtggcactggaatcctcaaccagggctgtatgctgatgtatggggttgccccgttacgcctccatctttaggatcatgtacaccataccctcagaatgcatctggatttcacagggctgagggaatgctgaatggatatagcataatacagaaatcagtcgatcttcacccggcagaggaggtgatagataaagtggtgaaggaggcaataaacaagccatggttgcctctacccttgggcctaaaacctccttcaacggagagtgttctcgacgcgctttctaaacaaggcatccccgccgtccctccacgccaccaccgctctcatcgcccacactgacatgccaattgcttaccgggaatcccatatacggaggctcgtgtttgaacactccacccatgcgcgtggcgatgacttcacccgacacgaaag

SEQ ID NO: 7793 - DNA, 662 bp, Lycopersicon esculentum
  misc_feature (595)..(595): n is a, c, g, or t
  Predicted polypeptide sequence is orthologous to G730
ctactactacctttcttttgatcaacacaaagataacataagttactagtaagcgcagcgcgctagcgcaaagaaagagaagaagtatatacatggagctattcccagcacaaccagacttatctttacaaataagtcctccaaacaacaaatcatcatcatcatcaacaacaacaacaacaacatggaaggctatgagtagtaataataacaatattgatagagatgagatggacttattcttcttgagaagagctttagaatcaaaacctgataacaacaatactctttttgagctttctttatctaatcctaattataaaccttctcatcatactcaactaattaactcttcccattttcatcccctacaaaacacaaatttcatccaccaacaaaatcaacaacaacttaatatcatgagacctataagaggaattccattgtacaatcaaaaccctcttcctcttcctcttcctctttctcatcatcataataactacccaatatttgctcaccaaacctttgaaaatactgctcctacaacaacacctacattacctatacattcttctggatattgtattagtagttntagtaacaatagtaacaaaactatacctaattcctcaccaacaactatcccttttcatcattctaat

SEQ ID NO: 7794 - DNA, 405 bp, Lycopersicon esculentum
  Predicted polypeptide sequence is orthologous to G730
gatggacaacttcacttcatgctagatttgctcatgctgttgagcttcttggtggacatgaaagggctactccaaaatcagtattggagctaatggatgtcaaagatctcactctagctcatgtcaaaagtcatttgcagatgtatcgcactggtaaaactactgacaaacctgcagcttcctcagatggatcaggtgaagaagatttgttagctattgacaagattatggatcaaagaggtccattagatggatgtgatgaaccttctacaactctttggagcaactcctcaagtagtagagaaagattgtcacaagctaactttaatgaatcaaatggactcatcagatcatcctctttcccatctcaacaaagattcagccatcatatagaggaatgtgaat

SEQ ID NO: 7795 - DNA, 490 bp, Lycopersicon esculentum
  Predicted polypeptide sequence is orthologous to G730
gcacgagataatagtttgactgagctttgtttagctcatccaactactaccaataatgaagaaaataagagtttttcaagaaacccttttctccaacaaagccaaaacatgaatagttatcatggggtttctttattagaccctataaagggtatcccaatttatcatcatcatcatcatcaagatccaaagagatcatcatcatttggatccatttatcataataatttggatcatatatcatattcgaataattcctatgttacaaatgttacttcctcttctccttataatcgaatacctattgtggctaatagatttcaaaatcaacaacacatatattataacggagttggattattaggttcaccttcttctcatgaaagtaataattttttgatgagatcaagatttttacctaaatttccaactaaaagaaacatgagggcaccgcgaatgcgatggacaacttcacttcatgctagatttg

SEQ ID NO: 7796 - DNA, 657 bp, Lycopersicon esculentum
  Predicted polypeptide sequence is orthologous to G732
ctattttctctctctattattatacactttctagcatttctctatttttcttcttaaaatataaaatatttatctatttttgattaaatatatattgatgctaaacttcttatttatcatctttgcaattgatgtctgcaattctcaatgaactctttctttgtggttttatgataaattccacgtataggcgaaggacccatttagtgcaatctttttctgttgtttttctctattggttttattgcatctcataatcaaattaattattttatttaattaattccccccataaaattattattattattattgcatacacataagtacttatatttagacctaaaaaaatcaatattttgggtcctgctaattttaattactattattttaaaagaattttgtcatggcttcatcaagtggaacatcatcaggatcaagatcggggtcagggtcatatacacttctaaactcgggatcagaagaagatttacaacaattgatggacgaaagaaagagaaaaagaatgatatcgaatcgtgaatcagctcggagatcgagaatgaggaaacaaaagcatttggatgatctcatgtcccaattgtccaatctcatgaaagaaaataacgaaatattgacaaacatgagtgtcacaac

SEQ ID NO: 7797 - DNA, 1875 bp, Lycopersicon esculentum
  Predicted polypeptide sequence is orthologous to G748
tagtgatggtgttatatatgatggaaatagaaatgggtctgatcttgatcgatgtttagagggaagtaaagcaagcagtgtagagaaggatgaaggaagtgagtatgaaaagcaagaagctgaaaaggataatataactggagagctcagtgaagctaaatctgaggagggagaccaaaatcagatgatagaagaatcagaaaatcctaagactccatcagaatcagagagcagtcctaaatcttcaactgaggaagaccctcaagcagtaaaatcatccaagactgagaatgaaccgactaatgtgacaaattccgagcagaacaatctgaagaagccagacaaaatcctcccatgccctcgttgcaatagtttggatacaaaattctgttactataataacaacaatgtcaaccagcctcgtcatttctgcaggagctgccagaggtattggactgccggtggtaccatgaggaatctccctgtgggagctggtcgtcgcaagaacaagaatcttgcatctcaatatcgtaatataagtatccctgaaggattactagcagcaggaattgaatctccaaatgggttaattcatcatccattattcaaaccaaatggcactattctatcgtttggtcccgacttacccctgtgtgaacctatggcttctgcattaaatcaagcagagaaaagggtatcaactggtattcaaaacggttctcataaatcagaagtcaagaattcttcttgcaaaggtggagattctggggatgagtgctgtagagggattaacatcccgactccaaatatgatggtggaagaaggtaaaggagagccccacaaggctgttatgcatagtataaatggcatcccgtctcctgttccgtgcctccatggagtaccttggccttttccatggaatgctgcagttcctgtgtcggctatttgccccattcccttccctatgccattcttccctacaccttattggaattgcagtgtgcctccttggagtaatccttggttgagtccacctctgcgagctgcaaacgagaaaacatcaggttctgatcctacttcttctttagggaaacattcaagagagggggatttgcttaagccaagcaatcctgggggcaaagaacaatcagaacaaaagtattcagaggggtctattttggtcccaaaaacattgcggattgatgatcctgatgaagctgctaagagttctatatggtcaacacttgggattaaatatgattctactaacaggggagagtttttcaaggccttgcaaccaaaaagcaatgacaagcaccacaaagccaatacatttccagtattgcatactaaccctgcagccttatctagatctatcaccttccaacaaggtgcctaaagatgatcctatgaatctgcgaaggatggtcttcacttgaaattaagtatgactgttgtctgatgagggctttttggggcctagcaaccaaaaagtaacaaagctaagataatgcttttttctcccattgaactccagcgggaaacttcatggatttcctgcctgatggggacatttacagtgcgcagatcacttacagagctgccaggctaatatctctcaagtgatccaatgaaactggggaatgacatgggaagctattgtagaaacctattgtttatagttttcttggtaacaataagagcaagtggctggcttggtttttacttttgtgtgttttctaatgtacatacctttttacagctaacactagagtgaggaagacagttgtttagatcctcatccaacagttgttgtaacatattttaaattaatgtcaaagttagtttggagagccaaaaaaaaaaaaaaaaaaa

SEQ ID NO: 7798 - DNA, 617 bp, Lycopersicon esculentum; identical to SEQ ID NO: 7340
  Predicted polypeptide sequence is orthologous to G748

SEQ ID NO: 7799 - DNA, 1766 bp, Lycopersicon esculentum
  misc_feature (1731)..(1731): n is a, c, g, or t
  Predicted polypeptide sequence is orthologous to G783
gcctctcaccatcccgtttcaggtataatttttctttctatctgtttcacatttattgctcttatcctttcaatctttcttatctttaagccctatttctgatgtgcttgaaatgatttcttttggggttgcgcttttaacaaaattttattaggttttttttatttttgcgtaggcagagagcagaagtcatggggcttcttttacgaattttttgttcttgctttggtgaagaattgggaactaaaggttttttcttatcaataaatagttgattatagaaaaatggggatcaaatgctgttatttactacccagtcttccgaaacaaagagtgtttctgcttagttcgcttgaattttacttacctcaatttaggagttccgctgtttaatagcatagcataggaaatagatggtgaagtaatgagaaatcggctaagtataccgtgttaatgctgaaaatttgttacttcaaatgaacttagcttgattgttcatcatttgacaaacttttggacaatccttacttgcacctttttttcccttggacagacaatagtttttctcatcaaaggctacaccgtggactcgaataagagatggatacagaaaatcctgctccaatagttgaaaaggatactacagatgcggagacatcattggatagctctcatctcaggaagaagattcagaagaaagttccaaaaagaattcacaaagctgagagagagaaaatgaagagagagcatttaaatgagctttttcttggtttggctgatgctcttgaactatctgagcagatgaatggaaaagcctctgtattgagtgaagctgctcgatttgtaaaggacatgctttctcagatcaagcatatgaggacagaaaatacgactttgctgtctgaatctcaatatcttagcgtggagaaaaaggagcttgaggatgaaaatacagttctggaggctgaaattagcaaactgcagaatgaggtcaaagcaagggaagctgagactagtcttgacctaaatctagctcctcctgaaattcatcacacagagtttgcctcacaaactaactatatgagattgcctgcttcggagcacggatttcaacagtcacagatgatgaaccccgtgtacgtctttcccttgagttctaatcctcaggcttatccagcgcctgatgctgcagatcccatggctatgccctcatctactgtgaagaaaccacagcctagataccccactccaaatgatgtatggccatcccaaatccttgaaaagaggcctcagttattgcgacaggaggttcaagatggtgcgtaagtatagtagtctagaagaaacaagacattcgttcatagggaatggcatgtataagtactagttaggtaatgtagatttagacgataaacagcagcagattcagcaatactttggacttgcagctctccattgtatataaacttttcgttgtattttgatcaacaataacctagtttgtctgtttgagtgtcgaggtagtaccagttgggaggtaaccataccatagcagtgttggatacaaaaatatgttggtaaacaaaacctgtaagtaggcgcctgacatgacatctatggattttgatgttgaactcttacaatgttgttgctgttgaggtcattttcaagctctgggtatctctagagtggccaaaatttgtcttagtcccttgtattttgacgaggtangagacagagaagtgacttaagttgtcattatcatt

SEQ ID NO: 7800 - DNA, 533 bp, Lycopersicon esculentum
  misc_feature (484)..(484): n is a, c, g, or t
  Predicted polypeptide sequence is orthologous to G783
tttgtagactgtctcgccataagttggaaggtactatatgctagtttgcagttcacatagtagctttagaggcttaattttatgatgccaaggaattgtcgcttcttatttccaaaatctacgattttcagcaataatttagccctttctgcaagtcttaacttagcaacaggatcagtttctaactgactaacttgcaaaaggtcctcacaaaatttagagaatgtatttctgcctcttcaaaactctattcttgcatctttgaatcctcattaaagctcccaatctcaggataaatacagtaataatttgtgtactcagttcatgtatttatgttgactttgttttgcctgctctctgcatcattatcagtggcatatctacacaagtactgattgtaaagctctcttgttacagctctcatctcaggaagaagattcagaagaaagttccaaaaagaattcacaaagctgagagagagaanatgaagagagagcatttaaatgagctttttcttggtttggctgatgctc

SEQ ID NO: 7801 - DNA, 506 bp, Lycopersicon esculentum
  Predicted polypeptide sequence is orthologous to G8
tttttttttttttttttttctaaaaattatccaatccacaaaaatgttattcatacaaaagaaatcaatgactatgtttatacctatattactagttacggataagtacatgttatggaagtggtaggcggggattaatctggtaaaagcactgcgaggcatttgttgaagttgctaatgcagatgttgatgaagtgatagaagtagtagatggaatgaagaatcctgatgatgctgccgtgcagaacattgtcaatgggctgtttgtatcaacctgactaggcatttgcagtgcccaatttggaggtccttgtgatgaacctgtgtcctttctcttgtcatatgctcttccctcatagctggaagagaaattagaatagattccagtccacaattgagcttgttgggacgacattggtagtcccttgagatgtgaacttccaactattactgaaccaggtttatccatcttaggttttgttgcgtcttgcatatcgtaaggatga

SEQ ID NO: 7802 - DNA, 625 bp, Lycopersicon esculentum
  Predicted polypeptide sequence is orthologous to G8
aggtggatttgacactgctcatgcagctgctagagcgtatgatagagctgcgattaagtttctaggtgttgatgctgatataaactttaaccttagtgattatgaggaagatatgaagcacatgaagaacttgagtaaggaagaattcgttcacgtgctacgacgccagagtactggtttttcgagagggagctcgaaatatcgaggagtaacgttgcataaatgtgggagatgggaggctcgaatggggcaattccttggaaaaaaggcgtatgataaggccgcaatcaaatgtaatggaagggaggctgttaccaacttcgagccaagtgcatatgaaggggaaataaactctaaccctcacagtgaaggtagccagcaggatcttgatttaaacttggggatcgcaacttcttctgcgaaggaagttgaaaggtcttcgagtttccagtatcatccttatgatatgcaagaagcatcgaaatcacagatggacaaatctggttcaccgatagttggtagttcacattacaaagcattacctgcagtaacatctgaacaagctcacttgtggaatggagcatatgccaatttaattcccaactatgaagaaagagtatccggg

SEQ ID NO: 7803 - DNA, 888 bp, Lycopersicon esculentum
  Predicted polypeptide sequence is orthologous to G811
gctgccactgcccctaaccttccgccaccgtgaacctccgcccagctcagtggagctccaccgcgttgacatcggaacgatatatatatatatgggatggaggctaacaatattattgctccgttcgtgatgaaaacttatcaaatggtgaatgatccgaagattgatggacttatagcctggggaacagctaataacagtttcatagttgttgaacctttggatttttctcaacgaattttgcctgtttactttaagcacaacaatttctccagctttgttcgtcagctcaatacttatggattcagaaaagtggatccagataagtgggaatttgcaaatgaatggtttctgagagggcaaacgcatttgttgaagaacatagtgaggaaaaagcacagtagaaattcgtgttctcagaagcaggatgagagtgaagatgaagaaattttgactgaaatttctagattaaagcaggaacaaaaagcattagagcatgaagttgagaatatgactagaagattagaagctacagagaaaaggccacagcaaatgatgggttttttgtgtaaagttgatgatgatcctgagattctgcccagaattttaatggagaaagagagatctaaaaggctaactttaacaaattgtgagaagaaacggagacttgtgatttcgaattcaacgagttgttcctcagtgaagagtgaagatgcactaagggcaacatcgtcatttcactcacccgacgcaaatttcgataaggatgcgatctgtcagtcctcaccgtcgtcgggaactccgccgacgacgacggcctggctaggtagtcggccgatgataacttatgagccaggtacgatacagtcgattctatctcctgacgcg

SEQ ID NO: 7804 - DNA, 1671 bp, Lycopersicon esculentum
  Predicted polypeptide sequence is orthologous to G812
attttccttactttagggtagctagccaagatattttcaagcaaatccttttttcacaaacttctaaatattactaccatactatgtaaagaattttcaaatcgaacaaaaaaaaaaacatgtgatgggtaggacagttaaaacaaatttctagacttcattaacatttggtaaaaaattcaataatttttattcatattatattttcttttacataattaaattaattaaatttcaaaataaatatcaaaaatataaaaaagaaaaaaaccagaatcaaggcttaaaagaataacatgagaattgtttcactcacaaagattttttttttttatgatttttaatatggtatctgatacttatattgaagttcaaacaatttcgatcaagaaggaagaaggattaaaaatatctagaatatcatcccacttaatagtaaaagaatgtataaaatattcattgaaccctcactatacttcctttttagttctcattactctcttgctaatatacctccaatattgcaaacatattaatttgtcctaattctttctccctcttacccatactccaaattaatattaaccctatcttttctcatatatccacaaactcctttattacctttgccaagatcctctatcttcttaactttgacattgactcaaaaatattgttatactcatctttgttgaagaatcaaagcatggatcattttggtaatttaataaaagaagagtttgatggatcatttttgacgcctcaaccgaaggagtgtcttcatgagaatggacctccaccatttcttacaaaaacatatgaacttgtggatgatccaagtaacaacgacgtcgtttcttggagtagaggttacaatagtttcatagtatgggatccccagaatttggccattaattttctaccaaggtatttcaagcataacaatttctcaagctttgtcaggcagctcaatacttatggatttaggaaagtaaatccagaccattgggaatttgctaatgaaggttttctgagagggaaaaagcatctcttgagaacaataaggagaagaaaaccaagtaatttcatcaagtcttcgtcatcaattaataatcaagcatcaaaaggctactaaatcacaacttcaagctatggagcaaaagcttcaagggacagaaatcaaacaagagcaaataatgagttttttggctaaagcattacataatccaaattttgtggagcaaataatgcaacaaaatgataaaaggaaacaacttgaagaagcaatgaagaagaagaggaggaggccaattgattattatgaagctggtcctagtaatataattaagttagaacctcaagatcatgatattattaataatgaatttgatgatgatttacaagtggctatgaacatgtcacatgggaacacattaatcaatttagaagaagaaaataatgaaggattttgggaggatatgctgaatgagaatagtaatgttgaagatgagattatggctttgcttggtgttaataatgaacaagaagatgaacaacttcatgtggatattttctctgattaattaattacttgaataaattatcagccaatttctctggctcatcatgatttaaattttaaaaaaaaaaaaaaaaaaactcgagaggggg

SEQ ID NO: 7805 - DNA, 635 bp, Lycopersicon esculentum; identical to SEQ ID NO: 7344
  Predicted polypeptide sequence is orthologous to G869

SEQ ID NO: 7806 - DNA, 633 bp, Lycopersicon esculentum
  Predicted polypeptide sequence is orthologous to G869
gcctcgtgccgaattcggcacgaggaagaacaggaggaaggaggaggaggaaggaggaagaaaggggttgtgatatatgtcggcaaatttctgtttggctgtgattagagctccattgaagctctgggtgtctgtttcttcggtgatatttggtctttgcatgcaacaaatcctctgctgtgatcatcagcagcagggtattactctgtttttcacaactgtttcgatgcgtttgaggcccaaaaggacttgttctggtgttgtttgctttggtggatttcatataaaccgatttttacatcctattttgctcttgagacggccgattacttgaaaatttttgctgagtttttcaaattaaattcaattttatttgtgtttcctgttgaaaaaaaccaattttctgggcatatttcgaggggttttgaagatttgaagaaatcatgaaaatgtccgagtctcggagacaatctcagaaatcgaagattagggaagaatcagcccgacccatgaggaaaatccggatcgtttgtgacgacccggaagctactgattcatctgatgatgaaggggttgatgtatcgaaacccaaacgaattgttagggagatttatcttcctgttgttagctctt

SEQ ID NO: 7807 - DNA, 756 bp, Lycopersicon esculentum
  Predicted polypeptide sequence is orthologous to G869
cagtcacaaaagcatgttaccttggagcctgaatggcataaccatggggaaattgagaaaaaaaacctttcaagaaaaagcaggtatgccaaaggctttaacctctaaccatgcatgccatctaacaaaccaataaatgtcatgaatctagaatcttgtaaacaaacatcatgttcattgtctaaatcagctgataggtgtaatactatgaaaagaaatcctaaagctaagtcaggcttacttggaatccgaaagcaaaagaatgggagatatagtgctgaaattagagacccgattaagcataagcaagtatggttaggtactttcaacactattgaagaggcttcacaagcttatttatccaagaagtctgagtttgatatgttaactcagggatataaggaggataaaccaaataattgtgatcaaactaagcctgaatcatctgttggggcatcattgtctagtgggggtagaaataaaaaaatggattctcccaaacaacgcgtatcattggggttcgcaagaaccagtgggggaaatatacatctgagattataaaccccattagtaagaaaaagatttggttggggacttttggcacgtatgaagaggcttccctagcttatcaatctaagaagctagagtttcgggaaatagtcaaggcaaagaagaaatgtagtaagaaaattcatttaaatgcaagggagaagcaagttgggaaagagaaaatagctgtaaattgtggaagatttc

SEQ ID NO: 7808 - DNA, 390 bp, Lycopersicon esculentum
  Predicted polypeptide sequence is orthologous to G869
ggatgcagagtgtttaacttaggtttaatggctaatgtttgtggcacaaaatcatctgatgactgtaacaatactacaagttgcaatcctaaagttaaggtaagcttgattggagccagaaggcaaaagaatgggagatatgaagctgtaattacagatccatttacgcataagagagtccggttggggacttttgacacagttgaagaggcttcacaagcttatttctataagaagtcggagtttgagaaattaagccatcagggaaatcagcagaatatactgaagaagaattgcgatcatattcagcagcttgaatcatcgtttgtggtggcatccttagatactgttgctagtgaaagtggaatatctaaaagaatcgattctcaa

SEQ ID NO: 7809 - DNA, 1260 bp, Lycopersicon esculentum
  Predicted polypeptide sequence is orthologous to G881
gaaagatggatataattggagaaaatatggtcaaaaagtgacaagagataatccttctccaagagcctattttaagtgttcatttgcaccatcatgtccagtcaagaaaaaggttagtttactactcccttctctctattttaattatcatgcttattaaaaataattaatttaaaatagttatcatttttaaaaattaaatatttattttcaattttacccttgctcaataaataaagatagatattaatgaagtgaaaaacaacataatataaaattaaattaaagtaaaaaagtaaataaagataatttattcaaattatgcttttagttgattctccctcaaatgttgactgaatttatgaggcagtgtacacataaaaatattgaagaatataatttaaatacactttccactattgtctttttcatcggtataacttgtcttctagaaaatatcaaattttattaagaaagagacaaattttgaaaaaaaattaaaccttgaactttgaatactttaattattttaaataataaaaaaagcctaaaattcaattaatataaaatagaggaagtattttattagtggttgtgcaaataaaaacatgacaaatagaagacaaaagatggagttagatggagcttcatgggttcggacgaactcagtagctttttcataaaccctacacttgtattaaaaatttaattaaatatttatgtatattaatttatgaatcactaacaaagttaattgacgtttgttaacaaaatttagaaccccaaaacacttaatccccgcttcggctatgaactagaaggagtaaatgcttggaaaaggatgtgtttactttaatgttcccacctaacataagagtatagaaatgaaataacattactatactaagtatttaattttgtgttgtctaaatttcttttatattaataggtacaaagaagtgttaaagatgcatcaattttagtagctacatatgaaggggaacacaatcatccccaaccacctcaagctgaaataacagtgccattagtgaatacaacagatccaacatttttgaacaaattcatgaaagacatcaacacaaattcagtgcaacaacaatatttagtcgaacaaatggcgtcttcgttgtcgaagaatcctagttttgcagctacagttgctacagccatctcaggattacttttttgaattatatgatgatttaattacctttcaaatgacacaaaattactgtttgt

SEQ ID NO: 7810 - DNA, 1042 bp, Lycopersicon esculentum
  Predicted polypeptide sequence is orthologous to G881
ggagaaaatcattggcaggaaattttctttttagcatcaagaatagtttaagcaagtggtgatagtaatatataaattatatattcgaagggggaagaaaagtttcagtttttccgagtttcatactccctgtcggctcaacagtgttccccaagatgatacgagttgccgctcaagccacaaattttctatccgtactcgactctgtggtgaagttgctcacgaaagcttcagtctcagaatgctgccttaaaagaaggaaacctcaaatcagatttcatatttttgtgtattggcatgttttgaccaatgaattgattagatgttagtagactgggttgtttcgacttcgtgctgacttcagataagtagcatacatttaatttttttcttatatttatcaagttatctttcagttccttctctcttgtgtcaactcgtcttgtttcgttcagttgattgcttgttggtgattatgaatatgaactgggactatttgttctctcttgtatttagctcgcgatatgacttgaatatgtatgtggatattggtaggcttaccactctgttcttattttggacttccatagcattgttgtcctcgtcttttggttttttttctcgatcggaagtggaaaagttttttttttgttgtggagccgactgtggagagtgtctttatctgtgaattatttgtgatatgatttacataaaatgatcattaaatgatttagtttctgatcatccgaaagaatacgatagtttttctatcttgtatcatttattcgtttcatcttgcctcttataaaactggtagttttcatcctagttcctctaaagttttcacttcaaaattttcttgctttgcttatgtgttattattttagaaatttttttgactctttggcagctgtgatttagtaaaagaattttgcagctttgttcttgttgttgttgttttccttgtgtttgatgctttccccttaggtctcaagttcttgttctttcattgttagaatgattcactgtaacagtagtgatt

SEQ ID NO: 7811 - DNA, 1302 bp, Lycopersicon esculentum
  Predicted polypeptide sequence is orthologous to G896
gcacggtaaaagcatcaccattttcaatttatcaaattaattgaaacaagaagaagaaagaaaaaacatgatgatgcttgtcaattgttccaagtgtcacacccccttacaactcccaccaggtgcaaagtccattcgctgcgccatctgcagagccatcacactaattgctgatcctcacgctgctccgccaacacccccttccgcttacaataaccactactatcccccttcttctccttctcctgctcttgctccatctacttatagttccggtcaaaattcatcgtcacgaaagagggcggtcatcgtaggtatttcgtatacgaatacgaggaatgaactgaagggatgtattaatgatgctaaatgtatgaaatttttgctcaccaatcgattcaactttcctcaagactctattctcatgcttactgaagaagagagggatccatacagaataccgacaaaacataacataagaatggcgatgtactggcttatgcaaggttgtcaagcaggggattctctggtgttccattattctggtcatggttcacaacaaagaaattacaccggagatgaagttgatgggttcgatgaaacactttgtccgttggattttgaaacccaaggaatgattgttgatgatgaaattaatgcaacacttgttaggcctcttccgcgtggagctaagcttcatgctattatagatgcttgtcacagtggtactatgcttgacctaccgtttctttgtaggatggacaggactggacgatatgtatgggaagatcatcgtcctcgatcaggagcatggaaaggaacaagtgggggagaggtcatatccttcagcggttgtgatgatgatcaaatctctgctgatacggataatttgtccaaggtcacttcaactggtgcaatgacgttttccttcatccaagcaatcgagcaaggaaaaggaactacatatggaggtattctaaatgcaatgagatctgccattcgcagttctgataatggtgtaggagctggcattgtgacatcgctattgactatgctgatcactggaggaagtgctggcattggaatgagacaggagccacaattgacagcaaatgaaccatttgatgtgtacaccaagccattttcattgtagcatcttactcatcaagcaacactaccaacctaaggtttttcatattttcatttagcttttgggtgttgaattcctgtacagttaccaagaaggcagttgtagagtactaagattcttatattcatcaatttcataaaatattaaaaaaa

SEQ ID NO: 7812 - DNA, 405 bp, Lycopersicon esculentum
  Predicted polypeptide sequence is orthologous to G896
ggtcaatccactttgatcaccctccatacaatggacagcaggagatgcaaatgccagtggtgtgggatgaagatagcagctcccattggagcacaaacagctacctgtccgaggtgccaatctgtgacacaactccaacctgcaagaaaccatggctttgctaattttcccactgccaataacaatatgagcccagcttttccatcaaggccaggaaggatgtgtgcaaatgctaataattttcagcctcaacaattcaaccgccctatgtcaccacagatcaataatatccgacctcctgcagtacatggacgaaaaagagcggttctgtgcggaatcacttaccgtggccatccaaagagtctgaagggaagcattaatgatgttttatccatgagatatttt

SEQ ID NO: 7813 - DNA, 253 bp, Lycopersicon esculentum
  Predicted polypeptide sequence is orthologous to G896
tacactactctggccatggcacacgagtacgagaccatgatggtgatgagattgatgggcacgacgaatcactatgccctgttgattttgagacagaagggaggatactagatgatgagatcaataataccattgtcaggcccttaccccgcggagccacacttcatggaataattgatacatgctttagtggaactttcctagatttgccctttttgtgcagaataaacagggcaggatactttatgtggga

SEQ ID NO: 7814 - DNA, 636 bp, Lycopersicon esculentum
  Predicted polypeptide sequence is orthologous to G910
ggccattatggggatttggcttgaaagatttggaaaatgccactccaccagatcagttcatctcaacatcgaatggtaaagcgaatggagttaaggtcatttcaaaaaaatttaaacggtctcactcatcaccagggggctcttccttagcttctgaactcgacttcacaggtctcgttgtttctcctgaatcagaagtgggatcaactagttactacactaaggtgttaagcttgcgtaaacggagagagaatacttctcttattctacagcagattcttgacttggaaagacttcagctgactgagggcagtaacaatttaacaagtggagaaagtcgaaataatgtttcttcattgaaaaattgtacatcatggaatatgcataacaaatttgattgcttgcagagttcacttgatcttggccctgaacttcaggattggggcagtactcatgaaagtccagttgatgaatcgtttccattaccgttgcctgatggtgattcgttttgggaatgtaaaagtccggttcagagtagtcagctttggcctcaaaatctgcaagatctaagagcttatgctgaactaaaacgtttcgataattccaatatgccctgatgtgatttgaccttccaaa

SEQ ID NO: 7815 - DNA, 451 bp, Lycopersicon esculentum
  Predicted polypeptide sequence is orthologous to G910
gaaaagtacatcaagagaaagtgtttataatatgataggatatatattcttgtgactctcaaaaaatcacttttttttttttttatctcaagaaattttctaattttttttttttgttgattcaagaaagttgacttcttagaagacattaatcacagatgtgcagaacaactgtttcgagggctcgttcgaatttgtaaagatggaaatggagaaagcatgtgaattttgcatgttattgaagccagtggtgtattgtgaagctgatgcagcacatctttgtttatcttgtgatgctaaagttcattcagctaatgccctctctaatcgtcatcctcgtactcttgtctgcgagtgttgtggacacaaccctgcttatattcgatgttctgatcatcaaacgttcatgtgtcgtgactgtgaccgatgccatcatgatctctcttctcac

SEQ ID NO: 7816 - DNA, 539 bp, Lycopersicon esculentum
  Predicted polypeptide sequence is orthologous to G921
cttcaattcccccccaattttccaattctctataacaaaaattttaatcaattttgaagaacaaaaatcaaagcaaaatggagttcacaagtttagttgatacttctctggatttgaactttagacctcttcgagtttccgatgaattaccagtatgtggaaagcgatataattttttttttgttctcaatataattattttgatgtgatgatttgatttttcgttgcagaaacaggaagttgagagtaatttcataggacttggaagagatctggtacctgtaaaagatgaggcaagtaatttaatagaggaactaaatagagtaaatgctgaaaataagaaattgacggagatgttaacagttatgtgccagaattacaattcattgaggaaccaattgacggaatatatgagcaagcagaatagtagtactagtggagctgatcaggatcagaacagcgatggatcgaagaaaattaaaattgaaaacaacaacaataataataataataatgaaattgtgaaatcgtcagttcaa

SEQ ID NO: 7817 - DNA, 1473 bp, Lycopersicon esculentum
  Predicted polypeptide sequence is orthologous to G921
ctgcaggaattttttaccagcttcaattcccccccaattttccaattctctataacaaaaattttaatcaattttgaagaacaaaaatcaaagcaaaatggagttcacaagtttagttgatacttctctggatttgaactttagacctcttcgagtttccgatgaattaccaaaacaggaagttgagagtaatttcataggacttggaagagatctggtacctgtaaaagatgaggcaagtaatttaatagaggaactaaatagagtaaatgctgaaaataagaaattgacggagatgttaacagttatgtgccagaattacaattcattgaggaaccaattgacggaatatatgagcaagcagaatagtagtactagtggagctgatcaggatcagaacagcgatggatcgaagaaaattaaaattgaaaacaacaacaataataataataataatgaaattgtgaaatcgtcagttcaagtgttgaattcagagagcagctcaagtgatgaagattcatctacaaagaaaccaagagaagaacacattaaaactaagacttcaagagtttatatgagaactgaaccatctgatacttctcttatagtgaaagatggataccagtggaggaaatatggacagaaagtaacaagagacaatccatctccaagagcttatttcaaatgctcttttgctcctacctgtcccgttaagaaaaaggttcaaagaagcgtggaagaccaatcgattctagtagcaacctatgaaggagaacacaaccattctaaagtggataccgcaggccctgttacaacaacttccccgtctagccgatttaacccgaaaaataatacttatgctgctgcggtaatgccaagacaaaccttaactcttgatttggcagaaccaaaaacattacaaaatgatatcaaaaaagttcatagcattacaagtacaagtagtgcaagtggtcagaagcgtaaatcaccaggaactgatcaacaacagcaaaatagaccagagtttcaacatttcttgatagaacaaatggcttcatcattgactaaagatccaagttttcaagcagccttagcagccgccatatcaggaaaattcttgcaaaataatagtaacactaaggataaataattaaaacgaaaattatgttgacacattgaaatgttccagagaaagacaggcagccactaggacatgtcgttataaattgtatatattgtttactatatttgtcttctttttttttgggagaacagtagccagtaggtaggactagtaagtgcacgtgaaaatgggatgggctaattttctatagcagcctatattagttaggtctcagtttgctccttttcagtctcacaagattgagacttttggtggcccttgaaattaaagtgttggatttgctcaaataaatatttttataatttgatttaaaaaaaaaaaaaaaaaaa

SEQ ID NO: 7818 - DNA, 981 bp, Lycopersicon esculentum
  Predicted polypeptide sequence is orthologous to G921
gaatatatttaattactcccactttctttatcccttataaataccaatcttacccaattcctctcttcattccatcaataaaaccaaaaatagaaagagagaaaaaaataataatattaaaattagattatattccatagacacaagtatgggaaacaagtctttttttattgaccttaacacaaatcccttattgcacaacatcaatagaagtccgataccgcgtgagacgttggatgaagaattgagtaggatgagagaggagaacaagaaactagcaacaacactaacaagtttgtatgaaaagtacaattctttgcaaactcatataattgagttgcaacaaaaatactcaaatcatgaagaagacaactctaaattattattatcaagaaaaagaaaggctgaagaagattattgtgtgaataattcatacatcaattttgaagaagcatcaccaaagatgccaagagaaatcacaactaatatttcaactgtttgtgttaaaactaatccctccgatcaaacttcagtggtgaaagatggatataattggagaaaatatggtcaaaaagtgacaagagataatccttctccaagagcctattttaagtgttcatttgcaccatcatgtccagtcaagaaaaaggtacaaagaagtgttaaagatgcatcaattttagtagctacatatgaaggggaacacaatcatccccaaccacctcaagctgaaataacagtgccattagtgaatacaacagatccaacatttttgaacaaattcatgaaagacatcaacacaaattcagtgcaacaacaatatttagtcgaacaaatggcgtcttcgttgtcgaagaatcctaattttgcagctacagttgctacagccatctcaagattacttttttgaattatatgaagaattaattacctttccaatgacacaaaattactggttggtgagaagataaattggtattg

SEQ ID NO: 7819 - DNA, 1603 bp, Lycopersicon esculentum
  Predicted polypeptide sequence is orthologous to G921
cagattttgaggagataaaaagaaagtgtttgtttctttaacttaaacacacctgaagaaagactacaactttgttgattcttggaattttcatacatcaaagaagatattaattacaatggaatttaccagtttggttgatacttcattggatttgagctttaggcctcgtcaaaaagtcctgaaacaagaagtgcagagtgatttcactggattgagcatagaaagagagaatatggtggtgaaaaatgaggcaggggatttgttagaggaactaaacagagtgagtagtgaaaacaagaagttaacagagatgcttactgtagtttgtgaaaattacaatgctttaagaaaccaaatgatggagtatatgagcacacaaaatggtgtagctgaagatactagtgcagggtcaaggaaaagaaaagctgaaagtatctctaatcctgttaacaacaacaacaataataataacaatatggatgttgttcatggacgttcatcagaaagcagttcgagtgacgaagagtcctgttgcaagaaactcagagaggagcacataaaagcgaaagttacaattgtttctatgaagactgatgcatctgatacctctcttattgtaaaggatggttatcagtggagaaagtatggtcagaaagtaactagagacaacccttgtccaagagcttacttcagatgctcatttgcacctggttgccctgtcaagaaaaaggttcagagaagcattgaagatcagtctattgtggtagcaacatatgaaggagaacataaccatccacaaacctcaaaaccagaatcaggtccaagtactaatacttccacagccagccgattaaatgtgacaactatcgcgggcactactacttcagtcccttgctctaccactctcaattcctcaggaccaaccattactctcgatcttactgcaccgaaaacagtggaaaagcgcgatatgaagatgaatcacagtactactagtcctaccagtggcaatagcattagaacaacaacaacaacatcagcagcaggaggtgaatatcaaaataggccagagtttcaacagttcttgatagaacaaatggctacttccttgaccaaagatccaagtttcaaagcagcacttgctgccgccatatcaggaaaaatcctccaacataataatcagacagggagatggtaaacaaaagtccagcagagcagtcaactactttgtatagacaattgttcaatattttccaacttgactcatatcaaaagttcttaggaggaaaaaggaaacacaaattattgttcaaatgtaaatacaggaaaagttagtaacatttggaccgcaaagttggactcggagatgcacgtgagaatgggatcttactagactcttaagaaattttcaacagcagccatactgggtcccctgcagaatggacttgctctgagttggctagattgagactgaattgtcctagaagcatttaagttgttgaatttgacaactttgtagaatactgagatgagattatgaaatatacaacttactgttctgttcactgactttaaaaaaaaaaaaaaaaaaaaaactcga

SEQ ID NO: 7820 - DNA, 638 bp, Lycopersicon esculentum
  Predicted polypeptide sequence is orthologous to G921
ggaagaagacaactctaaattattattatcaagaaaaagaaaggctgaagaagattattgtgtgaataattcatacatcaattttgaagaagcatcaccaaagatgccaagagaaatcacaactaatatttcaactgtttgtgttaaaactaatccctccgatcaaacttcagtggtgaaagatggatataattggagaaaatatggtcaaaaagtgacaagagataatccttctccaagagcctattttaagtgttcatttgcaccatcatgtccagtcaagaaaaaggtacaaagaagtgttaaagatgcatcaattttagtagctacatatgaaggggaacacaatcatccccaaccacctcaagctgaaataacagtgccattagtgaatacaacagatccaacatttttgaacaaattcatgaaagacatcaacacaaattcagtgcaacaacaatatttagtcgaacaaatggcgtcttcgttgtcgaagaatcctagttttgcagctacagttgctacagccatctcaggattacttttttgaattatatgatgatttaattacctttcaaatgacacaaaattactgtttgttgagaggattaaattgttattgtattatatattggagt

SEQ ID NO: 7821 - DNA, 434 bp, Lycopersicon esculentum
  Predicted polypeptide sequence is orthologous to G921
ttttcttatagattcaatggatacaaacttgggagacaataatttttctattgaccttaacacaaacctctctttgcacaacaccaacacaagtccgagcgagacgttggatgaagaattgattaggactagagaggagaacaagaagttagtaacaatgctcacaaatttgtgtgagaagtacaattccttgcaaactcacctaattgaattgctgcaaaaatactctagtaataatgaagaggacaattccaatttattattatcaaggaaaagaaaagctgaagaagagtgttgtgttaataattttgaagaagcatcaccaaagaggccaagagaaatcacaaccaatgtttcaactgtttgtattaaaactaatcgatccgatcaaacttcagtggtgaaggatggatataactggagaaaatatggtc

SEQ ID NO: 7822 - DNA, 270 bp, Lycopersicon esculentum
  Predicted polypeptide sequence is orthologous to G927
cccccaaacattcattttgcttcctctgttcgtgcagggaatatgggctatccaggtcactttgagctaggctctggtcagtccctgatttatgcaaaacatccttatggagagcaatgcattgggttattttcggcttatgctcctaaactttcgggccgtattatgctaccattgaatccggcttctgatgaaggtccgatattcataaatgccaaacagtatcatgggatactaaggcgtagaaagaccagggctaaggaaatggac

SEQ ID NO: 7823 - DNA, 591 bp, Lycopersicon esculentum
  Predicted polypeptide sequence is orthologous to G927
gagaaattgtactgacatggctgctactaaatggggtttctctaattgactgtacaatcacacaaagcttaaagttttcatcttggtacaactattacttcactaggaacataattcctttagattttcaagagaaaaggtgtgagttgctcttgtataaccatgaatactactatattttccaaaggaaatgaacgggttgtccagaatcaatctgttggaacattgtgctctgctccttggtggagtaatggttttatgtctcaatctgtggcttatgctgagccttttggacaattgaaatctgcatctgtggagcagcagcctaaggggaatgcaacagagttcactatttcctctggtgattgcaaatcttcggcaaatgggcaaaaacttccgaacattcaggctgcttcctctgttcgggcagctaatatggactatccaggtcactttgagctaggttgtggtcagtccctgatttatgcaaaacatccttatggagagcaatgcattgggttattttcggcttatgctcctcaactttcgggccgcattatgctaccattgaatttggcttctgatgaaggt

SEQ ID NO: 7824 - DNA, 174 bp, Lycopersicon esculentum
  Predicted polypeptide sequence is orthologous to G937
cttatttggacctgttgttctcttattttgatcatgtggctttcttctatttaggccttaaacatgcagcctgcttttcaaaatatgtgcttttacttgataatgtggaagttgttcatccttgatttactcttcaagggaaggcggatggcctgtgggtcagcatagaacata

SEQ ID NO: 7825 - DNA, 2473 bp, Lycopersicon esculentum
  Predicted polypeptide sequence is orthologous to G938
aaaaggctcaattattattctctaagctgagttccagttgaaccacagttttgcaacgacataaaaaaagtgatctttttgaggctcatgtaatttgatcaatttcaattagattctgatctgaatattggattttgggtattagctgcttaatcctgtggaagttgcaagtagcttcacctttttcatcctgtggaagatgatgatgtttgaggaaatggggttctgtggggatcttgatttcttccctgctccgctgaaggaagtggaagtgtctgctccgcagagtcagactgagccggattctgtggtggatgatgattatagtgatgaggaggagattgaagtggatgagctggagaggaggatgtggagggacaagatgaagttgaaaaggctgaaagaaatgagtaaaagtaaggaaggtgttgatcctgcaaaacaacgtcagtcgcaggagcaggcgaggaggaagaagatgtcaagggcacaggatgggatcttgaagtacatgctgaaaatgatggaagtatgtaaagctcaggggtttgtttatgggatcattccggaaaaaggcaagccagttagtggggcatctgataatcttagggagtggtggaaggataaggtgaggttcgatcgaaatggtcctgcagcaatagccaaataccaagctgatcatgccatccctggcatgaacgaggggtctaatccagttggtcctacccctcacaccttgcaggagctgcaagataccacccttggttcgttattatcagctttgatgcagcactgtgatcctcctcagagaagatttccattggagaaaggtgttccaccaccatggtggcccacaggaaaggaggattggtggcctcaattgggtttgcagaaggaccaaggttctctaccttacaagaagcctcatgatctgaagaaggcgtggaaggttggtgtcctaacagcggtgatcaagcacatgttccctgatattgctaaaatccgcaagctggtaaggcagtcaaagtgcttacaggacaagatgacagccaaggaaagtgcaacttggcttgccatcatcagtcaggaggaagctttggctcgagaactctatcccgatcgctgtccacctttgtcctcagctggtgttagtggaaatttcatgttgaacgacagcagtgagtatgatgttgaaggtgctcaagatgagcctaactttgatgttcatgagcaaaaaccaaaccatctcaatctgttgaacatcagtgctgagagattcaaggagacgatgcctcttcagcaacaatctcatccaaacaaggatgaactggtcacaaacttagacttcagtctgaagaggaagcaagctaatgaacctactgtgatgatggatcaaaagatatacacatgcgagtttcttcaatgccctcacaatgaacttcgccatggttttcaggacagatcttccagagacaatcatcaatttgcttgcctttaccgaagttctacctgttttggagtttcaaactttcagattaatgaagtcaagccagttgtgttccctcaacaatatgtccagccaaagtcatctgctctgcctgttaatcaaggtccaccttcctttgatctatctggtataggagttcctgaagatgggcaaaggatgattaatgagcttatgtcaatctatgatagtgatgtacaaggaagcaaaaggcaaaatagggggaacattgcattgaccaaagagcagcctcatcaacaacctcgtgtccaccaggacaactacctgctcagccaagggataatggacggaaatatcttcaaaaacactaatatttccacaactcagtctatgctcccacaagtcgatccatttgatcaatccaaggctttcaatgcaggctccaacgacaacttccatttcatgtttgggtctccattcaacatacaatctaccaattataacggaaatctacctagcattggatacgataccacaccaaaacaagatgctcctatttggtactagccagccagaagtctgttgacatgttgtatatcaagtagtcagttttggcttcatagatatagcgatttctcatgggtaaaaagatcccatgtactcgtctgcttttttcattctggtggatttttcatcgcctatagtcctcttagttatggtgttttcagttaccatgtgttgtaaaggttgaagaactaggcatggtgtaaacaaacacccctcaaatacttgccaatgcttctcataggacatgtagatataaataagttacttgtttcatcatggccagttttatcagtctctttaaaactgttgaatttataggctatggttaaggtctttactccttgtttaatacttcttctcaagattgtttgggatatcaatgttgttattgttgccatatcttatatgatgtttttctttcaaaaaaaaaaaaaaaaaaaa

SEQ ID NO: 7826 - DNA, 1102 bp, Lycopersicon esculentum
  Predicted polypeptide sequence is orthologous to G938
ttttttttttttttttttttaaaacataattgcataaagataattattgtgtttagcacttacaaccatggaaacatcaactacatcacaaagaaactacaatacctgtatatataaaggacagagagttgatcactttttttttttttttcaatttaaaacataattgcataaagataattattgtgtttagcacttacaaccatggaaacatcaactacatcacaaagaaactacaatacctgtatatataaaggacagagagttgatcacttatctaaacatatacaacctatcaagccttcatataggaaataagacagtttaatactagtactagttcagaggtaccatgtagatatatcctgctttgtcagctgttccacggcgtagtcgcttcctcccaagttgaacggggaaccgaatctgtaatcagttatatcatttatgtttccaccgaagggggcgtcaaaggacattttgcattgatcatattgaaactctgttgaacgataaacaggcatgctggtttcttgagctgaggtctccatatgtcctaggttgatgttgccatccatgggaagttcaactgtttgttgctgaggcaggctttggtttactagaatctcagaaattccggaacagatgctaccattttgctgaaagttgttgtcgtatgatgttatgaggtcagaaatgatcctctgatcatcttcagggagtccaagccccgaggcactcatcgaagaggaagcagtgactgacgagaccgctggcttagaagttgcagtttgtgcaggaaaaactgtgttgtgctcatagttgatctgatacttaggtgtagtaagtgtttgagcagaattgaaccggaatggacaactcatttggtggttgtttcttgaagtcctgtcaaggaatccagcttgataattgctgtatgggcagtgaaggtactcacaagtatatatcttttgatcaacagactcctcaaaacatggttccttcctcttctggataaaatcggaagttaaatcaataatttctcctttcactggagctaaacctggcatcaaaaccctatctttaggtaacataattccag

SEQ ID NO: 7827 - DNA, 878 bp, Lycopersicon esculentum
  Predicted polypeptide sequence is orthologous to G938
aatgtattccctttgttctctgttgtcttctctctctctaccttctatattctgaagggtcaattcttgaacaaaattttggaagcaaaaagaagaaacccctttgaggttgctggtttttttcaaaccaaaatttggctgccaagatgatgatgtttgaagacattgggttttgtgctgatcttgatttcttccctgctccgctgaaggaggcggaaacagtagctgctgttccaccaattgtgccggagccgatgatggatgatgatgatagtgatgaggagatcgatgtggatgagctggagaagaggatgtggagggataagatgaagctgaaaaggctgaaagaaatgagcaagggcaaggaaggtgttgatgctgtcaaacaacgccagtctcaggagcaagctaggaggaagaagatgtccagggctcaagatgggatcttgaagtacatgttgaagatgatggaagtctgtaaggctcagggttttgtttatggaattatcccggagaaaggcaaaccggtgactggggcatcggataatctcagggagtggtggaaggataaagtgaggtttgatcgcaatggacctgctgcgatagcaaagtaccaagctgacaatgccatccctggcaagaacgagggtgctaatccgattggtccaacccctcataccttgcaggagcttcaagataccacccttggttctctactgtcagctttaatgcaacattgtgatcctcctcagaggcgatttccattggaaaaaggtgtatcacctccatggtggccaaatggacaggaggattggtggcctcagttgggactgccaaatgatcaacgtcctcacaccttacaagaagcctcatgatct

SEQ ID NO: 7828 - DNA, 1160 bp, Lycopersicon esculentum
  Predicted polypeptide sequence is orthologous to G938
cgagggatgaccctatctttgatgttctggatctgcaaccaaaccatctcagtttgctgaatgtcaatgttgagatgttcaaggagaagctgcctctgctacagcagtctcagccaatgaagggtgacatttttgccaacttagatttcactcgcaagaggaagccggctgatgacttgactttcctgatggatccgaagacatatacttgcgagtgtcttcattgccctcatagtgagcttcgcaatggttttccagacagatccagcagagacaatcatcagctaacttgcctcttcaggaatacttctcaatttgtagttccaaactttcacatggaggaggtcaagccagttgtcttccctcaacagtatgctgagccaaagcgggcttcgcttccggtcaacccagctccaccctcctttgatacatctggacttggggttcctgcagatgggcagagggtgatcaatgagcttatgtcattctatgaaagtaatgtgcaaggaaacaaaagttcaatggcggggaactctgtgatgtccaaagagcagcctcttcaacaacctagcattcaacagaacaattaccttcaaagccaagggaatgtgttggagggaagcatctttggggacaccaacatttctgctaacaactccatgtttgtgcagggtgatcggtttgatcagagcaaggttttaacttcaccattcaatgcaagctctactgatgatttcaatttcatgtttggatctccattcaacatgcaatccactgatctctctgaatgtctttctgggatttcacatgatgacgtgacgaagcaagatgcctcggtttggtactagcaatgcgattactcaaatgaacatcaagcagtggatatcacaatatacctttaatcaggtggatttcagtttgcctatagttctcagtttggtttttctgttaccatgtagttgtagaggttggaggatcgtgcatgacgttattacaagggagtagtaagagatgtcatgctgctggttagaaggaacttatagatgtttctaaataaggtttagcagtcagtttattttcatatatgtctataactctatataggttttagctttatcccatagtcaatcgttggtttcggagataaaaaaaaaaaaaaa

SEQ ID NO: 7829 - DNA, 913 bp, Lycopersicon esculentum
  Predicted polypeptide sequence is orthologous to G938
gcttcctctcttcttcttactttccaatacacaacaaaagtgaaaacatcacttcaatacacctaacattcttctcaaaccccttctctttctctcttttttctttttttttttggttcaaaatcaaagtagtatagccatagataacagcttcaacaagctgttttcaagaaaatcataatttggtaaatggggatatttgaagatatggggttctctggaaattttgagtttctatctgattctatgggatgtggagctcaagaagttgagcataagccggttgggttggaggaggatgattatagtgatgaggagatggatgtggaagagctagagaggaggatgtggagggatcgaatgcttttgaggcgtctcaaagagaaaaacaagaataaagtggtgggggatggtgcgaagcagcgtcagtcgcaggagcaggctcgtagaaagaagatgtcgcgtgcacaagatggtatactgaagtacatgctgaaaatgatggaggtttgtaatgctcagggttttgtttatggaattatccctgagaaagggaagcctgtgactggtgcttcggacaatcttcgtgcttggtggaaggaaaaggtcagatttgatcgaaatggccctgctgctattgctaagtatcaggctgataatcagattcctgggagagttgaggaatcgagtgtgatagtttccactccccacactttacaggagctgcaggatacaactctaggatcccttttgtctgctttgatgcagcactgtgatcctccacagaggcggtttccgttggagaagggggtatctccaccctggtggccctctggtaaagaggaatggtggggtcagttgggtctgccaaatgatcaagttcaacctccatacaagaagcctcatgatctga

SEQ ID NO: 7830 - DNA, 575 bp, Lycopersicon esculentum
  Predicted polypeptide sequence is orthologous to G938
tgaagatgggcaaaggatgattgatgaccttatgtcattctatgattgtaatatacaaggaaacaaaagccaaaatacgggaaatgttgcagtgaccaaagagcagcagcctcatcaacaacctcgtgttgaccaggtcaattacctacacagtcgagggatgatggaggggaatatcttcaaagacattaatgtttccgcaagtcagtctatgcagccacaaggcaatcttgttgatcaatgcaagatcctaaattcaagtgacaatttgcaattcatgtttgggcctccattcaacttacagtccaccaattaccctggaagtctgcctggcattggatgtgacaccacaccgaagcaagatattccaatttggtactagccatgatattggtgaaacgtatatagtcagtcggggcttcatagatatagcttgttccccgagattggcacaccccattataattggtcttcattatcaggtggatttttaatcgcttacaactctcttagtcaagatatttcctgttaccatatgttttagagggttgaaagctaggcggcatggtgtaatt

SEQ ID NO: 7831 - DNA, 474 bp, Lycopersicon esculentum
  Predicted polypeptide sequence is orthologous to G938
gaacgtcccccaccctttcttctctatttcttacttatctttcttctctgtttccatatagtctcttaaaaaatggtcaaattattattctcctaagtagagaaaaagagtttaatcaaattttttcaaatatcataaattcaggattaaatatcgcgtaatttggattgatgagtgttgagaaaggacaggataatctgtgaaaaaattgggtgttagctgctagttctgtttagatttcttgacgtttggtgattagttttttggaggagtttgttcttgtgaagatgatgatgtttgaggaaatggggttctgcggggatcttgatttctttcctgctccgcttaaggaagtggaggtggctgctccacagactgaggcagagcaggtggcggatgatgattatagtgatgaggatattgatgtggatgagctatacaagagagtgtggacggacaagatgaagctgaaaa

SEQ ID NO: 7832 - DNA, 575 bp, Lycopersicon esculentum
  Predicted polypeptide sequence is orthologous to G938
caaagtgcttgcaggataagatgacagcaaaagaaagtgcgacttggcttgctatcatcaatcaggaggaagctttggctcgagaactataccctgatcgttgtccacctttatcgtcagctggtggtagtggaactttcactgtgaatgacagcagtgagtatgatgttgatggtgctcaagatgagtgtaactttgatgttcaagagcaaaaaccacaccatctcaacttgttgaatgtcactgttgagagattcaacgagaggcagcctctgcaacaacagtctcatcctatcaaggatgaaataatcaccagcttagatttcacccgcaagaggaagcaatccaatgaacagactgttaccatggctcagatttatacatgtgagattcttcaatgtccttacagtgaacttcgccacggttttcatgacagatctgcgagagacaatcatcaactggtctgcccttatagaaacacttctcaatttggagtttcaaagtttcccatgaacgaagtcaagccagttgtccttcctcaacaatatatcccgtcaacttcagttgctctgcct

SEQ ID NO: 7833 - DNA, 495 bp, Lycopersicon esculentum
  Predicted polypeptide sequence is orthologous to G938
ggtcaattattattctctaagctgagttccagttgaaacacagttttgcaacaacaacaaaaaaaagtgatctttttcaggctcatgtaatctgatcaacttcaattagattctgatctgaatattggattttgggtattagctgcttaatcctgcttggatcctgtggaagttgcaagtaacttcacttttttcatcttgttaagatgatgatgtttgaggaaatggggttctgtggggatcttggtttctttcctgctccgctgaaggaagtggaagtggaagtggctgctccacagagtcagactgagccggattctgtggttgatgatgattatagtgatgaggaggagattgatgtggatgagctggagaggaggatgtggagggacaagatgaagttgaaaaggctgaaagaaatgagtaaaagtaaggaaggtgtcgatcctgcaaaacaacgtcagtcgcaggagcaggcgaggaggaagaagatgt

SEQ ID NO: 7834 - DNA, 581 bp, Lycopersicon esculentum
  Predicted polypeptide sequence is orthologous to G938
ctgttataaagcatatgtcacctgatattgcaaagatcaggagactagtgcggcagtcaaagtgtttacaggataagatgacggcaaaggagagctcaatatggttagctgttttaagcagagaggaatccactatccggctacaaaccaatgacaatgggtcatctagcataagtgaggcacctattagaggtcatggtgacaaaaagaaatcttctgttgatagtgacagtgattatgatgttgatgatgttaatgtctctgtttcatctagagatgagaggagaaatgaaccattggatgctcgtcctctaactgatgttcctcaatctcaccaaagtaaggagcagggagatggacaacgtcgaagaagaaaacgtgctaggtcaaactttcaacagactcaactgtctcccagtgagcagcaaccttatgacgtggctagaaactccttacctgatatgaacaatgccaatgcgcagttttctgggtacattgcaaatgaaagccaaccagagaacaatatgatggtaccgaggaagtctgtggagagaaactctgagggtcaatctgacttacca

SEQ ID NO: 7835 - DNA, 569 bp, Lycopersicon esculentum
  Predicted polypeptide sequence is orthologous to G938
gatttgctttaccattttggaactacgatagtcaagttggtatgcaattaccatctttgtacaatgatgttaattcaccattgtacgatcctaatcgtaaccaaaaccattttcctcctaatgttgtcgatttagggttcactacgatagacctcgatgcatccgatcaacaaaaaatcaataataatcttactatgatgtatcgacaaatgctcacgaatgcaccttgtcctcaactattttttggaaaccctatacgcggcggggagcagccgattcgtggtatgggtacgattgagaatgtaccacataactctgtccatcgatgggttggtaacccaaataataagtttagggagaatatgggaactttttattcagctgctagagatcccattttctatgctcatcatgctaatgttgataggatgtggacaatatggaagactttaggaggcaaccgacgtgactacaatgatagggattggctagatagtgccttcttattctatgatgaaaatcgtacccttgtgaaagtaactgtccaagattgcataaacaatgagaaa

SEQ ID NO: 7836 - DNA, 593 bp, Lycopersicon esculentum
  Predicted polypeptide sequence is orthologous to G939
gctgcagcagctttagcttttgaatcacttggttcatggttgtggacatcaagtcaaatctttgactctctttagggtcttttggtataatgtataaggaaaatgatcagatatataatttagtataacttaatccaatatttggtcatgatttgaattatgtacaacttaatccaccaatggtgtattgttttataccaccaacagcattgaataactaatccttctataatttatacatggataaaatagcaaaaggacaaactaactttaaattttccctgaagtcaatgaaggtcaagcatttaagggtataactgcaaagtcattactttttagcttagaaagtaaataaatattttaaaattacatcttgtaatccaattttagtgcaatgaactaaacacccaacgagaaataatcttggtatttcttatccctgtataactactaaaattcttacgtaacttagccctgcatcataatccttgtgtaagttgtcttcaaaccaaacaccctttagaacatttgtattattgttgtatcatcataaacataatctgcttctcatatcaaataatgggacttaatga

SEQ ID NO: 7837 - DNA, 555 bp, Lycopersicon esculentum
  Predicted polypeptide sequence is orthologous to G962
atggcaattggcccttttattactacaaacatgagtcaatcccaacaacaacatcaacaacaacaagatgatgatgataacaacaacatcaacaacactattaaaggagatgataatgatgatgacgatgatcatgaacacgacatggtcatgcctggttttcgatttcatcctactgaggaagagcttgtagagttttatcttcgccgtaaggttgaaggaaaacgttttaatgtggaactcatcacttttcttgatctttatcgttatgacccttgggagcttcctgctttggcagcaattggagagaaggagtggtatttctatgtccaagagatagaaagtatagaaatggagataggccaaatagggttacaacatcagggtattggaaggctactggagctgatagaatgattagaacggagaattcgcggtccattggcctgaaaaagacattggttttctactcagggaaggctcctaaaggcataagacgtagttggattatgaatgaatatcgtcttccacatcatgaaactgaacgcctacaaa

SEQ ID NO: 7838 - DNA, 618 bp, Lycopersicon esculentum
  Predicted polypeptide sequence is orthologous to G975
gcctaaccctcatttcatcattcatttctgtgtctacctgaacttctgcaactttttttttttctttttttaaatttgtccccctcttaacaacatggtacaatcaaagaagttcaaaggtgtcagacaacgccagtggggctcttgggtttctgaaattcgccatccgctgctgaagaaaaggatatggttaggaacatttgagacagcagaggaagcagcaagagcgtatgatgaagcagctatcttgatgagtggacaagttgcgaaaacaaacttcccaattgtgaaggagagtactgataacaacaatgacactactaaattccctttaacttcttcatcaacactgtctagtagcatgctgaatgcaaagctgaggaaatgttgcaaggatccagcaccttccatgacctgtctgaggctcgataacgacaactgtcatattggagtgtggcaaaaaacatcagggaaacattcaagttctaattggataacaaaaatctaacttggaaagaaagaggagaagcctcatgatcatcaggatatgaatgctgaacttggcattactaaaccattggacgaagaaaacagaattgctatgcaaatggtggaaga

SEQ ID NO: 7839 - DNA, 451 bp, Lycopersicon esculentum
  Predicted polypeptide sequence is orthologous to G975
ggacaattgcttgcccacattcaagtatggtacaggcaaagaagttcagaggtgtcaggcaacgccattggggttcttgggtcgctgaaattcgtcatcctttactgaagaggagagtgtggctaggtacgtttgaaactgcagaagaagctgcccgagcgtatgatgaggctgctgttttaatgagcggacgtaacgccaaaacaaatttcgcagtgcaagcaatggatgaaaataaaaaagacaattataaatctaataattcgacattatcaggatcatcatcatcactctctgctatacttagcgccaaacttcggaagagctgtaaatcgccatcgccgtctctcacttgtctcaggcttgatacagagagttccaacattggggtttggcagaaacgggccggagcccggcctgattctagctgggtcatgacggttgaatttgg

SEQ ID NO: 7840 - DNA, 850 bp, Lycopersicon esculentum
  Predicted polypeptide sequence is orthologous to G976
cctaccaccccacccccctatagaaatctacatatacatacacacacacaaaaaaaaacatatatatatatggctgactctcaaaattctaccaagtccacccaaataattcaacctcctaatcaatcaagtgaaagtacgaaaatacccttcaacactacccttcctccaccactaccaccgttgccgccgcctccggcgccaccggagacacatattcaaataaccaatacattatcatcaaaattagaaaacacaaatacaactccaaaaaccgttattattccaactgcaatcatgagttccacctcatcgagcggcttgggatctccgagccgctcaataggcggaaaacatgcggtattccgcggaatacgatgtaggagtgggaaatgggtgtcagaaattcgagagccacgtaagactacgagaatatggttaggtacttatcctacacccgaaatggctgctgctgcatacgacgtcgctgcaatggctttaaaaggaaacgacgccgtaattaactttcccggtaatattaattcgtatccttcactccctccttcgcccgccgcggcggatatacgaaaagctgctgacaccgccgccgccctgatgaagattgaatccggagaaaccacctcgggaactcaaccaggtacggatgatcatcggtcattggggaatgtgcatatgatggaaactagggatcatgaatacattgatgaagaagcattatttgatatgcctaatttgctagttgacatggcggaggcaatgatggttagccctccaagaatgagctcaccgcggtctgatgattcaccagaacattctgatgcagaaaatc

SEQ ID NO: 7841 - DNA, 582 bp, Lycopersicon esculentum
  Predicted polypeptide sequence is orthologous to G976
aaaataaaagctacctaagtcagtctcatttgtatggctgcttatcattttaatgacaattctccttcattagaaaatctttcacccactgggggaggaagtagcactaggcatcccaatttcagaggaattcgacagaggaatgggaaatgggtctccgaaattcgcgagcctcgaaagaccacacgtatatggttaggtacttttcccattcctgaaatggcagctgtcgcttacgatgttgcagctttggcattaaaaggtcctgatgcgcaattaaactttcctgatcgtgcatactcctaccctgtccctgcttctctgtcagccgcagatattcgtactgcggctgctaatgctgctgctgctagagcacctcctttgtcagaaatcaatacagcagcaggaggaggacaagggcaagagtttgtggacgaagaggaaatatttggaatgccgaaattgcttgatgatatggcagaggcaatgcttgttagcccgccaaggatgcatcagtacgacgaatcacctgaaaactctgatgcagatagtctctggggttatccatgagtaaaatatatg

SEQ ID NO: 7842 - DNA, 740 bp, Lycopersicon esculentum
  Predicted polypeptide sequence is orthologous to G979
tacggaacagtaaagaaatataagaacatgactgtcgacagcttgaaaaagaaaaaaggagttcaaccgttccctaaatatggagtcaatgactttgaagggccattattgagtcaagcaaccgaaaccgagcaaagaagtcacatctgagctaattataactaagtcatccgcttatattataccaagcaagacccttttgcagtttactcgctagtgtcatcactcactggacgagcctttctatttgtaccagttgagtacgtctgcccaagacccagacaaaaagctttgtaccttaccacggaaactccgctatcaatgtcgtctggcccagttgccccaactggacttaaccatttgacttctgacaataagaggaagagaagccctcttgagtaagggctcttgagttagagttcgaactcaccttctttcttctatttcatagcctcttccgtattctcaatcggaatagccaggccaacaatctttttcttttattaggaaccgaatccgaaagagacgcagcagcaagaggtcctgaatcaaatagagcaagcaagtccgtattctgttcggcttacggcttcattcccagagtaaggagaaagaagacacagcgccggggaatagctccgagagggacttctctgagtaaagagataagtaagggtaagagtcattccaattgagtaggtgaagagtctctttcgagcgagatcctttaccacgcccta

SEQ ID NO: 7843 - DNA, 572 bp, Lycopersicon esculentum
  Predicted polypeptide sequence is orthologous to G979
atttacttgactatatttgggcaaactttcaaataatatatatggcgaaaacctcaaaattgagtaaacaaaacacttgtttaagcaacaaggatactgataatagcatttctaaagtgaagacgaagcgaaaacccagagactcgacgcctcaacgacgtagttcaatatacagaggtgtcaccaggcacagatggacgggtcgatatgaagctcatttatgggataaaaattgttggaacgaatcgcagactaaaaaaggaagacaagtatacttgggggcctacaatgaggaagaagcagctgcacatgcatatgacttggcagcattaaagtattggggtcaacacacaatccttaatttctctgtgtctacttatgaaaaagagataaaagaaatggaaactcaatcaagagaagaatatattggttctttgagaaggagaagtagtggattttcaagaggagtctcgagatatagaggagtagcacgacaccatcacaatggacgatgggaggctcgcattggcagggtgtttggaaataagtatctctaccttggaacatatgct

SEQ ID NO: 7844 - DNA, 600 bp, Lycopersicon esculentum
  Predicted polypeptide sequence is orthologous to G988
cgaggggaaacactctggtttactatgccagttttagttctgaatctcatgtcctattgaccagtggaagtatttgaaatggcacaagcacaaatacttgaccacacgtcgaagaaagaggatgatccttccattgcttctcaaccccttaattgacatagtgatctgtctcttgaagtttcatatgatttgcagctcgctcttctacttcaagcttctgctgaaatgttttccaagagacactatgaacgtgcaacggagttactaagcttgtgtaatctgtctgcttctccaacaggtactccggatcaaagagtagtttactgctatagtgaagctctgcgagagagaatcaataaggagacaaaatcgataaccaggattaccaactagatagaccttgtagattttgaagtgaaaaccaattggcgttgaagagatttccttgtgtacaaagcctcatgtaattgcatgttatcacgcccttcctttttaccaagtcgctcaatttgcttgtattgaagccattttgaataattttaagtcagaaagacgacttcatttgattggttttggaatcagaagtggagctcattggat

SEQ ID NO: 7845 - DNA, 808 bp, Lycopersicon esculentum
  Predicted polypeptide sequence is orthologous to G993
ttgaaatgttacgtaaacacacgtataatgacgaacttcaacatgccaagaaagtatataacaacaatactttcgagatgaatggaaggagcacatgccatactaatactaatatcgcgactttttcattagatactaatgaaaaagtcgcgaatatagctagtgaactgctttttgaaaaagtagttacaccgagcgacgttggaaaacttaataggcttgttattccaaaacaacacgcagagagatatttccctttggttgccaaagtaaataaaaatgataatacttctaaaggggtattattaaatttcgaagatatgaatgggaaaatgtggcgatttcgatattcgtattggaatagtagtcaaagttacgtattaactaaaggatggagtcgttacgttaaggaaaaaaagttgaaggccggagatatagtgagtttcaaacgatgttctggagttgaaatcgaagataaacttcttattgattcgaagaacagaataatacgaggcgaacaagtaaaaatggttagattatttggagtgaatatatgtaaggttcaagatgttagtaataatgttgttgttgagaaaaatatgagtgttggcaaaagaatgagggagatggagttgttggcatttgagtgtagcaagaaacaaagggtaataattgatgccttgtgaatttttcttttgtttgtaattttttttttttgtactttggtttttttagatgttttaatttatataacttccaattgtatattagtgttattaggaaaaaaaaaagggctcaaaaagagagc

SEQ ID NO: 7846 - DNA, 681 bp, Lycopersicon esculentum
  Predicted polypeptide sequence is orthologous to G993
cttcctaattttccttttctcatcaaaaaagacaaaacaacacacacaccaaaaaaaaaatggaaggaagtattagtagcatagatcaagagagtactactagtgactctctctccattgctccggccgcgtcgtcatcgacgatgattaaatcgtcgacgacgataaaactgccgccggagagtggtctttgccggatggggagtggaacaagtgtgataattgatgctgaaaatggtgttgaagctgaatcaagaaaactcccatcttcaaggtacaaaggtgtggtcccacaaccaaatggtcgttggggcgcacaaatctatgaaaagcatcagagggtatggttaggcacattcaacgaggaaaatgaagccgctagggcttatgacatcgcggcccagagattcaggggccgcgacgctgtaactaatttcaaacccttgcttgagaatcaagaaagcgatgacatggaaatcgctttcttgaattcacattccaaggcggagatcgttgacatgttacgtaaacatacgtatatcgatgagttggaacaaagcaagagattgtttggatttactaaagacggtatgataaaaaggaaagatggactagtaattagttcgttctttggtagtaaaaatgataaagtcaattgcaaagcgcgtgaacagctatttg

SEQ ID NO: 7847 - DNA, 246 bp, Lycopersicon esculentum
  misc_feature (240)..(240): n is a, c, g, or t
  Predicted polypeptide sequence is orthologous to G993
cagagacgctgactccacaaacggtgtagaagcagagtcgaaaaatactactattactaataataacaacaataagcttccttcttcaaagttcaaaggtgttgtccctcaaccaaatggtcgatggggtgcacaaatctacgaaaaacatcaaaggatttggcttggtacgttcaatggcgaagaagaagcagcaagagcttatgatatcgcggcacagagattccgtggtagagatgnccggtt

SEQ ID NO: 7848 - DNA, 779 bp, Vitis vinifera
  Predicted polypeptide sequence is orthologous to G1006, G22, G28
acaaggctcagcgtcctcagagaggagaagaagaagaaggagaagaacaacaggccatggctccaccttgccagagcgagttgcctctcaatgagaatgactcacaggacatggtcatataccaagtcctaaacgaggcttttgcactcaacaactcgattatcccaccaattaagcgccaaaccactcccacgtccagcgccctggaacctgctcggacaatagccaagaagcactacaggggcgtgaggcgtcgcccctggggaaagtacgctgcggagatccgggactcagctaaacatggtgcacgtacatggctaggcaccttcgagactgccgaagaggctgccttggcttacgatagggctgctttccggatgcggggttccaaggctctgctcaattttccagtaatagctccgctgcctcttgaatcgggagtagtgcttcatcggcatcggagaccactgttgcggaatcacaagatatgggctcatccgattgcctgcaaactatgtagaactgttttttgagacgaagtgatcaaagtaagtatccatgggcctattatgcaatgggacacaagtcccacgtacgtttctactaatatgcagatgtgttaggttctttcttttttaatttccccccttttgttattttctcaatttttggtgtgagtgaggatgtggtgatcttatcatctgtatatatacgtggtctccagttagtttcctgattataattcaattcacaaaaaaaaaaaaaaaaaaaaaaaaaaa

SEQ ID NO: 7849 - DNA, 510 bp, Vitis vinifera
  Predicted polypeptide sequence is orthologous to G1006, G22, G28
tccctctcacataaacccaacaatactcgatcacaccaaacaagaagctagatttcaattcgatatgtgtgattacagtagtaatccctcttctgacttcgctctcctggagtctgttcgccgccacttgttcgacgactccgactctcgtcgcttcgacgctcccctgtattgccgtagcaatagttttagtagcttgtttgaaactgggggtgaattgcctttgaaggaggatgattccgacgacatggtgatctatgggtttctccgcgacgccgccagcggaggctggacacccacgctcgctccactcttttcagagactgcctcccacggtttctctaccgcccccgcggtggccgtgaaatcggagccggaagtttttccggcggaggttattggagtgcccgagaagacggtggacccaccggcgaaattaccggctccggcggtggtgccggcgaaggggaagcattacaggggcgtgcggcagaggccgtgggggaagtt

SEQ ID NO: 7850 - DNA, 510 bp, Vitis vinifera
  Predicted polypeptide sequence is orthologous to G1033
gttttttttttttttttttttttttttttttgggaacctacaatactatatttaaccaaagaagagagctgatgcaaagtgtacaaataacttaacaagataaaatggcagcacaaggtgcttcttttcctgtttcgagaagcaccacaactgtaaaagtgttaacatacagaatgcagcattgttgcactggatcagccagaatgaccaattcagaaagcatgcaagctcagtcttcatcatcatcctcctcctcctcctcttcctcctctgcactctcctcatcattgatcattcacttcagattttgacctgtcagattcttcatcaccatcatcagcagtgctctcctgcttcttgttgtaagcattcataattttttcgtactcagccttcttttttgcagctttggcctcatatggagctttttcagcctcagacaaggatttccacctctctccgccagctttcccaacagctgagacagccttcacattgggattttccccc

SEQ ID NO: 7851 - DNA, 910 bp, Vitis vinifera
  Predicted polypeptide sequence is orthologous to G1033
ttttttttttttttttttttttttttttttatgctgaatcattgagcattaagaaaaggtgagtacatggccatatgaacgaggccgctcctgaaactaagctttcacctaaaatgggagcagccgaaatttcataaaaaaaaaaaaaaagaacaaaaaaaaagagaactatttatcttgatagagttatcagaaatgggagtcatgatatcctagcgatcctacacaactggcagatctcccttgttgacatccttcactgctggttccctactcttcatcatcttcttcctctccactctcatcctcgtcttcctcgtcgtcgttcacctcagacctagatttgtcagactcttcctcctcagcagcagtcggtccctcagccattctcttgttgtaggcctgcatgctcttgttgtattcagttttccttttctctgcctttgctacatagggcgctttctcagcttctgacaacgatttccatttatcaccaccagctttaccgacaacagacacagatttgttggctggatgcttttctttgtactgcttcctaaactcctccatgaaaacgaagaaggcactagcaggcctctaccattttctgcctcttctaagattgataaagccttattcaagtagccattcttacacaatccatgaaccaagaccccataagtcatggaatctgcacagcaatctttctctggcaaaagctcccaaattgaaattgtttcatccaccttcgcattctcaaacaaccctctgattagtatgttgtaactaacaacagtacggcaaccctccttctccattaccttccacaactccaaacattcctcaatcctccctgctcgcaaatacccattaagcattgtattatatacaaccacatcaggagacaccc

SEQ ID NO: 7852 - DNA, 859 bp, Vitis vinifera
  misc_feature (51)..(51): n is a, c, g, or t
  misc_feature (847)..(847): n is a, c, g, or t
  Predicted polypeptide sequence is orthologous to G1033
tctcttctaacatgaaggctgccaagggtaagggggcagcaaggaggcacncaaaggaagcattgaagcctgctgaagacaggttagattgtctatattttgtcttgtgaaaaattcttacattctttggggagtttgtttagtttgagatgactctataaagctctgttccttgtcatgttcttagttgtcagttttgtggctgagttaatgagttctatcatatttgatggtggatacggtggttacaggaattttgtagttatggatcatgtatctctattcttttcagaaagattgggaagcgaaaggctgctgttaaggcagaaaagagtagcaaaagagcgaccacgaaagacaaaaaggccaagaaagaccccaacaaaccaaagaggcctcccagtgccttttttgtattcctgtatacatctcctcctgtttctcagtcaagttgaaattgcttcaacttgttgcaactgaattttcagatttcccttgacttacatcttgttaaaactacagtgaggagttcagaaaggtcttcaaaaaggaaaatcccaatgtgaaggctgtctcagctgtaagaaagcaatgttcttcaaatacttagttttatagtttttttactagttctatttgataaatttatttttggaataagaaattgatttagtcactgcatttggcaattgaaggttgggaaagctggcggagagaggtggaaatccttgtctgaggctgtaagtatttagagattttcctcttccctttctaaaagtactagcttggacacgtccattataatggaagatcacaagccttttgaaatagttgtcttccacttagnaatccagtgagg

SEQ ID NO: 7853 - DNA, 694 bp, Vitis vinifera
  Predicted polypeptide sequence is orthologous to G1033
ggccaagctttctgtgaagaaaggggctgctgctacgaaggcaggaaagaaaacaaagaaggaaaagccagtaaaggaccctaacaagcctaagaggccagccagtgcctttttcgttttcatggaagagtttaggaagcagtacaaggagaagcacccttccaataaatcggtctctgtggttggcaaagctggtggggataaatggaagtctatgtctgaagccgagaaggctccctatgtagcgaaagcagaaaagcggaaagtagaatacgagaagaacatgaaagcctataacaaaaaacaggctgaaggtaccaaagtagtagaggaggaggatgagtctgaaaaatccctctccgaggtgaatgatcaggaggattacgaagatggcagtgaagaggaggaagatgatgagtaaaatttgctgacgagggcagtgtgcgtgcagatgcattggccatcaaaatgtttgatcatctcatgtttagtctctcggaacagaaatatggcacaatgattgatcatttcttttaaatgtttttcctttttttggatgaaatatatatcctccagctccactgtgtttcatcttgttttgctccttaagaagatgaatagtgaacgaagaaaaatctgctctatttgtactttgctctcagattttagtgatttagcaaggggtttcttttgt

SEQ ID NO: 7854 - DNA, 734 bp, Vitis vinifera
  misc_feature (707)..(707): n is a, c, g, or t
  Predicted polypeptide sequence is orthologous to G1033
gattgttttcgtcttcaacacctttactctgttctctcctcacagctgttcccttcatttctctcctactagggaatatttccttcaacaatgaaggttaccaagggtaaagcagcggcaaggaaagacaaaaaggaagcattgaagcctgttgaggacaggaggcttgggaagcgaaaggcagcacttaaggcagataaaagtaccaaaaaattggcaaagaaggaaaaattggccaagaaggaccctaacaagccaaagaggcctcctagtgctttctttgtgtttctagaagagttcaggaaggtatacaaacaagagcatcccaatgtgaaggctgtttcagctgttgggaaagctgggggagagaagtggaaatccctgtctgaagctgataaagctccatatgaagctaaagcagcaaaaaggaaatcggactatgaaaagcttatggcagcatacaacaagaaacaggaaagtatggctgatgatgatgaagaagagtctgacaggtcaaaatctgaggaagaggaagaagatgaggatgaggatgaggactgaaactagcatgttttatagattaagtccttatggttgatcaggccataaattctggattatgtaatgatcataccttcgggttgtgtgtgattggttttgagatgggaaagcttgcagcctgtactgctgctaagtttccatgttangttacttgtgtatttcgtatgcatata

SEQ ID NO: 7855 - DNA, 795 bp, Vitis vinifera
  Predicted polypeptide sequence is orthologous to G1048
ttttttttttttttttttttagttaacaaagaagaaaaagtgggttctaactggaaaactgaggaacagtgttaattcattttacagagtacaaacatctcaccagccatttttcagtccactagctcagcctacaccatcccctaaaccccacaggataaaataaacaacgaaaacagggggtatataggggaacataaatgtttcacaccaaaactccatgagcaagagaacctggtttcatctttgtttttgaagctttgcatctcttactcttgacataagactgtaacaaccataattcaaaaattttacttcctggccctcttggagccacacttttctggcctttgtcttccacgcttcccatcggaacggcttcccgacttaactggaactgtacgggaagagacagagctagacacatgatgcccaggaaccaaagcagggaacccaacagcagggattccatcaagagcacagcagactcctgcttggtcactgaagcaccaaaggccttctcattctgcaagtgaagacgtagagtttgattctctgcaaaacagcactggagcaaatgccccagccttctgcattccgattcaagatacctactcttcaactccaaatctctcacatacgtctttttcctctcccttgatctcactgcagcatcccgatttctcaactgccttcttcgtttcttagaggcctgatcttcatcctcccctcgtgccgaattcggcacgagggctctctctctctctctctctctctctctctctcctcggggcg

SEQ ID NO: 7856 - DNA, 601 bp, Vitis vinifera
  Predicted polypeptide sequence is orthologous to G1062
tttttttttttttttaatcaaaaggagaatttattctaaagctggaattactaacgaaaatactgttttcaatgcttctaaagcatgactaagaaaacatatcccgctgacaatttatccaacctaccattctcatttaacatttgttgacctacttgaatttggcctgaacacagcctgtactactgggaaatgagaagagggctgcatttatgaactcctcgatgtatagaactacagttagtgccttcatctgtaagcgggtttcattttcgggcgtttgagctacagcataccgtggaagcctgccgaatccagaagtactgctttgatttgttcaggcagtacatcctggccttccctgcattgctcagctctgaatacatccaatgcaaacccattgaagcagctgatgacagcctgctggatgtccaatccaaggttgtccagagccctcattgtggagagcaggagacctggtctgcgggcacaaaacatatgaatgtttacaggccttccttctcttacccttacctccacccttgctggttgacttttagggcttggcaatgagctagggcatagctcttctttgacacgg

SEQ ID NO: 7857 - DNA, 708 bp, Vitis vinifera
  misc_feature (598)..(598): n is a, c, g, or t
  misc_feature (671)..(671): n is a, c, g, or t
  misc_feature (681)..(681): n is a, c, g, or t
  Predicted polypeptide sequence is orthologous to G1062
gcaacaaatcagttaaaaaaagtggaccaggaagttagaagaaaccattggaacagaaaattttagctatttcaccaacgcgggtaaggaggcagtaagtctcctcaaattacccaagcaatgcaaaacactgtgatttagaacaacaaagaaaaaaatacctatgcagctcctaaggtcatcagaacccggtgtgattcacagagccaaaagaagcattgtatgaaggtaggaatgaaaattacccttggctgactattaggacttggcaatgagcccgggcagatttcctccctaacacggcagggcaaggtaggaatagttggtgtcaatggctggaaacttgaagtaggctgcaataaagattgaggtgtgatagactccagttcattctggaggtcgttgatcctctgcagtaactccttcaagtactcaatagcatccgccaggattgaagctctatccatctatcaacaaaagaacatttaaacaggtaatcctaaatatcttcccaaaccatccaattatgcaacagaacaatggattatcagtctatgatcggtccattttcccagatcttagcatgcccttttatcanacaattcttcaagacaactagtttctctgattcaattcctcatctttaatcgtcaaatcacagcccaatcttnaatgactctncagaaccagtaattttcgggcatttct

SEQ ID NO: 7858 - DNA, 677 bp, Vitis vinifera
  Predicted polypeptide sequence is orthologous to G1062
tttttttttttttttccgacccagaaaataaaccgatgtgtagatgcaactaactgtcaaaggctagagaaaatttaaaaaagaaaagaaaattttcagataaacgaggcccacatccaagcaaaccccacactgaaattcaccagaaaattctcaccttgctgatctttggaacaacagacctcagcatgtagagcctatcgttcagcttctttctccggcgcctctcagccatcaaattcttcgccggcagcccctttttcttcccttttcgatctcctccaatggaagatccattcaaatttgagttgtctccaccatcatttgcagtctcctccaccttgtggttctcaattgcatcatcagaatcgtatatcaaaccggaccgagcagtgctggcttcgtccatatcatcctcatcattgctcttgtcctttctcatcttgtccatttcttcttccaccaccggcctcttacccttatcttctccggcaactctaaccggaattgcactgccttcttggcccgaaactccataattccccgctctttctgtcgaatttcgccggagaatcgctctcttctggaacagcgtgggctgtgacccaactgaagggagttctcgagcggtttcacaccttacacctgtccacaacagagaactcccacaaaccctc

SEQ ID NO: 7859 - DNA, 682 bp, Vitis vinifera
  Predicted polypeptide sequence is orthologous to G1067, G2156
gaggtcgtcctcctggctccaagaacaagcccaagccacccataatcgtaacgcgcgatagcccaaatgccctccggtcgcatgtacttgaagttgccgctggcgctgacgtcatggagagtgtgttgaattacgcccggcgccgtgggagaggcgtatgtgttctcagcggcggcggcacagtcatgaacgtgacgctgcgtcagcctgcgtctcctgcagggagcatagtgacgctgcacggcaggttcgagatactctcattgtcaggaaccgtgcttcctccaccggcgccgccgagtgctggaggcctttctatatttttgtccggtggtcagggtcaggtagttggaggaagcgtggtgggtcccttgatggcttcaggtccagttgttttgatggctgcgtcgtttgccaacgctgtctttgacgtttaccactggaggaggaagagggagctgtgcaagtccagcccaccgcgtcccagtcttcaggtgtgactggaggcggtgctggtgggcagctcggtgatggcggaggcagtggcggcggtgctggtgttccaatctataacatgggagcaagcatggggaattttccctttccaggtgatctattaagatggggtggaagtgctcccagacctccattttaaggctattgtgttgaattcccatatatt

SEQ ID NO: 7860 - DNA, 562 bp, Vitis vinifera
  Predicted polypeptide sequence is orthologous to G1078
ttttttttttttttttttttttttttttttataagaaaaaggccatatatttattcagctgctaaaagagcgaacctctgatacaacaatccaagcaatttcctatacagaaacattccctttccccccttcccctaccaaaatggatgataaaaccgcaaaattccacatatttacacatcgaacgaaaaaacaacaaaataaaataagagctcatctctaaaaaaatcccagcccttatcggtatcaacttacctcaaaaacttccacaaaagaatattcaagcagcaattgcataggatctttcacataccaatgtaagtgcctccatgaacaggccagaaaaactggtcattgcctggaaaacccctggcaagcctgtttgaatgttattcagtgtcaatgctctggtcacttctaccgccttggaatgcctcaccatctcatcttcaactcgcctttggcaagctgcaagctcagctttcttctcagaaagtgggtctcgggcatccaacccctgcccattgtcaggcccagaatcaggaagccctataccaacccc

SEQ ID NO: 7861 - DNA, 642 bp, Vitis vinifera
  Predicted polypeptide sequence is orthologous to G1134, G2555
acaacaaagattgttattgatccagtagtattttgatatataaacagctgggttttatgaactacaagttcccaaatatttggagtgaaggagcttgttcagtagcaagctaaagaaaatattagtgtacaacactttacaactataaccacacccagagagaacttcagagtgaagtttttgcctagatgaattggacaagtttcttgatgattctacagttatggtgctgttctaatcagccaacatttacacattgtagaagaattcaacataaaaatagttgaatatatgagtaccttgcaatgtgcatgcatcttcgagaggacagccgaataccttgattaacctctgattgagaccttttgttacaatgaatatactaaatttccgggacgtactcttgggcatcttcatgttattctctagctaagcatgtgcattttttttgatgctcggacagttcctgaattttttgttgtagaaacttgacatactctactgcctcttctagcatatctgcagtgtttgtttgcttatccatattgggcacaagttcctgaagtttccttattctgtcactgattcgggtcctccgaactctttctgcaatgctgcgaggatgtgtagcacaaccccgct

SEQ ID NO: 7862 - DNA, 722 bp, Vitis vinifera
  Predicted polypeptide sequence is orthologous to G1136
ttttttttttttttttttttttttttttttcggtgacccaacttccaactgaacaagattgaatttgtctgactttattaccttcatcagagttgaactcaatcaacaaagaatcctagagaggatacaagagattatagtagatttcaatattgcaaacagaaaagcgggctagtacactaataaaaaccctgaaacttcatcagggaaacacctatatacattgacaacaaaagatgaacaccaaaaaaggggctagggctgttcttaatcaacagatgccggtgccggatccttcatcctaaaagacaaactcgcctcaactgcaattatatactaaagactactaaagaccagctaagagtggtgtattttacagagctcgccttctgggagccttaaaatgtcccagagccctaaacctttttgacactgaaaccccaggccgggtcgggtaataagctatacgcaacgcctacctgctgtctgcaaatttggatgacagggctagcctcagctgatcttgagtgtaaaacctacttcccatcttcacggttgcctgttggatcatcaaatcattcaccaccgacacactcgcgtggttcacatctaggtccagctccttgagagcccccataagctttgcagcaggatggttctttttactacactgaattcgaatcatggcatcccacccgattatcttcacatcaatatccccc

SEQ ID NO: 7863 - DNA, 726 bp, Vitis vinifera
  misc_feature (687)..(687): n is a, c, g, or t
  Predicted polypeptide sequence is orthologous to G1140
tttttttttttttaacctttttttaccagagtgcattgacaaggttcaacttgcaccttgaaatattaccgtctcattgacttgtaatcgtgtgtatatttaacatatagcgtgggggttaattttacattccatttaattgagttgatgttcctgaaaaactccagtctcttcagccacagtagttcccgacttcctccactggttattttttttaaccagagtatggcagccccaatttgagggatgtatctgaactttcatagtcttgtggaggcccattggagttgctaacattggttacagactcagatgattggccttcctcgtggaacatgttttctgaatcaccagcaacctgccttcggcggttggaaatctctaccacttgttgtcttaatcgctcgttctcttccatcaattggacaccctttgactgaagatcggttatctctttcatgattctttcaccctttttttgtatcactcggctcaatccagcttcaagggatttctctagttgctgcagatcttctatatttaatccttgaagttcttctcccctcatctgcctcagcttatggcttttatctgcaacttccttgctcaacctggagtgattggttgttttctactagctgcaactcaagagatggttgctcaagtttctcaagggtctttgattgnaaactatgcttctcaagtatctctttcatactggagcat

SEQ ID NO: 7864 - DNA, 896 bp, Vitis vinifera
  Predicted polypeptide sequence is orthologous to G1140
ctctttctctatctttctttttctatcttccgaacaattggtggctgggagtgtggggtttgtgacctgtccacacaactggaagcaacacagaaagggtttggttgaaaattttccaatggcacggcggaagattcagatcaagaagattgacaacacagcagcaaggcaagtgaccttctcaaagaggagaagagggctttttaagaaagcacaggagctctcaatactgtgtgatgccgagatagcgcttattgtcttctcagcagcaggaaagctctttgagtattcaagctcaagtgtgagccaggtgattggaaggcacaatcagcatccacagactccagggaaaccagaaccaccatctctggagctgcagctggagaacagcacctgtgcagccttgagcaaagaaattgcccagcagactcagaggctgaggcaaatgaaaggagaagagctccaggtattaaaaatagaagaattgactgaactagaggaattacttgaagctggtctgtgcaacgtcgtggaagaaaaggaagaaagaattcgaacagagatcagtgatctccagagaaagggagacctactgcaggaagagaatgaaaggttgagaaaggagatggagaatatttttgaagcacaacctcttctttaacagggccactcatctgaatcaatcacaaataatatttgcagcttattaggtcctaatcaaggccatcacaactctgatacttctctcaagctggggtatgtttatttgatgtatttgcatgtcaaatctgagatcttatttcaattcaaaacaatcagtagtattacctatgcagatgcatgttttataagtaaagggacatgtgcccatgcatgtaacttgactgcaccgtgaa

SEQ ID NO: 7865 - DNA, 714 bp, Vitis vinifera
  misc_feature (560)..(560): n is a, c, g, or t
  misc_feature (619)..(619): n is a, c, g, or t
  misc_feature (647)..(647): n is a, c, g, or t
  misc_feature (690)..(690): n is a, c, g, or t
  Predicted polypeptide sequence is orthologous to G1146
gattttagtcgatagtagataatctggattttagtggcaactttttatcatcttcctagttttctatcaatgagagtgaatgagagagatggcttggagcgttgctacacaaaccttagaacgccaaacctcacagccaaacctcgccttcataaataaaaaataaaaaaatagaagaaggagaagaggaagaggtggtagaaaatatgatcaaagcaatgtttccatgcgctccagttcaaggctctacacttcagcagataagctagttcgtgcacatctggaccctttgttattgatattcctcatgggtatgttgaaaatgggggcaacatgtgtgaaatgaaggctcatagagccattaatggtttttcttacttgggaatattttatggcagtaaagtcaatggaggacttttggtggggcatccatggggcacatatgcccatatacctttttaaagcctttatctcacgttttcacaattttttttttataaaaaaattaactttcaaaaattctggattttcagtcacttcaatcttcaaattaatttttncaaaattaaaattttcaaattaatttttttttaaggattccattttcaaataaattccncaaatttcattttttaatttaatttttncaaacctcaatttttaagtttaattttgaaaactccaattctncaataatttccaaaatccaatttt

SEQ ID NO: 7866 - DNA, 800 bp, Vitis vinifera
  Predicted polypeptide sequence is orthologous to G1146
tgtgtgctcaggcccatcgacaggagctcatccaagatctttataagacttggcaggatcctgtaagaggaactgtgtctggtggaatgatcaaagaactgcttatatctttccggagagcaactgggcagaaacctcagcgcataatattctatagggatggggtcagtgaagggcagttctatcaagtcttactatatgaacttgatgctattcgtaaggcatgggcatctttggagccaaactatcagcctcctgtgacatttgttgtggttcagaaacgccatcatactagattgtttgccaacaaccataatgaccggaatgcagttgacaagagtgggaatatattacctggtactgttgtagattctaagatctgccatcctactgagtttgacttttacctgtgcagccatgctggcattcagggcacaagccgacctgcccattaccatgtgttgtgggatgaaaacaagttcacagctgatgggctgcaggccctcacgaacaacctctgctacacatatgctaggtgcacacgctctgtttccatcgtgccccctgcatactatgctcatctggctgctttccgagcacgcttctatatggagccagagacatcagatagtgggtcaatgacaagcggtgctgctgctggtcgtgggggcatgggtgttggaggaccaggtcctcgaagcacacgggtatcaggtgctagtgcagccgttagacccctcccggccctcaaggagaatgtcaagagggtcatgttttactgtgatcttcttctacattca

SEQ ID NO: 7867 - DNA, 777 bp, Vitis vinifera
  Predicted polypeptide sequence is orthologous to G1146
ttttttttttttttttttttttttttttgaaacaaagaaccttcttcacaatattaaatatactagatttcaaaatccttccattacatattccacactgtgacaaaacttgttggataagcttgctttcaaaaaaatcggtggttcaccactcacatataaacacaacactcatgtacagatatgtctttgcatttcttctttggtcccttcccagtgcctattttctttttctctaacagtagaacatcacattcttcaccttctcattcaatgctggcaggggccggacgcgtgattcatttgacgtgcgcatgcaatttggtattgcattctcaggcttatcaggttccatgtagaatcgagctctgtaggctgccagatgagcataatacgcaggaggaactagagaaacagaccgagtgcaccttgcatacgtgtaacagaggttgttcgtcaaagattggatctcatctgctgtaaagttgttctcatcccagagaacatgataatgagcgggtcggctggtcccctggattcctgcatgactgcatagataaaagtcaaactcactgggatggcagatcttagaatcgaccacagtaccaggtaagatgttcccactcctatcagtgctgcttttgtcattgtggttgcttgcaaagagtctagtgtggtgccgtttttggacgacaacaaatgtcactggaggttggtaactaggttccaatgatgcgcaggccttacgaatggcatcaagttcatatagtagaacct

SEQ ID NO: 7868 - DNA, 698 bp, Vitis vinifera
  Predicted polypeptide sequence is orthologous to G1150
gctttttctttttcctctcctttctggtctatcatatattttcaactcccaaagacccaatatctggcatggagcttgccagctaggctgcaagggctgccaagtggtgaaaggtagtgtctcttagaccagataagtcccacaaatgagaccttggaagggcacgtcatcctacatatttggacacaataaatggaacctaatctcacaactgggtccgcatttaagaactaggtagtaaaagaaagcgaaagattttagagcctcatttgctcttctaggaagaggcaaaagtttcttgtcccaaggagagggtgagataaggtgttaaatcctcattgatggaagggggtggtggtatttatgatgacccatttctcacagaaggaacgaaggtggaagattagagatgaggatgggtggatctttgaatgttgaaacgtatcaccaaaaagcaaagttgcaagaatgattacagtggcttttttgatgttgatcttgtgttagtggtggggcataagggttaggttttttgggttggtgttcatgggttattatgatagctccatgaccactagttcaattacttttgcaagcagggtgtcatatggtcgtgggcaaaacggttttatcaatcaatcttcgaagtatatgcatattattaactactatttgatgtcaatggcatgtgctatgta

SEQ ID NO: 7869 - DNA, 216 bp, Vitis vinifera
  Predicted polypeptide sequence is orthologous to G1150
caagcgtcgtgctgctaggagaaggatcgaagatcgacaccctagatggggagagcccagaagccgaaagcatcactagcttacgctctgacccgagaagcagggggcacggggaatcccgggggaatcggcagggaccaccttgcaaggttaaaaactccggggggaccgatagcgaagaagaactgaaaaaaaaaaaaaaaaaaaaaaaaaaaa

SEQ ID NO: 7870 - DNA, 841 bp, Vitis vinifera
  Predicted polypeptide sequence is orthologous to G1198, G1806, G558
tgagcatccattgggtttcatttagaggatgctgtggacctgagtggaagcactgcattcaattcgacaaaaccaagtggtcgagcagttacttctgatcccctccatactgtcacttttgataagtcacaaaattcatttgatataaatccaactgctgcccgggtggagtctcagaggttgccattgcaaaagggtcaacaatcaaatctggtttctatatctagtggtagtgtagagaactggggagagtctgcaatggcagatgccagtcctaggactgatatctcgacagacgtggatacagatgataaagttcagaggtttgaaaggggtcaacctgcttccaatatggcttctgattccagcgacggatcaaaggataaaatgatcagaagactcttcgtaggcttgctcaaaatcgtgaagctgcacgaaaaaaccgattgagaaagaaagcatatgtccaacagctagaaagtagccggatgaagctgacccaactagagcaggagctccagcgagcgcgacagcagggtatttttatttcaagctcaggagatcaagcccattcaatgagtggaaatggggccatggcatttgatgtagaatatgctaggtggctggaagagcagaaccgacaaatcaacgaactgagatcagcagtcaattctcatgcaagcgatgctgaacttcgtgttattgttgataatatcatggcacactatgatgacatattcaggctgaagggcgttgcagccaaggctgatgttttccatttattatcaggcatgtggaaaacacctgcagatcgatgttttttgtggcttggtggtttccg

SEQ ID NO: 7871 - DNA, 819 bp, Vitis vinifera
  Predicted polypeptide sequence is orthologous to G1198, G1806, G558
aacttcggatattgtggacaatgttacagcacattttgacgacattttcaggttgaaaggcattgcagccaaggctgatgtcttccacatcccgtcaggaatgtggaagacacctgcagaacggtgttttatgtggattggcggtttccgttcatctgaagtcctcaagcttcttgtaaaccaattggagcctctaacggagcaacagttgatgagcatctacaacttgcagcagtcatcccaacaggcggaggatgctctctcccaagggatggaggccttgcaacaatctctggctgagacgttaaccagtggctcacctggcccatctggatcatcagggaatgtggcaaactatatgggccagatggccatggcaatgggtaagctagggactcttgagggatttcttcgtcaggctgataatctgcgccagcagacgctacagcagatgcaccgtatattgacaacccggcagtctgcacgtgctcttcttgcaataaatgactacttctcccgacttcgagccctcagctctctgtggcttgcgcggccacgggaatgatgttgtatgagtatcaggatcgtctttagaaatatggtctcctgctagggaatcaaaaggctcacttccaacttcggagtacttttgggacctatacatggtgcagggaggctgtagtggtggtttcagctccatctacacatgtaacatgagatatgttcactgggtagttgtatgcttgtttcatatgttcagttaggtgatgtatttttatttcttatgtctcagacaacagtgccaataatgtgatcatg

SEQ ID NO: 7872 - DNA, 786 bp, Vitis vinifera
  misc_feature (712)..(712): n is a, c, g, or t
  misc_feature (731)..(731): n is a, c, g, or t
  Predicted polypeptide sequence is orthologous to G1272
tttttttttttttttttttttttttttttttaaaaaaaagccataaacatttagaagttcaagccaccgcggccaacccaaggccatactataaagaggtggcactgtctaaaagcataaccccaaaaattattatcatagatagataccctacaccttactacttactaaaccctaaagcaagaaaggattttaacatccttcagcttcctccaaaggaaagctcaccctaaaagacaaaactatacaaaacccaatttgtttttggaacaaaagtatttaacatggatatcaaagtctctcagcaaaagaacatcgaattacagacgctctcttgcaatttggggaggtggggcactggaacaggccctgctgacgtcagtccaccttggcttgaggatgtctctgacgtgtcttcaaacttcatgaactgaaacatctgagtagctgctaagtgggcatagcatatgggagcaactacggaaatggcagtggagctcctttggtacacataggataaagaatgcacaagctcctgaagatcatccgaagagaaaccaacttcatccaatagaacgtggtaatgcgtcggcctggtagtaccaatcattccagcatgtgcacagagataaaagtcattgttccgtggatgacaaactttgttgtctatgactgtgccaggtgggacgttatcatgagatccatgttgganaaacttggtatgatgatcnttctgcgcaacaatcaccacaaaatttgggagatcacttctcatcaagggaactt

SEQ ID NO: 7873 - DNA, 648 bp, Vitis vinifera
  Predicted polypeptide sequence is orthologous to G1313
caacagcagcggaagtgcaggtgggggaattgttctgaagaaaggaccatggacgtcttcggaagacgcaatcttggtggaatatgtgaagaaacatggtgaaggaaactggaatgcagttcagaagcattctggcctttttcggtgtgggaaaagttgccgtttaaggtgggctaatcaccttagaccaaatctgaaaaagggagcattcactgcagaagaagaaaggctgataattgaacttcatgcgaagatgggcaacaagtgggcacggatggctgcacatttacctggacggactgataatgagataaagaactactggaacacccgaattaagagaaggcaacgagctggtttaccactttatcctcctgaagtgtgttttcaagcattgcaggagagtcaacaaatccagaatactggtggaattaatggtggggataaagtgcaccatgatctcttgcaaactaacagttatgagataccagatgtcatcttggatggttttaaggctaaccaggatgcctttccctatgtccctgattttcctaatctttctaccagtagcatgctaatgaaagggtttggttcttctcaatattgtggtttcatggctccaacaatgcatcgccagaagcgtgttcg

SEQ ID NO: 7874 - DNA, 497 bp, Vitis vinifera
  Predicted polypeptide sequence is orthologous to G1335
ttttttttttttttttttttttttttttttcgattaatatgatagccgtttcactaaatatcacaaggaacatgtaaagatgatcaatggatggaaaacaaagaacaaggaagagaaaaaactatatatcatgcaaacaattacccacattacaaacaaatttaccaaaaatatggaagaccgaaactcaacaaggagaaacagttgttgatgacaagcgctgctgatccgtttgtcttctctggtttcatccccgaaataatcaccacaaaccacataaaaattacattagagaggtaaacccacattgtcacttctgaccattagggcagtccctcgcaaaatgcccttcctctccacagttatagcatgcaccaccgccagcaccaaaagagtatccaccaccgccagcaccagcagagtatccaccaccgccagcaccagcagagtatccaccaccgccaccgtatcctcgtctcccccaccactgccctccc

SEQ ID NO: 7875 - DNA, 457 bp, Vitis vinifera
  Predicted polypeptide sequence is orthologous to G1335
cccgcgtccggggccatctcgcaagggactgcagtcagagtagcggcggcggaggaggcggtggccgatacagtagcggaggcggaggcggtggaggcggcggtggcggtggctgctacaggtgcggagaagcaggccatttcgctcgcgagtgccctaacaatgcccgttaaagtgcgagcaaaaaggcgatgattggtggggggtaaacgtgtattttcacatgtttttttccttcctctcatcatacctgtcgttcttctttttcagttactgtcatggtttgtttcttagtgggtcatcttcgtatagcccacctttctcatttcaagttatgttttgcaactgtttgggcctatctttcatagggtttttcttggatcggatatggtgatttgctctctcttttcccctctctcccccctctttttcttgaattgacattggggttggttgt

SEQ ID NO: 7876 - DNA, 486 bp, Vitis vinifera
  Predicted polypeptide sequence is orthologous to G1341
ttttttttttttttttcattggatatataactggttcttgatatatgaagaaagtatgtacaactcctgaagaaaggaaaaaagaaaaagaggaaagaaaatgggagtcatctacagctcatatagaaagaagattcatactatcatgaaaaaaaaaagggggggggggggaggaaaagaaaattcaagcagagaagaagccattaatggcagcaagaccaatctggctcttgggctccaaagcccacttcacaatctccgtgttctcttcacccaccgccttcttcacccaggagaacccctccagcctcatcgcaagggctgacacactagaaacaaagccaatctcctctgctgctgctcctcctcctccacaaccaccaccaccaccacttttttttgagttcttgaccctcctctcatactcctctgcaactagcatagcaatatctgacatctctctcttgattaaatgatgggtagttt

SEQ ID NO: 7877 - DNA, 959 bp, Vitis vinifera
  misc_feature (887)..(887): n is a, c, g, or t
  Predicted polypeptide sequence is orthologous to G1361
tcatcgatgcaaaggctgatgacatacttccgacactaacatgcccttcatgtggccaccaaatagaattccaagatcaggctgggattcatgatttaccgggactgcctgcgggagtgaagttcgatccgacagaccaagagattcttgaacacttagaggcaaaggtgctgtctgatacacataaaacacatcccctaattgatgaatttatccctacactggagggagagaatggaatttgctacactcacccggagaaactaccaggagtaagcaaagatggtttaattcgtcacttctttcatcgaccttcaaaggcatacacaactgggacgaggaaaagaagaaaggtgcataccaatgaagacggaggcgagacaagatggcacaaaacaggcaagactagaccagtttttgttggtggggcagtgaagggattcaaaaagatactggtgctctataccaactatggaaggcaaaggaagccggagaagacaaactgggtaatgcaccagtaccatcttggcaataatgaagaagagaaagatggagaattagtggtttcaaaggttttctaccaaacacagcctagacaatgtggtctgagcattaaggattcacttgataacaaatcaaatagtcgaagtgcgcatgatggtccgataataaaaagtgctgcattggtagaatattatcatccatcttttatctcttatgaccaagtaagccataatacagaaagcccacctcagctgattcccaacttggtagtccaaggcgacgggtcttccttcattcgactagctgctgatgcaagcaaaggaaacttgagaggaaatagagatggaagagctgatatatagcaacgacaatgactcctgggnggtgggattagtttgttgttgctgtgtaacactcgaaaataattaatagcatcagattttattaatgaggag

SEQ ID NO: 7878 - DNA, 888 bp, Vitis vinifera
  Predicted polypeptide sequence is orthologous to G1364, G481, G482, G485
tttttttttttttttttaatcctccaaaacaaaacataataacaagtcctcttctgacatacatggcaccagatgacaatctgaggtataatattagctgttgcttaatcatccaaaacgagcaaaatataattccaggcgtcacccgccttacatggcagaagatgaaagtctaaggtatcatatgcaaacccttctccagatattgcagtctgccctcaaatatgcctagataattaaacggcaaagatccagttctacaatatcgggctatcccagctgttctgcagtcaaaattctgaatcattgaattggtaaaagagaagctagagtctcctactcgctactctgcacgggagatacaattagatgctgcccctgtgcctgggaattcatatagttcattgcttgcgtaaaggacccctgatgagcaaactgtgcatttggaccaggttgacttcctattgcatcccttctagcagatccatctccacctctagcagatcccctggtatcaccctccagctctctatatctctgcaggtacacctttagtggttcaatataatcttcaaatcctagggtcgccatcgcccaaagcagatcatcaccattaatcgtctttcgcttctctttctgacacttatcactagcctcgctggtgatgaaactgatgaactcggagacgcactcttggacagtgtccttcgcatccttggcgatcttaccattagccggcaacgccttcttcatgatgcggctgatgttggcgatcggaaggtaccggtcctgctcacgaacgttgtggcgggggctctggtccccgccgctttcgtggctgcctccggggggactcgccggacatctgcatggtcgccggaacctctc

SEQ ID NO: 7879 - DNA, 589 bp, Vitis vinifera
  Predicted polypeptide sequence is orthologous to G1364, G481, G482, G485
ggttgaaggtgtacctccagaagttccgggaggtggagggcgagaagaccgctgtgggcagacaggtcgagaaggacggcggcggctccagcggggacggaggtaatggcggcgtagtaaacactggaaacttcggaagtgggtacggtgcgatgcagcagacaatgatgatgatgggccaccaccagcatcatcaaggacacgtctacggatcagggtcgtatcatcagatgggtagcggcagtagacctacctccggtggttctagcagtggtggcggagccgccaccggaagacccaggtagatttatctgttgtaacttctaagtgatatatatgagtttttctttaccagattgatgtggattatgaagatgaagatgaagaagtagatgaagacgatgatgggttctgtatgtgaggatcacaggctatgttcgaatacattcttttctggagctactgcagctagctggagaaggggatggatgaagaaaacactagctacagcccttgctcttggtttttcttcttctttttgtttttttctttcctttccagtttatttcatatataaattgtaaatccc

SEQ ID NO: 7880 - DNA, 1091 bp, Vitis vinifera
  Predicted polypeptide sequence is orthologous to G137, G145
gtgagaaaaaatctgtttgcattttgtgtttgttgttgtttggtcggagagaaagctaaaggctttccctttgttcttttcttcatttttcctgagaaatggggagaggtagggttgagttgaagaggattgagaacaagatcaacaggcaagtgaccttcgctaagagaagaaatggccttctcaagaaggcgtacgaactttcggtgctctgcgacgccgaggttgctctcatcatcttctccaatagaggaaaactctacgagttctgcagtagctcgagcatgctcaaaacccttgagaggtatcagaagtgcaattatggagcaccggagacaaatgtatccacaagggaggccctggagttaagtagtcagcaggaatatttgaaacttaaagcacgttatgaagccctacaactatcccagaggaatcttcttggggaggatcttggccctttgagcacgaaggaacttgagtcactggaaaggcagcttgatgtatcactgaagcagatcaggtcaacgcgaacacagtacatgctggatcaactcaccgatcttcagagaaaggaacacatgctcaatgaagcaaacaagaccctgaagcaaaggttgttggaaggaacacaggtaaaccagctccagtggaatccaaatgcacaagacgtgggctatggtcggcaacaagctcagcctcagggcgatggcttcttccatcccttagagtgtgagcccacgttacaaatcggataccagcccgatccaataacggttgcagcagcaggccccagtgtgaataactacatgccgggatggttgccatgaccataataagaggaaggccaaccctcacggtatgcatgcattcctttgacaaatgggtataatttctgtgttgtaagttacatgacagaaactgaagaacatgtgtaatattatgggtatccacgtttcccctaatacaccataaaaacagattctattattataactctccatccttagggagaactgtaaggtaatgtttgttgtgtgctccaagcattctgcttctttctttaattcccgcttttctccagtttgaaaata

SEQ ID NO: 7881 - DNA, 1053 bp, Vitis vinifera
  misc_feature (971)..(971): n is a, c, g, or t
  Predicted polypeptide sequence is orthologous to G137, G145
ggagaagcctaaggttatatagccaactgaaagaaacaaagattaatatatatatacgaaagaggttgatataaaggagaggaagaaggattgagagaggaaatggggaggggaagagtggagctgaagaggatagagaacaaaataaacagacaggtgacatttgcaaagagaagaaatggacttctcaagaaagcttatgagctctcagtcctttgtgatgctgaggtcgctctcatcatcttctccacccgtggaaagctctatgagttctgcagcagctcaagcatgctcaagacactcgaaagataccaaaaatgcagttatggtgcagtggaagtcagccgaccctccaaggagcttgagcagagcagctatagggagtacttgaaactgaaatctaagtttgaggcccttcaacgaactcagagaaaccttcttggggaagacttgggtccattgaacacaaaagagcttgagcagcttgaacgtcaacttgagacatccttgaagcaagtcaggtctactaagacccaattcatgcttgatcagctttctgatcttcagaacaaggaacaagttttggttgaatctaacaaggctttgacgaggaagctggatgaaattagtgtcaaaaatcaccttcaattatcatgggaaagtggtgagcagagtatgccatacggccaccagcaagctcagtctcaggggttcttccagcctttagaatgcaatcccacattgcaaataggatataatcctgcaggctcaagccagctatctgctccgagtaatgcccaaaatgtcaatggatttatccctgggtggatgctttgagttttcacatttgtttgcttgactgattgctcttggaaaaatgtttaccaggtaaatgcccttgtatggtgatgatatgtatgtggtttcattagtaatatatgtaacctttaatggcaaaataacagctatgnctgaatctccaagggctggaacacttagccaaggcatgtaagaaattcattgtattctggaaacctatgatacttgctttca

SEQ ID NO: 7882 - DNA, 667 bp, Vitis vinifera
  Predicted polypeptide sequence is orthologous to G137, G145
tttttttttttttttattgcaaaaggatttattacatagtatttgttccaaggattgtggtttctacaattgccgacaattcaattggactttattaacaactttgacttagattagagatatactcaaatcagtagctctattattgtcctctgtcatatgacagaaaaggggttggataggcatgattttagtgaaggttagaaaacaattgcgctgttggcatttctatggccaattacagatcatgagtttgggtttcaaaccatccacccagggatgaatccattgacattttgtgttgtgctggctccgttcatctcaacccgcagcacaggattgtaaccaatctgcaaagtgctatcgcattgcagaggctcgaaaaagtcctctgactgaacaggctcgcgattatatggtagattatgtgcggcagcttcccatgttgatcccaggccactttctgcactgctttcacccaacttcctccttaaggcgttgttggcttccattaggatttgctcctttctttgaagatcagacagttgatcaagcataaattgggtctttgttgatctgatttgcttcaatgacttgtccagctgatgctcaagctgctcaagctcctttgtaccaaatgccccaatcttccccagaaaattctctg

SEQ ID NO: 7883 - DNA, 728 bp, Vitis vinifera
  Predicted polypeptide sequence is orthologous to G1382
acatgttttttttttttttttttttttttttttttgcagccaataagagacagcatgaacagctatcaggaacattggatacttatgagaacatctacatgatacatctcatgcctattggactaattttacacacctgggggtaagtcttacaatctatataaccgatcacaagtaatcccacccccaaaaaatgagaagggaaaagagaagataccctccaatgcgcacacacaatctaatcgagatcctaagtaacttattgctactgaaaacaaaagtttaggtctggacaggttctgcacttggagtttgttgatcgtttgatttattattctcaggccccaaacatatatagggcactattgcaaggccaacattgtcgctttgttctgatttagctcttgattcgtcattcacatctgttgtagtggtattgggtcctgctgaattatgggtaactgtccttgctggaggcatatcatggtcgtgttgtccttcatatggggttataaccatttttggatcatgagatgccctctccacatgcttttttactggacatcctgcatttgagcacctgtaataactccttggatttgtattgcctttcactaatttctgaccatatttcccccagcggtacccatcattcacaatatctacctcactcacagtctgaacaacaatgcgcggttcaccacttggcttatcgggcggagtggcat

SEQ ID NO: 7884 - DNA, 846 bp, Vitis vinifera
  Predicted polypeptide sequence is orthologous to G140, G146
tttttttttttttttttttttttttttgacgaaaaacaggcatgctagcaaatataacaaggagaaagaagcacacaaaggatcagtatagctacatcgatcagtagaatctttcatggagtcatagtgtgaaacatgtagagaagtagcactctaacaacatacttgggtgacctatgcccatcaacaaagatactaacttgtcagagtattaagttcctccacttgagaaaagttgatccctgctttttagtgtttctcaagataatctgtagcttgcatccgctaggcactagatcatccccacagaaactaaaaacagcagaaattactggtccttgaagcatattaaactaattgaagagctggttggtcttggcgagagtatgattgatttggttgcagtccatttagttggaaatagtttctagagtcgaactgctgagatggcatgagttcatagttagctccttctggcatcaagctcatctgctgttggtttctctcattctcggctatccttgctcggagatactggttatcattatgcaagtctatttccctcttttgcatatactcgatctcagcaaacaacagctcattctttttggatctgattctacttatgcctttctctaaccgaatctccaggctcttgaggtccttgaaattcaaggagcccagagactcacccagcatgtgcctgttcgaattctgcaaattacgaatctgctgatgcagtttggaggattcttgctggtagaactgagcattggcttcagaaacggacccggtgttggaggatctgcgcttgccttcttatacctctcattgttgatttacact

SEQ ID NO: 7885 - DNA, 942 bp, Vitis vinifera
  Predicted polypeptide sequence is orthologous to G140, G146
cgcgtttttgcacagtttgaaattttccgaaagctgaggtcgccggattttggaaacaagtgtagtgaacatggggagaggaaagatcgagatcaagaggatcgaaaacacgaccaaccgtcaggtcacattctgcaagcgaaggaatgggcttttgaagaaggcttatgaattatcagtgctatgtgatgcagaagttgccctcatcgtcttctccagccgcggtcgagtctatgagtactcaaacaacaacataaaatcaaccatagataggtacaagaaggccagctcagatagtacaaatggaggctttaccatggagatcaatgcccaatattaccagcaagaatcagcaaagctgcgccagcaaatacagatgctgcagaattctaacaggcacttaatgggtgattccttggcttccttgactgtgaaggagctaaagcagctcgagaacaggcttgaacgaggcatcacaagaatcaggtcgaagaagcatgagttgctgttggctgagattgaatacttgcagaaaagggaaattgagctggaaaatgaaagcgtatatctccgaaccaagattgcagaagtggagaggcttcagcaagcaaacatggtatcaacacatgagttcaatgccatccaggcattagtttctcgcaatttctttcagcccaatatgattgagggtggatccacaggctacccacttcatgataagaaggtcctccatctcgggtaaatgatgggagaaaatatccgccaacttcatctccttaagatgtttaaataaatcttttcccatgctatccaaactgttatgtaacggagaattaatgtcattgttgtatttggggtttctatgacttggtatttatcagctagctaccagttctgttttgtataacattagtacgatatataataatagcctattaaaat

SEQ ID NO: 7886 - DNA, 1160 bp, Vitis vinifera
  Predicted polypeptide sequence is orthologous to G140, G146
gcaaaatactgaaagatacactataattcttgttttgcttcttttggatgtattggattctcttgctttgtttcaagttccaattcaggcttaaatgtaacaaaatttgcttatagaagcatcaatttggtttagctcatttcagctttcaaccacggagtttccgaatcaagcctcggaggggtcttcccaaagaaaaatgggaagagggaagatcgaaattaagcggatcgagaacaccactaatcgacaagtcaccttctgtaagcgccgcaacggcttgctcaaaaaggcctatgaattatcggtcttatgtgatgcagaagttgctctcatcgtcttctccagccgtggccgcctctatgaatatgctaacaacagtgtgagaacgacaatcgaaaggtacaaaaaagtgtgttctgattcctccaataccggatctgtttctgaagctaatgctcagttttaccagcaagaagcctccaaattgcgccgtcaaatcagggatatacagaatttgaacaggcatattctgggtgaggctcttagctctctgaactttaaggaactcaagaatctggagaccaggctggagaaaggtatcagcagaatcagatccaaaaagaatgaattgctgtttgctgaaatcgagtacatgcaaaagagggagattgagctccaaaacagtaacttatttctgcgagcacagatagctgagaatgagagagcccaacagcaaatgaacctgatgccagggtctcagtacgagagcgtgccgcagcagccatacgactctcaaaacttgctccctgttaacctcctggaccctaatcaccattactctcgccacgaccaaacagctctccaactagtgtgagaagtggtgctgtatttgtgggtctcttcgtggagtagaatgggaatgaagagatatgttttcctgcagattgtaagcgtagttaactttatgtgaagtgatggtgagaagcagtgtgtccaagtagagaaacaagtgagagagccctttcccattttctcataaaactctctttttaaataactctgttgcctgccacaaattaagaagatgtattaattcatcttgtatgactgaaacactgaaactgaagatgaaactggaaactacctacattgcttca

SEQ ID NO: 7887 - DNA, 791 bp, Vitis vinifera
  Predicted polypeptide sequence is orthologous to G140, G146
ttttttttttttttttttttttttttttttgcttggataagtaatccatttcgacgcatgtatgtatatatatatgtgtgcgcgtacagataacacagaagatgaatagtctacatccaaagacggttattcacaaaatatctaagtaaaaaagcagaagcacccagattaagataagggataaagccatggacagcaacttgttgacaccaactactatacaatccaaaacactgcaagcaactggtggccatttggagcctgcggtttaggggtcacctccatcctgatcagcaagcattcttgcagtctgatgatggctcttgctgcccatttgcccgtctttctcatatcccagccccgtcatgtggaccgccaaaaccactgctgccactgctcctcccaaatgcatcacattcttctgctccaaaggctctggtgtttaagttggcctcgtgcagcttaactttcttttggaggcgggtgttgtcctcttgcagggccctttgacgttttttaagcaggctgatgtgctccgaaatgattcgcctcttcttagcacgaattcgttcaaccccgtttttcagccgcctctccagctgttttagctctttcatgcccagcgtcgacaaatcttctccggccaaatgcttatgttttgcttccaaggtgtctattgttctcctcaagttatcgatttcagacatccaaaactgctcaattgttctagagcgttggtaattattgaattccatcaacccaacttcattcctatacctggctatgctcct

SEQ ID NO: 7888 - DNA, 615 bp, Vitis vinifera
  Predicted polypeptide sequence is orthologous to G140, G146
atcatcaaatcccttttttatctctatctttctcgatctctccctctccctcttcatcttcttcttcttcttcttcttcttcaaaacaaattgcataggaagagggacacactagtggtggtagatctctagggagaataatagcgtgagttggatgattgttggatggtctattttgtgtccataaatacccatctgatagaacaaaccatttccattttctgcaactctcctgtgcagagctataccaaagaatcgtgtgaattcaaccagaggaggaaaaaaaaagaaaaaattgttgtttccacccttgtttatctacttctcctaagtttccttaccagctcatttcagctttcaaccacggagtttccgaatcaagcatcggaggggtcttcccaaagaaaaatgggaagagggaagatcgaaattaagcggatcgagaacaccactaatcgacaagtcaccttctgtaagcgccgcaacggcttgctcaaaaaggcctatgaattatcggtcttatgtgatgcagaagttgctctcatcgtcttctccagccgtggccgcctctatgaatatgctaacaacagtgtgagaacgacaatcgaaaggtac

SEQ ID NO: 7889 - DNA, 793 bp, Vitis vinifera
  Predicted polypeptide sequence is orthologous to G1419, G43
tcactctctctacctgtttgcagtgccaatactccactacctcccagtgctcatctccattgatatggcagaagaagcttcatcgcttcacttcattcaccaacaacttctcttcgactttgaagctttcgaaagcttcgtctctcatgtaaatgatccatcccaaacttcaacctctgattcaagtccttccacctcagatattgttccgctctctaattactcgaatctccatgaacatgaaaacaacccttttctcctcgactgttctacttcggctccatcagggtttttccagtttgaaaccaaatcccccaaaacttccacattaagtcatcggcgacctccactcagcatctcagtccctcagccagtcgtttctcagtcgcaggcggagtccgattcaggcgatatcaggcattacagaggcgtgaggagacggccatgggggaaatttgcggcggagattcgagacccgaatcggagaggatcgagggtatggctggggacattcgagactgccattgaagccgccagagcttatgatcgagctgctttcgagatgcgtggctcaaaagccattctcaatttccctcttgaagctgataattggtcgggttctgatccaccagcgatatctggccggaaaagggagagagacagtgagactgaagagagaaaacaagtggagattaaggtttaaagcaagaggagcacttgcccgaatccgacagcacgctgatcgcagccagtcatgttttaggggttagtccattaactccgtcaaacttta

SEQ ID NO: 7890 - DNA, 801 bp, Vitis vinifera
  misc_feature (679)..(679): n is a, c, g, or t
  Predicted polypeptide sequence is orthologous to G1419, G43
tcactctcactctcactctctttaagtgctcgtctccattattgatatggccgaagaagcttcatcactgcacctcatccaccaacaactcctctccgactttgaatctttcgaaaaattaaacaatccatcccaaacttcaacctctgattcgagtgtttccacctcagatattaatccgctctctaattacttgaatatccctgaagatgaaaacaacccctttctcctccactgttctacttctgctccgtctgggtttttccaatttgaaactaaatccaccaaagcttccagattaagtcgtcggcgacctccactcagcatctcagttctcagccaaccattcctcagtcaccggaggattccgattcaggcgacgtcaagcattagaggggcgtacggcgtcggccgtgggggaaatttgcggcggagatccgagacccgaatcggagaggatcgagggtatggctggggacattcgagactgccattgaagcagccagagcttatgatcgagctgctttcaagatgcgtggttccaaagctattctcaatttcccccttgaagctgggaattggtcgggttctgacccaccagcgatatctggcccgaaaagggagcgagagagtgagagtgaagagagagaacaagtggagacgaaggttttaaagcagnaggagcagtcgccggaatctgagagcacggtggcgggggcaaccagtaatgttttggggattggtccgttgactccgtcaaattggagggcagtgtgggaggagagagagatggagggaata

SEQ ID NO: 7891 - DNA, 763 bp, Vitis vinifera
  Predicted polypeptide sequence is orthologous to G1419, G43
tcactctcactctctctacctgtttgcggtgccaatactacactatctcccagtgctcatctccattgatatggcagaagaagcttcctcgcttcacctcattccccaacagccccttttcgactttgaatctttcgaaggcttcgtctctcatgtaaatgttccatcccaaacttcaacctctgattcaagtccttccacctcggatattgttccgctctctaattactccaatctccatgaagatgaaaacaacccttttctcctccactgttctacttcggctccatcagggtttttccaatttgaaaccaaatcccccaaaacttccacattaagtcatcggcgacgtccactcagcatctcagtccctcagcccaccgtttctcagtcgccggtggagtccgattcaggcgatatcaggcattatagaggcgtgcgccgacgaccatgggggaaattcgcggcggagattcgagacccgaatcggggaggatcaagggtatggctggggacattcgagactgccattgaagccgccagagcttatgatcgagctgctttcaagatgcgtggttccaaagctattctcaatttccctcttgaagctgataatcggtcgggttctgacccaccagcgacatctggtcggaaaagggagagagacagtgagactgaagagagacaacaagtggagattaaggttttaaagcaagaagagcacttgccggaatctgactgcacactggcggcagccagtaat

SEQ ID NO: 7892 - DNA, 691 bp, Vitis vinifera
  Predicted polypeptide sequence is orthologous to G1419, G43
acgccgccgcccctgggggaaattcgcagctgagatccgcgacccccaccgccgagggtctagggtttggcttggcaccttcgacaccgccgtcgaggccgccagggcctacgaccgagcggccttcaggatgcgcggcagcaaagcgatcctcaacttccctctcgaagccggagcaccaccagaggcttcgcagcggaaccccagcgttcggaaaaggctgagagagactgagaagaacgactgagagaccgtggaggtcaaagtaataaagaaggaagagatagttgagtcgccggtttcggacgtcacgttggctaatacttcgacggcagtcgcttgtcctttaacgccgtcatcctggacggccgtttgggatggtgcagatgggaatggtatttttaacgtgccgcctttgtcgccgttatcaccccttgtgatgacatgagatgaaacgttataacggcgttcaagaaagcgaaaaccatctgacggcgctacagtcttggatgatgcgtaaattagaaatagaagatttattcaaattatttaaaaaaccaaaaatataaaaaataaaataaataaataaattggggaaaaaaacagtaaagttagtagagatacacgtggaaaccacacgtggaacatggttgtgtatccccaatataatatgcttgatgatgcttgttgt

SEQ ID NO: 7893 - DNA, 609 bp, Vitis vinifera
  Predicted polypeptide sequence is orthologous to G1419, G43
gatctcggtcccacggccgaccaaggaaattgaatggttggagttcgctgagccgaaacaggcggccacagtagaaccggcgcagaatatttcccatcctgaggagaagaagcactacagaggagtccgacagaggccgtggggaaaattcgccgcggagatccgagatcctaagcgtcgcgggtctagggtttggcttggcacctacgaaactgccatcgaagcggccaaagcgtacgacagagccgcgtttcagatgcgtggaagcaaagcgatcctcaactttcctcttgaagccggaaaatctgccgagaccagcgccgattacggccggaaaaggtgcagagaagccgaaacggaggaaacggaagtggaagcgaacccgccggcgaagaaggagaagttgccggaagctgacaccatcacacatgtgcaaaatgatactccgttaacgccgtcattttgggacttcgacctggattccgtaggctgtttatttaacgtccctcccatgtcgccgttatctccccatccgaagttcggttttcctcagcttatggtcatataattacaatattttccaatgcatttagtgactttcaagtgtat

SEQ ID NO: 7894 - DNA, 652 bp, Vitis vinifera
  misc_feature (627)..(627): n is a, c, g, or t
  Predicted polypeptide sequence is orthologous to G1421, G1750, G440
gctgatttcagccgcccatttcccccaaggacgttgccgaacgccgcgaaactttttacccgtcgacggcttcgccagctgccggacagcctgagcttcaccttttccggtgggcttcttccggccatttctcgccgatctgcttctccaaacagtggtgccgtcgctgttatctcctgaacatgactgaatagtgatctcgttaacgaacttcttcacacgctgacgcgcgaaaagctcaccctcttcgtcgctggaagagtccgtcgcgtcaccgtcagtgacggaaatccgtacaattctgggcccatcagcattcatactcctgccggtgaatttctccgacgaggttgtcagcagcttagtacgcttgcggtgctcactgtacttgattggggacaacatgtttcgggagatttctcagattccctccgttagcattgaaagcagaggatgaaagggaaagggagagagaaggagggtgtaaaaatagagaacggagaaaaagcagagattcctctgagaatagagaggcacggagaataaagagataaagaaagctgaggaaagaacacacgttaaagggaagcttgaaacgcagataaacctgccattaatggattgaanacccacaaaaagccattaaagcacc

SEQ ID NO: 7895 - DNA, 549 bp, Vitis vinifera
  misc_feature (417)..(417): n is a, c, g, or t
  misc_feature (518)..(518): n is a, c, g, or t
  Predicted polypeptide sequence is orthologous to G1451
attcagcagctaccatgaactgcgtggtgagcttgctcgcatgtttggccttgaaggccagttggaggaccctcggagatcaggctggcagcttgtatttgttgaccgggagaatgatgttcttctccttggtgatgacccctggccggagtttgtaaacagcgtgtggtgtatcaagatactctcactacaggaagtgcagcagatgggaaaacgagggttagagcttctgaactcggtccccatacaaaggctcactagtagcagctgtgatgactatgcaagccggcaggactcaagaaatttgagcactgggatcacatctgtggggtctcttgactactgaacaatttaacagtaaagatactattctctcttctgtaatattagcatctctttcaatcgctctcatgttgngtagggctgcctaattctagcttaaagctcttatatttaagccaatactgtaattatatgatatctgccttctccctttctatgcttttgatatacatacnatacatatttattaggagactaatgttcttt

SEQ ID NO: 7896 - DNA, 697 bp, Vitis vinifera
  Predicted polypeptide sequence is orthologous to G1451
ttttttttttttttttttttttttttttttcatggcaataactaagtagcatgggggatacaggttgtatacaatacttgtacggacaagggggaagaaaacagacaggagagaaatggcacacaccataacggggaaatcccggacaaaatgcatacaagacatttatttcactcccaagagtaggacttgaagcaatgactctggagggttatagaactgattttccatgcattctcagtactcaagcgacccagcagagggtagtccagaaacaaggtctcgatcatcagttccactgctattcatcctttgagcactatttgggctgaatcctgattcaatcccctgtttccccattttctgcacatcctctggggaaagtatcttgatgtaccagacattattcacaaatgcctcccatgggtcgtctccaaggagaagcacatcattctccctgtcaacaaatacaagctgccagcctgatctcagagggttttctagtttcccctcaattccaaacatctgacccagctcctctcgcagttcatgatagctgctgaaccgggtgatgtctaatgaccgcccaaccgatcccgatttgtaaaccttgacaaatgttcggcttggagttggaggatcaacttgtcctgcattctgcaacaactctgaagggtcttgcacgcaaccaaataac

SEQ ID NO: 7897 - DNA, 560 bp, Vitis vinifera
  Predicted polypeptide sequence is orthologous to G1478
tttttttttttttttttttttttttttgccttggatatgcatatgttactgatgataaagcacatgacattaattcccctatatttttaatacctcagaggaacaaactctccaacaatttgtcttaactatatctaatcacataagactcaaagaaacagaaaaggcatcttcagtgttcttgggcacttggactcatcgcttgagttacaccagcttcgctcagtccagctaatcatggttggcagcgccacctcatgtgaagatcctatgaggtatcgctgtgtaagattttgacatgtactgcagagaaagcatcgaatgtgcctgaacgccaaaaagttagctccatgaacccacctatcacatttttggcataaaaatgcatcatctgcttgacaatacagcagggcccctggagctgcagagctcacaggacaccagcccaccaccaccatcgtctgaaacagcctccttgagtacctcggacttggccaaacggccttgctttccatcttctctacctctacacatctttaggagttctagaggacatcccc

SEQ ID NO: 7898 - DNA, 840 bp, Vitis vinifera
  Predicted polypeptide sequence is orthologous to G148
tggggtttgttgtagtggttgacgaataagaggaagaagaagaggaagagaggatggggagagggagagtggtgttgcagaggatggagaacaagatcaaccgccaagtcaccttctccaaacggagaaatggactgctgaagaaagcctacgagctttctgtgctctgcgatgctgaggtctgtctcatcatcttctctagccgtgggaagcttttcgagttcggaagctctggcatgaccaaaaccattgagcgataccgaagatgttgttacgcctcaagagataacaatgacgctgagcatgatcttgaagagatgaataaacagctcacatcgaagcttgaggaacttgaagaatgtgttcgagttattgaagcttcatgggattctggcacagtagctggcaacgacaacctcaacatgcacatctctcaacccaaccaaattcaacctcaaccccaaccccaacccagcctaccaatggggttccacgaatttgttccaccggaaggagcagctatagcaaggaatgtaggcaatgcccggaatggcctcgcccaaggatggcttgtttgaccttcaaaccatcataaaaaataccaataaatgcgtgatgttgcgacttatattttgtttggaattgacttcttgagtgatctttgctttttcaaaattattatatatgtatatatggtttgttttttttatgcaattgaatatgattttgataataaacatagatatgtacgagacattctcttagacttgtgtgttcgagtttcttaatttgagaataagaatggacataaaaaagaaaaaaaaaaaaaaaaaaaaaaaa

SEQ ID NO: 7899 - DNA, 1008 bp, Vitis vinifera
  Predicted polypeptide sequence is orthologous to G148
ctcgcgtgcccattgaagtcacgataggagagcccaagaaaaattatagaggagcatctgggttttcactcagagtggtgtaaggagagagagagagaatggggagaggaagagtggagctgaagaggatagagaacaagatcaaccgtcaagttaccttctccaaacgcagaaatggtctgctcaagaaggcctatgaactttctgtgctttgtgatgctgaggttgctctcatcatcttctctagccgcggcaagctctatgagtttggcagtgctggtactaccaaaaccctagagcggtatcaacgtgtctgctacactcctcaagacaacaatatggaatgtgaaacacagagttggtaccaagaggtgtcaaagttaaaggcaaaatatgaatctctccagcgcacccaaaggcatttgcttggagaagatcttggaccgctgagtgtcaaagaactgcaaaatcttgagaaacagcttgaaggagctctagcacaagctaggcaaaggaagacccaaatgatgatagaacaaatggaagaccttcgcaggaaggagcgacagcttggggatctaaacaaacagctcaaacttaagcttgaggccgagggacaaagtcttaaagccattcaaggttcatggaaccccagtactgcaactgctggaaacagcagcttccctgtgcatccttcccaatctaacccaatggactgcgaacccgaacccatcttgcaaattgggtaccatcactatgttccagcagaagggccgtctgtttcaaagagcatggctggtgagagcaacttcatccaagggtgggttctttgaagtagtgtttgatcaaaagagaagaagaagaagaaaaaaacataagtatgacttctatatatatttgtgtaatgtgtgtattgtgttgacatactgatcaccacatgaattgcttgtatacttatatagcttctctttcatggggacaatatatatatatcaccatttctagctg

SEQ ID NO: 7900 - DNA, 843 bp, Vitis vinifera
  Predicted polypeptide sequence is orthologous to G1480
ttttttttttttttttttgatccgtgatcagaaaaggcaaaagtgaaaaggtttactaacagcagagttacagaagccttgagaaagagagggaaaaaacacagtagatgggggatgttgagagcaactttgagatggaaaaagcctaccatcatgcttcttctacaccacactctcatccatggaatcaaggattcgataatcaaaaaacgaaactaaattaaacataagacaccaaaagcctttaaagcacatcagattatttcaggggacaaaaaaaaaaagaaaattaataggacggaacgacaccgtatccggcgtccaccatgaaagcagcggcggaggcggaattgtagatgtgatcaaccatctccgattccatctcggttcgctttgcgaaacggcctttgattcttggacgcgtctcggcgtaggcttttctggaggcgtatctgatggttttctcgaatttccggttctttctcttctctctgtacctcaacaccctcgcttcgcgatccattccagataattgggtcgcttgactcccagtagaaccgccgccgccgccgccgctcacttgcttcatcgaagggtaggatgtatcagatatggagttgcagttcccatctgggacaaccccaacatctgaagatgaaatgctttggcttagagattgagctgtatagttgtaggcagagagctttgatcgagagaaatccagttcaaaacaattgtcagcagggtggttcgtgaccggaggtgagggatctttggcttgaaccggaactacaccatcatttccacgcagtggtggtgatgatggtgtgggaattcgcatcc

SEQ ID NO: 7901 - DNA, 748 bp, Vitis vinifera
  misc_feature (57)..(57): n is a, c, g, or t
  misc_feature (104)..(104): n is a, c, g, or t
  misc_feature (184)..(184): n is a, c, g, or t
  misc_feature (191)..(191): n is a, c, g, or t
  misc_feature (216)..(216): n is a, c, g, or t
  misc_feature (233)..(233): n is a, c, g, or t
  misc_feature (235)..(235): n is a, c, g, or t
  Predicted polypeptide sequence is orthologous to G1480
ttttttttttttttttttttttttttttttctcaaaccttttcatttttcccccacngaaactttcgccctccaaagcggcccccccgatctgctctggatcanggcgatcgatcgataacaccaacaataaaaggcgattaggatattggtacatggccgcccctcaaaaagatggatcgacnccgatcnctgagtcgatcgatcgtgctccagntgagctgatctcccacncnaatctccgatcgcttcccgaaccttcccttgattctcggactcggttcggggtaggcttttcgtgatgcgtatcggatcgttttctcaaactttctgttctttcccttctccctggacctcaaaaccctaggttctcaatccattcctgaggaaatttgaccagtttgattacctgattcggacccggatcgaatcgatctaccgaaagggttggttacatcaaccatggcgttaccatctggcacgactcccacttctaaagaggaggacgacacactttggctgagagattggccgttgtaaaaggacttggaccctgaaaaatccatgtcaaagcagttgtcgttcaccaatggagctagaacactcttgctctgtactggaacaactccatcccctcccgaactttgctgctgctgctgcgattgaacctttgcatctatcgacgaataatccaaatcccccggccggatcgacggaattcccgatcatatgtccggtaccgccaactg

SEQ ID NO: 7902 - DNA, 726 bp, Vitis vinifera
  Predicted polypeptide sequence is orthologous to G1480
tttttttttttttttgcttggaacaaatcgacggctaccatgtcgtcgatcaaacatcgtcacttagtatatacaaaaacattcgtacacaagaacaacacagcataattgctctgcaaaaaggaagagcgagaagaaataacaacaataaaaagcgattagcatattggtacatggcccatcaaaacgatggaacgacgccgtatcctgagtcggcggtcagtgctccagacgagctgtaatcgacttcgatctccgatcgcttcgcgaaccttcccttgattctcggtctcgtttcggcgtaggcttttcgtgatgcgtatcggatcgttttctcgaactttctgttctttctcttctctctgtaccttaaaaccctagcttctcgatctattcctgatgaaatttgagcagtttgattagctgattcggatccggtgttcatcgatctaccgaaagggtttgttacatcaaccatggcgttaccatctggcacgactcccacttctaaagaggaggacgatacactttggctgagagattgtccgttgtagaaggacttggagcctgagaaatccatgtcaaagcagttgccgttcaccaatggagcttgaacactcttgttctgtactggaacaactccatcagttcccgaactttgctgctgctgctgcgattgaagctttggatcatcgacggataatcagatcagatacgatctatgtc

SEQ ID NO: 7903 - DNA, 717 bp, Vitis vinifera
  Predicted polypeptide sequence is orthologous to G1488
gcgacagctgcaactccgtctctggttgcgagccgcagttcgccggagatattgggtctcggaattacactgatgctcatttctctagcgacctatgcgtgccgtatgatgatttggctgagctcgaatggctctcgaacatcgttgaggaatcattctcgagcgaggacttggaaaagcttcagctaatttcgggaatgaaagcgaacactgaggaagcatccgaaacccgcgacttccaacccgaaaacaaccaaaacccaccgctatcgctgcgagattttccggccaaggctcgaagcaagcgcgcacgagccatgccatgcaagtggacgtcgcgccttctcgcgctttcccctacaagttccttgtcagaaaccgacatcatccccccattccggcaagaaatcgacgaaatcggctcccaaaaagaaggaaagccccgaagttgtggccggaggctgcagcgatgggcggaaatgcttgcactgcgccacagacaagactccgcagtggcgaaccggacccatgggacccaaaactctgtgcaatgcttgcggggtcaggtacaagtcggggcgactcgtacctgaatatcgacccgcagcgagcccgacatttgtgttgacaaagcactcgaactcgcaccgaaaagtgttggagctccgaaggcagaaggagatggtaaggtcccagcaccagcatcagcagcagcag

SEQ ID NO: 7904 - DNA, 847 bp, Vitis vinifera
  Predicted polypeptide sequence is orthologous to G1494, G789
tgagtgccaaagcgaggctgctgaacatgaatcagctgcaggaaacaaggcatcacaaagatccgggtcaactaggaggagccgtgctgctgaagtccataatctctcagagaggagacggagagatcgaatcaatgagaaaatgaaggcattacaggagcttatacctcacagcaacaagtcagataaagcatcgatgctagatgaggcaattgagtacttgaagtcccttcagttacaacttcagttgatgtggatgggaggtggtgtcgcgcctatgatgtttccaggagtccagcactatatggccagaatgggaatgggaatgtgtccacctccactgccttctattcacaacccaatgcatttaccaagggttcaactagttgatcagtccacatctgcagttccaccaccaaaccagcctccaatttgccaaaccccagtcttgaatccggttaattatcaaaatcagatgcaaaatcccaacttttcggagcagtttgcacattacatgggcttccaccctatgcaaactccctctcagcccatgaatgtgttcagctttggatcccagagtcaccccatggcatcgcctgccaccactggtggcacctccactgcagctgctgcagttgatggtgctccaggcagcaagttgggttaataccagtgggtacgcatgctgctcgaatgcttttggttccattacacatcaagtgcgtccattgcaagatgatgataaaagccatccattaatttcgtcctggtggatggcctaggccagctcttcctacatagactaaggatccatcaagttatgtgtttacccatatggatgaaatta

SEQ ID NO: 7905 - DNA, 790 bp, Vitis vinifera
  Predicted polypeptide sequence is orthologous to G15
ttccgtggggtaaatgccgtaaccaactttgatataacaaggtacgatgtggagcggatcatggcgagcaggaaccttcttgctggagaacttgctaagcgaaacaaggacatggaatccaccagtgaggctaagaatctcaacccttctgttcataccagcagtggggaagccattctctcccaggataacaatcaaagtgaatcaggatggaaaatggtgctctatcagtcttctcaacaatcgaactcctgtttgaaacagcttgatcagaagccactgagttttgatcattacagagccccatcttttccggtggccccacacaatctgatggggacggacgctatgggtccagctcagcaagaggctgaagactcggccaagatggggacccacttgtcaaatgcttcctcattggtgactagcttgagcagctcaagagaaggtagccctgataaaaccagccttcctatgctctttgcaattcccccatcagcacccaagttcttcgccactccagcaaatactgtgaattcctggatcccatcagcccagctgaggcctgcaatccccatgcctcacatgcctgtctttgcggcttggactgatggctaagaaacttgtgttttggcaaaactggtaaaagtttttgcattaacaaaacatgggtggaaagggaaagggaaagagaatggtttcatgttggttttttctgaattactggtggaaattggggggttaatgggggtcaagggtgggacctattgtgaacatggttcaaaatttt

SEQ ID NO: 7906 - DNA, 648 bp, Vitis vinifera
  Predicted polypeptide sequence is orthologous to G15
ttttttttttttttttttttttttttttgcaaaatcttcattccaatatgagccaaaaggttgagtctgaaaaagttgccaacactttggttacagacagattactggcccctacccttgtctttttcattcactaataccataggaaaagagaaaactaaagtaaatttctttttaccaatcccccccttccacccctcaacaccacgattttctttcccccttgtccatgcaaaactttacatgtttattacaatgaagctttaggtgtcattccaagcagcaaaaaggggcaagtgagccatggaaactgcagcagtcctcagctgggatgttgggatccatgaactgagtgcgcttgcaggccccatcaattttgatgctaatggaggctttgcaaacagcattgcagggccagttttatctgggctagcttctcttgagctgctcaagctggtcaccaaggacgatggattggaaaagtgcgtccctagtttggtcgattcatccccaatgggctggcttgtgttcactgaatcaatcccaataagatcttgcaatgccattgaaaaagaggtggtcctgtaccctccaatgctcattggtttctgttcaagtgattccacacaactacttggctgctgcccc

SEQ ID NO: 7907 - DNA, 774 bp, Vitis vinifera
  Predicted polypeptide sequence is orthologous to G15
tttttttttttttttttttttttttttttggtaattttctaacgggaagttgatatgagtagaaggtccccagtatttgagggccgccagatcgtaagctcttgcagctttctcttccatatcatacccccccagataaacttgtcttcctttcctagtctgcccctccttcttgcaactattatcccaaagatgggcttcatatctaccagtccatctatgccttgtaactcctctatattgtgaagtcctctgcccaaatgtgtcaatggacttcctatgaactggttgcttttgtgcaacctttccggacccccttttctttgtttccatggccacacactcagctccggtaggcgagatctgtcttggagctgtcacacagcttgactgagaaccggggctcatggacaagctgagagactgtaaatccccacaacccatagctccaatagacccaggagctcctccgtcatcaacgatgctgttgttcatctgctgctctagtgcatggtgagtcgagtagtgccttgcaacccagtttttcaggcaaggcattccatcctcccccataggagggatctgggtatggcaatctgcaagttgggtttcctttgtttcttcttctaatgggttctggtaaatcccattgcaggcaagtccagtgaaatatgggtggtgttgaactggaatttgttgctgaccttgttgcctaaaggattcctgaagaaggtttagagaatgttgcctactggtttcaggttccgcattttg

SEQ ID NO: 7908 - DNA, 797 bp, Vitis vinifera
  Predicted polypeptide sequence is orthologous to G1506
actctgcaatgcctgtggatcccgatggaggacacaaggaacccttgaaaactatacccctctacatgcaagggtagatggtgatgatgctgaggactacagggtttccagagtgaagagcatatctattaacaaaaacaaagaagtgaagctgctcaagagaaagcaaaatcaagataatgtggtggttaatggtgttgcctctgattatagccaaggttcccggaaggctatagatgaagatacaagtaacagatcaagttctgggtctgccatatctaactctgagagctgtgcacagtttggcagtgcagatgcaagtgatttgacaggtccttcccaatccattgtgtgggatacaatggtaccttcaaggaagaggacatgtgtgaatcgtccaaagccatcttcagtcgagaagctaacaaaggatttatgtacgattttgcatgaacagcaatcttcgtacttctctggatcgtctgaagaggatttgctttttgagagtgagacaccaatggtctctgttgaaataggacatggaagtgttcttatcaggcatccaagtgcaataggtcgagaagaggaatctgaagctagctctctttcagttgataacaaatcatacctggtaaatgaggtttattcacgcattggcgcccttcctgtaaatacaaacaataagggcatcaattttccaagtcctgggcttgaaaagatgaagaagcctgctggactggggatgcaacaagagcaaacaagagggacaagtctcagcacgaaaaattgcaaatcct

SEQ ID NO: 7909 - DNA, 730 bp, Vitis vinifera
  Predicted polypeptide sequence is orthologous to G1506
ttttttttttttttttttttttttttttggaaaaaagagcaaccatcccacctcattcacattaactccttttttgtgtttttggcatgcaaaatatgtggacccataatgggtttttggcagaagaaatacctacatagccctaaggattaaagtagtgtttaacatcattgtcagggacgcaaaagatgtgggtatgctgagctactactagtgctttgcagttgggtgccaaagcccgaacctggatgaaggagctctgcctgtgggaatgagttgttggatggcacatccagcagtagatcatgatcagaaatttcatcaccaaaggtgaatgaatccagctcaagagagccaccatcaggaggcaaggcaaatagacttctaggactgaagctagagccttcattgtctatatgttccttttctactgccttcataatcacccttctggggctcttcatcgtagttcttgcttctgaaaaattttgattttgggcatcacgagatctcttggcatttgcaaaattacttgctgcaatggccttaggttctcccgcaactacagacactccagtactattcttacatttcttaagtaaattatagtgttccacccatttggatttttcagaattcaacaatgcaagcctctgcaaagtcttacagtcttcagctttcgatcctgggaaagagatatcaaagaccccttccccaagcagctgctgga

SEQ ID NO: 7910 - DNA, 645 bp, Vitis vinifera
  Predicted polypeptide sequence is orthologous to G1506
tttttttttttttttgggtgtttctgagagattaggatggcatggttcttttgtggaaaaaaaaaaacttaaaaagatatggtagattgctcccctaagcttatcttaggccctataagaggaaagaaacagtagattttttaaaaatgggaagcattctattcaacgactaaaagactctttcctttgtaatatatgggcttggttcacgttgtttttaagttcgggtcctccatgcagagtttgttgtcgattagattcacagtgaagggtgctgttttttgtggtccctttatttaatttcttattggaagcgcttttaggcatctgtttatatttcccgtgtcctttgacttgatattttgccctcttgtttgtaatattttcttgctttatctacacgtaatcacgtatatacatatacagcacggcacatacatcaaacatcaacgtggaagaaacatgaaaaaagagcgcaatttcgaaattcaaagctccaatcctctgttaggttcccaaaaaaaaattgagagaaaaagaaagaagaccctaatgcaaaattcacaatctttcacctttctagcattttttgagactatatctttcaggaagtagacatagaaggagtacgaaccgttgattgga

SEQ ID NO: 7911 - DNA, 723 bp, Vitis vinifera
  Predicted polypeptide sequence is orthologous to G1510
ttttttttttttttttttttttttttttttctcttcaaccttgaaactttattttaatgaatgaaaatccttttttcttgcatcacaccctttccaatctcaaccgtaggatattttggcaataatatcatttgaatttcccaacccttttttttggtcacattaaatttatatgtaaacaaatgggggtcacatgatccaatgccacccaaaattcttaatttatcctccattaaggtcaacgtcaattgtgtaagcaagaatacctaaaccccctttttgggatttgtctggaacctcaaagaggtccattcccagccattggatcatggggtctttcgcttcagattttctaacacggacggagaaattaaggagagaagtttcctgatagcgacaggggtgacatcatggatctgagatcttgccaattcttccaacgacgtagttatgtgggcctggaatctttggggccataaccacctacagcccaataggttttggttttgtgtccatgttggggacttcgagtacacccagcccaaatccatgcattaggagcgtgtgatgtaattccattatttcattgaaattcgagagagaaaaaacaaaaggtcagtagggattttcccactttttctcatttctttctcttccattcaccactgtcatcaacattatcatgtccatcagcagcttttcatttgtcaccatctctatgat

SEQ ID NO: 7912 - DNA, 698 bp, Vitis vinifera
  Predicted polypeptide sequence is orthologous to G1510
ttttttttttttttttttttattacagcaaaagggggcttttatttgaagcctaagatggatactctatgatatttatttggagatcagctatggtgaagcaaatgatcaactcactctcgttcacaaacaaaaccttaatcataatccaaagaaaaaaatggaagtggggagccgaaatatcaattaatcaactgtaaacaaggtcacaagataaggccattaggaggatcgcggcttcttcttcatcccgagggaacactcgtctaaaacctgagttcttgcaaatactcgaagtgaaatcttcgaagcaaagcttcttctcggtgggaggaggacaagggggcttgcagagcttcttctgttgccctacattgcttgtatgcatcttcttttccttgttgggcagcttcatcttcataggcgatatctcggtcccaacggctgtgccattcgctgctgctgctgccgctgctgccatggctcgtctcgccttcctttgcctaattccacaggcattgcaaagtgacttgggacctctaggaccgctcctccaaagaggggttttggttgtgttacaatcactgcagactctaattgggatattactagtattgttggaagagttgaactcattaatattgtcccactgctgatgatcttcaaccttctgctcgattttcgctgtagtgcaatccg

SEQ ID NO: 7913 - DNA, 937 bp, Vitis vinifera
  Predicted polypeptide sequence is orthologous to G154, G1797
acatgttttttttttttttttttttttttttttttgcaggagaaaagcacattgtgaaatttaatgcagggcaatttacatcataatacaattttctgagaaagtattcttctgatcataccgaccattgagtgtattcaatagacaaaacattactcttactatacgactgatactagaatcattgctcgcgctggtgcaactcatagtatatagcagtgttgctgagcatggaccccttcatcagtttcccaataggaggcgcttggctctcccctcaggcagtccaatgaacaagtcagtggagacatctgaattttggcttctctctgcactaggcaaagtttcattctcttgattcggagcttgatacggttgcaccccacacttttcacacagcattgcattttcagctgctagggctttctccttttctttcagttgctcgatttgttccttgaaaacctgattctttcttgctcggatgctgcttacgctgcgctccaactgttgttctatctgttgtagttcttcaatggagcatgaccccaaaccttctcctaagagtttccgtttggaaatttcaagaagctctatcttctttgccatatttgctgcttcatgcttcaaatgctgcatgttatgttcggtagtcttgtagttgttggtatgaacatcttttgtgtgccgttgatatcgttctattgtctcctgcatactggaactggaaaattcatagagcttccctcttggagagaaaatgatgagcgcaacctcagcatcacagagcacggagagctcgaaggccttcttgaagaggcccattcctccgcttaaaaaaggtgacttgccgacttgtggcgttttctatacgcctcatttgagtctttcctctcaccatcctccagaaaaccccgttgaaaactctccaaaaaaa

SEQ ID NO: 7914 - DNA, 851 bp, Vitis vinifera
  Predicted polypeptide sequence is orthologous to G154, G1797
ttttttttttttttttttttttttttttttggtgctaaatttagattagatcgattataatttgttgcctaatctaacattaggcaccaactccctgtagtgaaaacaaaaactagagcaaggaaaactaattaagagtacaattaatggcgatgaaaccgggtttccacaaaccagcaacttcacactacattttttttttctttcaggcaggcataaactcacactacattaactttaatgctatatatatttgaaatttattctataggcacaatcttaacactacattattcttgtttattgaatgctgccactcagatgattagcgagtgcaattatttgatgttgaaattgaaaatagacactgcaaatcacgatctggaaatgtggccaagaacatcagcaagtccccacttggtcatgagcagcgcatttctggcaggccgatgaacaactcggtctccacttcagaacttggactgctttggctgtaggttacaccttcacttggttgtgctgagagttgccactgccttgtgtccttttgacttaaccttgcattttcttctagcagttgtttctccctttcttttagctcctcaatctgctcctggaatatctgagcctttcttgccctgatgctctttaagctcttctccagttggctgtcaatctctaggatttcgtccagagaacatgagctcaagccttgtcccaaaagcttccgttgagaaacttcaaggagctctatcttctttgccatgctttctgcatcctgcttcaaattctgcatatattgctccaattctggattgttggtttcaacttgttttgcatgttcacggtat

SEQ ID NO: 7915 - DNA, 516 bp, Vitis vinifera
  Predicted polypeptide sequence is orthologous to G1543
ttttttttttttttttactaccatttaaaatattgaaagctatatatatcgagaatattcaacatgcataactatacttgtgtcgagttccaagcagcttaatttcaaacatatagtgccaaatttcttttagaagcaactgggcattattgatggcaccccttagggacatatatactaatagggaattctgaaagacaacaactgattcgatacaaacacataggatggggtattaatattgagactggactggtactgccgagtgaatgtcgtgtaaaagctccatcttctatagattacaaggccagtccatgaaactctgtaaagaagtaacttcaaagataatctcagttttgatgtttccgaagatagatctttcttatagttgcatttgcacaaagtataggcatcttcatgtcttggtgagaataccttgaaagtgtagatgcagggtacgatccttctatgcctcacccaggggatgttcaaattgagttacagaaacagcatgta

SEQ ID NO: 7916 - DNA, 678 bp, Vitis vinifera
  Predicted polypeptide sequence is orthologous to G157, G1759, G1843
gattctgtagtggcaatagcttgagaaacattatcgagtcttacctacagataagtcgtgatgcagaagcaaatgttggcagcagctctcatgaagccaagcagaagcgttatccagttccatgggcaggtgctgacctacttaaaatagttgaaagtcaggttgaagggccacgcatcgagcaactaaggttgtcagagctcagccaactagagcaaaaactggatggcatgctgagacaaactaggcgacggaagacacagctgatgatggaagccatagcatgcctcaaagaaaaggtaaaggagctgaacgaacaaaaacagcaaatggagaagatgattgcagcagcagagagtaaagacgccctccagcatgaggacctggtgatggaacaagccggtaacaacagcaagccccctccccagaatgttgtgctgcagttgctttgattcaatgctagtgacaagcttgacacgtggcaattgataataaaccgttctacacaagtgccagctgtggtatgtctcagctatctagttctaatcttgaagtggacttctctgtaagcttaggttggggagatattctatagtatttgtttggtggctggaggatagtacagaaagtaatgggacatccaccgcctaattgtatctttggtcttatgactccttg

SEQ ID NO: 7917 - DNA, 851 bp, Vitis vinifera
  Predicted polypeptide sequence is orthologous to G157, G1759, G1842, G1843, G1844
ggggggcttgaagtagagatatgggtaggaagaaggtcgaactgaagcgaatcgaagacaagagcagtcgccaggtgaccttctcaaagaggcgaaatggcttgatcaagaaagctcgcgagctctctgttctctgcgatgtcgatgttgccgtcctcgtcttctccagccgtggaaagctctacgagtacgctaatggaaacagtttggctaggatccttgaacgttatcagagtcattttgaagcagaaggcaatgcctctacaggtgctaatgaatcagagaattgtcactacgagtatacaagagactggactgagctactgcagacagtgcaaagccaacttgaagggcaaaatgatgagcagatgagcgtgactgaccttgtgcaactagagagagaacttgatgctgccctgcttcaaaccaaatctagaaagaatcaactaatgatggagtccataaggcatctccatgaaaaggaaaggatgctgaggcaagaaaaggagcttctagagaaagagatggaagcaatgaggaaggagaaggaagaaggctggaaggagtgtgcgattgggaacaacctcgatccctttaacccggaagagccctgtcctcatcaaaggacaaccctttccttgcttagagggtaggcaccgctcatacccaccgccattgccaccgcttaaaaaggtgtgctaggcttcagtggaaggccaagtgtttggtgtctcaacggctgattgcaatgacgttttattacgtgtgtatgaactatagctgccaagtggccgttcttgtatccgctcagtctctttattagtaataagtttagtttcaaaaaacctatt

SEQ ID NO: 7918 - DNA, 935 bp, Vitis vinifera
  Predicted polypeptide sequence is orthologous to G1634
agaagagataagaggtttgagagagctcttgctatttatgatgagaactctccggatcggtggttgaaggtggcggaaatgatcccagggaagactgtgtgggatgtgatacagcagtacaagatactggaagaagatgtcaacgatatagaagcagggatgcttccaattcgtggctaccttgccccttcttttacactggagttggttgagaatcgtggcttggatgcgttaagaaagaggaccgccactatggttcgagcttctgatcaggagaggaagaaaggggttccatggacagaagatgagcacaggcgatttctgatgggtcttataaagcatggtaagggagactggagaaacatatcccggaattttgtagtatctaagacgcctactcaagtagccagccatgcccagaaatacttcgctaggcagctttcaggagggaaagataagaggaggccgagcatccacgacatcacaacggtcaatctgaccgacactactcccccagagaacaataaatctccttcattgcatcactcaactgcacttcagtcgcagcagaagtccactggtgctccaaaagtaatactggactgggatcattccaatgatggagccctcatggtattcaattcgactcatggcaatttgttcaggccatcgccatatgaagttgcttcgttcggtacccatcatggagctcatattgtacctcgcaatccagtgtttcaaatccaatctgcaagacatcaagttcgtggatgagcaaatcgggtccagaagagaagagcaggggagttgatggacaaggaagcagtctctgtagttcctcagtggattgaggagaattctgatgttatggtgccctagataggcatggttttttatgtgattacatgaatgaggagttgagctactacttaaaa

SEQ ID NO: 7919 - DNA, 725 bp, Vitis vinifera
  Predicted polypeptide sequence is orthologous to G1635
tgaaactcatgacaaagagattcacaatgaaggatcttggaccgggtcaaatactggatcagtgaacgaggggggcaattgtgatacaaattgggatgttgaaacccagagccaccaaccttatttagacacgatggaaaaagaatcagactcagctttcgagttaaagttgagcgagagatcagccttctctagaggaagaacaaacacggacaagtgtgtgaaggggtttatgccatataaaagatgtttggcagagagagacacccagtcatcaataataattgggaacgagagggaggagcagaggaaccgcctttgcttgtagcgtctctcactggaaagaaatcccctagagcgcagtttcccttttagtgcatagatttttttttgacagattcagaaactgattcaggtaccgttaaagaagaaaatggggcagtaaaacggcagccatttctgaagctttgcaaagtctcttctacttctctactagtactaccttttcccctcatctgttcaaatccataaccctactcctttacttgcaatctcttttgtcctttcggaattagcttttatattcctttttaattctttttgcctttgttgaaatgtgaatccttgatcacactctaattctggtaatgtcctggacacctatgattggaggataaatttacataaagtgcagcattttcgaccaaaaaaaaaaaaaaaaaaaa

SEQ ID NO: 7920 - DNA, 211 bp, Vitis vinifera
  Predicted polypeptide sequence is orthologous to G1637
tttttttttttttttttttttttttttttattaactaggagttagatagatacaaaattttaggtttctaggttcataagctgcataaatatacagggtgtatgaaaattatttcagttccgggcacctccccacaaatcattaacatgaaagttcccctccttcaacaatcccaattccccaacatttccctctcaacccctcaatctaa

SEQ ID NO: 7921 - DNA, 542 bp, Vitis vinifera
  Predicted polypeptide sequence is orthologous to G1646, G715
tttttttttttttttttttttttttttttggaaaaagctcttgtttatttcataataaaatagcttccgcaatgtctccaacaaaaaaaaaaaaaaaaaaggcactactaacacataggtatagatgcatgttattccacaaaacataagatgacgctttttccaaaccatcaagagctttcacatgcctccatcacattttcctcgcttgggagcatttttgttcaccatttcagaagaagcaatagggggcagctgaacagaacaagggatttcatgattccacattattaattcatggtttgctgcaggaaaatgtacttcgtcatttgccacaacaaatcctgctcctcctgaaatattttcactgtgctcttccttatgcacatcgggagcaatgtttgtcaagaaatgcagagttgggtaacatcgtatggctctccctatatcacatggctgcagagttcggcgtttgttggcttccgcatgaagccatgctcgaagtgtgagctctaggatgaacaattcacttgctttggcaa

SEQ ID NO: 7922 - DNA, 692 bp, Vitis vinifera
  Predicted polypeptide sequence is orthologous to G1646, G715
tttttttttttttttatgacaagtaatatgagaatatattcagataactagaatcattcagttaaaatgaaaaacatggaccttacatttagaactgcacataggattagttgagtcatcactgcactggtccaaatcacggtttttaacaagtttctaattgaagccattacattaaaaaccaaccagttttcacaaataataacagagcaagtgctcctatgattcatagccaaggaaaatccaagttctgtccacgagctcgatagtttccatcatgctgggaagcaccacaacatccacaatgggcgtttgcttaaccttggccatcaagattcccctgtccactgctccctccgctcccgtacgacccatcctctgccgtctgccacaccgactgccacgcctgcgacggcggctgcacgtacacccccggatccacccccggaaccgccggccttcccatcattacccccggcgcgggctgccccatcggtggataatagtacggcaccccactggccgtcgaccctaccatccccaaccccccctcgtccttgatctcatccctcggcacaatatccaccaaaaaatcaaatatatccgtcctagtaatcgccgcggcgatatcattcttctgcagcgtcctcctcttgttctcctccgcgtgcaccacgacctatcgtcagctc

SEQ ID NO: 7923 - DNA, 586 bp, Vitis vinifera
  Predicted polypeptide sequence is orthologous to G1660
ttttttttttttttttgaaaagacaaaaaagaagcttcattccagctcttaacagcagaatacaattgttgtcatgagaaaacagcccacgaggcttctgcaaaatgagacggccacaatggcaaagacatatcaacatcctcaaattcatacatgctatatatgctacatcacagcacaatgtctaaggaatcagtcacagtgcaaaacaggaacccgaaccagcctccccaactagtgtttcagattttaggagcaccaattccagcaggaaaacgaggaagggatgcgcccagtttttcgtatatactctgcttgctgctcagtttttgctgcttgtcgactcctcttggcttctgctgccgctcgcttctcctcagccttgtgccttgcagctgccagcttgttcatcagcctgtcatgggcccttccccttatcctttccacctccacctcaattttcctcatctcagcttctgtctttgctttctgatgattttcccatacttgtattttgagctcttcgcgttcaaacctggccatatacttagctttctccgcctcctcccaagctgctgcacgtgtc

SEQ ID NO: 7924 - DNA, 605 bp, Vitis vinifera
  Predicted polypeptide sequence is orthologous to G168
ttttttttttttttttttttttttttttttgtttacaagctttggtgggaaatttgagaagaattcttccttggcagaacacaacatgggtcgatcgaggttgccattggagctcattcctaaagaaaagtctcgaaaaattaccttccaaaagcgaacgatgggattgaagaagaaaacatatgaaatatcaacactttgggggggtgatgcatgtgtgagatctatagttggacgtcaaatgatcgccctatggaaccaatattttggccttcaaatcctaaggaggtgaaatccattatcaataggtacaaagaacatagcaaggaggaaagagggttgaaaaccctagatttatcaggctttttcgaggaaaggactaagaagatccaaaaagagatttcaaaattaggtcaccaaggtgtagaccagactaaataccccacatgggacggacgatcgactgaatgatctatcagtggatcaacttagggaactcgtgaatgcattgggcaccaagcttgaagtcatcaagtctagggttgagttgttgaagaagggcctgcattggtaaaccctagttatcctaacaatacaatgccccc

SEQ ID NO: 7925 - DNA, 396 bp, Vitis vinifera
  Predicted polypeptide sequence is orthologous to G1752
tttttttttttttttttttttttttttttccgagaatcattaatccattaccctcattcttatttaaaggcagcagaaacatatacagaacctacaacccaaacatggaccgagaaaacataagaagcaaggaaaggagattgatgatcagagaatagcacaaacagaagcggtttctgaatcagcggcggtggaggcgctgctggactgatcgccgagtttgacacctggccaatcacggcagagacagtgttcgccttccgggactcgtttatggacggagggaacatgccttccgcacccaccccatgtggtcttcccacaagtcgagcacttcacctcgtagcacatcttcgtcttccttctcaatttcttcttcaattttttagggtcccc

SEQ ID NO: 7926 - DNA, 790 bp, Vitis vinifera
  Predicted polypeptide sequence is orthologous to G1760
ttttttttttttttttgcatagtattgcctgacattatgtttcaaatttctgtatgaaatgcccaaaaacagtttacagaacatatttgagatctcacacaatttcattctgctattccagcattaaatcaataactgagcgctacatcaaagcaaaagaggaacaccaacaactggttaacccaacttcagaagtcaaggtatcttcagtaaccaccactccatcttcttctgtaaatttatccatgtttaaagaagcatatatagttgattttgtatgcaagcacagcattgcagcattatatatagaatgctttatctaattgtttgtgtatgtatttatcaacctatccataaggtataaaaaaatttaagacatgttcaaacaacaatgcagttaatagacaataggcaaaccttctctgtacttgcactggtgtcgctcatgttggcataggaattaattgggaaggaggaattacagttcaaattcctgaaaatttttactttcttgcaagctttcccaacacgaattataccttccacaaatccttagcttcctggcaacgaaacctccatccacctagattgcacacaaaaaatccccaagaagtgatgcagtaatggttttgttggtttacttaaacattacaaccccttctgatgacccacagccatagtcatggaatccagttgttccatccacttccaggtttaaatatatatatttctcacaggcctacgcgtctccagattgaatcaaatctgttctttatccaactcatatcta

SEQ ID NO: 7927 - DNA, 482 bp, Vitis vinifera
  Predicted polypeptide sequence is orthologous to G1767
ggagcttcccacgcactagcaacgagcgcctcatgctcgaacgcgcctccggacgcgcaatcgtcgacctggtggcttgcccgccgtcggagtcgatcgaacggcgcgagacggccacgcgctggtctcagcggctccatgcaagcgggttctctccggtgtcgtttagcgatgaagtatgcgatgacgtacgtgctctcctgaggagatacaaggagggttggtcaatgacacagtcctccgacgccggaatattcctctcatggaaagaccagccggtggtgtggaccagtgcatggaaaccttgatccaccatcaccactctcacacgcatagagtttgattcccacgtgtatggtttttttttctttttttcctttttttgtggtggcacgtgcatggcatggagtttgtgggtgtgttaggatggaaattgctttaattgaatagagaattgaagtaatatattctcattcctcttt

SEQ ID NO: 7928 - DNA, 729 bp, Vitis vinifera
  Predicted polypeptide sequence is orthologous to G1772
attggcggcttaaagatgtatttgagagttgctcaagtctcagatagggaatttacatatatatcgcccacaaaagccccaataaaaggctatttacagtataatgattttcagcatagcgaagaaaaggaaaattaaaaagggggggaaatgcaatttaaaagaaatgaatttatagtttctcttccagggtagatctcaacaagggagagggatgtgtaactcaagaagggaaaaggaaaaaggaaggcagggaaagggttttaagtatggcatcacaaatgatctgatcccatgagagagaaaccaaggcccactctttaagttagagctgtacacttgtatttgaaacgaaggctgaaactttcaaagattagttcctatccacgacctctgctggcaagttgagatcaatgcctccgagaccctcctttctagcccgcttcctagaagaatatccactctcatatgaactcccagagcctgaaggtcgatcaaattctgctgtccctccatctgtgccattttctgaagatggacagttatcagcattgctggctttattgctctgacaggttataagttctgatgccctttcaatgccctttgacttatatggagcaatattgtggatgccatgttggagagaacccaatagatcattctcaatgcattcatacattttcttacagagggtatccgtgatcactgataggttgatgacttgca

SEQ ID NO: 7929 - DNA, 673 bp, Vitis vinifera
  misc_feature (156)..(156): n is a, c, g, or t
  misc_feature (204)..(204): n is a, c, g, or t
  misc_feature (257)..(257): n is a, c, g, or t
  misc_feature (281)..(281): n is a, c, g, or t
  misc_feature (395)..(395): n is a, c, g, or t
  misc_feature (489)..(489): n is a, c, g, or t
  Predicted polypeptide sequence is orthologous to G1789
ttttttttttttttttttttttttttttttgcgcttgatgatagatattccattaaaataggggtgggaccgggattacgtgcatacaagagcggacagagagagtcagacttttttttttttttttttccgtttttttttccttaaatgaaaagnccgcttctattttttcctaaaatataatttaataggagccaggccttnggatttcttgcaggtttaggatacttcaaaagccaacaggggcttttcgtctntttgtagttggggatcggagatcngcccgactcgatatgcttgggggcccgaataaggatctcggaggggggcttgatcgacgatcgatcgatgccccccccagcgtgggccacattctgccagcgggggggggtggnccgtgacatataagggatgagccttttctaacagtttgttttgttttggggcccatgagccagacctctggagaaaaggagatgccatggatcntttcaaaggagataacaaaccaagggggttttaaaaaggactaggggggattagaaataatcgggagataggggttcaatcttctaacttaaaaaaaggcctaaaggaagggtacttgaaagaagagagggagctgagttggaaggatgttgtgtccccggccgtgatggccgaattcccgggc

SEQ ID NO: 7930 - DNA, 439 bp, Vitis vinifera
  Predicted polypeptide sequence is orthologous to G1789
ttttttttttttttttttttttttttttttctgatcaatagagatccccttaaaaaaaggggggtacagggattacatgcatacaagagcagacagagagagtcaaactttttttttttttttttcggtttttttttccttaaaggaaaaggccgcttttactttttccaaaaatataatttaaaaggagccaagcctgggactttattgcagctttaggagacttcaaaagccaacgggggcttttcgctacttgtagttgggaataggaacacggcccgactcaatatgttgggggccccgaataaggatctcatagggttgtttcacctccccgggagattggccacccacagggtgggccactttctgccaggggtcgggggggtcccggccatataaggatagggcctttccaaacagtttgttttgttttggg

SEQ ID NO: 7931 - DNA, 763 bp, Vitis vinifera
  Predicted polypeptide sequence is orthologous to G1789
tttttttttttttttttttttttttttttcaacgtacaatctattataacaagtaaatacatttgtttctgcaaaattccattacaatatggtaggaggataaagggatgaaggacttgcaaaacaaggggcgaggacaaatcctacaggaaaaaaaaaaaaatttatactttacactgtatgggggaaaaaaggaaagggaaggaaataaacttcttgttattctagtactccattacttgctttgtagcatgaagcaaaaaaaaggaaagggaaggaaattaacttcttgttattctagtactccattacttgctttgtagcatgaagcataatggatccttattgctgctaattcgtcatattatctgcttaaagcttcaaatacttcaacctaggagaggaaaaaaaacagaatcaaaaggaagccctctgttcttcatcgttgaagttgtatcctttgttggaggctccagcttttctgtagttaggcaatgggacttggccaaactcaatatgcttgacatcctccacaagcatctcatagtgcctcttcacctcctccacagtcttcccacccacagccctggccatgttctgccagcggtccggggtgtccttgtcatacatcaccaaagcattctcgaacagtttgttttgcttggtagtccagttatttgaactcaatcccatttctgaatctgcacacaaattgtaggtggggggcgcagtaccaaggataggaagattgaattgtatcccc

SEQ ID NO: 7932 - DNA, 484 bp, Vitis vinifera
  Predicted polypeptide sequence is orthologous to G1789
tttttttttttttttttttttttttttttctgataatagatactccattaaagcaagcgtgctaggtgaattgaattacaggcattagagggggatacaaggcaaagagagagagagaaagagaaaatttcttctggataagtctgcatctgcttttctcaaagatataactatataacttggtcatgcctagtcttggacctttattgcagctttatacacttcagcagcctctgttcttgatcaccaatgctgttgcttccagtggacttgtaattaggaatcggaacatggcccgattcgatatgtttgaggtcctcaatgaggatctcatagtgtctcttcacttcctcggcagacttcccacccacagccttggctacattctgccaacggtctggggtgtccttgtcatacaaggctagagccttttcaaacagtttgttttgcgctttgaagtccataagccagagcccatgcgaga

SEQ ID NO: 7933 - DNA, 611 bp, Vitis vinifera
  Predicted polypeptide sequence is orthologous to G1789
ttttttttttttttttgataatacttcattcatatatagaaccattacattaatttagcagcacaatggaagacaaaacaagaaaagacatggacacaatatttttcagtaattctgcttctgcttctgtgtcttggatagatacctcagagggctctgttcatcatttcatggccatgcccacttcacctgtaattgggaaatggaactttgccggactcgatgtgcttgacatcctctatgaggatttcatagtgccttttcacttcctccgcagatttcccacccacggccttggcaatattctgccagcggtcaggggtgtccttgtcatactttgccagtgccttttcaaatagtttgttttgcttgggtgtccaagaggagccagaggtacgtgaagaagtcatagagttggatgccattagttgatttttgaagtatgggcttttggatttgcaagaggaaaggaaaaaaaaaaaaaaaaactcagggaatgcagttggaaaccaaagtgaaaatgcaggagtggctggtatgaatcccacgaaatggaaaagaaggaaaaaaacagctcagttgcttcagtcaaggaagaggagttggaagtc

SEQ ID NO: 7934 - DNA, 503 bp, Vitis vinifera
  Predicted polypeptide sequence is orthologous to G1809
gcaggagcccaagatgtctcttcccaatcccaccccctcggcttccaggagttacgagcaggagggatcatcttcttcttcgccttggaggaggcacactgccgattccttccctcctctcaatattcattctgacaacaagcacaaaaagacagcgatgaagatttgttcagagttcccgacgtggaagcgcagcccccttcggattcaacgcgaaccaccaccaccaccacaacaacaaatactagtaataatccagaggttcaacaacaaactagcagcggcaagcgccggaggggacgcaatcctgtggatagggagtatagaagactcaagaggtacacattatttacacatcacccccctcctaatttttatgtttacaggtgagttcatcacatattgatttgagcctgttggccaatgtataaagatgggcacattcatataccattgactcgatgtgatctaatataagtatcaagtatcaaactttaacaatc

SEQ ID NO: 7935 - DNA, 609 bp, Vitis vinifera
  Predicted polypeptide sequence is orthologous to G1809
gaatttataattgaatatgtacttactaaggaaataatagtcatatagattggttcagtggtagtaattaataggttacacaattacatttagtgtggcccccaaccttaatgaaggcagcatgcaggctgaggttgccttaatttggaacacaatttgtagatacacttttagtaaatcaaaatgattacagtcaggtgatagtggctccatggcactggacatgacccagacagtgataatcatgtagcacagctaagtgcatatctgcaaggctaatttttcaggtgtttggcaaatgggtttggcgcagattcaaaaataaattgatctgatgacaggcagaaggatgtggtagaagttcttcagctcttgcccaactgatcatgctttgactcagtactactgtcatccatcttaggcctagtgttcatgaggaccttacggagcatggtgttttcgttaacaagagttgagattttctcttctagttttgagttcctgtcctgcaactcctgggctcttgactccagatcattcacatacaccttctttctttctcgagcttgttggggagaaaccctgtttctcagcagtctcctcgtgccg

SEQ ID NO: 7936 - DNA, 752 bp, Vitis vinifera
  misc_feature (539)..(539): n is a, c, g, or t
  misc_feature (541)..(541): n is a, c, g, or t
  misc_feature (727)..(727): n is a, c, g, or t
  Predicted polypeptide sequence is orthologous to G1821
agaccaaatttgagagtgaagagagatagggagatggagactggaggcttccatggctacagaaagctctccaagacgacctctggaatgaagctgacagaacccaatgagaagcagcctgagagcaatcagatgtccaacaattcagccatggaagacactgaatgcactgtgagggaacaagacaggttcatgccaatagcgaatgtgatcaggatcatgcgcaaaatcctacccccacatgccaaaatctcggatgatgccaaggaaacaatccaggagtgcgtgtctgagtacatcagcttcatcacaggtgaagccaatgagcggtgccagcgcgagcagcgcaagaccatcactgcagaggacgtgctgtgggcaatgagcaaacttggttttgatgactacatggagccactcaccatgtacctccaccgctaccgcgagcttgaaggcgaccgtgccaccatcaggagtgagccagtggtgaagaggaatgtggagtttgggggtctgagcgtggcggcatttgcggatcngnttcatatgggtcatcaccaggggttcttcggagcagcagccatgggtggatacttgaaggaagctcccaatgcaggcacatcccaggctgcagtggctagcttggaaccatatgcccagtacaaatgagctgatcacaaaatactagctagagagagtagtagtttctagtgaggtgaaggtaaanaaaaaaaaaaaaaaaaaaaaaaaaa

SEQ ID NO: 7937 - DNA, 641 bp, Vitis vinifera
  misc_feature (623)..(623): n is a, c, g, or t
  Predicted polypeptide sequence is orthologous to G1838
ttttttttttttttttttttttttttttttaagaaaaaagattagggctcccattcaacatccattgagaagtttacaaaacctagttttcctagcataactagaacttcatcttgtctcaaacaaaacctcatatgtttcaacaactgctaaaagtcatgaaagaggtggtgggtcagatgtgggtcagctgggtaggaagcacaaacaagagcttttgctaattgttagcataattgtgcggtcagtaggactggtgaggccatatgaaaaactcagctggaggcggcaacaaagccattggggttggcatagaggaggaggtcgtgcctggggagttggaggcgcccatgttactggagtgaagatggttgaagaggttgtgatgataaaatgcagttgcagtatctaatggaattccacatgggattgcaggaattggttggattgcgccgaaagtgatgccactgctgctggcgctggactgagtttgctggtccaggttcaaacaaggcttctgatctgattcaagcgagagctttagccgctttgctgctccaccaatgggaagagcactatttgcaattgcttccacatcatatcggttcatctcgaaatgatcnaccgcattcacaccccga

SEQ ID NO: 7938 - DNA, 888 bp, Vitis vinifera
  Predicted polypeptide sequence is orthologous to G1850
tttttttttttttttttttcttaaaatatatgcagattttcttcaaacaatcaatcaaagcaataaacaaagtctaagagattcagagcaaaagtcataacctctacattggcaatgatcctccttgtcaagtctacctctaacaagtaatgatcctaaatttgctccgggctgtaagccaaaagtttggaataaactagtaatgtttttcaaaacccatcccatccgacgagctggcaaatcttaaaaccattattcacggatcatgggatcatggatcattaagctgaaaccgtcaccgaaaatatcaaataattctatacttaatttgacattgcaaaccaacctaaccttgatgagcctccttcctcagcatttccagagagggcagctcgctgcggttccacgtttccacgggcaaaaattacacgtcacgtctcagggagagggcttccgagaaacaactagaatggagcttctaaatatacaattgaaagcgagcgacacgtgtcgatcatggcacgctcctgcctcgaaaagcgttcctaaggtgcccactgttcctgtcactatcaattctaatctaaaacgtttaatcaactgcggagttctagccacggagggtcttgatgatgatcagaacttccatccaacggctctgatttcacctcttgttgctgggtctgaccttccttctctgactcctcctcttcatctcttctgacgcgcttcacgccgatggaaacaccgaataatcgtgggcttaaatcgccctcggccttgacgccgctctgtccggcttccacaggcaactgtctctccgtcaacaagtccagcggcctgccttccggaatacctcctgcgtcaatttggccggcggcgtatttg

SEQ ID NO: 7939 - DNA, 492 bp, Vitis vinifera
  Predicted polypeptide sequence is orthologous to G1855
tttttttttttttttcggttaatcattttccacttttccagaacaaacctcaattagtctcattatttattcactgatgattataaatatctgtctgaataactgtctctccttcactaaagaccactaaaaatcaatcaaaatctctatcctattaacatgatttatgtgcatttaatgttttggatcaataacaagaaaatttctcaaagcatctagaaaaatttacctattcacacttctcatttgtctaccaagattatcttctctggatggaaaggcccatactcgctgtgtagaattttgcttttccatctcattcgatctgtgatgccttttactttcgcaaagatgtcaatgtgatctctgattatagcatccccttcctgacgaataattcggaacatctcaaatagaatatcaagaatgtcacatttgcccatgtagatgctgaaaactccatgagcatgtatcatatcatatgttcgagga

SEQ ID NO: 7940 - DNA, 423 bp, Vitis vinifera
  Predicted polypeptide sequence is orthologous to G1855
tttttttttttttttttttttttttttaagcaaacctcaactagcatcattatttattcactgctgaatatagatatctgtctgaataactgtctctccatctctaaagagcactaaaaatcaatcagaatctctatcctattaacatgatttatgtgtatttaatgctttggatcaataacaagaaaatttcacaaagcagctagcaaaatttacctattcagacttcagagttgtctacaaagagtatcttctctggatggaaaggtccatactcgctgtgtaaaattttgcttttccatctcattcaatctgtgatgccttttactttcgcaatgatgtcaatgtgatctctgattatagcacccccttcaggacgaagaattcggtacatctcaaaaaaaatatcaagaatgtcacatc

SEQ ID NO: 7941 - DNA, 754 bp, Vitis vinifera
  Predicted polypeptide sequence is orthologous to G1863, G2334
ttttttttttttttttctataaaagctcaaacaagtgtatcaagagttctcaaaagttaaaatgagtcatttctccccggattccgggaaaatttttgtcatcccctgcagaaactaggaaaagaacattgttctaccacatgggtaacgccatcaagaaacccgcaaaatttacagcaatcaaaggaatgccagaaaaaatggtttctgttttcattcgttacaaacacaatgttttctggttcctgaatatttgccagagttttgagtcttgttttattccatacctaaaacttgaactcgcaaatgtagttttacacacagagctacacggaaagtgcacaagcaaatcagacaaatcttcttccaagttgcaaatggtagagctcctggaaatccgaaatcatgattctttcagttatcgtggggagaccgagagctggttgttgagaagtcagaggaggccattgggatcgaaattgagagctgagttgtggagaatgaggtctggttggacctctcttcctcaaggccggaccaggagtctctggttttaggccactcgtcaaagaaaggacggagagactgaccctcctgtttcacaacctctcccgacgcaaattcgctgctgaagaacgaatgctgggggtagtcactctgcaagatggagttttcacttgattttgatggggggaatgatgagacccgtgatggcatcagaggccatgtgctgtccaaggcgagtccatctgaa

SEQ ID NO: 7942 - DNA, 734 bp, Vitis vinifera
  Predicted polypeptide sequence is orthologous to G189
tttttttttttttttttttttttttttttttttttttttttttttttttttttttatgattcaaacccccaccaaatccacaatcttctctcttttctatttctattctttttttcgtaaacacaactaaaagattttcaagaaaaaaaaaaaaaaagataaggaatttatgtacgggataggggggtaacataaacactcatcctcttgggatatttggactattgagcatcacgggttcttgatcctctgtttcttgtttcttcacgggacgatattcaccatggggtgatagccactagggattaggatgattcgagaacgagagctgcagtagcgtccgtaattgattgagaggggttgggatcgccttcataggtgaaagtcagcaccgtcggatcgtcgagagcccgttccacgtgttggggtggggggcaccctctcacgctactgggcttgtaatatccccttggatgcggagaaccttggataggtttctgaccatactttctccaagaaaaatcatccgggggaatatcagccatctggggtgttatggggaggactcttgacccttttttactctcaatttccttttttaaaacaaggacccggccaaaaatgttccgatttggccctgggttggccatgggaaggggtttttttttcatggaagacaggaaagggagggcggcccgtaaataacctgggttattttgatttgaaacccgggc

SEQ ID NO: 7943 - DNA, 547 bp, Vitis vinifera
  Predicted polypeptide sequence is orthologous to G189
gttttttttttttttttttttttttttttttggaaacccaacaccaactccaccatttccttctctctctccttttctttttttttttttttttttttttttggatttttgattctaaatggaaacgcagcggtttacagggagagcatggagttgaccccggacttttttacagggaaccataaactaacccccaatctctttgattgagctggtatcctactcctggtgctctaccattttcttgatctaaaaaaattctaggatgagaccagcggcttctgcgacggaaaaaaagggggtgggctcgccttcgtaggtgacaatcagcatctttgggtcgtccagagctctctctacctggttgcgggctgggcaacctctcacgctactggacttggaggaaccccttggatggggagatccttttattggtttctgtccggacttcctccaagaaaaatcatctgggggaatatcggccattttcgggcttattgcccgaactctaaccaccctcttcaatttcatctttcttctcttcgaa

SEQ ID NO: 7944 - DNA, 674 bp, Vitis vinifera
  Predicted polypeptide sequence is orthologous to G189
ttttttttttttttttttgcgaaaagagaaaagaggtcacgcactacttttatgattcaaacccccaccaaatccacaatcttctctcttttctatttctattctttttttcgtaaacacaactaaaagattttcaagaaaaaaaaaaaaaaaaagataaggaatttatgtactggatagggggctaacatagacactcatcctctttggatattttgactattgagcatcactgcttcttgatcctctgtttcttgtctcttcactggacgatattcaccattggatggtagccactagggattaggatgattcgagaacgagagctgcagtagcgtccgtaattgattgagagtggttgtgatcgccttcataggtgacaatcagcaccgtcggatcgtcgagagcccgttccacgtgtttgcgtgcggggcaccctctcacgctactgcacttgtaatatccccttggatgcggagaacctttgataggtttctgaccatactttctccaagaaaaatcatccggtggaatatcagccatcttggtgcttattgcaggaactctgaccactctcttcactctcaatttccttttcttagaacaatgacaccgcccaaaagatgatccgcacttggcacctgcgtcatccattgactgcactttctcttcat

SEQ ID NO: 7945 - DNA, 465 bp, Vitis vinifera
  Predicted polypeptide sequence is orthologous to G189
tttttttttttttttgggatttttgattctcaatggaaacgcaacggtgtacagggagagcatggagttgatcccgtacttttttacagggaaccataaactagcccctaatctctttgattgatctgctattcgactcctgttgctcgaccattttcttgatctaagaacattctaggatgacaccatcggcttctgcgaccgatagagagtggttgtgctcgccttcataagtgacaatcgtcatctgtgggtcgtccagagctctctctacatgtttgcgtgctgggcaacctctcacgctactggacttgtagtagccccttggatgtggagatccttttattggtttcggcccgtacttcctccaagagaaatcatcggggggaatatcggccattttgatgcttattgacggaactctaagcaccctcatgaatttcatcgttcatctcttcgaacaat

SEQ ID NO: 7946 - DNA, 559 bp, Vitis vinifera
  Predicted polypeptide sequence is orthologous to G19
tttttttttttttttgtaaagacgtttttacattattacccatataatataatgagcagtctaattatagcagaagaagaaggaaggactaggaaggaaattaacagaaaaagagcagtagatacatgcaccgacaaacgccgtaaaatccaagggtcttaaagcaaacgcagatgacgacaaccgacggcgatgcatgtaaccacatgcatttattactgtatctgcgatgcactggaaccattacagagtggtgcatcaaaacgcagcgctgcatacatgcagacgatggtggtgagggtgagtggaagcaaggtcctccagcatccagaggtcgaccgagtctgactcggtgatttcgttcaactgagtggcggcctgttccggctccaaacccaggagcgattccaagctcgagatttgctccttaaactccaactcgctcgctgcttcgttctcgtacggagcaggataggtcattaatggtggtggtggtacggtcggctgataacttgactgtgctgtggggtctggaacacgcatcgtcttttggtggcgg

SEQ ID NO: 7947 - DNA, 680 bp, Vitis vinifera
  Predicted polypeptide sequence is orthologous to G194
gaggaagagaagaagactaagaaagagttgaagcccaagaagacaacaagtcaaaagaggcagagagaaccgagattcgccttcatgacaaagagcgaggttgatcatctggaagatgggtacagatggagaaagtacggccaaaaagctgtgaaaaacagcccctttcctaggagttactatcgttgcaccagtgcatcatgtaatgtgaagaaacgagtggagaggtgtttcaaggatccggccattgtcgtaaccacctacgaaggtcaacacacccacccaagcccaatcatgcctcgagcaaacccatcctccattgccaccacctttgctggcccgaggcttcaaacgacgccgtttcaacacctacacctcctccaccaccaccagcaacagcaacatccctctttcaacgatgttccactcttgaattatggccatggcagcagctttgggagcgccgcaaggtctgttcaagagaggcgttcttgcgcaccaacttctgctttgcatagagaccatggccttcttcaagatattgtgccctcccatatgagaaaggaagaggagatatgacgaaacgcgactccattactgttttgagagaggaggtgcggactgcggtgtagacggaaaaacccagttctggcatgtaattcgcttgctgactagtactg

SEQ ID NO: 7948 - DNA, 633 bp, Vitis vinifera
  Predicted polypeptide sequence is orthologous to G2
ggtcatttgaagctgattggcggagtcggggcttcagacctaagttcaacctgcagcaggaggcgtgtaaaagcgatggggatgccctccggagaaatggatataatgaaatggaaaccatgcagcttctgagccacacccacctacaatcgccagcggcattaaagccaggtgaaatgtacagatatgggcaattcagaagagctggagaaacccagatgcttcatatacttccgccacagctcagctcaccaaattatcagattcagtttccaagcagcagtaacggaggccgaattgctgtcaacggaggagatctctctctggccacaaaccatcaacaatggcaatccggtcccccacaattgtttgcaactgctgcagcatcatcaggattcccaccgcagatgattagacccaaccaacaatggccgcagaaaaatgggttccactctctcatcagaccctcctgacccatacaaacaattcttcttttttttttttctttccaatcttttttctcttttctgcctcagccatcacctcccattttccattctttttcaagccccaccataccatgtaaaaagaaaggaaatcagtgttgtgtacgtggctgtctgtcttctacct

SEQ ID NO: 7949 - DNA, 619 bp, Vitis vinifera
  Predicted polypeptide sequence is orthologous to G2
ggttgattgctattttcatttttctgcctgggtttattacagtatttccaatgcacatatcggtaaggaatagataagagttcagtgggatttgaatgatgtattgttaatttttgtagggcctatgacaaagctgcaattaaatgtaatggcaaagaggctgtcaccaacttcgatcccagtatttatgaaaatgagctcaactcatccggtgagtaatggaaagatgaatcgtttcacttctctagtgatcaacagtctctttatgcattggtgtgtattcaattagatcatgtctggcacaattctcaggtaatgctgcagatcacaatctcgatttgagcttgggtggctccgcatccaagcagaacaatctggaattgggggatgacagccaagttgttacaatggatcagcattcggtggggatgtcatttgaagctgattggcggagtcggggcttcagacctaaggtactaaacagatttgattctttcagctggataattaggtgttataagctgtgcatattcagtcctagatggtgatgttctctacttgtccatgaaacctagttcaacctgcagcaggaggcgtgtaaaagcgatggggatgccct

SEQ ID NO: 7950 - DNA, 805 bp, Vitis vinifera
  Predicted polypeptide sequence is orthologous to G20
atgcagcagcggaaagtgaattttttggtggtttttgcatggaaagaaaaattgatctaacgggttatattaagtggtgggggcccaacaaaactcgccaatcagattccctcgcaaaatcatcagaggaaacaaagcaaggcagtggggaagatattggcagtaaacttaaaacattggaatgggcaatccagcctactgagccatatcagatgccccgtttgggccttccccatgaagggaaaaagcaaaaaagttccactgcatcggccttgagcattttgtcacggtctgctgcctacaagagtttggaagagaaagcatccaaaaagcaagaaaataacactgataatgacgagaatgagaataaaaataaaatcaacaagatggatcatggaaaagcagttgagaaatcaacaagccatgatagtggaagtgagagacttggagtagcattaggattgggtggggaattctctattcaaagaagtgtgtatccattgactcctttgttatccgcaccacttcttaccaactacagtagtgttgatcccttggcggaccctattttatggacgtctcttgttcctgctctgccgactggacttccacgtactgctgaggaggaacaatgacacttccacaatctcctacaatttggtggaaaagcagacgtttgcttgagttccatttgagtgttctagcgatgcagtattttgaaaagaaggtggaaaggtatgaacacctcagtttgtctttagacatcagaagctttcagttattcttcaatgcttgttttacacag

SEQ ID NO: 7951 - DNA, 712 bp, Vitis vinifera
  Predicted polypeptide sequence is orthologous to G2057
gcattgcaccacctctggactctgattccattgctgacactatgaaatctttctttcccactagttcagggacttcctcaatcaattatcagaactacccgcctgatagcaaccatcataacgaagatctttgtctatctcttcattctttccaagacccagatgcggagtccaaccacaagaacctttttgccagtgcagcacaagttgggtatgagactaatttccagagaatggtgagttggggaggaggtggtggagattcagagagtcgcggtggatttgggtttatgtttaactcacctccaatgccaatgccacagccacagccaccaacattgctgagccaaggctcagaattttcacagaggggaccccttcagtccagttttgctcctgctgttcgtgcttggaatgagcttcctattgcttctggggcaatgcatcaatcttcactctctgatggcaggtttgtgccaaatggagtcccaggttttcgaattccagcacgaattcagggtgaggaggagcatagcgtggtctcagataggccatcctcttcctcccccaactctcatcactgaatacactttttcatccaacaggattttctctaggctttcatggtgaccaatgaccaaattcaatgcgaccaagaagatgagcttcagtcaattcattggtctaccaaggaagaagatatctagttgaa

SEQ ID NO: 7952 - DNA, 636 bp, Vitis vinifera
  Predicted polypeptide sequence is orthologous to G2057
gccgccgcgttcgcctctccgcccacactgccatccaattctacgacgtccaggaccgcctcggctacgaccgccccagcaaggccgtcgattggctcatcaagaaggccaaagccgccatcgacgagctcgctcaactcccagcttggcatcccactgccatcaccgtcaccgcggccgccgctgctgctaccaccgcaaccaccacccaccaccaggaagacgaagaaaatcccaaccaggtcgccattgatggcgacgatgatcgtgtgcaaatgcatcacggcaacaatccggaccccaaccccaatcctaaccctaaccaaaaccctagttttcttccgccatcgttagactctgataccattgcggacacaatcaagagcttttttcccatgggtgcttctggggaatcctcgtcttcgtccgtacagtttcagagctacccgcccgatttgctctcgagaaccagtagtcagaatcaagatcttcgcctttcgcttcagagcttccaagaccctatgcttcttcatcatcaccacacccagagccactctcatcatcaacaacaagcccttttttcgccgttaggcttcgacgccccctccgccgcttggtccgagcaccacgcagcgg

SEQ ID NO: 7953 - DNA, 606 bp, Vitis vinifera
  Predicted polypeptide sequence is orthologous to G2057
agcaaaacccaaacacataacaatccaacaaagatttcaacaaagttgagctctgaaagcccgctcaaaacaggaaagcaaatctaagaacataaatcaactgatagaagctaagcaaaccggggatcgaaaaacctgaaatcccaactcagatttcttcttcccgcggattaggccattggatagaagtcaccgaaatccctcttcagattgctttgaatttgctcaaaagaccacacacaacagctagttctttggcctccctttgtggatgatggattagccctgttagagaagatttcggggttttagtgctacactcaatggcgagaatcggaggaagcagaggacggcttgtcggagatgccatcgtgctcctcctcaccctgaattcgtgctggaatccgaaatccggaaaacccgccagggacgaaaccaatgccggaaatcatggatggttgaatgggagttgtttgatggtggtggtggtggtggtcgatggtggcggcaattggcgggtctatccaagcgcgaatcgaaggcgtgttgctggactgaaggggtcccctctgagaatacatctggctttggcaaaacaatggctga

SEQ ID NO: 7954 - DNA, 632 bp, Vitis vinifera
  Predicted polypeptide sequence is orthologous to G2059
agcccatgtcatcatgtcctttattccccacaccccagctgagccaaagccagcatcttcccggatttgaatggctcaaaataaatcaaagccttgcaaaccatccctcaaaaggtctgagtgactactggctcagcactaccaagacacagcccatgaaatacacgggaagaagaatgctgaatcaccaacagaaaacttcgctgtcgtcctcagcatcgtctccgggaaagttgtttcgaggggtgaggcaaagacactggggcaagtgggttgctgagataaggttaccgagaaacaggaccagggtttggttgggaacttttgatactgctcaagaggctgcttttgcatacgatacagcggcctacattctaagaggagactatgcgcatttgaatttcccagagctaaagcatcagcttaaggccaattctacaaatggaaccacggcagcccttcttgaagcaaagttacaagccatatccaaaggcatttcagctcacaaagagcccattgctcctccaccaccgccatcaccaaagcagcactacttgccttacgacaattcaaaagtagcgaaagcagtgagccaaaaccccacaagtaaggagtggcagcttgagttggag

SEQ ID NO: 7955 - DNA, 679 bp, Vitis vinifera
  Predicted polypeptide sequence is orthologous to G206
tttttttttttttttagttgccgacaatcatttggctgagtctgttcgatacatgaataattctaaccggtatgacagctcctgtcccaccgataattgttgtccaatctttcaacagtcaaaagaggccacccaaagaatttcattttcccatttcccacatcggacaacttgaaaattacaagccccttccctcatatttctgataattcatgcaactccccggaccttgtgaaaatattgtaccaaaattccatgtccatgtcatacgtgctatatggactactgccaatgacagcacgcggagagaatggaaactgaagctgtggaccactggccgcccctggcaaatcacccgccgcgccggatttgttggatgacagtacttccgaccagaaattctcgtccatttctgggaaatcctccggtgaatcgaccttaatgcagggtgtagtaatgtcggacatggtggcggtggtcgtggtggtcgtggtggtggcggctgaggagatatcgctaaaggacggctgtggggacagtactggtccatacccaaggctctccgatctcgaattggttgcagaattaatggggttttgttgtttttcgacttgggacgcatcaagagagtgtcttttagggggtggcgtggcgtggttgtgcttgagctcttcttcaa

SEQ ID NO: 7956 - DNA, 909 bp, Vitis vinifera
  Predicted polypeptide sequence is orthologous to G2071
cgggcccccccattgtgtgtttgttttctaaatatagtagtgatgattatacatgatgttctatgtttatggcttttggttttgagtttgagtttgttaagttataggggttttctagttttgaatattttggtggtggttgggtttagttttgggataatgatgaaccaagtaccttaatttcgatgggtccttagagcttattcatagatagctttgaatgttctgtctcatcttgcatatctttcattgatttgatgaattttgggtctacatttgaagaaagagagcaaaaagaaattggggttttcttgcagatctgcttcatttggttggatatataagacacctctcatttgttgggtttcagtgaattactaaaaaataggatcaaacatgaatttcaagaacttcagtgatatgccgccagaaggaaatggtggtaagccactgggaaatttctccttgacccggcagccttccatatactccttgaccattgatgagttccaaaactccttgggtggagttgggaaggattttggatcaatgaacatggatgaacttttgaagaacatttggacagctgaagagactcagaatatgacatcctccgctggtggagaagggagtgtccctggtgggaatttgcaacggcagggttctttgacattgcctcggacaattagtcagaaaactgttgatgaagtttggaaggacttgcttaaagaaaatagtgcattgaaagaaggtagtattggggggccaccaaacttgcagcagagcaacctactttaggagagatgactttggaagagtttttggtgagagtagggtagtaagagaaatgctcaaccaatgttaggccaataatagtggatttacggttatatcacagcccatcatgct

SEQ ID NO: 7957 - DNA, 782 bp, Vitis vinifera
  Predicted polypeptide sequence is orthologous to G2071
ttttttttttttttttttttttttttttttcgtcgaattgtctccaagatctgatttttctggacttccatatccgcctgtttcttctgcaattcttcattcgcctctttcagttttgcaacttccatttcaagttccaagggataagcctgcttacgagctcgtgatcttgcagctgattctctgtttttaatcatccttctctgccttctctctactactttctccagtgcaccgggttttcttccccgctggcttccattaaacacataaggagcaggcgataatgaagatgtgttcatattactcttcccaattacatcaaaagatatgtggcttgcaggagatccagaggcacccaaaacagccccagttcccaaaccaatcatggccattcctccactctgtagcccaccattctgaaccagaccattgttaaccgtaggatttgcaattccaaccactgcaccccgcacacccgagctagcaagctgagtggtgtttgttaaatgcattggagaggaaaaagccacagtcgcttgcttgggaaagagtggctgctgctgctgctgttgttgatgatgatcctgctgctgttgctgagaaggtctagctccactcatattcaaagctagactaggaggttgattaggaactaaataattactctctgtcatccgattagttaaagcaccattatttcgacctgattgctgaaacccaagccctaacccagcatgattgggctgtgatgataaaccgtaaaatccactattatcccc

SEQ ID NO: 7958 - DNA, 730 bp, Vitis vinifera
  misc_feature (709)..(709): n is a, c, g, or t
  Predicted polypeptide sequence is orthologous to G2085
aattggcacgaggcaaaatcagagggctttaacagacttccctggaccatacaatcaacctcatagagcagcttctttaaataggttccgtcaaaagagaaaagagcggtgttttgataagaaaattagatataatgtccgccaagaagttgcactcaggatgcagcgaaacaagggtcaattttcttcgtcaaagaagtctgagggaacttttagctgggattctgtccaggattctggacaagatgagagccctcctgaaaccttatgtacacattgtggcaccagttcaaagtccactccaatgatgcgacgtgggccaactggtccgaggtctctctgcaatgcatgtgggcttttttgggcaaacaggggatctttgagggatctttccaagaaaaaccaggatcattctctgaaccaaattgagcggggtgatggtgaagctaatgattctgactgtggaactagtggatacataaataacaatcatgttgctttctcaaatagtgataacccggctttaatacctgagcagtaactgtcaagctccctcacaagaaaggcttctgccattacctctagcatcattcaaatgaagtacaaaggtgttttagtaatttcttctacttgtctttatatatgtacaggtatagtagtggcttaatcaatatatgaggttctctctttgtatttcttttacactctntgggtacttttaatcgtatag

SEQ ID NO: 7959 - DNA, 869 bp, Vitis vinifera
  Predicted polypeptide sequence is orthologous to G2094
ggcgcctcctttataatgggtgcctttctttgatcttggatcttcggtctcatgctccgtttcattccattttttggtacaggggtcagagtcggaagacatgaacaacaaaaacccagatgctgtttcgtcggctgggagccaggttaacgagccgaagaagacctgcgctgattgtggcaccaccaaaacccctctctggagaggcggtccagctgggcctaagtctctgtgcaatgcatgtggtatcagaagcaggaaggagagaagagccttcctggggttgaacaaaggatcaacagatgatagaaaagcaaagagaagcagcaaccactcccataacaatggtggcggcaacgggaacaataaattgggggactcgctgaagaggaggctcttcgcattgggaagagaggtgttgttgcagagatcaacagtggagaaacagaggaggaagctgggagaagaagagcaagcggccgtactgttaatggctctgtcttacggctacgtctatgcttaaaatattagctgtagtagtagagaagtactagaagtgaacaaatagaatcaagagcgccacaaagtgtacctacccaccatttcttttgttgtctcttccctttttgtttttgtttttcaatttttggtctgttctttacacagctcttttttagttttaactttctaactgtttttgggatttggagaggagagggtgaagttgatgaagaagaagaaattgtaagaatttaagagtgatctgttttttgctaacataatatttcatgtttgctctagatcttatgtactcttcttttttgaaaatatttccatggattttcttaaaaaaaaaaaaaaaaaaaaaa

SEQ ID NO: 7960 - DNA, 696 bp, Vitis vinifera
  Predicted polypeptide sequence is orthologous to G2107
ggcttcactcagcactcaaatcagttaccgttctccttaactgctcttactaaatctcgacacttcagtcttcaccgttatgaatactacttctccaccatattccgaccctcacccgctcgtatgcaattgggattccctgaatttgcctgattctgatggaggcagcgaagagttgatgctggcctccacacacccgaagaagcgagctgggaggaagaagtttcgggagacgcggcaccctgtgtaccgcggcgtgcggcggaggaactccgggaagtgggtatgcgaggtaagggagcccaacaagacgtccaggatatggctggggacgtttccgacggcggagatggctgcgcgcgcgcacgacgtggcggcattggcgctgaggggacgtggggcttgcctcaattttgcggactctgcgtggcggctgcatgtgcctagctcccgcgacgccaaggacattcagaaggcagcggcggaggcggcggaggcgtttaggccaatggagaatgatggggttatgcaagatgagaggagggaagagagtgaggtgaggacgccggataatgtgtttgttatggatgaggaggacgtttttggaatgccgggtctgctggtgaatatggctgagggtctgctgatgccgccgccgcatagcgtggcggatggctacggtggagatgacatggc

SEQ ID NO: 7961 - DNA, 800 bp, Vitis vinifera
  misc_feature (800)..(800): n is a, c, g, or t
  Predicted polypeptide sequence is orthologous to G211
ctgcattcacttttgggaaatcggtggtctctcatcgcaggtaggcttccaggtcgaaccgataatgagatcaagaactactggaacacccatctgagtaagaagctaagaagtcaaggaactgaccccaatacccacaagaaaatgacagagcctcctgagcccaagaggaggaagaacacaagaacaagaaccaacaatggcggaggcagcaagagggtcaagatcagcaaggacgaagaaaattccaatcacaaagtccatctccccaaaccggttagagtcacctccttaatctccatgtcgaggaacaacagctttgaatctaatacagtcagcgggggctcgggctcgagttcaggaggaaatggggaatcgcttccatggcctagtttcagagacatccgggacgacaaggttattggggttgacggggttgacttcttcatcggagatgatcaaggtcaagacctggtcgccagctccgatccagaatcacaatcccacatgccaccaactgacaactctctggacaaactgtatgaagagtatctgcaactgcttgagcgagaagacactcaagttcagcttgactccttcgccgaatcactactcatttaattcaaatttcaaaaggagttgcagagagaccaaaagatcaactggttatgcttgcttgcttgctttgaatcttagcttccatgcacgtgctcaccttcttcaaaccctagcttggttatgaacttcattgatctattaattaattacttagcaaaaaaaagatcgaaaaaaaaaaagan

SEQ ID NO: 7962 - DNA, 1212 bp, Vitis vinifera
  Predicted polypeptide sequence is orthologous to G211
agaaaccaattgatccacgcagagaagcaagccagagggatgagaaatccggcatctgcgtctacgagtaagactccgtgctgtaccaaggttgggttgaaaagaggaccatggacgcctgaggaagatgagcttctagctaattatgtgaagagagaaggtgaagggaggtggaggacgctgccgaagcgagctgggttgctgcggtgcggcaagagctgtcgcctccggtggatgaattatcttcggccgtcagtgaagcgcggccagatagctcccgatgaggaagatctcattcttcgcctccatcgcctgctcggtaacaggtggtctctgattgccggaaggatcccggggcgtacagacaatgagatcaagaactactggaacacccatctcagcaagaaactcatcagccaaggaatagatcccagaacccacaagccactaaaccctaaacctaatccatcaccagatgttaatgctcctgtctcaaaatcaattccaaatgcaaaccctaaccctagttcttcccgggtgggagaaattggaagcaaccatgaggtcaaggagattgaaagtaatgaaaatcacaaggagccgcctaacctggatcagtatcacagtccacttgcggccgatagcaatgagaattggcaaagcgcagatgggttggtaacgggactacaaagcacccatggtaccagcaacgatgacgaagacgatatcgggttctgcaacgacgatacattcccttcatttttgaattctttgattaacgaggatgtgtttggaaatcataatcatcatcagcagcagcagcagcaacagcagctgcagcaggtgcagcagccatctaatgtgattgcaccattgccccacccagcaatttctgtgcaggccaccttcagtagtagccctagaactgtctgggaacctgctgcactaacatctacatcggctcctttagtccacgatcaaaaacactccatgtctccctgaaaatgatgaatcaagcttatatgagtttgattaaaatctgtgtgatgtaatttgttgtttccctttttgtgttttgatgttgtattagcttccactcttggttatttaattaggatgttaattaaagctttatgtgtgaatatcgtatgtgaaatggatccttgcaactaagttgtttttcccaaaaaaaaaaaaaaaaaaaaaaaaaaa

SEQ ID NO: 7963 - DNA, 1103 bp, Vitis vinifera
  Predicted polypeptide sequence is orthologous to G211
cgggggacgagagagaaagaagaaagaaagatgaggaatgcatcctcagcatcagctccaccttcatcttcttcaaaaacaccatgctgcatcaaggttggattgaagagggggccatggacgccggaggaagacgaggttctggccaattacatcaagaaagaaggagaaggccggtggcgcaccctcccgaagcgcgccggtctcctccgctgcggcaagagctgtcgcctccgctggatgaactacctccgcccttccgtcaagcgcggccagatcgcccccgatgaagaggatctcattctccgcctccaccgacttctcggcaacaggtgggctttgattgccggaagaattccgggccggacggataatgagataaaaaactactggaacacacacctgagcaagaagctgatcagccagggaatagatccgagaacccataagccattgaaccctaattcatcatctgttgatgtgaaagcttcttcttcaaaggcaaaagctgttatgaaccctaaccctaaccctaatccttctccttcagaaaaagcagcagccaacaaggaagctgggaacttcaagagtgacaatcagtatcagattggggcagctggcaatgatggcagtgccaatatccagaattcggatggttccgggaccggattgaggagcagcaacaacgaagaagacgatgaccttaactgtggcaccgatgatgtcttctcttcatttttgaactcattgatcaatgaggatgtgtttcctggacagcaccatctccaacaacagcaccatggtggtctcattgcaccgggctccgatgctttgatctctacttcttcagtccagtcgttcgggttcggtaccagctgggaggctgcagccatgacttccacgtctgtttttagccaaatcgatcactccaagaggtttaacgatcaacctgataagcggttctgatgacagccggtgttctttaatttggcttcaacaccctgcaatgagatatatagttaataagaattctagggtttgggttgttaatttatgtatgtggttgtgttgttgtgttagtatgctttatttgtattgtgaac

SEQ ID NO: 7964 - DNA, 775 bp, Vitis vinifera
  Predicted polypeptide sequence is orthologous to G2144
ttttttttttttttttttttttttttttttagtttctttttcattgttggttaacaacgaatagatttcataatgttgtttcaataacccaaacatgttaagattaggaaaagtaacataagtaaaacttaacacatcagaaatctttagttagcatccaagaggattgagacccatatattaatgcaacccatcaaactgatataaatagaaaaaaaagatcattatgatggaattcagatcatatagagaggcaccaaaaaacagttggcaaacctcaatagttagaggtgggggccaggggcttcaggactcatcacacaaacaaagcctcattaacaaattgttcctggaaaagtttaaattctgcatctcccataatattgtagacaagaactgttcaaatttaacactctaaattagatgcctcagataagcaagtctgacctctacttggcgttgtagggattgtacgtggctgataatttcatccagcactaaagctgtacctgaaatcttattacaaccagggaccagctcttgaagaagcttcatccgggcgttaatcttctctctcctagccctttctgctaagctatggctatcagtggcttggccgcgacgagctcgaacgtgaacgtacggaagcttctcggcctcttcggaggtctcattcgatgcgtttttgcactttttcgtcgaccctttggccttcttctctcgctcctttcgcttcgttgatcgctgattcttgttctcaaccgttggattggag

SEQ ID NO: 7965 - DNA, 856 bp, Vitis vinifera
  misc_feature (854)..(854): n is a, c, g, or t
  Predicted polypeptide sequence is orthologous to G2147
tttttttttttttttttttttttttttttgtaaagtggaggtggattaaaaacaaccacatatatagattataaatggatgtgtatatataatataactacatgcccataccaatttttgcaacaccaaaacgcctaacatttcaacagcagtagtgagtaatggggttggggtccttcccagttatttattgacccttcttcagtactgcaatgaaagcaacctacacaacctaaacttggaagattaaaagaagagtggcagaaaaaaaacccaagttcataaagtcccttaacaacgcctactacaacaaaaatattgactaaaattcaaaaggaacaacacttcaccccgtgcccagcagacactaaaggcaaagatgatcttcctcccagaatatacagctttatcccattccttccaccagaggccccctctccccaacttccgcagatagctctaagatgggatgcctgtttgtgttttcaaaggtaccacatggatacatcctgctttggcagtgggtccaccgtataatctactgctgccaagttgaatggagacccaaatctaaagtcagcaatgttgtcatttgggttggtgtcaaatggagaatcaaatgctttacactgatcaaactggatctcacttgacgagaaaacagaatgatttaagggcatgcttgtttcttcagtgatgttgccacccatcataaccccctgattgaagaagttatcatctagctgaagttgaaacttctgctgctgctgctgctgctgcggctgattttgatcttccataacattaaggttcccaggattcaagctcttgtttccctggagatttgtgtcatnaa

SEQ ID NO: 7966 - DNA, 793 bp, Vitis vinifera
  Predicted polypeptide sequence is orthologous to G217
gagagagagagagagagttgcagttttcatatagaagctcacacccaagcaagcagtctgtgaaaccctaaactctgaatctctcattctctctgctcttttttcgtttttggtgataggtatgaatctgccattctctcaatctcttgcaaaggagcttcactgaatataggtgtttcttcttcttcttcttcttctgattcactaattcaaattcaaatccaaatcgtagaaccctaatcatcgaaaaccctagagcggaggaggtcttcaaagagagaggggcaagatgaggataatgataaagggaggcgtgtggaagaacacagaagatgaaattctgaaagcggcggtgatgaagtatgggaagaaccagtgggccaggatctcttctcttctcgttcgcaaatcggccaagcagtgcaaggctcgctggtacgagtggcttgacccttctatcaagaagactgaatggaccagagaagaagatgagaaactacttcatcttgccaagctcatgccaacacaatggagaacaattgctcccattgttggacgtactccttctcagtgccttgagcgttatgagaagctccttgatgcagcctgtgtcaaggatgagaactacgaacccggagatgacccgcgtaaactgcgtcctggagagattgacccaaacccagaatcaaagccctgcccgtccagatcctgttgatatggatgaggatgagaaggaaaatgctttcagaagctccgagctcggttagcccaacacgagaggtaagaaggccaa

SEQ ID NO: 7967 - DNA, 672 bp, Vitis vinifera
  misc_feature (563)..(563): n is a, c, g, or t
  Predicted polypeptide sequence is orthologous to G217
gctccatcaagggatgcccattcttttggtataaccccaaaaggaactcccattagagatgagctccacattaatgaagatatggatatgcatgatagtgcaaaacttgagctccggaggcaggctgatctaagaaggaacttacgttctggtttaggcagtcttccacagcccaagaatgagtaccaagtagttatccaacctattccagaagataatgaagaaccagaggagaagatagaagaagatatgtctgataggctagctagagaaagggctgaggaggaagccaggcagcaggcattacttaggaagagatcaaaagtactgcagagagagctccctagacctcctgttgcttcattagacctcattagaaattctctgatgagggctgatgaagacaagagttcctttgttcctcctacgttgattgagcaggctgatgaaatgataagaaaggagctgcttggcttacttgagcatgataatgcaaagtatccacttgatgaaaaaacagagaaggagaaaaagaaaggaggcaagcgctctgcaaatggaanatctgctggttctgtccctgacatagaagattttgaagaagctgaactaaaagaggtatatgctatgttgcaactctatttaaattaagtcttttttgtagttctttac

SEQ ID NO: 7968 - DNA, 853 bp, Vitis vinifera
  misc_feature (853)..(853): n is a, c, g, or t
  Predicted polypeptide sequence is orthologous to G2226
agctcattaatcgacttctgctgtcaattccacatcttgggatcccatgaatttctctgctgctgctgcttcttctccttcctgatcactccaacgcccccatcatcttctcaagctcaaccctatcagaccctccttctccgcaaatctaaatcccaaaactccaatttggagcagcatgggactatcgagtctcccagccccatctgaaggagtactgtgtgtgcttctggtgaacacagctctctccatctccatcttcaagggcatagtccgggccatcctccatgtcattggaattcacctctccgcaaccccatcctcctccgactcccctgaacccacctcagagccctttgagtttaggcggaacccatctgagacctgcatggaggaattcaggagcaggaacccagcaatcaggtttgacacagtgtgctcctgcaagcgccctgaacatgactgtgcggtttgcttgactcgatttgaaccagactctgagataaatcacctgccttgtggccattttttttcacaaggtttgcttggagaagtggctggactattggaacatcacctgccctctgtgcaggactcccttaatgccggaagaggaaacatcttgcttttggtaagcaatatctgggagaatgacaagttgaggaaatattcaaatatcactgtacagcttatgtataggtgttttacatgaatatcatcagctaggtgtatcttttattcatatgttagttatatgctccagttttatgcctttatgtgaagaatctatatgatatcagggtcacatatcccatgtctatatatgtatatatatatatattgtacatgatcn

SEQ ID NO: 7969 - DNA, 797 bp, Vitis vinifera
  Predicted polypeptide sequence is orthologous to G2239
acatgttttttttttttttttttttttttttttttgcacaaaatggaaattttaaatttcatatcctcatcaacaacacggttatttacaacaaacagagacgaaagaatgggcttcagaagggttcccatgggctccggcccagtcaaacaggtgatattctctggaggtggtgggcccaatatatcgacatgatatgaaactccagacttggtctcttttttaaaaaaaattaaaaaaattgagatgatttataataaagttttaatgaaaatgaggaaaaataaaataaaattaaaaatacgtgggaccgctaaaacttaaaccggtggtcgcggggagccgacaggttgacgaggggagacgaccggtggtgttccggcgggatcgcgtttggcaccaaaagacgccttgggagtcaatgtaggcttgcgcggtgaaattgaggatgttgcctcgccgtcggcagccaccttcggcgattttaacgacgatgctctggagaagaacggcggagttatggagaaagtccaccgatccgacttccccgaccgctccaaacggtcaaaacggcggaagttttttcctcggctgcttccttcgccgggcggttcggtatccctgccgcgagctcccttcccttggcaacaccaagaaactcgtcgtgcggtgtaagctcgcttcattatctgtttgcgcacgtcctccggcagcttcaaatgaaccgctcgcagtctcgcctggttggatgacgagtgaccggtaagtgcgaccgaggaacttcgaggcgcgtcgat

SEQ ID NO: 7970 - DNA, 596 bp, Vitis vinifera
  Predicted polypeptide sequence is orthologous to G2239
acaacacgccgtattcggcgcactttagcacacactccccagaaaaagaaaaaattataccgaggcgatgatcagcggttcagtttcccaggcgaacaggaatggtgccactctcgtttgtgggctgcttcgctttggtggcttttctcagcatggcacggtgtctctctggattctcttgctcttgctgcctttcgccggagctcagtccgactcctccaacgatccgtaccagcagcagcggttcagttcatccatggcaattattatcgtaatccttgtagctgcgctcttcttgatgggattcttctccgtatacatccgtcactgctccgactcgcgtaacggcggcagtattcgcgcggccgccggagccgctcttggtcggtcgcgacgcggtacgcgtggtctggatcaggcggtgctcgaaacatttcccacgtttgagtattctgtcgtgaaagggctcaagatcgggaaaggcgtgctggagtgcgccgtgtgcctgaatgagtttgaggataatgaaactctgcgtttgattccgaagtgcgatcacgtgttccatccggagtgcatcgatgcttggctggctt

SEQ ID NO: 7971 - DNA, 520 bp, Vitis vinifera
  Predicted polypeptide sequence is orthologous to G225, G682
gtaaaaattcattcccttccctttcctcttcattcaatttctttcttcttttcttctcctccctctccttcattaaaaccatggaccgccgccgccggaaactccccaaaatcgccgccccctcgcagtctgaagaggtgagtagtattgaatgggaattcataaacatgagcgaacaagaagaagatctcatttacagaatgtacagactcgtcggagataggtgggatttgatagcaggtcgaattccggggcgaaaacctgaagaaatagagaggttttggataatgagaaatcgccaagggtatgctgagagaggaaaagaggctagtcaaaagaagcaatagacctcatacttacttggccatgcccaatgattctttttttgtcttcttcttcctcttggctcctttagaaaggttgttctttcagtggtagcttcttggctttcatattggtgtaaagcgtgttttgaatactcaaaaatttgtgttaaggtagccattactcaccatttctc

SEQ ID NO: 7972 - DNA, 647 bp, Vitis vinifera
  Predicted polypeptide sequence is orthologous to G225, G682
ggttcttctctgtgttgtcttctgtgttttcaacctaatggctgacttggatcactcctctgatggcagctctctggattctagaggtacccatctgaaggatttaatggctcttctgctcttctccatttgcatgtcaccttctggttttctgaatgttttctactaaagatgtgttttttgccttctgggtcttcatgttttggtattggggttcctgtttcataaatacccaaatcatttttgtgatgttagctctctggattcatgtgtttttatgggtattttctatcaaaaatgtggttttgccttctgggtctctctgtttttctattgggtgccctgcttcataaattcccacatcatagctctctgaattctagaggtacccgtttggaattagtggctcttttgctggtaacctttgtgttttatgggtatttttgggctggtaacccatatgaaattttgcttcttttgctattatccccacaagatactagccagtttttttctctttccttggtggttgttgctgcagagggaagcagtcaagattccaagcttgaattctctgaagatgaggaaaccctgatcactaggatgttcaatctggttggagagaggtggtctctgattgctgggag

SEQ ID NO: 7973 - DNA, 759 bp, Vitis vinifera
  Predicted polypeptide sequence is orthologous to G227, G242
ttttttttttttttttttctgtttttgttttttgggttgcttctgaattcgttgctgcatgttctttgacaaaggccgagagatgataatggatcaaagcctcgaatttgtgcaatctctctttctttcccccaactaggatttgatttggatgggtgattcatagcctctctcttgttcttcttctctctgtacaatgaccaaaattatttcctctgtatatagaaaccgaaaccatggtctgaagaaaaaacaaagatggggttttttctccattgttttctctctcaaactctctgttcaaacttctactcgatcttgctgatgccgatgcgcttcactgccgcgttcctaatcccatctgcttgcaagcataccccattctgttcaagccctgccatgtagtttctcacttcctttcttatcatctcttgcatcacagctaacagctctgcactgaaggggataaatggcttctccccctgggagaggactgtagccggcaccgtcgctggctggttgtgttggtgcatcggaatctgctgcaaaggagccatcgcaggtatcatctgaatagggtttgcaggcggtgcatggttgggttccggtgcacggttggaaacctcgcacgaatcgacccccggaagagagagggagagagaagttggagggtcgtttgaggacgacgtcgtttcgggaggtatgatcccgccggttctcgccacggggcggtacacatgtgatgagctcaccacggga

SEQ ID NO: 7974 - DNA, 789 bp, Vitis vinifera
  Predicted polypeptide sequence is orthologous to G227, G242
gtttttttttttttttttttttttttttttgcccgggaaaaaaagtccccattgaatttcatttttccccattttttcgattttctattgcttaggcggttgcttctcagattctaccaccaaccaccgaccaccatagctcattcctctcgttaacaaaccctctagattttcttccttccccgtcttttccactggaaactaccaaaattatttgtatttaagaaggaaaaaaaaaaaaaaggaacaagatttcaaaaaaacacagcttgttttttaaatatcccgattccctccgagtcgactcatcgctgcaaccataggtaggttgttccttcctctactcgattttgccaattccgatacgcttcatcactgcgttccaaatagcttcagtctgcaaacacagaccattttgctccatgcccgacatggagttcctcacttcctttctgatcatttcttgcatcacagccaagaattcgggggtgaagaaaggtttctccgacatacctaaacccaactcacagttctggacgtttcgtggggatccagggttttgttgcagctgtacaggcggtatcgccggtgattggagaatctggttttggattttaacatgatcggatcctgataaatgatttgacacttcgcaagaatcggatccagggagagagagactgagggatgttgggggatcgttcgtcgatgaggaggcctcgattttctgagtaggtaaaactatggaccggttcccggcactggtctataaacaagcgatgaagccat

SEQ ID NO: 7975 - DNA, 691 bp, Vitis vinifera
  Predicted polypeptide sequence is orthologous to G2290
tttttttttttttttttttagagagaagtagtgttctgaattctgggtcttctacaaagttaatcataggaaagtcaattaacaacaatatggtgaaggaatcaatcaaagaccgattgttctactgtttctaaagttggagctgccagccaacctaaaggtgaaacgaaataaggatctgcagtggtaaaggcgatggacgataactagatatgttactatgtatatatatacatacatatatatatatatatatatatatatattaatcctcgtacaaaatgattgtttgagatgtatgtatccaagcaatgacagtgtcgaccttgtgctcaatgcttggtacatataggtgtatgtgatatggagtaaaaagggatcacttctggcttgggatggcttcatggcttccttacaaaatgttccgtacagagttgaatccataggctctagtctcggcactactgcatggccgtctttttctcttcatccattgcgcattccaggaggcaccatgtccccaagcagtccttcatcagtgggaagctgtgggcttggctcagccagtgcgcgtgcttctctagcttgggctgggacttggtgtgactgtgccatgctaccactatgagaaacttcacggtggaacgacatatctggataataaaagtgtgatgttaatggaggggtcata

SEQ ID NO: 7976 - DNA, 832 bp, Vitis vinifera
  Predicted polypeptide sequence is orthologous to G2291
ttggagtctaattaggattaactagttgagttataatataattagaacttgagtcatgataggttattagagtcctagtagactttggatgttataattagaattagaatcataataggttattaaagtcctagtagactttggatttcttagagaagcctataaataggttaatcaatgtaaatcaaaggaatgaatttgatgaataatattatactttcttttattgcaaggttgcaaccctcaatggtgagactccattgatttttcttctaggtgagactcctagaaggccttagtgagactctaaggttttccatcttttcttcattatttcttctttctctctatttcttatcttataattttctctaccataaagattattccttgttcctctccttacaccctaaaaataaaaccctagcccacctacccttgagtgtaggcaaccatcctagggttgtcctacatcatgtctcctttattgctttgtcttaaggggcggcagtttgggattcatactgaaaggagaagagatagaaaaaaggagggatccaatttcaaacaacgattagtgagtagcccttgaggcctggctaaagtggttagggtttgggttggggttgtaggaggttcccaagtttgcggtccattgcaaaaaaaggtttacccatgaaaatgattagtgagcagatagattacctatattaataaaaatgatcaaacatctaaagaatacttcctacaaaaaccttttgtatgttggggggattccatttagtacaaattggatacatgtgacttcatttgtcctttagcttcttatttg

SEQ ID NO: 7977 - DNA, 668 bp, Vitis vinifera
  Predicted polypeptide sequence is orthologous to G2291
gctagctccacatttacttttcccttaacctcagtggtggaagggatagaactagaactgaagagatgagcaacagaagtgacaactgagcactttcttctattctgcgccttaggcttactactcatattcctcttcatttcagatgatgacgacgaagaagatggggatgagagaggcaacaccgaggggatctcgaagttggtcctagctttcgaccctctgagccgcctcgccgccgcgtcgtatgcacgcgctgcctcctccgccgtgtcgaacgtgcccagccagtgcctgcatcgcccgattctgtcgcgaatctccgccgaccacctcccccacggccgctttctcactcctctatagctcttctgcacggaaacgtcaccgatatttttcttatccaccactgtcttttcggcaccgaagcgctgtgaaaccggcacgaaccccgaaatcccgccaccatcacagctgctcccactctttttccctccaaagagaacgtgttggccaacaaccgcagctattccgtcaagaaccggaggaatttcggcttccttctgggtaccatcccccaaattccccgataaatcggccaaaacagcaccattactgggcaggttgacgagctccgggacagaaacagaagaaagtgagaagtgagc

SEQ ID NO: 7978 - DNA, 793 bp, Vitis vinifera
  Predicted polypeptide sequence is orthologous to G2344, G929
aaatttgaaaattctcaaggtttctcgtttcccaccatactttttatttattattatattagcagctgagaagaagaagaagaagaacccaaaaaaactgtaacagggacggcacaaagagccatctttaagataatagtgaagctgacgagccgcaaaaacactcagaacttcaagttcagtcttcatctcctgcagctggagcgtcccatcctggcagtgcagctgcaaacattccatatgcaacacctccacaacttggggcaggacatgctatggcacaggcagcctacccatatccagatccttactatagaagtatctttgctccctatgatgcacagccctatcctgcacaacattacagcggacaacctatggtccaccttcagttgatgggaattcagcaagctggagttccttgccatcagatgcagttgaggagcctgtgtttgttaatgcaaaacaatatcatggcattttacggcggcgacaatctcgtgcaaaagctgaatcagaaaataaagttgttaaatctcggaagccatacttgcatgaatctcggcatttgcatgcattgagaagagctaggggatgtgggggccggttcctgaattcaaagaaaaatgaaagcgaacagaacgaagtggcatcaggtgacaaatcacagtccaatatcaatctcaactctgataaaaatgaacttgcctcctctgatagcacatcttgatatccgatcaggaagcaacagcagaaagttgttccatcagcagtgcctgggggccagaagttc

SEQ ID NO: 7979 - DNA, 789 bp, Vitis vinifera
  Predicted polypeptide sequence is orthologous to G2394
ctttttttttttttttttttgatgtgcaccacctgatggggtgtgttattgaacaatttttggtatataacagactgtcaaaaggcacttgcctggtataacaagtatcttacaacctttcttaacctagaaacatcaaccaccaaaaaaaaaaatccatgaatgaattttaagtggtcattcattcatccaccatcagaagaacgaaacctaaaagtaccagaagcaccaattcatacataccatatgtgatgcacatatacttgaaaaaaaaaggggggtgacatatacttgtcaagtaaacatatttgctccacctgagcctttcaaccacaccaccattctcaccctctttcactagttgatacttaaccctgagagtgaacctaaaaagctctcaccgacctcacgcttgcagaggggacatagagcattgatcttcagccatttatccacacactccttgtggaagaagtgagaacatggcagctcccgaagctcgtcgttgtttgcatactttgccaagcaaatacagcatactgcatcttctccagagatcacccgctccctttctgttccagctgctacaaccccaccttcgcccgcacctgaattgccttctctatcatcgccatttctattttttttcagcttgaacttgtaggttggaagagcatttattgattctgatgtggctcctctagtctgtgtcagatcctctctaagccaaggatggaaattatacaagggaggcagcagcagattgtagcacatagaatcggacgcgtg

SEQ ID NO: 7980 - DNA, 947 bp, Vitis vinifera
  Predicted polypeptide sequence is orthologous to G2394
gggggttatggatatccattgagatatttttcactacaagcccgattgttgcatccatagtagtattgtccttgtctagagatgagaaaccacaaactccgttgtttgcttgggttgtgggttatgcagctggatgtgcagcaagccttcctattcttttctggcgttatcttcgccgcaaccatgatggtgagcaaggtttaaatcatatgcttcagggttcatcacaaggaagtactacattggaatctaattcgtacataactatctcattgacccggtctgcagcagaggaaaatctcccagatgcgtctacaaacacttggaatggtcatactatgggtgcttcaaatgctaggctcagtatattagcagactactataagatggccctggattgcttctttgctgtgtggtttgtggttggtaatgtatggatttttggaggacactcctcttttaccgcagctccaaatttgtacaggttatgtattgtgtttcttacctttagctgtattggatacgctatgcctttcattctatgtgcaatgatatgctgctgcttgccttgtataatttcaattcttggccatggggatctgagccaagttagaggagccagtgcagaatctattaatgctttaccaacctacaacttcaagttgaagaaaaatggaagtgccaacagtggagaaattagttctggagttgaaggtggggttgtgggagcgggaacagaaaaggagcgtgctatctcaggggaagatgctgtttgttgcatttgcttgacaagatatgcagatgatgatgagctgagggagctgccttgctctcatttcttccatagtgagtgtgtggataaatggctgaagatcaatgcatcctgtcccctctgcaaatgcgaggttggtgagaatactggggagtttgccttgatcatcaaactc

SEQ ID NO: 7981 - DNA, 650 bp, Vitis vinifera
  Predicted polypeptide sequence is orthologous to G241
aatggaagaatacattttattacaggcactgaatcttattcaatatctagacatacaactgataaggcccaatgagatcatgttacaacaatgaagaaatcaagtaataagaaattttctgggaaatatgggtttcttttccatccttttctcggacttttctgtggattaatttttacatactcctactttacatttctataaagcaacttttcctaagtcaatttcttgtacttctatctttttgacccgtcaatcactatgaaagtgatcatcaaaggagaattccgctttttgctttcttggtcaatgaccctttgccccactggaatttgccgcatccccatcttctcactaaccgtcgaaaactatgcatcactatgttcagatcctccaaaacaggaatcaaagctcctgtaggccgccagatctaatgaaaacgtcataccagaactccatgccatcatccatcatgtttgaaatttgtccataggcgagttccggtgtctgaagctgtaattcgtctgcgactgctgggaaatctgacgccatgcttgaattatcagaggacagcgcgtctgaccaaaaactttcatcgatatttcaggaaatgattccgttgagtactcctccatctgttcattcttgac

SEQ ID NO: 7982 - DNA, 242 bp, Vitis vinifera
  Predicted polypeptide sequence is orthologous to G242
ccgggcaggtacttaggtgagtctaggagtgcggccaaacggagggctaaccgttacggccgatgttactgttgtggtagaatggagtgcaatggaggaaagagaacaaccatttcacaagacgaggtgaaagcatgtattaggactccggcgaataggtttctaaccgaaaacggtggtcgacacatatcgaatgcaatcgatctcgctctcagtgacatggaaagaatcgggaagtctga

SEQ ID NO: 7983 - DNA, 497 bp, Vitis vinifera
  Predicted polypeptide sequence is orthologous to G2457
ccacgcgtccgctgggttttggttttacaggtgagtgttccatgcagcagcttgtttgacatcgtgaccgtccgatgcggacactgcaccaatctatggtccgtgaatatggcagctgcatttcaatcactgtcatggcaagatgttcaggcacccaactacacttctccagattacaggattgacttgggttcctcttccaaatgcaacaccaagatggccatgcgagcaccagcctcgaatatctctgaggaaaggattgtgaatcgccctcccgagaagaggcagcgagtaccttctgcttacaatcagttcataaaagaggagattcagaggatcaaagccaataatccagatatcagccacagggaagcattcagtactgctgcaaaaaattgggcgcacttcccccatatccatttcggtttgatgttagaaaccaacaatcaaccaaaactggacgagggctctgagaagcacctaatgtcaaaggctgc

SEQ ID NO: 7984 - DNA, 859 bp, Vitis vinifera
  Predicted polypeptide sequence is orthologous to G255, G664
ttttttttttttttttttaagttcaaatattctcggtcacaaatttattgactaatacatgtgtactgacccaaagtactgtccacaatgccataagcttcgcaaaggaagaaagcaattggtagtctctttttcggatctacctccagtgcgattccacatgcctttctttgtaaactttagtcatagtgagcaatataattcatcaattggaagaatgactaaaaattcatgaataggtgttggctgctaggagatctctcagcctttcaaatgcatcgatcagaacttgcttttctcctgctcttgttcactttatgcaaattaattcctcttctaaatgttaagtggtggtttaagatcaaggaaatgaaaaaccaaattttccaccaaattaaaattttcgtccatgttcacctaacaatcatccaaagaggagcagcgtggaagagggaccaggttcaagctccctcgatactttgggctcattatgtttcttcgcctcttcggtagtatctactgaaggttgaggaatggtgattgcgacatcaaggttcaaatcaggtaaggcacgccggttatcatctaaacagcttccggcatcagatgtctgatcattatcaccaaccgattttaccggcggacttgcatggttgttcaaaccagatgatgttgcggtcgcagcggtacatgggtcccgagggcgagggaacttgtggctcagacgatgattatttgggtcaatacccatgtttattagctttctccttaatgagaattccagtagttctttacttcattgtctgtccttccaggcagtctccagctatcagtgaccagcggttgcctaggatgcatg

SEQ ID NO: 7985 - DNA, 891 bp, Vitis vinifera
  Predicted polypeptide sequence is orthologous to G255, G664
cggggggccttgatgcttttttgacaacaataccaaaaacaaaaggcctccgtctccctacccaccacccccaccatcaccaccaccaccatcactactgctaaaactgtacacaattctatagcttttatagctgccagtttttccttctgcttgtgattcagctcaatggggaggtctccttgctgtgagaaagctcatacaaacaaaggggcatggaccaaggaggaagatgatcgcctcatcgcttatatccgggcacgcggcgagggctgctggaggtctctccccaaggccgcaggccttctccgatgtgggaaaagttgccgcctccgatggataaactacctgaggcctgacctcaagcggggaaacttcaccgaggaagaagatgaactcatcatcaaactgcatagtctccttggcaacaaatggtctcttatagctgggagattaccaggaagaacagataatgaaataaagaattactggaacacccacatacggagaaagcttctgaaccgaggcatcgatccgtctactcatcgccccatcaacgagccctcaccggacgttacaaccatatctttcgcagccgcagttaaggaagaggagaagatcaatatcagcagtactggtggatttgggtgcaaaactgagaaaaacccagttacggaaaagtgtccagacctcaaccttgagctcagaatcagcccaccataccaaccccaagctgagacgccattgaagactggtgggaggagtagcagcactactctttgctttgcatgcagtttgggaataccaaatagtgaggagtgcagttgcagtattggtactagtagtggaagcagcagctctgggtatgacttcttagggttgacatctggg

SEQ ID NO: 7986 - DNA, 685 bp, Vitis vinifera
  Predicted polypeptide sequence is orthologous to G2575
gctttcatgactaagagcgagatcgatcatcttgaggatggatacagatggagaaaatacggacagaaggcagtcaagaatagcccttacccaagaagttattacagatgcaccactcagaaatgcactgtgaagaaacgagttgaaagatcatttcaagatccctccattgtgatcactacatatgaaggacagcacaaccatccatgtccggctacgataagaggcaatgctgctgcaatgttgccaacttcatttttctcatctgctacagtgggatctagcttccctcaggagtttctgactcagatgcttcccccgaataatcaaagcggtccgaactctatgtactatcacaacattactccccaccatcagcagcagttccaacttcctgactacggattattgcaagatatagttccctctttcatccgcaagcaggagccatgaactctctctattaatgtagttgttttgcatggtagatgaaccgatacctatatgtctagcttttatatatgaagggatagcagtgaatgcatatttctggcctatgatgttcgagtacaaatattatccagatcttacagaactccctaatgcatatttctggcctatgatgttcgagtacaaatattattcagatcttacagaactccctcacttcagatcaactttatct

SEQ ID NO: 7987 - DNA, 575 bp, Vitis vinifera
  Predicted polypeptide sequence is orthologous to G2604
tttttttttttttttttttttttttttatctggaacttttggcagttcaagaaacataaaagttaatgaaaataaatagatccagtgtccttgatgccactcatacaatacacacttgtcaaagtaaaagaaaccaaagtttttcttatccaaaaattttcaaatgaactcacagcctaaaaatcttctcatagaatgccgttcacacacccagcctgctggtaaagctaattattcttatagatcgcgcaaatggaaaataactctatacatgtggtctgaggagagttctcttcttgttgagggatgcaatcatgtgggataccatgtatataagaaccaaagctgtagagtctgtaataacagaacttctcatcacttttagcagttgaacttgtgttcagtagagcttgttgaggccccaacagatgtcacaaaattgcaaactgcacatttcacagatctagctccatattggtacatcaacagcatccggcaattcccgcaattaacatgtgcaacttgatttgcttccaaggctagattgatagtgtgacaacatgaacactgtacac

SEQ ID NO: 7988 - DNA, 581 bp, Vitis vinifera
  Predicted polypeptide sequence is orthologous to G261
acatgttttttttttttttttttttttttttttttcgttgaaatcatgaaagagccaaaaagttgataaatgatggagacaccatcctacataagatcatgtgtacagaaaagataactcaaataatatgtctattcactgccagatcaaaaatcaaacgtgcctaaatttattacaccaaactattgatgcatcaaaacttgaaaaagaattgactaacatcaagttctctctgctggagtaagctgtcccatttgatctgcaagcttatttgcactccttgcattccaccaaaacctgccatgatcaccaggcttcccttcattcttcctgctttcatcatcctttctttctaactgaacttcctctgctgatgaaccaggattctcagtgaagaactgttcccagaatacgtcgttgaccccagttggaacaggagatgcagctccaactacttgttcttttaaggtagtaacctcaggagcagtagcagcgggcttgcaattcatgtcaatcccagtagatttagacctagtatcaatattaagttgaatgtaagatatacctggactttctgcccc

SEQ ID NO: 7989 - DNA, 372 bp, Vitis vinifera
  Predicted polypeptide sequence is orthologous to G261
ggcgacatgtttttttttttttttttttttttttttttcgtcaagaacctggcatgcaccacaacagtgagggctaaaacttgtagtctgtaactataggaccaaggtaatcatacctcttagttaagttaatatacaaccagccactgagacctagtgttaaatgaatggaccaacattaagttctttcagatgaagtaagatgacccatttttttagtaagatgatctagattatttgtatcccaccaatatttcctgtggtcatctggcttactgtcacccttgccgccatatgcttccctccgttctgactggacctcctgtgcatccgatgaaccaggtgtctctgttaggaattgtgcgcggaaga

SEQ ID NO: 7990 - DNA, 667 bp, Vitis vinifera
  Predicted polypeptide sequence is orthologous to G2632
ttttttttttttttttttttttttttttttccagaagacagtactatgggaagaatggagtgaagttctatcaaatatcaaaataagctacaatgcccatcactcatttccttgtaaccccttttccccctcactgcaggcacaaaagcaaagccaaaaatgatttgccgcccagcaaacaaaagccgaaaatattttcatttgccttggataaaaaccaaatgaccaagggcttcccagggggctcactggaaggcatggggcctctgaaaaccctggtcagcaaagaagcttttccattgctggtcttcctcccctctctcactcgggggggaatgatttgttgtctgtgagtcaccaggactttggtagtagccgctgccatttttatatttggggggttcatgggtgtcatgtgcttgaggccctcttgcttcttgctgtctactggaggaattccaggtttcagtaaagtcagatggcaaccgctctgaacccgatgaactgacagattgtggtgaaggggctgagcctaaagctgtaaccttttcttcagaagcgtgtttagaagcttcagctgcattctttttggcaaaacggcctccactactccttgcccttctaagggcgtgctggtgtctggattcgtgcagatatggctttcgga

SEQ ID NO: 7991 - DNA, 646 bp, Vitis vinifera
  Predicted polypeptide sequence is orthologous to G2632
gactgtatctcctgaggttgcagagacaccatggattcccaccaacggccatgatttccttccaaactcctaccttttagggtttattcctctgctctcatcccacattagatttggggctaggggatttttgttttcttggtggaaaagaataatgccgactaaacccaaaattgaggatcggcggatagaacctggtggtaagagcaatccgtcatcaacagtctactcccaaccttggtggcatggtgttgggagcaatgccatctccccagctgccttgggtggaagcccatcaaaatcaacttcagttgaacaccttaacagtcatatcacgagcaatggtttccagttacaagctaatggcaggctggatgatggaactacctttaataaaggaacacaacctacggtagccctgcaatctgatggaaggaatggacaggaacaccagcacctcaatcctactgcttcctcaacactgccaattatgagtgaacatcttgaaccaaattcccaaatggaacttgttggtcactcaattgtgttgacatcatatccgtatcaagatccacataatgtggggattatgacttcttatggggcacaggctatggtgcatccacatttgtttggaatgcatcag

SEQ ID NO: 7992 - DNA, 592 bp, Vitis vinifera
  Predicted polypeptide sequence is orthologous to G2639
cggcacgagggagagaaccttaaaaccctaagctgaacccagatgggccaggcgtttaacaaactcgccggcgagcatggtgccggcaacggcgagggtcactccaaggaagcagccgtcgccaaaaccgccggattcttcgtcttctctggaatcgccatgagcatcctcaaagctctcaactcttgcaacaacgacaacaacaaactcctaacccactcagtgactgaaccaagtcaaccgactgacccatcccactctcgagaacccatcttcaaggagaaggaggttcgggagtcgacgcagaagacgatagatattgtgaagggagatacactgtggggtctctctagaaaacatggggtatcaattgatgctattaaagaggcaaatgggcttaccggggacaccatctatgccggcaagaaacttgttattccatgatgcaaatccttgctcttaatttcggcttttcagttttctcttctgattatgttgttggttatgttgtgtaagataaaaatggttctgagaatcctattttttcttgttccttctcaaaacctgttctaagcaatttggaaatggcatg

SEQ ID NO: 7993 - DNA, 601 bp, Vitis vinifera
  Predicted polypeptide sequence is orthologous to G2639, G2640
ttttttttttttttcagagaaaaactataaacaaatactactacgacaaaagagacactacatgccatctggtttatacccaaataaacaaagaaaaaaaatcaaggttaataataataataataataataataattaaataagccttgaaatgtgaacaaaaacaaacatcatccacatttcttcctctcgttctccatttttgtttttcctctttgtttttgtttctttgttcctagttgaatgggtgggtgttaaaaatgtactagaacaaaatcgcactattgccttgcagataaaagagtgaaagttgatgaaagagagagaaagaatgagagagagcagaatgtggtgtacgttcaaggtcttgggtgtgggaagaattgcgtaccagccatgaaggtgttaaggggagctgggtataaagaaggatcaagaaatgcggcggctgcaccggcactgccactaccagtggtggcggctgtggcagtggaggtactggcggctgctgcggcaccagtaatgagattaagctgttgaagtcctccgccaccggcggaggaactctcgcctccaccgtaatgaccttccggaccatgat

SEQ ID NO: 7994 - DNA, 685 bp, Vitis vinifera
  Predicted polypeptide sequence is orthologous to G264
ttttttttttttttttttttttttttttttgcgaatcaaatgcagtgcatatggtttatttagaattcagatattaaacacttattttttggtaaacataaacaatatgttcaagaacttaaactgatgtaacatcaagataacactttactgctatcttcttgatttataactttagcaaccacctgtgcaaaattattaacccaaaaaaggacattatatggtttatcctatccaaaactcacaaatcaaagcaagaattgagactaccctttgaaaatatgacccggcttttgatgcaaacttccagtgctcaaagagtgagatgctccatgctttttgagttacccaacattccttggcctgctcttctatcttcttgctcatcatatgggtttgacctaaaatttgaacttgcctcttcagtgtctgaagagcctggtctttcagtcaggaactgttcccagaacacatcattcacccggaccggagcagttggaggtgcttcatttgcaactgaggccccttgtgaggaagacaaaatagtgtcatcatcagcaaaatttctgctcttgtggatagctctaaaatcagcttctttagcatcggcaatagacctagatgctgaggatttgccaatatcctgacctatttggggcatcctagttgaactacttttgtcaac

SEQ ID NO: 7995 - DNA, 710 bp, Vitis vinifera
  Predicted polypeptide sequence is orthologous to G268
ttttttttttttttttttttttttttttttgcccaatgtacaggaacaaatttcattgacatctccccctatatgtagaactcgacgaaggggttgctgtaattttcaacaaaggggacaaaaaagaaatgcttacatgtcatacaccctatcaagcatgtcaaaatcgcttgtcacacctcaaaagtctccgacttgcatggggaccttcacttgtgtcatgtacagcagacgcccatcccatggcaaccgcaattgcatgtagttcattcacaacagatactgtatcacggatataaacacgcccaccaggtcttagcattcgatctatctcaagcatgatgtttgagatattacatcttttttgctctatggagaagagacccgctgcatgcaataggtcatatgttcttgggtaggtgtcaaatggctcacaccagtcatgcctaactcctatgagtccacgatcatagattacaggcagggtgttgaatccactaactggaacaacattcataacccagcaatcaacttggaaatcaattagtgctgctgcaaaccctccaaatcctgctctcatgtccatcacatttctcaattttgaatcattccagtggtaagcatgaacataaccatatattacttcatgccaaaattttgtgtctgccttgaggatttcctttctggatatgtaggcatccatttctatg

SEQ ID NO: 7996 - DNA, 702 bp, Vitis vinifera
  Predicted polypeptide sequence is orthologous to G2682
ttttttttttttttttttttttttttttttgcttcaactaataaaaattttcattcaaatggcatcatacaaaggacatggacaatgcccaaattcacaaaaatccataaaagataatatatcacttgatcatgaaaagatgaggcaagactacaaatacactgcctccctcgacaagtgagactcaaatactctttccagcctctttccatatgtcatcacaattcgtgacattttttcaatataccactctctacagatggagatcatcaaaatacgattacacattccccaaatcacgatttaaaaaacctatacttaagaggcaggaaacatggcagcacacatgatttcatgaatgcatggtatttaacatttgactttaaagaaacacctactgtaataattgtaaaaataaaatatgaccgatgcaggatgtaatgagtatgtgggtgatgaatcccaaccccacataatgagtatacacgaaaacagtgaatgatatgaaatgcaacttgactatgacaaacaagagacttcgatacaatgcaagacacaaattaaaagagagaggggggaggtgttgttggaacaagaaagagaactggttgaaggaaggagaaaatgtggaatatagcactgggttgatttgacgtgcctcggacactttgaaccaattttctgcagtcatccaatccgccc

SEQ ID NO: 7997 - DNA, 673 bp, Vitis vinifera
  Predicted polypeptide sequence is orthologous to G2723
attcggcacgaggtcctcttacatctccaacttcaatactcagtatactgtcgccttctcaccttcatctactttttcttcatattcacccaactcttctatgaccttattattccagcttctatagttcttatttcattcccccatcaatatagtaatggcatcccatgctttctcctcttcatgttattcaagctcctcttggacacagaagcaaaacaaactatttgaagaagccctggctctgtacgacaagaacactcctgaccgctgggcaaatatagccaaggctgtgggtgggaaatctgctgaggaagtaaagagacactatgagatcctggaacaggatgtcatgcatatagaaaacggccaagtccctctacccatttacaggtcaactgggagtagcagcggaggaagtgttgatgaacaaaggcacttgctgaagaatctaaagctccgttgaagcaaaagactcagttatacgacaaatatacatcagctcgagcatatgctaaaaagaagatgcagacgcatgtattagaaagagaaaaaaagaaaaaggtgaataagaataataaatataggctcaaactaatgaagcaagcaagatgaagtagttatctgtgtccatgtatctcaatttgtcgctactgcaatgaattcgcaaatt

SEQ ID NO: 7998 - DNA, 697 bp, Vitis vinifera
  misc_feature (607)..(607): n is a, c, g, or t
  Predicted polypeptide sequence is orthologous to G2723
ctcagctccctctcttctttcagtacccttcctttaggcctttttctaagttagaagattgaagccccatctcccaattatttctaatcaccttttgtcatcttttagacagacttggtttgtaatctcctctgaagtgacccatggcatcaacctctctcaagagctctggctcatggaccccaaagcaaaacaaactgtttgaaaaggctctagccttatatgacagggacacccccgaccgctggcagaatgtggccaacgctgtgggtggcaaatctgctgaggaggtgaaacaacactatgagatccttattcgggacctcaagcatatcgagtcgggccgtgttcctattcccaactacaagtagcgaaaagcacctgttggcttctgaagtatcctaaagctgcaataaagtccaagacttggctcctattaaattatatttttggaaaaagtagatgcggacttatcatttaaggaaaaaaaaacagaaaaaaaaaaaaaagtctgactctctctgtcagctcttgtatgcatgtaatcactgtaccacccttattttaatagaatatctattatcaaaaaaaaaaaaaaaaaaaaaantaaaaaaaaaaaaaaaaaaaaaaaaaaaaaaaaaaaaaaaaaaaaaaaaaaaaaaaaagggcaaaaaaaaaaaaaaaaaaaaaaaaaaaa

SEQ ID NO: 7999 - DNA, 777 bp, Vitis vinifera
  Predicted polypeptide sequence is orthologous to G274
tttttttttttttttttttttttttttttgattagcacatcaacttcatcgcggaatatgacggcaccttctggtctcaaaatccgatccatctccagaagaatgtcctccgcatcacatttgtccttgtataaactgaaaacaccatgggcgtgaataaggtcgtatgtccttgggtatgtagagaaggcttcacaccagtcatggtagatgccaatcagtcctcgttcgtatacagcaccaagagtacttttctcagctatggtgggtacaacattcataacccacaatttaggagattcaagtgcagcagcaaaacctcccaacccagcattcatatccatgatgtttcggtaccttcctgagtcaataattttattaatttttttataagcatttaagtgcttcttccatagtttattgtcctccaggtatgtctcaacagagactccaggaatagatccactagctactctaggagggacagcataaagcctcttgggaaatggctgcagttctccaccagaaacttctcctggactattaacatcaggatatggacttatgcatggctccatattcttgtgaccaagtatcatctgtttcttcagctttgcaaaatgtagttcgagcatcatcttgtctgccactgcatgcaccagcattcactctcttctgccaaattgcaatttcaccttgctcatatttcttctcccagcaaagaagtctggatatgtcttcaatctttctctgctcctcctggagttcctctttagg

SEQ ID NO: 8000 - DNA, 826 bp, Vitis vinifera
  Predicted polypeptide sequence is orthologous to G274
ctctgtcagaacagcattggatactggttgtggggttgcaagctggggtgcatacccgctaaagcgaaatgttttgcctatgtcatttgcaccacgggacaatcatgaagcgcaagtacagtttgcattggagcgaggtgtacctgccataattggtgttcttggaagtatacgcctgccttacccagcaagagcctttgatatggctcagtgctctcgatgtttgataccatggacatcaaatgatgggatgtacctaatggaagttgatagagttctgagacctggtggatactggattttatctggccctccaattaattggaagacttactacaaaacatggaaacggagtaaggaagaactgcaggctgagcaaaggaccattgaagagatggctgaacaactttgctggaagaaggtatatgagaagggagatcttgccatctttagaaagaaaataaatgccaaatcctgccgaaggaagtctgccaatgtatgtgaatccaaagatgctgatgatgtctggtataagaaaatggaaacatgtgtaaccccttaccctgaggttaccagtgcaaatgaagtggctggtggggaactgaagaagtttccagcaaggctttttgccatccctcctcgcatagctgccggacttgttgaaggggtcacagttgaatcttacgaagaggacaacaaactatggaaaaaagcatgtaaatacttacaagaggatcaataaattacttggcacaacaagatacaggaacataatggatatgaatgcaggccttggtggatctgctgcagctcttgaatgatcaaa

SEQ ID NO: 8001 - DNA, 759 bp, Vitis vinifera
  Predicted polypeptide sequence is orthologous to G274
tgtcaaagcttataaaagaaccaataagatcattgactcaggaaggtatcgcaacatcatggatatgaatgctggtctgggcagttttgctgcagcacttgaatcacccaaattgtgggtgatgaatgttgtgcctacgatagctgaaaaagacactctgggtgtcatttatgaacgaggattgatcggcatataccatgattggtgtgaagctttctcaacttacccaaggacatatgacctaattcatgcaaatggtgttttcagcttgtacaagaacagttgtagtgcggaagacattcttctggagatggatcgcatcctacggcctgaaggagcagtcatattccgtgatcaaatagacgtgctcatcaaggtgaaaaagatcgtaggaggaatgaggtggaacactaaattagtggatcatgaagatggcccccttgtctctgaaaagatattgtttgctgtcaaacagtactgggttgtaggtgaaaacaactccacagcagctccacagtgaattcaaaagagggaactttcagtgtgattttatcaagcaatgttgctacctctgattcaagtccatcaatttcatttatctcactcatgattatctggccgagtaacaaacataggggatatgattcttacattatcacatgttgattaattcattgattgccccatgttctaccattgccattgttgatggtactagttcgcaaggttctatgatcttagatggccttctatttttat

SEQ ID NO: 8002 - DNA, 625 bp, Vitis vinifera
  Predicted polypeptide sequence is orthologous to G2754
ttttttttttttttttgagcaaaaactctgagtacagctgggtctatgttagaagctcatccaatttagtgaactggctgtcattcaagtggggggcctcctgaggcactacttgttctgcatcctcttccttcaccctttctttcatcagcatctgttcttcctttgccatggttccggatataatagaagaatctccattttttttttatcagaccccactacatcaaacccagtgaacggaatgcagtcggcgttgggatgattaataatgagactcatatcggaatagcatagcgtgaaacttcagcctggaagcatatttcccagggaatatcactctcacaaagccatcggtgctgctagtctcgggtagtaaaatgcggatcaaaactttccgcaactagttccatgggagcagataggtgtgaaggatgaaattgctaggaaaaacagagtgaaaacgacaaaatccaagaaatatttagacaaagacacgtttcatgaatgatggatgagctcgaaactggtgggacagttcgaatggtttcaacatacagacaggtggcaccatcatcatgtaaccatgcgggaagaaacagagatcaggcgagcagaaatgaaa

SEQ ID NO: 8003 - DNA, 624 bp, Vitis vinifera
  Predicted polypeptide sequence is orthologous to G2766
ttttttttttttttttttttttttttttatgtatatcaatttggccctatagcaaggcccatatattagacatatcatttgttttttcgctcattggaaggggaaattaccaaaacatgaaaaaagaaattagcaagttaatacatagaaggatacaaaaaatggtcgtaatgaattaggaaaaaaaaagttttggcattatatacatgtttgggttcaataatgaggtcttaacttaggaaggttagtcttgattggattatccaccttcttcaagaaacttgatgcccaacccttacttgcttcatcactagtccctctgactaaacattagagggcttgcttgcaaccacaagtacagttctccagttctttattgagcttctgcacttcattttgaagacctttgatatgttgcacagccaagtccaacatggcagcatagctagtttgcttatccatgttaggaacaagatcttgcagtttcttcagtttcccgcttattctagttcttctctccctttcagcaatacttctaggatgagtggcacagccacgcttagctcgaactttgcatggaacagagtcttcaggtacttgcagcagcttctctactgctgcccc

SEQ ID NO: 8004 - DNA, 858 bp, Vitis vinifera
  Predicted polypeptide sequence is orthologous to G2779
cttcttccttagaaatgaactcaaacatggaactgatgaacaaccggagtgcaccagagaattcccacatgaatggtcacggattcatggctttctccaatgtgggattctctatacatcaccaacaagagttccctgtgaacttcagggataatactcaaagccctgttcattctggaggtctaagtgctgtccaagttcttcagttctcatcgcagcccggagattttggccaggaaacaaagactggaaaagtgaattttgtatcatctcctccagcttctgggtctgagttccttggagataataagaacttgggtggaagaaagaggaagagaagcaatgagagagaaaacaataaaccaagagaagttatccatgtgagagcaaagagaggccaagctactgatagtcacagtttggcagaaagggtaagaagagagaaaataaacgagaaactgagatgcttgcaggacctggttccaggatgctataagactatgggaatggctgtgatgttggatgtgataatcaattatgtccagtcactgcagaaccagattgaatttctctctatgaagctttcagcagcaagcaccttctatgacttcaactcatcagaggcagaagctttggaaaccatgcaggggacaaatgcatatgaggtacatgaggtggagaggtcggtgaaagaagggtatggagggccttctcatctccactcaacatggcctttttgactgcaattaggcttccaatactttgcataaccatgaagccacatgaatataatcttttacttaaatgcagagcaaatgcgatagtgcacagagccacagtattgcccacgcacatggg

SEQ ID NO: 8005 - DNA, 481 bp, Vitis vinifera
  Predicted polypeptide sequence is orthologous to G2779
ttttttttttttttttttttttttttttttgcccaagttattctttttcttagtactactaatttctttcaaaccacttccagaagccatagaagaaatgttctctgagctgctttttgattgttccatcacctttctcctcttgctttcatggaaagcatttccactcgagggcatgctctgaaccactggcattgagctcagtccattggactcaaaactagattgaagattataagcaaacgttcccatgagctcaggctgctggtgggccaaaagattctccactgaaacatcagttatgttgaaattctccaacataattggattcatctctgcaaactggttcaccatttccatggtcacatccatgcccaagaaaggttgagaaggcctaaagctctgcatactgtcagaaaaatcaactattacacaattccaattatagagcctcctgagagaactcaagggatgttccccc

SEQ ID NO: 8006 - DNA, 614 bp, Vitis vinifera
  Predicted polypeptide sequence is orthologous to G280
ttttttttttttttttctttttttttttcccatccaaagctacttcattttttctaggggtgaaacagggaaggaaaaaagcaaaagcacaaagcgattagcaaggaaaatgtaatcagaatcagtctctttaaatcctttttaaagagaagggggtggaggagagagagggacagagagagagagataggccaaagccttaaacagccgctgcacaatttacatgcaattacagacacccactagcttacaacactcaacactgaaacaaagaaaaaaaaagattgaaaagctaatgaagagaaaccataaattagagctaatatacctaaaaaccctactctcagtttcaaatcaacacccaacaggaaccaccgccggcttcacctttggcggccgtcccctgggcctcggtgccccagtcgccggcgctggggctgacgaagttcccaccttgggcttctttggagggcgtccgcgtggctttccacttcctgaggaagccttcttcggcggagagaccggagcaaatggatctctgggctttggcggacggcccctgggcctcggcggcgcgagaacggttcctggaggaagaggaaccttgggcttgg

SEQ ID NO: 8007 - DNA, 727 bp, Vitis vinifera
  misc_feature (697)..(697): n is a, c, g, or t
  Predicted polypeptide sequence is orthologous to G2826, G2838, G362
gcgtcctgcacctgttaaagagaaaggtattcgcctgtttggtaaagaatttggaggtcaccatgacccagaagagcagtcagagtccgtggagactaacatgtgtgaggatgtcaaggacagtgaaaatggcgaaagtggtagaagatttgaatgccattactgctgcagaaacttccctacttctcaagcgttgggaggtcaccagaacgcccacaagagagagcgccaacacgccaaacgtgcccatcttcagtctgccatggtccatagtggcctctcagatgcacacatgtacggcctggtcaattacaggctcggctccgcccccacgccgcccatcacctacccgtcatggggtagccaagccatttctagtaacggcaggttttatggaagtcatggatccttctcgcagccaccaattaacggaaaccctttggccttatggcgaatcccggcctccgtacaaactactcccactttcagtcgcgaccgttcatcacaccatccactgccattattcgccggtgatgacttgaagccctcgtcgcatgtcggtggctctacctcccaaagcagatacgtctacgaatcaacaaagcccggcgtgcaagaccatgtgagtttggatctccatctgtaataatctgaaacattccattttagaagaagaaaaaaaaactgagattttctncatgcagccatcttttgttatgctaatatg

SEQ ID NO: 8008 - DNA, 529 bp, Vitis vinifera
  Predicted polypeptide sequence is orthologous to G2826
ttttttttttttttgaaggaagaaaaaaaaaattaataaatagatttgaaaatttacatgatctggctggggaaataaacatcagcttttgagttaagtccagtggagccaggagaacaaagcagagccatataactaaagaagccaagccaaaagtcaaggcgcagctggggcgaggctaagatgcaaatccaagccgaatgcatcatcaaaagtggggccaccgtcgcctctagagaacctgctcaatgaaggcgcatccactcttccatgagctctagactgtggagccgacgtcgttagtgttgactccccgacaccgccggcatacgatagcgtagcggcacctctcccactagatgaagggaatacacacccgtgagacacgtggaacggcggcggcccacgtggaacgtacacccaggaagccgactgcggcgccgcccccgccggaaccaccacaggccccgccggagccaggagatgggggggcggcgcgaacgcagatatcatggggtttcggatgtag

SEQ ID NO: 8009 - DNA, 665 bp, Vitis vinifera
  Predicted polypeptide sequence is orthologous to G2826, G2838, G362
gtacatcaccactgcaaaatataattgttttctcatttcaacaaggatggagaaagatggttctagcctcctttctcccatatcagatggagaacatggggattctgccggaaccagcgttgagaagaagcttaggttatttgggtttgagcttgatccatataagaaaggtgagagctgcctgaaggagtctgtggaaagagatgaaagtgtaaattcctcaaacacagattcatctgggagggaaaaaccctctatagagaagaactcaacagtagagccagaggacaagaagtttgagtgccaatattgtttcaaggaatttgcaaactcgcaggcattggggggtcatcaaaacgcccacaagaaggagagaatggagaagaagaggttgcagctccaagcaaggaaggctagtatcaaccattatcttcagcccttgcagaacaaccatagtttcacttaccatggctcagccctatggttctatgatccctcctgccaatctcccgacgatgaatctcagattagtttcactccatttgatcaagatgcccatctcaagaagtcccagttttccaagtggtatgccccccctgctaacctcccacttcaacaggatacctgtatgttcactctcacacatgctgatggatccggacaga

SEQ ID NO: 8010 - DNA, 646 bp, Vitis vinifera
  Predicted polypeptide sequence is orthologous to G2982
ggaagtttcttacaaattatcagcaacttattgttcttcaggaatactcagctgttgggaaaatcaaagtttaaagtttacttctcctttttggcgtgcggaaagtagctactggaacatgatgagtgatagacacctgggagatattcttgggggctttgatcataaccatacaggcaaacagagccctttctcagtttcatcaagctacgaccatactgcaactgctagtgagaatacaccaggagtgaaccatttggctactgatcatgagaataacagcactcctctatatgacagtgcagcaaagaaaaagagagtatcaagaatcatcggtggggggctgcggcagttcagtatcatagtttgtaagaaggtggagaacaagaggacaaccacatatagtgaggttgcagatgaaattatagcagagtttgctgcagcacacagtaaaacagcagtatctctggatgagtttgatgagaagaatatccggcgacgggtttatgatgcattgaatgtccttatggcactggatatcatcactagagacaaaaaggaaatcaggtggaagggacttccaactgcagattggaaggatatagaagaggtcaaggcactacgtgtgaagcttatgactaggatg

SEQ ID NO: 8011 - DNA, 861 bp, Vitis vinifera
  Predicted polypeptide sequence is orthologous to G2983
ggagcatgaaggtgcatcagttcgcacgtggattctgggagcacgaaccctccctcacgcttggctgcaagcgtttacgccctcttgctcccaagctggccaacagtgatagtgtcgctgctttcgatctcaagagcttcattagacctgaaagtggccccaggaagcttggatgctctgatgataagagagattcacctcaggtggaaacacatccaggtgggacgcggtggaatccaacccaggaacagattgggatcttggagatgctgtataaaagtggaatgcgcactcccaatgcacagcaaatagaacaaatcactgcacagcttggaaagtacgggaagatcgaaggcaagaatgtgttttattggttccaaaaccacaaagcacgggagagacagaagcagaagcgcaacagtttgggtctcggccactgtcccaggactcccacatccataactacaataaccttggataccagggtggaagtgggaagagaagaagatagtccaaacaagagaaagtgtaagagctggacgtttgaaacggtggaagaaaataacagatactacagagaggagggagataagactctggagcttttcccgttgcacccggaaggcagatgaaggggtttgaaaatttaatttaaactctgtttcattgtgatcaatttgctttcatgtgcttttccatgtttttctctctttgtttggggaaagaagaaagacaagttgtttctttgtggcctcctgcttattattcctgacttgaaaccaaagtgttttgtcactctttattcgatttctggaggtgattccttttgacaaaaaaaaaaaaaaaagataaaaaaaaaaa

SEQ ID NO: 8012 - DNA, 743 bp, Vitis vinifera
  Predicted polypeptide sequence is orthologous to G2989, G2990
atcctttatttcgcatgacctcctcattccttactccttacctcaaaattttttatcatcatgttcaccgccaccatcatcattaatgcctaatcttagatgcttcagcccacccatggatgtcaccgccaccgccacagccacccgacccactgatattgagactgaaacaaccaccaccaccaccaccatctccacgccttggacggttgcggggagttcatgccgtcgccgacttccactcctgccgaccccacctccctcaagtgcgccgcctgcggctgccaccgcaatttccaccgccgcgaccctgatgaacccaccactcatgtcatcgaaatccaccgccacccactggggccgccccgccggagctcaccctcaccgtccccatctccaccgccaccgccccatcactcgtcatactactcatccgcaccccagatgctcctagctctcagcagcggcggtgcggggccgtccgatgagcatcagattcatcccataacggtgacgaggcaggacaacccaaatggaagaaagcggtttcgcaccaagttcagtcaagagcagaaggagaagatgttctcgttctctgaaaaattggggtggaagatgcagaagagcgatgagggtttggttgaagagttctgcaatgaagttggtgttggcaaaggggggtgctcaaggtttggatgcacaacaacaagcacacttttggtaagagagatattagcagcaat

SEQ ID NO: 8013 - DNA, 451 bp, Vitis vinifera
  Predicted polypeptide sequence is orthologous to G3055
ggggcggtgggcctccaaaggtaacaacagacaccatggtggcaccagccctttctgctcctgctactgatgtttttcacatgggagtgggagttccatctcaaaggccttctgtagtggcccccaagcctggccaaaggccccttcagaaatggaaagggcccgacaagatcagtaagatttatggtgactggattgatgacctcgaataagaataggctcacaagaacttgtttagagggtgattgctggtggaagacaccgctggtgaagttattcgaacttgtttaaatttttgtatctctgacctgttctttggcccccttttttttttctttttctccagagttggaactttagcttccttttgtattattaccgtatgtcaggaaccatcctttgctctgtggatcatatgcagattctataatgtaaatcttctagttttctt

SEQ ID NO: 8014 - DNA, 900 bp, Vitis vinifera
  Predicted polypeptide sequence is orthologous to G3060
tccaagcaagaaatggagtcctttccatctggtataggaagcaaatcgaagccatgcacaaagtttttcagcacttctgggtgcccatttggtgagggatgccacttcttgcattatgttcctggtggcattaaagcagtgtctcagatggttaatcttgggggaaacacacctcttgcaccacctgcaagaaatcctgcagtgcccccttctttcccagatggttcatctccaccagctgtgaagacccgcttgtgcaacaaatacaactcggctgaaggctgtaagtttggggataaatgccatttcgcccatggtgagtgggagcttgggaagccaacacttccatcccatcatgaagatcatcgtggcatgggatcaggcaggttggctggcaggcttgagccacccccacctggccttgctgcagcagctagttttggagcctctgccactgctaaaatcagtgttgatgcttcactggctggagccatcattgggaaaagtggggtgaactcaaagcaaatctgtcgcctgactggggccaaattatccataaaggaccatgattcagatccaaacttgaggaacattgaactagagggcacatttgatcagatcaagcaagccagcgccatggttcgtgaactcattgtgaacatcagctcagcctctgggcctcccatgaggaacccagcaatgcaagcctctgctgcagcaaacaacttcaagactaagctctgcgagaacttcacgaaggggtcatgtacctttggtgagaggtgtcactttgcgcatggagctgatgagttacggatacctgcagggatgtgatgattgtctctctctcctcttctcttaccttcggctaggactgactctttgcaatggccttttaag

SEQ ID NO: 8015 - DNA, 627 bp, Vitis vinifera
  Predicted polypeptide sequence is orthologous to G3060
ggcatcgttggctggagccatcattgggaagggcggtgtgaactcgaagcagatatgtcgccaaacaggggccaaactttccatacgggagcatgattcagatccaaatctgaggaatattgaactggaggggacttttgaacagataaaagaagcgagtgcaatggtaagagaactaattgtgaacatcagtgcaatgccagggcatgcaagaacaactgcaatgccaggtggtggccaagcccctccggccagcaactacaagactaagttgtgcgacaattttacaaaagggtcatgcacctttggagaaaggtgtcactttgctcatggggctggtgagttgcgcaaatctgcaatataaatggcgcactgctgtaccatagtagtagtggggtggggaggggacatgagtgggaaatcagttcgccttttttctttttttatcattatggcagctggaatttaactttgttgaagtagcaattatcatatcatagagctctgggcttctaattttgctttacgaacaactacattagctttagtagccttgggctttgtcttaagagtggcggtagatgctattaattattcctcctgttgtgtgtgtgtgtatttgctttc

SEQ ID NO: 8016 - DNA, 424 bp, Vitis vinifera
  Predicted polypeptide sequence is orthologous to G3075
ttttttttttttttttattaaaaattatttttcttcaatgagatatgcacttgatacaacaagcatagcaactgcatcaattaaatgttgtgtggtccaccaaaactgagatccttctgagctacatggaaatgcataaaggaaatcttgttaatgctcatcagccagatcgcatacagataaatgcacatacttgatggatctttgaaggcccaagctcatgtcttagctgatctctctgctaaagccttctcagcagatactctctcaggaacaaaatctgatagaaagtcaaatctcttgcatttgctaactgctgatgctatgtgcttgtaagaaacataattcttgcgatccttaacagaacatgcatatgcatcattaacaaattgttgaaggaactcctcagaagctttgttgatga

SEQ ID NO: 8017 - DNA, 853 bp, Vitis vinifera
  Predicted polypeptide sequence is orthologous to G309
tttttttttttttttttttgtttatgaaataattgatttcattgaaggaatagactatgcaaccaaaatccaattacaagttttagaggagattattatgatttataactgtgtctaggaggggttgccaagccgaagccgctatgagagggcggctgtgccagcctagcgtcaaacacccgtcatgctcctcaacacagtacccctcagccgagaacagcgtcagcagcatactggcttgtttgaacgcattggatcccaggttcaacggcctgaaccctgctgctccaagccgattcctccacttagccaacggctcgtgcctttccactcgagccgacccttcgcaacacaacacgttgcatatctctttctggatgtaaatctcggctacggctttctccggctggagagagcaagcctctagggaatcgaacattgtggagtagtagtacagggcctcggtgaaccgatccaagaactctgattggttatgattcgcttcctgttcaaccactgtcacgattttcgggttcaagcttcggatccacccaagcaccgtttctatggcagacacccgggtcggaccggatccgagaagccggtgaagctgcatgattgagtttatagctacggcttcctttgggctcacctgtagcatccacggcttcacatcttccagccgcgaagctgccacaccacgaaaagcgaagcggacgttgacggaccgggctaactcagcgagccggagaccgatttctcggagcgagtcgcggccgtcaggcgatgggggaccatgcctgtcaacggagtaaggaggccaccgggacgcaggctaggcttgaatagagcc

SEQ ID NO: 8018 - DNA, 639 bp, Vitis vinifera
  Predicted polypeptide sequence is orthologous to G309
gcatcgatttcagcatgaaacaagggatgcagtggcctgcgctgatgcaagccctagccctccgtcccggcgggccgccctcgttccgtctaaccggaattgggcctccttccacggacaacaccgatcatctgcatgaagtgggttggaaattggcccagctggcggagacgattcatgtggagttcgaatacagaggtttcgtggccaacagtttggcagatctcgacgcatccatgcttgaactgcgagatggggagtccgtggcagtgaactcggtgttcgagttgcatagtttgctggctcgccctgggggtattgagagggtgctgtcggcggtgaaagatatgaaaccagacatagtgacgatagtagagcaggaagccaaccacaacggccccgttttcctagaccggttcaccgagtcgcttcactactactccactctgtttgactcattggaagggtgtggtgtgtcgccggtgaacacccaggacaagctgatgtcggaggtatacttggggcaacagatctgtaacgtggtggcctgcgaggggcctgagcgagtggagcggcacgaaacgctggctcagtggagagcccggttgggatcggcggggttcgacccagtgaacctag

SEQ ID NO: 8019 - DNA, 324 bp, Vitis vinifera
  Predicted polypeptide sequence is orthologous to G3111
tttttttttttttttttttttttttttttttttttttttttttttttttttttttttttctaaggtttgggaaatatattttacatgcacaaaaaaacaatcatggaaaaattacatattcaaagactacagattttttgaaaccctaaatggatgggaagttgaaagaattcaattggaggaaagaggaaccctagttaaggaaaaaacatattcacatcgtcttctctctccttcaatcgggactccgtctcagctcgggggctgttggagttggttggaactcccccacacttcggacttcgggaaacaaccagaatctgc

SEQ ID NO: 8020 - DNA, 546 bp, Vitis vinifera
  misc_feature (17)..(17): n is a, c, g, or t
  misc_feature (26)..(26): n is a, c, g, or t
  misc_feature (36)..(36): n is a, c, g, or t
  Predicted polypeptide sequence is orthologous to G3111
ggtcggaattcccgggntcgacccancgcgtccganacattaaaaactgtaaaattctctaaatctgagctctctttctctctcctcacaggtcacatgactcatccgtctagattcctcggcggcgtgaactcctcggcgaccgcatcacaggagtccgccgccgtcgactccgacttcgtcgtcatcctcgccgcgctcctctgcgccctaatctgcgtcctcggcctcgttgcagtagctcgctgcgcctggctccgccggatctccggcgcagcgaacctcccgggcggttccgctcctcaaactccggccaacaaaggcttgaagaagaagatcctccgatccctcccgaaggttacctacgcagccgagaccgccggaaacctaacggactgcgctatctgcttgactgaattcgtcggaggagacgaaatccgagtgctgccgcagtgcgggcacgggttccacgtcggatgcatcgacacatggctaggatctcattgttcttgcccttcgtgcaggcagattctggttgttgccaga

SEQ ID NO: 8021 - DNA, 678 bp, Vitis vinifera
  Predicted polypeptide sequence is orthologous to G3111
gcacttctccatctctctcttttctactcttagtgatgactcgttcttcaagattcctgagcagctggaactcatcggcagcggaacccccggaggcagtggaggtcgagtccgatttcgtcgtgatccttgcggcgctgctatgcgctctgatatgcgtggtgggtctcatcgccgtagctcgctgcgcttggcttcggcggggctcagcgggaggggcgcgcgcgtcggccacgcaaccggcggcgaacaaggggctgaagaagaagatccttcagtcgcttccgaagctgacccacgacgccacagtgagcggcaagttcgcggagtgcgccatatgcttggcggagttcgtggagggtgacgagatccgagttctgccgcagtgcgggcatgggttccatgtgttgtgcgtggacacatggctgagctcccactcctcctgcccgtcgtgccggcagatactggtcgtcaccaggtgccggcagtgcggcaagttccccgcaatttccggcacggcaacgtcggacgcggaactcaaggcaagggaacagggtactgctgataatgggtttctaccataaccccatcacgatgtattttccatttctcctctagaccctcaccatgtacagaagaactgccccattttctctgtgcttcttgtattttcctcat

SEQ ID NO: 8022 - DNA, 685 bp, Vitis vinifera
  Predicted polypeptide sequence is orthologous to G3111
gcattttagcattaggaaggggtttgcattttttatcttgtatatggcctttcagttggagcgaggtttgcatggccttgagcctgctgttgtagccaactttccaacaaagaagtttgctgatgagtttttctcccctgcagaggatgctcagtgcacagtttgcctagtagaataccaagctgaagatatattgcgtattctcccttactgcggccacttcttccatgttacatgcatagacatatggctgcagcagcattccacatgtcctgtgtgtcgaatttcattgtgggagtttcctgagagaaaatgcttgatgcaacccatgttcagttcagctgttcgatcacattttggcatggaatcccgcaacacacattcatacaactgtttgtcaactggccgtgggttttcatcgagatctcacgacaaccacaggatggaccccattcaagaggatcagtttgggccaggaggtgacggagctgaagctcaggagagcaccctccccttgaccgatgctaatcagcctgcaaaggactctgaaaataagcacatagaaagcccatcaaatccatgaaatccttcgtttcttggaatcctggctgcattcatcgtgctttctgatagaatcaaattggaattgaaatttattaaaaccatctccttggaatgctctttt

SEQ ID NO: 8023 - DNA, 609 bp, Vitis vinifera
  Predicted polypeptide sequence is orthologous to G328
ttttttttttttttttttttaagtaaaatgacatgcacattaaatgattccaaaagcaaaagtgggaccaaaggggaacctccgtgtctccgggcggaccacggttgggccccaccagaaacgcagctagccacaagataacttaacaacttttcggagccactaaaaaggtgacgcgtgtcactcaaaaggattctctacaacccccacttgcctcttccgtcttcctacagttacctcttcaccacccttcgttcactgtgcacccgaaacacaaacctacgctcactctcacagtctcacacacatgttgaaggacgaaggttgtaacgctgatgccgccgccggtggaggcggtggctgggctcgtgtttgcgacacgtgtaggtcggcggcatgcactatttactgcagagcggactccgcctacctgtgcgctggctgcgacgcccgcatacacgccgccaacagggtggcgtcgcagcacgagcgggtctgggtgtgcgagtcgtgcgagcgcgatccggcggcgttcgtctgcaaggcggacgcggcgtcgctctgcgccacctgcgacgctgacatccactccgctaatcctctggcccg

SEQ ID NO: 8024 - DNA, 767 bp, Vitis vinifera
  Predicted polypeptide sequence is orthologous to G328
ttttttttttttttttttttttttttttttatacaaaattactaggcacatttctcattaattcaaacccattacatcgagaaagatacagtattagtggttgagtctttagtaacaaactcatacaattctttctctccttgatactggatttagaatgacgggacaatgccatatccgctttccgccattaatgtcgtagagaacatctgatccacttcaacttctacatctgtcctcttggcaaacctgcccttgatccggggtcttgtctctgcatatgctttccttgatgcatacctgattgtcttctcaaacttccttgtcttctttttctctctgtacctcaggacccttgcctccctatccattggagtcagctgggttggcatctgaattggagggcctgagaaaaggtcgattgttcccttgggaggtctcggatgcgagattgagattgagatatcactcatagttgttgcttctggcacgacgccaacatccattgatgacacagagacgctgtggctaattgaagggttgtagctgtaggcagctttcgaggactcatactccatccccagatgaaaaccctgctgctgatgctgctggtgtagctgcccctttgcttccccgcactgaactggcacgacactgtctcccccataattcttgtgcggaacgctgtaatgcggcggcggctgctgctgattatactgatcactgaactgattctcagggcatgaattgtactccactaggtcccc

SEQ ID NO: 8025 - DNA, 717 bp, Vitis vinifera
  Predicted polypeptide sequence is orthologous to G351
attcggcaccaggcagagttcctcaacccgcataccttttctctcagtgtttctctctgcctacttcatctccctctttcatggctctcgaagctctcaactcaccaaccacacccacgccttcctttcactacgaacaacccagcctccactctctggagtcatgggccaagcgcaagcgttccaagcgtcctcgcttcgacaaccaacctacagaggaagagtatctggctctctgcctcatcatgttggctcgaggaggcgccgccgcctccaccgtctcacaccgccgccatctctctccccctcctgccctgcaggtggaagctcctaaactcacatacaaatgttcagtttgtaacaaggccttcgcatcctaccaggcactagggggacacaaggccagccaccgtaagcagtccggatccgatgacctgtcggcctccatcaccaccacaagcaccgcggccgctgccagcggtggtaggactcatgagtgttccatctgtcacaagactttccccactggacaggctttgggtggacacaagcgatgccactacgaaggcggcgccagcgtcagcagtggcgttacctcgtccgaaggtgtggggtcaacccacagccaccgtgacttcgacctcaacctgccggcttttcccgaattatggtccgcacgtcgattcccagtcgatgacgaggtcgagagtcctctgc

SEQ ID NO: 8026 - DNA, 731 bp, Vitis vinifera
  Predicted polypeptide sequence is orthologous to G351
gctccctacaatctcatcgcaaactctctctctctctctttctgaaactctcaattctctttctctcttacagtcagtgatggctttggaagcgctgaattctccgacgacgatgtctcctactttcaaatttgaggaggcggagctgcactctcttgagccatggacgaagaggaagcgatcgagacgaccccgttttgagaacccctctactgaggaagagtacttggctctgtgtctcatcatgttggcccgtgggggcgccaccacccgggaagagtcaccgatgccgctgcgggcagtgcctcctcctcccccgttgaatctctcttacaagtgtaacgtctgcaacaaggccttctcttcgtaccaagctctcggaggccacaaggccagccaccggaagtcctccaccgacgacgcgtccacctccgccaacaccaccactacggcggggagttccgcgctgaatcctagcgggaagacccacgagtgctccatctgccaccgcacgttccccaccgggcaggccttgggcggccacaagcgttgtcactacgatggtggcagcagcggcgtcacgtcttcagaaggcgctgtttctagtcacagccaccgggactttgacctgaacttgccggccttgccggatttctggccgaggtttcgcgttgacggagggcggaaaagtcaaactggggttgagcaagaggtggagagtccactgccgg

SEQ ID NO: 8027 - DNA, 910 bp, Vitis vinifera
  Predicted polypeptide sequence is orthologous to G363
tcccttctcctctcctctccatttatttactatattttcctcttgcatccaaactctattcccagttggtagtatccgtccacaacgcccttccatccaaactttatttccaatttaggggttgtggagaaatgattttccatggggaaggagctgaaacatcagtcaacaaacagcaaggtggactgaggataagtgagaacggagatgaaggagctgaagaagataatccaggtgagtggctgaatttaagcctgggtaggaatttgccgtctacagctctagactcagacccgcaatcaagaccaacttcttccaaggttttctcatgtaacttctgtatgaggaagttctacagttcacaagcattagggggtcaccaaaatgctcacaagcgggagagaggtgcagctagaagatatcagtctcataggatgatggccatgatgggtttgcccatgaatacacctatcaggtcacttggcgtccgcccccattcactagtgcagaaaccaaacagagatggaactgcaattgtggcgagatttgatgattccaacacgggctttggaatgacatggacacccttcacactagaggaaacgatggacgtgatgtggcccggaagctaccgcttggaacaacaaccatcagagcaaacatcagagccacttaagctcgacttaaatctccggctctaacagacccttcatcagcccttgtccagaattgtccatctcggttcatttctgtaataacagttcttgttttgttcttccatcaaaaaacatgtactgtgtactaacttaggtatgagccaaacaactttgaagagtcaaaaatccatgcctggatttctgcctaatatctctagaaaaaacactaggaatatactactgtttatgcatat

SEQ ID NO: 8028 - DNA, 907 bp, Vitis vinifera
  Predicted polypeptide sequence is orthologous to G363
tctgaagtcagtagccaagtagcgtccaatgtatccatccaagagacttcctctgatccctccaaggacagcactacgacatcatcttgcctcacaaatcttataaagcttcagccagaccaagggtctgtttctctagacttaacactatgtttcaaccccaacgacaccaagttgaagggcatgggtgagagtagcagtgatgcagtggctcaggctccagtggcaacggccccaaaggttttctcttgcaattattgccggcgcaagttcttcagctcacaggcattgggtggccaccagaatgcacataagagagaaaggacactggcaaaacgggccatgcggatgggaatgttcgcagatagatacactagtttatcatctctgccccttcacggttctgcattccggtcccttgggattgaagctcattcctcactgcaccaaagaatggtaccgctggaaaggcctgatacaaggggcggagcaaggtttgagcaaggctattacgggctgccagtgttcatagaagatgaagaagcagagctgttttggcctgggagttttaggcagatcggtgaaagagttggaggcagtgcaattcctgaattggctcaaggtcccaatataaattttgtaccaatggctcccccaccaaccacagattcgtcttcacctgatctcactttaaaactataagattctttccccccttttttccttcatttcctctggactcattactcctcacagggttcactttgtacagcgagatatgctcgaggcatggcggctaccctcggattttccactctcttttgtttctttaacttgttttcttttccaatgatgtgctgcggttgagctagtaagttgtatgagaagtatctgaagatgaatttta

SEQ ID NO: 8029 - DNA, 671 bp, Vitis vinifera
  Predicted polypeptide sequence is orthologous to G385
ctgctagtgggtgttagctcttcacccactactttaaaaaaaaacacacacacacaaacaacaggagatttaagtaggaaaaaaggttggacagaaatgaagtattaaaaccctaataaaaccctaaccctaaccctaattgacaaagttagaaaggtgaggggaagctcaaacctatgtgacttacatgaaactcattgtactttgttttgggaagtcaatacccgaacctcgaatccttgcaaattcttaatgaaataagctaattatcttttccatcttgggaaaataggatggtgtaaggtgcgctcttgacttctccccatcttttataagctgaaaatcctcctcaccttcgtttcttttcctgcttttcttttccccttcttgagttcataacaatatttcaagctttgcagttcatgcgttctcacacgagactgcagccttaatcctgtcgacagtgcaagcgatgagattgtttacagtcgcaaccgaccctagagagagttttgccgttggaaccgaatcaaccaatatctgaaatgccacggttagaagagatcctccagacccaacttcacctatgactcctccatgagctgtggttccatctggaagaattgcaaatcctgagggaagaagagcaacatagtctggatcccctccat

SEQ ID NO: 8030 - DNA, 910 bp, Vitis vinifera
  Predicted polypeptide sequence is orthologous to G4
catcaagccttccgctttctccgctgcgaagccacatggctatacaggtataaaatctgtggaatttaatgggcaagctgaaaaatctgcaaagagaaagaggaagaatcagtatagaggaatccgacaacgcccttggggaaaatgggctgcagagatccgtgatccaagaaagggggttcgagtttggcttgggactttcaacactgctgaagaagctgcaagagcttatgatgctgaggctcggaggatccgaggcaagaaagcaaaagttaattttcctgatgaaactcctttgactgctccaaagcgcaccatcaaggcaaatgctcaaaagctaattccaaagggtagccctaactcttcccattcgaatctgaaccagagttttaatttcatgaacaactctgatcaggaatactatagtagtttaatggatgagaaaccatcaaccaatcaatatgggtatccagattccttccctgccaatggcgaagttggactaaaatcacttgccccatctgagaatggtcgcatgtattttaattcagaccaaggaagtaactcttttgattgttctgaccttggatggggagagcagggagcaaagaccccagaaatctcatcggttctttcagctacccttgaaggtgatgaatcccaatttattgaagatgctaacccaaagaagaaactgaagtctaactctcagaatgcagtgtctgttgaagaaaatactccaaatgggctttctgaggatctctcagcttttgagtcccagatgaagtactttcagatcccttatcttgacggaaactgggaagcttcaatggatgccttactcagcggggatgctgctcaggatggtgatcgaccaatggacctttggagctttgatgatctgcctact

SEQ ID NO: 8031 - DNA, 826 bp, Vitis vinifera
  Predicted polypeptide sequence is orthologous to G409
gcaacgcatctctcttcctcagtctctccctctccctttcactttcacaaacacccaaacattagccgtcggcgctgccggagatttctctttcaacccttccaagaatcgacacccttcccttctacgtcttctgagtgatgggggtgagctgttctcgctgttcccacacttcccacatcactgagatcatcatcaccagtttcttccgtcacaagctctagatcctggttgattcagaagcctccgttcgtcggaattcggaagctatgggagcttgagaattagtctggagagttgtaagtatggcgagtgggagggtcaatctcgcagcgatgcttcagaaccaaagggtcccttgttcttctcagcctcttgatgctctcttcctttctgcctcttctccttcttttcttggttcgagatccatgttgagctttgaagatgttcgtgcgggaaagagacccgataatcccttcttctgccagtttgatcatgatgaaaatggagacgaggacttggatgagtatttccaccaacccgaaaagaaaaggcgacttacagccgaccaagtccagtttctcgagaggaattttgaggtggagaacaagcttgaaccagaaagggaagtccagcttgcaaaggaccttggcttacagcctcggcaagttgccatatggtttcagaaccgcagagcgcggtggaagaccaaacagctggagaaggactttggcgccttgcaagctagctataacagccttaaggctgagtatggatacctcctaaaggagaaggatgaactaaaaactggatctattctcctcac

SEQ ID NO: 8032 - DNA, 919 bp, Vitis vinifera
  misc_feature (812)..(812): n is a, c, g, or t
  Predicted polypeptide sequence is orthologous to G409
tctctcaatctctctctcataagagaatttccattcaaagtttgagcagtcgttgttgttgcgcgtgatgggtgtgaggtctccctactctcaaacttaccacattaccataattctcatcacaagcttctttcgtcacaagccatagatcaaaattcaacacaccgcccttgcttattctcccaataaattaacatgaccccttagctcatcttaaattcatattcagtaatctatggacggtaggaaactgtatggtggcggttcaaacatggccgttttacttagtaaggaaacacttccctctccttcagagcttcttgaatctttctggattcccgattcttccactactttccatggttctaaatccgtcgtaaactttgaaggtgttggtggagacgacacaaaagataggccattcttccaaacactccatgaggaagaaaatggcgatgaggattttgaggggtgctttcatcgacccgagaagaaaaggcggcccacagccggtcaagttcagtttcttgagaggaattttgaggtggagaataagcttgaaccagagaggaagaaccagcttgcaaaggagcttgggctgcagccacggcaggttgcaatatggtttcaaaacagacgagcccggttcaagaccaaacagctggagaaggactatgattctttgaaagctagctatgatagcctcaaggctgaccatgattgcatcctgaaagagaaggaaaaacttaaaactgagctcctgttgctgacggacaaagcgctgatcggggagaaagaaggggagaaaaganaagcattggagaacatcagtccatcacatgcagaatctcagaaagcaatgatcgatagagtttctgaacacgtaccacccaatgcaccaatcctcttctgtaaacag

SEQ ID NO: 8033 - DNA, 673 bp, Vitis vinifera
  Predicted polypeptide sequence is orthologous to G428
ttttttttttttttttcacttcggctacacaaccaatattttcagctctaagtttagcagtgggagcccattagtttcatccctaccataaaatatgccagcaactagaacttacgaaataaattaggacattgtcagaaaaataaggtgggtaaacatttcatttggtatcagcaaattaaagaccaaattgaagaatatacaccggaaatacgggagagagagaagagagggttgtcactgcatcactcattcatgaaaaatggtccataaatactgtccataacagcaaattgcatgttctccgatggcttccagtgccgtttacgttggtttatgaaccagttgtttatctgcttctggtccaggcctgttgattcagccagtgcgatcttgtcttcctccgttggatatggccatttatagtgaatattccaccaatcaagaagggcttgtcttgcttcctttggtagctttcccttcttctttgtctttgaaaattcatgcttcagggtactgatatagccactatatttccgcaatagcttatccttaagctcctgattttcagtagtttgaagacattcttgtacctccacctctcctccacttaagtcctcctctgatgacccagctgcttcgtcggaaacgtagcttctggaagcaccattgc

SEQ ID NO: 8034 - DNA, 688 bp, Vitis vinifera
  Predicted polypeptide sequence is orthologous to G43
gtattcaatcctttcattcaattcttctgtgtttcaacaactcagcttctgtgtctctagaagttgtttgaatttgaagtttgagcttgctgatcatggcaacagcagttgaagtctcagcactccaactcatcaggcaacacctcctaggggagttgtctccaaagaacatcgtcgtcactgaccttacagtcggtgaagaatggagcaatggattaaattctgaggtttcgacctctcaatctgattccttctgttctcaggctgctagttgtgactctcctgtcacaatctccgagttgttcggcagcacggatctcagcgctgatttcttcggcttcgtccccagctccacctctgagcagtctcaaagtaatttcttcgagttcgaaactaaacctcaaatcatcgatctaacatcgccgaaagggctgaactcgagtcatttttttgaatttgaaacaaaacctcaaataaaagatacgacgaaaacaaaatcgctagattcgagctctcaatcgactggtaaagatcgaaaaccgtcgttgaagatctcggtcccacggccgaccaaggaaattgaatggttggagttcgctgagccgaaacaggcggccacagtagaaccggcgcagaatatttcccatcctgaggagaagaagcactacagaggagtccgacagaggcc

SEQ ID NO: 8035 - DNA, 685 bp, Vitis vinifera
  Predicted polypeptide sequence is orthologous to G450
ttttttttttttttttttttttttttttttgacttactgggacattattataattgtcattaagcaagccataatgctaattaaacaaaggcatagagacccagtcttgcaacacaaaataaaaatagttttttttttttttgggtttttttcttagtcctggccataattaatactcaaatatctcacaagtttatatgatcaaaccacaattaataatattacacacccccaaacatcctgctcaatccatcttggccctttcggtcgttgaagatcaaaggagcaggctgggggggccactgccttagctcctattcttgcatttctccatggctctaggggcgagccctatcgcctcttttcctttcattatgcgcaagcgtttgcatgaatccacaaacatctcccatgggacatctccaacgagcatccaatccccatctttgtcttcgtatgttggaacatgatcaaaaccattcaaaagatccatcaacttgctctcatttatgaaatccttcattccttgtgatccataattcccaatagtgaaggagctgaacatgttgcccaaggcattggacagctcctgataactagtgtacatcttcaagtcaaccttacgcagatacggcgctccgtccatgctaaccttcacaaaggctgcgttgcagctcaccttccc

SEQ ID NO: 8036 - DNA, 358 bp, Vitis vinifera
  misc_feature (139)..(139): n is a, c, g, or t
  Predicted polypeptide sequence is orthologous to G450
ttttttttttttttttttttttttttttttattttactaataaacaaccgatacgaaaggtacgattattgcttcttggccattacaaatgccccgatctttgataattatataccgtcaaataaaaatacggacacancgatccaacatcctcatcaatcgaagcttgaacaccgggctgctagctttatcttctaagcttcatggatgctggacttgtacggggctgtgctggatcagcatctattcttacacttctccattgctcttgggatcgaaccaattgcttctgatcctttcattatacgcaagcgcttgcatgaatccacaaaccccggccgtagtgggcgaattcccg

SEQ ID NO: 8037 - DNA, 780 bp, Vitis vinifera
  Predicted polypeptide sequence is orthologous to G450
atgtcaccgcagctccctaaaccctcgccggaatcttcctccgccggcctctatttcaatgataccgagctcaccttatgcctccccggcgctaccaagtccggcaccaagcgcgggttctccgacaccgtcggcttgaacctccgtggcccctgcaatacggatcacgctagcaatccatctgaaaacgatgtttccggcgactccaagcctccgccggcaaagacacaaattgtggggtggccgccggtgaaagcgagtcggaagaatgttgcgaagatcagcaaatatgtgaaggtggcggtggacggagctccgtatttaagaaaagttgatctggagatgtacggaagctatcagcagctgttgggatctctcgaggacatgttctcctgcttccctattcggaattatcttaatgagaggaagcttatggatcctgtgaagggatccgactacatgcctacctatgaggacagggatggagattggatgctggtcggcgacgtaccatggaaaatgtttgtggaatcatgcaagcgactacggctgatgaaaagcattgaagcaattggactagctccaagggaatctcaaaaatgcacaagcacaagtggatcaaaaagcctatagtttgatagcatccttggatgataatttgatgtaaaaaggcttcttcttctatttttttcccctaattttgattggttttaggtgaccaaaaaaaagagaaaatatatgtaaaagagacttttagagtagagaaatagacgttagtta

SEQ ID NO: 8038 - DNA, 715 bp, Vitis vinifera
  misc_feature (568)..(568): n is a, c, g, or t
  Predicted polypeptide sequence is orthologous to G450
tttttttttttttttttttttaatttaaaatttaaaaattatataaaaaaaaatgtatacatttggggacagagaatctctcatctcttacaaataaaatacatggcactgaaaatttctagggaaccaaaaaacactcacaacaacaagaaaggacgatgcatgagggttgttattagactaacaagaagccattgataatagacaaagctacacaattttgagcaacagtcttatgaacaagtagtactgttattgtttcttgctcctaatacaatttcccagcttcttttctctctcatatttatatatcatgccaccatacaagcacatccatccatgatcctcagctgcttctggctttcctttgatgggcagactgtggatgggtgcctctagcttctgttcttgcacttctccactgctcttggggcaagtccgatggcctcggatcctttcattatgcgcaagcgcttgcaagattcgacgaacatctcccatggcacgtctccaacaagcatccagtctccatctttgtcttcataagtaggcacgtaatcggaaccgntcaaaagatcgatcaatttgctctcattcatgaaatccttcattcttgtgatccacagttgccaatagtaaaggagctgaacattttgcctagggcatcagagagttcttgatagctcttgtacatctttagtccaccttacgtagt

SEQ ID NO: 8039 - DNA, 988 bp, Vitis vinifera
  Predicted polypeptide sequence is orthologous to G450
gaggaagaaggagaagcaaagagagaagatagccatcatcatcaacgactagaatagagcaaggtttccccggagattccatggaagttggccggaaaatgtcgagcatgctcggggctgagcgtggttttgatttcaaagagactgaactctgtctggggctgcctggtggaggtggaggtgaagccgagacgcttaaggcttctggcaagagggggttctccgagactgttgatctcaaactcaaccttcagtccaaggaatcagtagtggatctgaacgagaatgtcaagtgtccacccaaggagaagaacctccttccttgcaccaaggatccggccaaaccacctgccaaggcacaggtggtgggttggccaccagttcgatcatttaggaagaacataatggctcagaagaacagcagcgaggagggtgagaagggaagcagcggtgctgcattcgtgaaggtttgcatggatggcgcgccatatcttcgcaaggtggacttaaagatgtacaagagctaccaagaactctctgatgcattaggcaagatgttcagttcctccaccatgggcaactatggggcccagggaatgatagattttatgaatgagagcaagttgatggatcttttgaacagctctgaatatgttccaacctatgaagataaggatggagactggatgctcgtgggtgatgttccatgggagatgtttgttgattcatgcaagcgcttgcgtataatgaaaggatcagaagcaattggtcttgcaccaagagcaatggagaagtgtaagaatagatgctgaaccagcacagcctcgtacaagttcagcatccatgaagcctagaagataaagctagcagcactgtgttcaagctttgattgatgaggatgttgtttggatgtgtctgtatttttatttgatggtatataattatcaaagatctgggcatttgtaatggacaagaagcaataaacgta

SEQ ID NO: 8040 - DNA, 585 bp, Vitis vinifera
  misc_feature (61)..(61): n is a, c, g, or t
  misc_feature (451)..(451): n is a, c, g, or t
  misc_feature (477)..(477): n is a, c, g, or t
  misc_feature (526)..(526): n is a, c, g, or t
  misc_feature (528)..(528): n is a, c, g, or t
  misc_feature (545)..(545): n is a, c, g, or t
  Predicted polypeptide sequence is orthologous to G451
tttttttttttttttttttttttttttttgaacactgatatctaatggagtatcgggatcngtttgaagggttgatccaaaactcgacagcaagaacgaattatccacatttggcatatatagatctatcttgtgctgcgtaggggaaaaccgagagcccaagccacaagaccatgtgatctgatcatcagaccctccccatcggaaaggaattctaaatttcggggtccgttccgatgccttcatgaaacttagcctcttacaggatgagaagaccatctcccatggaacatctccaaccagaatccagtcgccgtctttatcttcataagccggggtatagacagaaccattgcagccttccctctctgagaactcacctatgctgaacttgaacatattctccagatcgatcaggagctccgggtagctcttgcaaaccttgagatcnatctttctgagggaaggagctccctncatgctcactttcacgtacattccggccccctcggcttcccctttcctntnctggaagctgtttttcnggatcgatcggaccggcgaccaccccaccacttgtgcttt

SEQ ID NO: 8041 - DNA, 738 bp, Vitis vinifera
  Predicted polypeptide sequence is orthologous to G451
ttcatcattacaactcctgatcggaattcaaaaacgatctaacgggataatcatcgggaaaaatggagaagccagagccctacaataacggacttaatcttgaggcgaccgagctaagactaggggtaccggggaccaatgagcctgagaaacaatcatctactagtgttaggagcaaaaagagagcatcgccggagatggccgaggagactaggactaagagcagctcttgtatatccgatgccgacgacgacgcccctccaccaaaagcacaagtggtggggtggccgccggaccgatcataccggaaaaacagcttccaacagaggaaaggggaagccgagggggccggaatgtacgtgaaagcgagcatggatggagctccttacctcagaaagatcgatctcaaggtttacaagagctacccggagctcctcaacgccttggagaatatgttcaagttcagaataggtgagtactcagagagggaaggctacaatggatctgactatacccctgcttatgaagatagagatggtgactggatgctggttggagatgctccatggaagatgttcatctcatcctgtaagaggctaagaatcatgaaggcatcggaatgacacccgaatattagaattacttaacgatgatgaggctctgatgatcagatcacataatcttttggcttgagctctcggttttcacctacacagcacaagatagatctatatatgt

SEQ ID NO: 8042 - DNA, 845 bp, Vitis vinifera
  Predicted polypeptide sequence is orthologous to G451
ttttttttttttttttttttttttttttttcgggaaaaccatacttttgtgtatctatattttcataagattgagacagaaccaaaacttggataaccatgtcatgttcctttgttctttacaattgcatttgaagcataaatgtatatctcttcatatgcaggtttagcttgatgcgattattacaaacaaggctacgaataacatcgagatgcttaaaaccaccatggatcttggtgccacaactttgggaaagaaactttaattctgctttgttttctctgtttgctgtcttgacttgccgtttcagttccagagaaaactgttgatagagaaaacgacattcaaatccaaatttcttcctggagaacccaagccgaaagagttgccctgggtgagagacacgtcctttcttcttttatgggctgccatgacttctaggattccttatgcaccacaacccaagcctctagcgtctgatcctttcatgattctcagtcttttgcaggatgacatgaacatgtcccatggaacatcgccaaccagcatccagtcaccgtctttgtcttcataagtgggtacatattctgatcccttgtagccctctctctctgagtaatcacctatagtgaatttgaacatattctgtagagcctgaaggagctccggatagcctttgtaaaccttcagatcaatctttctgaggtaaggagctccatccatgcttactttcacgaacattccagcagcctccgcctcagtcttcttcagttggaagctatttttccgaaaggatcggattggtggccaccctacaacttgtgccttcgtggcaggtgcatttt

SEQ ID NO: 8043 - DNA, 733 bp, Vitis vinifera
  Predicted polypeptide sequence is orthologous to G451
tttttttttttttttttttttttttttttaagtaaatttgtacacttccatttcaagaaaatatgcataaactatacataaaagtttgtttctccgactcatcatcttgatttcgttttgtttctgtgttggaattcagactcagatttctccatggacagcccaatctacaaggagttttcctttttcatagaccaatcaatggatcttcttttggatgtccccaattcccatttttgagcagcttggattgtgcaggtgttttctatagaaagcagcccaagcctctagcttctgatcctttcatgattcttagcctcttgcaggaagagatgaacatattccagggaacatctcccaccagcatccaatccccatctttgtcttcataggtaggtgcgtattctgaaccattgtagccttccctctccgagtactggccaacactgaacttgaacatctcttccaatgccttaaggagctctggatagcctttgtacacctttaggtcaatctttctgagataaggagctccatccatgctcactttcaaataggttctcccctcctcagcctccgttttcttcggctggaaacagcttttccggtatgatcggaccggtggccaccctactacttgtgccttgggggccggagcagtttcacggtgggattttccatcatccgagacactagagttgttcccagatcccgactcctcgttcatgtcccc

SEQ ID NO: 8044 - DNA, 275 bp, Vitis vinifera
  Predicted polypeptide sequence is orthologous to G451
tttctttttttttttttttttttttttttttttttttaaaaaaaaaacatcataattagggtaaacttaaaatttgttcagggaaaaaaacaataaaattattttttgcattacaatcacaaacttctaatcatttattttctggagttccttcaaaaaatttaactgccggccgaaatttttggtttcggatttttttttgatcctcacccttttgcaaaattcaatgaacatttcccaaggaacatttcttacaagcatccagcccccatttt

SEQ ID NO: 8045 - DNA, 694 bp, Vitis vinifera
  misc_feature (335)..(335): n is a, c, g, or t
  misc_feature (338)..(338): n is a, c, g, or t
  misc_feature (376)..(376): n is a, c, g, or t
  misc_feature (452)..(452): n is a, c, g, or t
  misc_feature (652)..(652): n is a, c, g, or t
  Predicted polypeptide sequence is orthologous to G468
ttttttttttttttttaaaataaaactatatatactcatttggtgtgtatgcatgtacatctataactcagtaacaaattcatatactgtgagtttgatttccaccccacaagacaaaatgtggagagatcggaaaagacaactatcaaggatgtactgggattgggctctttagtatttgtctaccctagtgatcttcaatctctttacagtggtcaagaacagctcccaaggaacatccccaaccatcatccagtctccttccttgtcttcatatgttagcacatggcatttctcagaatgcagaactccatccacctcagcccagagaatgntgntgctgaacatatggtcaagagtccttatcaaggcatgntaaccgtcgtgcgcaaatagatcgagctttcttccaattggaatgccttccatgtataccttcacaaagaaggtgncatcattgcacttgtttccttctcctgccagggccttcctgaggagagtctttatgggtggccaatctgattgttgctcccttggagtggaagggcagtaatggtgatcagaggttgaaatgctgagcccaaggctaagatctgtgctgaagtctctcttgagccgggggaaagaagatgcagatgaaacagttgaatgnctgctgctgtcaatagatgatgatgaagagtttgtagctcta

SEQ ID NO: 8046 - DNA, 699 bp, Vitis vinifera
  Predicted polypeptide sequence is orthologous to G489
gacatgttttttttttttttttttttttttttttttgcgtcataaggtcaaattcagctactttgatttgcatgacctgaaaatcatagtatagcaaatacattacaagtagaccctgcactagtaacttgataataagccgtccatattaactaagttttaagcactaaatctttcaacaaaataaaacattcattctatagataaagctaatcctcactatccagaggtaataatattttctttatcaatattaatttgtgcagcccacatattccgtctttgcaatcactttggtgcttctcttgttcatgtatttctcctgttcatttcgatactagtaaggcatcttcttccctgacacttattgttcttgcttctgctctagcaaatctcctctttgctcaagaatctgcaggtggctgctgttgctgctgctgtggccacatctgctgagcaacataagggcgaggctgttggccataaagaccttgatccatcacagtcttacccataaccattcctggagctccaacctgtggaccatgctgaggttgcatataaaagtaagggagaccctcagcaggacctccaactggaagtggcccccctcttggcattgatgctagcacctcctcttttaaatcctcaccgtgggacaatatccactaagaaaatcaaatatatccagcccctgtg

SEQ ID NO: 8047 - DNA, 826 bp, Vitis vinifera
  Predicted polypeptide sequence is orthologous to G489, G714
ataaaaatcgagtaccataaagccaaaccctaaccaaccaaccccatcattcactgtacggactttccctccacaacgcccgaaacccaggatagcaatggatcatcaagggcatggacaaaccccagtaatgggaatggctggtagtgcagctcagttgccatatgggacaaacccttatcaacataaccaaatgggtggaacccctacttccggatcagtagtgacatcagttgggaccattcagtctccagggcatccagcaggggctcagcttgcacaacaccagcttgcttatcagcatatgcaccaccagcagcaacagcagctacagcaacaactccagtctttctgggcaaatcagcatcaagaaatcgagaaggctactgattttaagaaccatagccttcccttggcaagaatcaagaagatcatgaaggcagacgaggatgtaaggatgatatcagccgaggcaccagtggtatttgctagggcatgtgaaatgttcattttggagttaactttgcgctcttggaatcacacagaagaaaacaaaaggaggactctgcaaaagaacgatattgctgcagctatcacaaggactgatatctttgactttttggttgacattgtgccaagagaggatctcaaagatgaagtactcacgtcaatcccaagaggaaccatgccagttgggggggcctctgacacagtcccttactactatatgcctgctcaacactcgcctcaggttggcacgcctgggatgatcatgggcaagcctgttatggatcctgctttatatgcccaacagcctcacccctac

SEQ ID NO: 8048 - DNA, 337 bp, Vitis vinifera
  Predicted polypeptide sequence is orthologous to G489, G714
tttttttttttttttgggcgataagctggcagccactaagaatctgatggtgattgccattgctgcttttcctgcaacagccacatcaattgacccatgtagagatgaggttaatgggcatacaaagctgggtccatcgcaagcatccccatgatcattcctggaatttcaacatgagatgaatgctgagcagcataagtaataagagggtgcatcagcaggggccccaataggcatggttcctttcaggattgatgcaagcacttcaatcctgtcttggcagaatgtcgatcaaatgtcaaagatattgtcctcatgattgctgctgcaatgacct

SEQ ID NO: 8049 - DNA, 687 bp, Vitis vinifera
  Predicted polypeptide sequence is orthologous to G519
gccgaaattgatctctacaaattcgatccctggcagcttcctgagatggccttgtacggagagaaagagtggtacttcttttcgccgagagatcggaaatatccgaacggttcaaggccgaaccgggcagcgggaacagggtactggaaggccaccggagcggataagcctattgggcatccgaagccggttgggattaagaaggctttggttttttatgccggaaaagcccccaggggagagaagacaaattggattatgcatgaataccggctggcagacgtggaccggtcggctcgcaggaagaataatagcttaaggttggacgattgggttctgtgccgcatatacaacaagaagggcattgtcgagaaacaacacaccgctgcccggaaatcagattgctccgatgttgaggatcaaaagcctggacctcttgctctaagcaggaaggtaggtgcgatgcctccacctccgccgccgtcgtcctctacggcaccaactgcgacagcggcactggacgatttggtgtacttcgactcatcggattcggtgccgcgcctccacaccgactcgagctgttcggagcacgtggtgtcgccggagttcacgtgcgagagggaggtgcagagcgagcccaagtggaaggagtgggaaaatcccatggacttttcgtacaattacatg

SEQ ID NO: 8050 - DNA, 684 bp, Vitis vinifera
  Predicted polypeptide sequence is orthologous to G519
gcaggaaaagggggagagaaaagagaaaagagaaagagaaaaagggaaagtaaattttaagaattttcaagaggaagaagtgaatgatgagcggagatcagttgcagttgccggctggtttcagatttcatccgacggacgaggagctcgtggtgcattatctggttcgtaaatgcgcatcacagagcatctccgttccgattattgccgaggttgatctctacaagtacgatccatggcagcttccaggaatggctctgtacggtgaaaaggagtggtacttcttctctccaagggaccgcaaatatcccaacggttcaaggcctaaccgggcggccggatccggctactggaaggccaccggcgccgataagcccatcggccgacccaagacggtcggaattaaaaaggcactcgtattttatgccggcaaagctcccagaggtgtcaaaaccaattggatcatgcacgagtatcgcctcgccaatgttgatcgatccgccggcaagaaaaacaacttaaggcttgacgattgggtcttatgtcgaatatacaacaagaaaggcagcgccgagaaacagcacacctttgatcaaaagtcaatgaaatatccagaacttgaagaccagaagccaaaaataatatcaacggttcaaaataaagtagtaccctcttcattgccgt

SEQ ID NO: 8051 - DNA, 648 bp, Vitis vinifera
  Predicted polypeptide sequence is orthologous to G519
tttttttttttttttgaaaaaaaaagaatattttactattattctatattctacaaaggtgagaatttcctacaatggtacatattaacaacgaccaatccaacacattctcatcccatcatccccatatcttccatgaatgaaactcatgttagcaacttcatgaatcatgagaccaatatagctaccatcttcatattctaggtttgacgtacgatgatcaaattttcctaatcggaatatttatcaaaatgacttgttcgagaacatcaacatgtcctgccacgacgatgttaataagtctcccgaaaactgtgcttgagaggcaaaagggtcgttggcaaaaccatccatatagaggctaaaatcaaagtcattccacttaggctcgctttgaacctccttctccggtgacattacttgttcggatccactagaatctgtgtgagtgtgtaacctcggcactgaatcagatgtctcgaagtataggtagtcattggttgttggcggcgcaggcattggaggtagggacggcaatgaagagggtactactttattttgaaccgttgatattatttttggcttctggtcttcaagttctggatatttcattgacttttgatcaaggtgtgctgtttctcggcgctg

SEQ ID NO: 8052 - DNA, 459 bp, Vitis vinifera
  Predicted polypeptide sequence is orthologous to G522
ttttttttttttttttttttttttttttttagtctggttttaaccctttatcaaataccttatttttctggttccaaaaacaatggttttaacaattagaaattctttcatagtttttttccaatcaaaaccgaaaagagtcccaagttttacactcttgccaagattaaatttcttattgcaattaaagcaataaatccatttgttacatttgtctcgtataattcttattgaatcatccatgtttattgcttctagttgagacactgttatttgctccatagaggttggttaacctaacaacaacagtaagattgtatggtcaagaggcctgtatatcaactcagaatgctcttcttagggatacccatgaaaacaacacaaatgttgttaaatatgatacttaacctgtaaaattttgtgttgcttggttgaattttcgcctcagtttaccacaaa

SEQ ID NO: 8053 - DNA, 672 bp, Vitis vinifera
  Predicted polypeptide sequence is orthologous to G525
gctggaaggcaaattctcatattacaacctccccaaagccgcaaaggatgaatgggtcgtctgtagggtattccacaagagcgcggggatcaaacgaagtcttattcctgcgccgataaggatgaactcttttggggatgatctcttggactgttcttctctaccacctcttattgaccctccttattccaaccccaacaaaaatgattcctgctttacaaatggtgaagatgaattcaagggatcatcaaccagattttcagatggaaaccaccactacccttacttctcccccaccataaacggtcatcaactgcaaaagcaacaagatcagaagagctttcttctatcccccaataacgtgcacaccacctccaactaccaagccaccctaagcaaccctacaccaaactccattttctacccccaagtttctccctcgaatcctcttttccccttccaagcatccccaactcctagttattcacactggcagatgggtagttcatttccaagctttccgggctctggcttcaaaggtagtgatccgaccagtaccgtaagagcccagacatctggcgtacagaggcaatgcaaggtggagcagttctcatccaaccagtctatggtcagcctctcgcaggacaccggactcagcactgacatgaacac

SEQ ID NO: 8054 - DNA, 763 bp, Vitis vinifera
  misc_feature (762)..(762): n is a, c, g, or t
  Predicted polypeptide sequence is orthologous to G525
ttccatgtacaatctccctaaaacaaccaagaatgagtgggtgatctgcagggtcttccagaagagctcaggtgggaagaaaacacatatttcagggctggtgagaatggacccttacggcgatgaattacgctcttcttcacagctgcctccattgacagactcttctccgttcagcagcgaaacgagaacagtcggtgactcgtctcacgtgacctgcttctccaaccaaatggaggacagaaagccccaggaggacatgattgacagcttcaacaaccctctcttagctgcctcttcttcctcctcaaacccctctgatatctccccggcttcactgcttttctccaaattccccttcccaaactcattccacactccccaaaatccactaaaccttggaaactgtcaattcccagactcctttctcatccctgaccagtccatactgaggattctccttgaaaaccagggatccgacatgaaaccatcctcgaaaacagagttctcacaggaaacagggctgagtactgatatcaacactgatatctcttcagttgtatcaacccatgaaatggttcaaaggtctttcgaagatcaaaatgatccatccacttcagctgggcctgtagacattgattgcctctggaattactgaagctgaatgataagaattatggaatcaagaagaagaagaagaagaagaagaagcagaagaagcagaacagcatggtctatagaattatagaagccaaaaaagana

SEQ ID NO: 8055 - DNA, 672 bp, Vitis vinifera
  Predicted polypeptide sequence is orthologous to G559
tttttttttttttttttttttaacgagccatataactatatatcatatataatatataacccacagttcaatattcaactaaaattaaatataaatgaaattaaatacctaagaaagaaggtcatatagatgtctagaagggataaacaaaaaaccaaagatgtcctatctgacaacagactgaaacaaggattttgaacccatactgaccctttaatacctagctgctgactggcacgttcctcatctttcgtttgaagcggggctatgatgacacatgcactttcctttgttctcagagaaagatcaaaaaaggacaaacaaaaaaccaaaggtgtccaatctccggagagattgaaacaaaattttgaacaaacactgacccttgagtgcccagccagctggtgcattcctcttctcatcattctttcacagcagaagagttggtgtctgatgcattttccttctggctcggagaagccatagatcctcggattttcagatctccagcttgttgaggctgttcctgctgcatttgttgctgctgaatctgctgttgaatctgctgctgctgctgctgcagctggtgcagttgatgctgctgaagctgatgctgcttatgagatgaatctggagctgctgaactgctgtgcagttaaagagtggcatggc

SEQ ID NO: 8056 - DNA, 902 bp, Vitis vinifera
  Predicted polypeptide sequence is orthologous to G562
ggcatctatacaggcatactatggatctggagtccctcttctggcaccacatttcaactctgcagtcccgggcagtcattttccttatccatatgtatgggctccatctcagccactgattccaccttatggggtgccctacacagcaatctactcacatggaggtgttcatgcacatcctgcagttcctcttgttgcaactccattaagcaaaaaagttccttctagatcatcagtggatatggatcaaggtgttagaaagaagtttaaaagattggatgggctggcagtacctgtaggcaatgttagcactgaggacaatgccggaggctcagtctatgaggtgtcacagagtgtgaaacatggtattgatggttctactgatggaagtgatggaaacactggagcattcctaccccagaggaatagcggttctgagggcatcctttctactgacaatgatgggaacttccataggtttgctggttccttatctgaaggagaagcatatgcagcttcccacaaggtttctgtgaactctgtggcccctacaaatgttgcaggaaaatctgtcagaccccttcatagaaatgaagaaattcatgcagcttgtgttgcttctagcactagtgcagggtctccttttgaagtctgtcaacaggatgaacggcagctgaagcgagagaggaggaaacaggctaatagagaatctgctaagaagtccaggttgaggaagcaggctgaaaatgaggaactgagaatgagatacgaaaccctgaatgaggagaataaggcactgaagtttgaaataagcaagctaacagagcatttggacaaagtgaggctagaaaatactgcattacgggagaagctgaaaaataaacagcagcttgaactgcaag

SEQ ID NO: 8057 - DNA, 744 bp, Vitis vinifera
  Predicted polypeptide sequence is orthologous to G562
cacatgggcatggggttcaatcatcacctgttgtaagcgaagcattggtacttaaattttcccttaactcttgaaatattctcttgccctgtactgcaaatatggacagaataatgtgactaagaatgcatcagtgatggacaaagcaaagttgtgtcttttagctgtgcaggtagtcacagatacatctaattaggtgctatgatgcaggctgcacctcctttgagcatagaaacacctgcaaagtcatcaggaaatacagaccgtggtttaatgaagaagttgaaagggtttgatgggcttgcaatgtccatagggaatggcagtggtgagagcaccgagggtgggtctgatcatggattatctcagagtggagaaactgaaggttccagtgatggaagtgatgggaatacagcaggggcagatcaaactagaaggaaaagaagccgggagggaacaccacctataggtggagatgggaaaactgagacacaggccacttcagctccttctgcagaggtaaatgcaggttctgataaggtgttgggtgttgctgtccctcccactagtgtcacaggaaaattggcaggagctgtactttctcctagaatgagcacagcattggagctcagaaatcctcctagtgtgaatgcaaaaactagtccgagtagcatccctcaacctggtgctatggtgatttctgacacatggatactgaatgaaagggagataaaacgtgagagg

SEQ ID NO: 8058 - DNA, 774 bp, Vitis vinifera
  Predicted polypeptide sequence is orthologous to G591, G793
tcttccttctcacggaagctgagaggccgagagctgagacttcactccaatcaaggccatctcttccatctccgaaaccctaacccaccttccgtacggttccgactcgtccgagtttgagtgatggcgagcaatccctcggaagctccagcggacgattttctcgagcaaatcctcggaattcccacctaccccgcagctgaccctaatttggctgctaatgacgtgaatttggccgctcctatggtgcttcagctcggctccggcgaaggctctggccacatcgccggcgggtaccagggaaccatgtttccgttagggttgaggttggagcagggaaagagcagctttctgaagcccgaagacgcgtctggcagtggcaagcgctttcgtgaggaggttattgatggtagagcttctaccgtgaaaaatgctttccatggtcaaccaatgcaggctaccgttgctgcagcaccacatcctcctgcaattcgcccaagggtgcgggcgagacgtggacaggccacagatccacacagcattgctgagcggttacgcagagaaagaatagcagagagaattagagcactgcaggaactagttcctagtgtcaacaagacggatagagctgcaatgcttgatgaaattgtggattatgtgaaattcctaaggctccaagtaaggtcttgagcatgagtagattgggcggagctggtgcagttgcaccacttgtaacagacattccattagcatcagtcgaggaagaagcaagtg

SEQ ID NO: 8059 - DNA, 654 bp, Vitis vinifera
  Predicted polypeptide sequence is orthologous to G591, G793
gatttcatcttgcattaaaatttcttcaaatacatcatacacatacccatccaacccttttaaattgccccacaacccactatcccaaaaagagagaaagtgtgcacccatcaatgttctggtcatccaccactaaccccaccactgatattaggagaacacatcaatttagcttttgacaaactaatcccttagaattgaccatggcaaaaacccaaaaaaaaaaaaaaaaaaatcaagtgcctgtagttttctttcctgggcatcatcataatcactcctcctttgacaaaactggaaaaaagaatagaacagtgtcaccatcgcatcttccatgattgttcttccaataaggagttagaaactagatttggagtaagatattcccaggatgggggaccaagagaagcaccataatagggttgtatgtcgatgagcatatgcatatgtgatcacatactctttgttctgatctatgagggagcatcggattcaggcttgactagtgttgatggttcaggttggtgtgtccggaagattgccgaggccagtgagataggcatgatgcaaagtgccttggactgaaggaactgcatggcagctcccacatctacttccatcagcttagctacttgttgttctgttccatctgtt

SEQ ID NO: 8060 - DNA, 810 bp, Vitis vinifera
  Predicted polypeptide sequence is orthologous to G598
ctttcgactacgagtagtcacagcgaggtgtctgtgcagagggtgaagaaggaggaggtggatgcaaagatttcagcatggcagactgcgaagatcgccaagattaataatcggtttaagagggaggacgccataatcaacggctgggagagtgaagaggttcagaaaaccacatcatggatgaagaaagtcgagaggaagctggaggagaaaagagcaagagccttagagaagatgcagaatgacgtggcaaaagcacacagaaaagcagaggaaaggagggcatcagctgaggctaagaggggaaccaaagtggctagggttcttgaactagccaacttgatgagagccgttggaagggctccagtcaagcggtccatcttttgagtcctaccatgctatatgatacttgatttctacaacatttataaatgcttcaatacaaggacacataataattgcccctaatatataagggtcccttcgtattttgaactataagggtaccctacatatatgtatatgggattggggcaatgggaactgcaggttgagtgttttgtttcttcaatggttcagttttcctcttgatgcatcatcatcgaccttgcttctcaagaccagtcacagacacactgtgattggtcacaggcggagccgggattcgcaaaccaagggcaaaagtgaaccaacttcgatgactgtgtgatgattttgaaaagggtttggtcttgtacagttgcttgtaattttgcaatggaattgtattattagcaaaaaaaaaaaaaaaaaaaaaaaaaaaaaacatgt

SEQ ID NO: 8061 - DNA, 926 bp, Vitis vinifera
  Predicted polypeptide sequence is orthologous to G653
cggggctctctctatctctctctctctttctttctctatcatcatccactacttcgcagcatccgctccctgcaaaaagcgtccaatcctctttctcccgctctcttttacgtcagcttggattttgattctccaaactgcctctgaatctttaatttctggctgttgattaagaccttcatttctgaagacctcacggatcaacgatttctggcttgtttagttttctgagcagctgagggaaaggcaaatctaagcatatatttccgaagccaatctcgcatttccgaatcggataaaaagtcggatctaaggcacgcacaattatgtctttcattggcacacaacagaaatgcaaggcgtgcctgaagactgtttatccggttgagcagttgtctgctgatggagtggtttaccataaatcgtgcttcaagtgctctcactgcaatgggacacttaagctgagcaattattcctcaatggagggtgttctttactgtaagcctcactttgagcagctctttaaggagtctggaaatttcaacaagaattttcagtcacctgcgaagtcagctgagaagttaactccagagctgacaaggtcacccagcaaagctgccagcatgttttctgggacacaagagaaatgtgcaacttgtggtaaaacagcttatccacttgagaaggtaaccgtggagagccaggcttatcacaaatcatgtttcaagtgctcccatggtggctgcccaatatccccatcaaattatgcagcccttgagggcattttgtattgcaaacaccattttgcccagcttttcaaggagaaaggaagctacaaccatctaattaagtccgcatcaatgaagcgctcagcagcctctgttcctgatgcttgaactccataacaatattttatcctctattac

SEQ ID NO: 8062 - DNA, 1106 bp, Vitis vinifera
  Predicted polypeptide sequence is orthologous to G663
ctcgatgaagagcttaggagttagaaagggtgcatggacccaagaagaggatgttctcctgaggaaatgcattgagaaatatggagaaggaaagtggcatctggttcccctccgagcagggttgaatagatgcctaaagagctgcagattgagatggctcaattatttgaagccagatatcaagagaggagagtttgcattagacgaggttgatctcatgattaggcttcacaatttgttggggaacagatggtccttgattgcgggtaggcttccagggaggactgctaatgatgtcaagaactattggcatggtcaccacctgaaaaagaaggttcagttccaggaagaagggagaaaaaaaccccaaacacattctaaaaccaaagctataaagcctcaccctcacaagttctccaaagccttgccaaggtttgaactaaaaactacagctgtggatacttttgacacacaagtaagtacttccagtaagccatcatccacgtcaccacaaccgaatgatgacatcatatggtgggaaagcctgttagctgagcatgctcaaatggatcaagaaactgacttttcggcttctggagagatgcttatcgcaagcctctggacagaagaaactgcaacacagaaaaagggaacacattctaaaaccaaagctataaaacctcaccctcacaagttctccaaagccttgccaaggtttgaactaaaaactacagctgtggatacttttgacacacaagtaagtacttccagtaagctgatccacgtcaccacaaccgaatgatgacatcatatggtgggaaagcctgttagctgagcatgctcaaatggatcaagaaactgacttttcggcttctggagagatgcttatcgcaagcctcaggacagaagaaactgcagcacagaaaaagggacccatggatggtatgattgaacaaatccagggaggtgagggtgattttccatttgatgtgggcttctgggatacacccaacacacaagtaaatcatttgatctgatttagaccattgttatcttaatgtttaagttcaaaagttgttcttgcattcaaaaaaaaaaaaaaaaaa

SEQ ID NO: 8063 - DNA, 850 bp, Vitis vinifera
  misc_feature (799)..(799): n is a, c, g, or t
  Predicted polypeptide sequence is orthologous to G666
ggacgcttgtctcccattaccaaagttgaaacgctaaggaaaagacctttgtctggaaacccttccacaactcagagagaaagaccgaagagccatggggaggccaccttgctgtgacaagatcggggtgaagaaagggccatggactcctgaagaggacatcatcttggtctcttacattcaagaacatggtccagggaattggagagcagttcctactagcacaggtctgcttagatgcagtaagagttgcaggcttagatggactaattatctccgcccgggtatcaaacgcggtaactttactgatcaggaggagaagacgataatccacctccaggctcttttgggcaatagatgggctgccatagcttcttatcttcctcaaagaacggacaatgatataaaaaattattggaacacccatttgaaaaagaagctgaagaagtttcccacaggtgtagatgaccataatcaagatgggttttcaatctccaaaggtcagtgggagagaaggcttcaaacagacatccacatggctaaacaagcgctatgtgaggctttgtccatagatacgtcaagctcgctgcctgacttgaagagctctaacggctacaaccctaacaccagacctgtccaagcatctacatatgcatccagtgctgaaaacatagccaaattgctggaaggttggatgagaaattcaccaaaatcaactcgaacgaattctgaagctactcagaactccaaaaaactccagtgaaggggcaactacaccagatgctcttgactcggattntagcttcaactcttccaactctgatctttctctgtctaatgatgggacagc

SEQ ID NO: 8064 - DNA, 661 bp, Vitis vinifera
  misc_feature (635)..(635): n is a, c, g, or t
  Predicted polypeptide sequence is orthologous to G707
cttctgcgccggtgtctgcgcttcaacagtccacaaatggaacaagctgtgcgccggcaacgtggacgaagacgtgcgagtaatgaccagaaagagcgtggacgatcccggggagccaccgggcattgtgctgagtgcagcaacctcggtctggctgccggtgtctcctcagaggctcttcgacttcctccgcgatgaacggctgaggagcgagtgggacatcctatccaacggcggacccatgcaggagatggcccatatagctaagggccaagatcatggcaactgcgtctccctactcagagccagtgcaatgaacgcgaaccagagcagtatgctgattctgcaggagacttgcatcgacgcggctgggtcgcttgtggtgtacgcgcccgttgacatccccgccatgcacgttgtgatgaacggaggagattccgcctacgtggctctcctcccatctgggttcgccatcgtccctgatgggcctggctctcgcgggcccaactctggggcccacaccaacagcggaggcccaaacagagtcagtgggtcccttctcaccgtggctttccagatccttgtgaacagtttgcctacggccaagctcacggtagagtcggtggagactgtcnacaatctcatctcctgcaccgttcag

SEQ ID NO: 8065 - DNA, 790 bp, Vitis vinifera
  Predicted polypeptide sequence is orthologous to G720
ttttttttttttttttttttttttttttttcctgaagttgattagatgtgggatttgggggaagcgaggaaaagcaacatctagattctcaaaatagacatgtaaaccaaaaaaaaaagtcccatcttcatatcatcagacgagacccctcatcttatctaaaacagccaccttccaccataacaccaccgcctccattttctctctattatttgcacaccaaccccacccccacccaccaattaaaaaacaagaaaagcctcaactagtctctatttacaaccacacatctcatttggggcgtccaattcacatgcgcggcccccttgtcaaccgtcccaccctccacctcagagatgcctttggggtcccacttttcgtctgcagccgatgcgggatatgtgtggcatggggctgattcagtagggacggggggtgttgatgtgaggggggatggtggaaatgccctggcgggagagctccgccagcacgctctcgggggccggcggtttcaggcccaatggcaggggcatccacggcttgcttattgcctccttcactaccctgtcaattacctcctctgccggataaaggtcaatagggctctggggtatgccagggttgtatattccacttccattattatgatcaaacccagatggattttgaggaaaggaagagcatggagtatgtgttggtgtcatcacagggcagccccatgcatcggcattcatccctggataaggcttccaaatccaactttctgcgggctgccatgtatgatagccag

SEQ ID NO: 8066 - DNA, 873 bp, Vitis vinifera
  Predicted polypeptide sequence is orthologous to G732
tttttttttttttttttttaagacaggaattcaactgatattattatatataaagcagagagaccaagtacatttatagttcttaagtccatattttatatggcaaccctatttttacagaccatgaactgattacccatatgcttattccttaccatcctttgatggagatttgccttttttttttttccttttttttttatatctctctctctcttgaaaacccagacgctcataaagatcagtactgaaagatatcagaagccatgatgggttgactcaaatatagcaaactcaaagggttcatgaggctgtcaggagtggtaggctcaggaagggtccagggctccccactttcaaagccaccattgcttgtattcaagaaacttatgatctcaaccagatactgcagtctgttgctgagctcagagaattgagctctgagtactgaattttcagcctcaatgttaaagtaatgctgggtggtgacattcatgcttgtgataatctggctgttctccttcctcagctgagcagcctgagccattaaatcatccaagtgcttctgcttcctcatccttgaccttcttgcagattctctattggatatcattcttttccgctttctctgatccatcaaagcctgcaaatcttcttcagaaccagagttctgaagcaaagttgaccctgaagatgtgccactggaggaagccatgaaaactcaaaaattatgcagtttgggattaattttaggttcaagcctcaagagagagatttagcaggacccagacactgattaactctagtacttaaaagataacagtatatatagctatatattaatacctaattatcagagccatttgagagcaa

SEQ ID NO: 8067 - DNA, 942 bp, Vitis vinifera
  misc_feature (866)..(866): n is a, c, g, or t
  Predicted polypeptide sequence is orthologous to G732
cggggcttctcttttcttctcttcctcccctatagatcttgggtgttctgccttaggacatctcctttatagatctgaggttctgccggttttctttcagggtgtccagcctctgttttccaaggtttgatcttggggttctggtttctagacccgaagctgggggaacctctgctgaaatcaactcttgctctgattttgatttccgggggggtttttgttcatgaatctgggtctttgatttctccatcaaaaccccatttttccatttgtttagatctggggtggtttctttctcccgatcttgatgctgaatgttttattcttaacgtttgagactcatgtctccagttgtcagtgaaatcctccgctccgggtttatgataaattcctcactcaaacgcaggacccacttagttcaatctttctctgttgtgttcctctactggttctatgttttttcatgaactgtctctgattttggcttgattttaaaatagatattagtactgtataaaaataactagtgtttgggtcctgtgtcctgtgtcttctcgatctcttagcaaagtttatagtactgctgagattgttagtgtctgtggtataaatatagtatgatggcttcttcaagtggaaactcttcaggatcaactcagcttcagaactctggttctgaagaggatctgcagcatgtgatggatcaaagaaaaaggaagagaatgctatcaaatcgggaatccgcaaggcgttcccggatgagaaaacagaagcacctggatgatctgatggcccaagttgctcagctcaggaaggaaaataacgaaatcctttcaagcatcaacatcaccaaccagcgctacttnagatttgaggctgataattcaattttgagggctcgatctatggaactgagccacagatatcagtctctcaatgaca

SEQ ID NO: 8068 - DNA, 801 bp, Vitis vinifera
  Predicted polypeptide sequence is orthologous to G748
tttttttttttttttttttttttttttttactaaagattgacataaccattactacttcaaaggcacctggaaaaatggaaaaggttcctggtttagatgtacaaatttattctacaacacttggagtggttcttcctagaatctctccttcctctgcctctctgtcacatatagttatgtacataaacatttactgatcagaaaacaatctaagctacaaggcaaaacacctattcatgctgttacaggaaagataaaagttaccatgcaaactcatcaaagacggcttcactctcctacaaaagtaaatatggatgaactcttctctggtcttcctctgacttggggctactacattgaagctgctaagtcatctggaaactatgggaaaagggcagtgcaaatttgttatcagggagagtttgcagcaaggtaaactccatcacatcaaatcacatcccactgccactgtagtagataatttacaatgcaatttaggctctctcatggaagttgagtgatctggacaaggctgcagggttggcttgcaacaccggagacatttcagctatgcgctttttctcgtcaccctttgattgaaaggccttcaagagacttcccccattactcccatcattcttaatcccaagtgttgtccatatagagctcttagcagcttcattgggatcgtcaatcctcagtgtctttggaatccaaacacctctttctggattgttctctttctggtgatcttctttccctgggttggctggattaaggacctctccatccctggcccc

SEQ ID NO: 8069 - DNA, 949 bp, Vitis vinifera
  misc_feature (894)..(894): n is a, c, g, or t
  misc_feature (896)..(896): n is a, c, g, or t
  Predicted polypeptide sequence is orthologous to G748
cttagtatcagggaacagaagagatgtgctgagatgcgaactgtcaattgcggaggaaatggggaggagccatcctcatgtgcatcttcagtgtcggctcctagtttcccagaaaatgagtttcctgaaaatgttgggcataaggaccaacctagtttgcctgcatctcgtagtgagattcatccacaacttcatcagccctgttaccctgttcctccatgggctttcccttggaatccaggttggaccaatgtagctcctgtagcaccacctcagtgctcgtctgacactgtttatgctccgaacaacagtaatccaaattcagttcagtggtgctccagaccaatgctggcagttcctggcttttgtgcaccaaccatacctctacagcttgtgcctccctcatattggggttgcatgcccatctggggtgcaggagcagggaacatctccttggctggatccaatgactgcctgtctccctcatcctccacgagcaacagttgttcaggcaacgcctcaccaacactaggcaagcattccagagatgcacaaccagcagaggaacagaagctagagaagtgtgttttggttccaaagactctcagaattattgacccagatgaggcttcaaagagttctatctgggctacattaggcattaagcctgaccagaaagcacccatatcaaaaggcggtattttcaaagcatttgaacccaagtctggagccaagaccgatctatcagatgccactcaggtactagaagcaaaccctgcagctctgtctcgctcccaaacattcaaagaaagtacgtaaagccgatgttgaatacagtcgttgcttgaagaacttgtctctctgcaatctttccatgcatatttgctatctagngnatattgcttcagctttgagttgctggatcagtcatggaacccatttgtataat

SEQ ID NO: 8070 - DNA, 860 bp, Vitis vinifera
  Predicted polypeptide sequence is orthologous to G783
cccctcgagttttttttttttttttttttttagacaactaggatttaagcttcatttttcactagattgatacaacaacgaggctctgaagacaatgctgtcttgatcatcatgcaatatgttgaatgaagagaggcacttttaaggttcattgacaaagggggcctagcacattattgaacatttacataaatgaatgtctattctgaatctatgaagtaaagcagggtaatatccagtggtgttgcggtaaccttacacatagacagcctttagtctcccctgctgctggttccagagctagtgccactaccaacctcatgttgctcgggtgtcttcagctgactatctagaatttgtgatggccaacagtctgatggggatggatagcgagcatggggtctgctcacatttgaggctgcagcattgggttgcgggaatgtttgaaggtcctgatgtaagggaacaacaaagacgggacccacaacaggtgctgtttgcgatgcatgatcagttacaggaaacatgagatggtcttctggtagctgtggggcagtgctgttgtgatccaactgagaaggatctgaattccatgctggtttggaccgaatcctttcttctagctcgctctgcagcttcttgatctgagcttctagagctgaattgtcctctctcagctcgttcttctccatactcacatagtgagattcagataaaagagctgcattatcccttttgagacagtcaacctgagcaagcaggtctcttagaagacgagtggcatcagtcaatacacaggcctttccattgttctgctgagctgagtcaagaatgttgcccagctcaggaataggacattc

SEQ ID NO: 8071 - DNA, 822 bp, Vitis vinifera
  Predicted polypeptide sequence is orthologous to G8
tttttttttttttttttttttttttttggaatgaaacgaaatggagtgcttcaagtagaagtaccaggtacactgttatgatcagtttacatggcttcatattaaacagaaaacaagcacagaaacgactctctaattggttttgctttccagcagggtcacttcctaagcagaaagaggggaaaaaaattatcaaaactgcatctgttgacttgagctcccaaaattgtagaagcaacttgtactgttggtggtggatgtggttggtggggagatttgtggaggaggctgcagggcaggattaatgttcctgggatttaatagtggaagagttgcagagggaccaatggtggagcaagaagggaatcctgatgatgctgcagtagacaacagtgggattgggatattgacaccatggccatacacttgccttgcccagtttgagaatcttggtgaagaaaccccttccaaccttttctccagggctgtttcctcgtgaattggtaagaaactagtgcatatgccggatatcatgggaaggtgcttggatactgtggttagactatggcggggttgtccaccaactagtgtgtaagtggagccctcaaccatggatctcctcccaactgcgtcatttcccctaggaccatcgggagggaaagaaagcccaaggttcaaatcaagattgtgcccactgcttctgtcattggcctctaagattgccccttctccataggaacttgatacaaagatcgggaccgcttcccttccatcgtatcgatcagcagctttgtcatatgcccttgcggcttctatttcgct

SEQ ID NO: 8072 - DNA, 745 bp, Vitis vinifera
  Predicted polypeptide sequence is orthologous to G8
ttttttttttttttttttgaagttcaaacaaggcaaaaatatctaaattggctcatcccactcaggctaaagcaccctggtttaacaggcttcataaaagagaaggatcaatctaatgtctcatatctacaaccacacttcaaaattagaatatatgaattcatttaccaatcttagtttgctttgcttgcctacccacctgctttcaatgcaaatgagaagatattgaattgtggctgtttctgctggtagcttgtttcagctcctgcagtagtagtaaggggatatactggtggtgttggggagtgatggagagtaatagtgctggagaactgttgtactctgtaagctgccttgagtgggattagctggtgaagcagttgtaaccgaagacaagaatcctgatgatgctgcagtagagaagagaggtggagtagccccaccataagggccatgaatttgccatgcccagtttggcaagtgatcaacttcaatcctcttctctattgctctttccttatagataggaaagacacgagaattttcaccactccagataggagggtgatcagatgccattaccaggccatatgatggatgaacccccagtgttgctgaagtagagttctcaatcctttctcccctgtcatcaggcatggcatcgtggccctgctgggaaggagaaccatttgctttgctgttcctcactggatcatcagacattggttcatcagaaaaatatgga

SEQ ID NO: 8073 - DNA, 665 bp, Vitis vinifera
  Predicted polypeptide sequence is orthologous to G811
ggaaaggttgatccagatagatgggagttcgccaacgagtggttccttcgtggccagaggcaattgctcaagaacatcgtcaggaagaagcatagctcttgtggtaggagttcgtttttgctacaggcgaagctggaagatggtgtgaggaaatattggcggagattgagaggctgaagcacgagcagaagtcccttgaggaggagcttgaggggatgaccaagaggttggaagcaactgagagacgtccacagcaaatgatggcgtttctctacaaagttgtggaagacccagagcttattccgacaatgatgatggagaaagagaggaggaggcaattgggcgagaagaagaggcgtcttctgatccaatcgacatcgtcttcctcaggcaccgctgggacggcttcagtgaagtcggaagaggaagaagacggcagcactgtaggtataatttcatcgccggagactctgagccactcctcgccgtcgccggacacaagcactccggcgtgggtgaggccaaggcagatgatgggttggcctctcgtcgcccaacagccttaccctttggctgccattcccagtcccatatattccgggtctgtgaccggaataggacatttcaacacgatgtcgccgccgcctgaaaacaccatttctagc

SEQ ID NO: 8074 - DNA, 732 bp, Vitis vinifera
  Predicted polypeptide sequence is orthologous to G896
ttttttttttttttttttttttttttttttattttttttttttttttttttttttttttttataaactatctagttgatttcctcacaaaaactaagttggaagtaaatcaaatcttaacttaacctcatgatatataacctggtatcaaaacatatgatctgcaaaaaaataactcaagctgacaatcatattaggaaggggaattccaaagccatgcctaatgtttcccatgattgcaaaaaaatacaacaatagtttactgacaaaaaggattgggggcaatggcttttctcagtaactgtacacttaaacaagccacaggatggagcattgagcaattgagctctctgagtcaaaggatgaaaggctttgagtacacgtcaaatggttcgttggcagttagttggggttcctgcctcaacccaccactaaaactctgtcctgtcaaaagcatggggaaaaaaaatgtcacaacaccacccccaaaattgtctgtattacggatggttgatcgcattgaatttagcatgttcccatatgtagttgcatttccaacctctattgcttggatgaaaaaataagtcattgcacctgttgaagtgatctttgataaagccgacgtatcagcaaaggtttgattatcatcacagccactaaaggaaatgacctccccaccacttgttcctttccatatacctgatggggggcgatgatcctcccatacatactg

SEQ ID NO: 8075 - DNA, 719 bp, Vitis vinifera
  misc_feature (13)..(13): n is a, c, g, or t
  Predicted polypeptide sequence is orthologous to G904
agctggttgaagnatatgtagacaggttgtcttcgacggcgtcgttgtcaatctcctcacgtgcgctatcgttccggagctccggcaggtttttcaccggaagcagtcgccgcaatgaaactgccagcgtcggcgagtgggatttggaggcgaatcgggttggagaagagataagcgaaatgtttcggtggttttcggggatataatggtaatttcggtccatagctagggtattttctgattcattttcagccaattttcctcctacctctgtagataaaaaaaacaaaaagcagggataatttggtaaaaagaattagctccagttgcatcctgaccgttcatcagagcagaggtggacggcacagattgaattgaggtagcatttgtcagaaaattcataaaaatgctgccatcctccaccaccagtgaggataaaattgtagaaaattgcatttttgagatgaaaaaaagtatattattaaatttggatggagctgtaacgggaaagaagaaagacggtgggtgtgttcactgttcatttgggacctgtgatttggtaggccacgacagacggaattaaatggcctctcttcatttatggaaatcaacaaccttcttctacggttctacctcgcttttcatcgcattctccaggtcgcgtcttctttcttcttcttcttctcctcctctgtgatcaattccgttacgttttcact

SEQ ID NO: 8076 - DNA, 846 bp, Vitis vinifera
  misc_feature (764)..(764): n is a, c, g, or t
  misc_feature (804)..(804): n is a, c, g, or t
  Predicted polypeptide sequence is orthologous to G921
tctttccaccttcttccaccttagcatccatctcatcagcaatgtaattcgaatttattgatacttctcttggtttggacctcaagcctaatcctcctgcgaacagccttggcgacttctctcctaagagaggagattgtgtggatgtggatgtggaaaggaaaccctctccagtattgaaagaagacactggtggtttggtagaagagttgcgtaggatgagcactgagaacaagaagctaactgaaatgctatcaatcatgtgtgagaattacaatgctttgcacaatcacttgaaggaattgatgagaaagaactctgatcatcagctctttaattcaaggaagaggaaggctgaaagtgaggataatatcaataatattcatgggagtagtggaaataatactgagagtatctctagtgatgaagattcaagtaagaagccaagagaaagcaccaagggaaaggtctctagagttgttgtaaagaccgagaagtctgacaatagcctgcttctgaaggacggataccaatggagaaagtatgggcagaaggtcagcagagataacccttctcccagagcctacttcaagtgctcctttgccccaacctgccctgtcaaaaagaaggtgcaaagaagtgctgaagatcagtctcttctgatagccacttatgagggggagcataaccaccagcaaccttcaccagttgaggtgtcattaggcttcaaccgagctgccactcctgcttcagtcctcagcccnagctccatgatctctccacgcccaacagtaactctgatcntgatccaacctggattagctaacaacactgccaaaaattcag

SEQ ID NO: 8077 - DNA, 437 bp, Vitis vinifera
  Predicted polypeptide sequence is orthologous to G921
tttttttttttttttttttaaaactttatgtaaaaatctaagtaaaacagtagaatagttacaacgtcttggcctgtctccatgtccacatgccctaaacctgaaacctaatttgatgcaaattttcaatccaagcctaatcctaattttcctatgctctaaagttttcaacccaagccgcccctttaggcttgggtgggtcagtcagattcgatatgttcaacttggaaactgctgaattcaaccgtcttaacattggacttgggctgcaagtgcttcaaacctttttcttccccgtcttcgatctctatatttacatacactttgaagcttctgaaagtcaccatttttcagtttgattatggtggaaaattcttcctgaaatggcggctgcaagtgcagccttgaagcttggatctttggtcaacgaaaaggcc

SEQ ID NO: 8078 - DNA, 715 bp, Vitis vinifera
  Predicted polypeptide sequence is orthologous to G937
agaggagtctcctcctctgcacccaatcttcaacccaatttacggaccggaccacagccaccacagcagcagaccgcccggaagcaaagaagatgttggtcacctgagctgcatcgacggtttgtcaatgccttgcagcaacttgggggctcacaagctgccaccccaaagcagattagagaactcatgcaggttgatggcctcaccaatgatgaagtgaagagtcatttgcagaaatacagacttcatactcgaagaatgccgactacctcggctgcccctccttccaatcaacctgttgtagtattgggaagtctgtggatgccccaagatcagtatggtgactcctcaaaggcgagtagttctcagtctgcttccccccaaggtcccctccagttaggcggagctgctggagggacctcaactacaggtggggacagcatggaagatgatgaagatgagaaatctgagagctatggctggaaaagtcaagttcacaaatctgtaaaagaggatgtatagaactcatcccccatgaattttgcagataaaaatagacatgggagggtaaatgactataaaaataatacagtatacgttaagacaatggatcttgagagagagaatgtgaaattttgcaggattagcttcaaaaaaaaaaaaaaaaaaaaaaaaaaaaaaaaaaaagagatcaaaaaaaaaaaaaaaaaaaaaa

SEQ ID NO: 8079 - DNA, 653 bp, Vitis vinifera
  Predicted polypeptide sequence is orthologous to G937
tttttttttttttttttaaatgcaagacagagaactttattatagaaaaggattatcatgtcagcttcctccagtcctccaacaaagggaagagatacaaagcctcaatgaaaaggtgagaagactcaaactgtctaaagaacctgcaaaatctaaccctctcttctaagagatgggtgcctcaaaaagacttcagaatgttagtttcgctctctgtatattatgtttttttttttctaatgtcacagtacgattccccatgtatatttgtatctgcaaaattcatggtgggatcagtgcatgactatacgtcatcttctcctggcttgtgaagctgatctttccaactgtggccctcggatttatcatcttcatcgtactccatgctgtctcctccagtacctgatacacctttagcagacccagctaaatggagtgggccttgtggagagccggactgggaaatgtttttctttgagacgtctccaacctgaacttggggcacccatgatccatttgcaggagcagctgaagtggatgggatcctccggacgtgaagtctgtatttctgtaaatggctttttacttcatcgttagtgagaccttccacttgcatgagttctcgaatctgtttaggagtggcttgagatccc

SEQ ID NO: 8080 - DNA, 838 bp, Vitis vinifera
  Predicted polypeptide sequence is orthologous to G962
aatctgatttttagtttctgcttgtattatcaatgttattaaatagaacaagtatggaaaattggaaggagatctctcacctatgttagatttttttgatcagtgcctatgttagatttgatcacacactgccattatttagagtcaagtggtcatgctactgatgtaaactaagagagatgtaatgctcttgaacatttcatagattttaccattaagattggtgcatatgctagatatgcatatggcacacaggccaaataaatggctggtttcaatattatatatgccttcatcagtgttattcaaggtgttcgcctgggtcgccttggtgaccatgcaatggaaagtatggggcagtcccctgttgtagacccaggtgaggcatcttcaaacactagctacctagggaatctcctcaacaaagactccaaggtgataggatccgtgcccttctgaagccgaggtgacatagttatttttagatattggtgcctcaatatggaggctccctatattcgaaaacaatatatcattgtgttagatacatctctcataatgttatgtcttgtcttattagaaaactaaacaatcggaagttattagtagttagaacttcctgtctaccagctggagtaaattagaatataaattgtgaacaagattattattattattattattatcatttttatttgaactagttcaatgctttgtatgttaaagaacaaaaatttattactattgattgttgaatgattatcatgatgatgacgctgaagatgacattatatcttttttagcatctccgcaaaaagataaaaaaaaaaaaaaaaaa

SEQ ID NO: 8081 - DNA, 687 bp, Vitis vinifera
  Predicted polypeptide sequence is orthologous to G976
ctcgaatatggctcggcacgtacccgacgcctgaaatggcggctaccgcctatgatgtagcagcgctggccttaaaaggcactgatgccaccttgaattttcccaactccgttctgtcataccctatcccaaagtccacctccgctagcgatatacgcgcggcggcagcgagggccgctgaggctcagcaagcaaagcccgagagttcggagagcccaaaccccacccaacctaaaaaggaggagacaacagaatccagtagcttggcagcgggggaggatcaattcattgacgaagaggagcttctgaacatgcctaatctattggtggacatggccgagggaatgctggttagcccgcctagactcaagtcccaaccctccgacgattccccggagaattcagacagtgatagtctatggagctacacataatcaaagccagaaaggtggagaagcagaaccatcatcaccatcatcatcatcttcaggtaaaagaattaatatggtaaattttccactttgtttgtgagatttgtttttggatttccttttctttttccaacattgatgttgggttccgaagctgatcgggttgcagagatcccagttactaacctgtaagaaagcgtgtactgtacagctaccattaatgtgactagtgcttatatatctcaatgtcataact

SEQ ID NO: 8082 - DNA, 631 bp, Vitis vinifera
  Predicted polypeptide sequence is orthologous to G976
gccgggagagtaatagtgataaatacttctatccctcataaaccccacactctataatatatggctcatagtcatgccacatgacatgcgccaagtagactaaccttgtccagcctatcttctccaatctccatccacacgtgccaaaaccaaaaacccaaaaaagaaaagaaaaaaaaattccaactccggataccaccacgatatggcgtccgcctccgccgggggctcagccaaacagccctcccctgggagacacccaatgtataggggaatcaggagtcggagtggcaaatgggtgtctgagatcagggagccacgtaagactacgcggatatggcttgggacgtttccgaccgctgagatggctgctgctgcctatgatgttgccgccttagccttaaaagggacagaggcggttctcaacttcccggactttgttcactcgtacccggttccggcatcagggtcaccatcagatattcgtagtgcagcagctgctgctgctgcgttgaagaaagcgcagacagacgatggctctgcagcacacagcaggcgtgaagatgatgggaggttcgatgttcatactaatactaatactacgtccgagggaggaattgtggacgaggag

SEQ ID NO: 8083 - DNA, 492 bp, Vitis vinifera
  Predicted polypeptide sequence is orthologous to G979
ttttttttttttttttttttttttgaacagaaacttgctcacttcaggtaataaaggataaaaaaggaaaacaaaatacaaaaacaactgcatgcaggagtcaactcccctcttccttatgcctgccctttttggaagaaaaaaaaaggaaagaaagaaaaagccaactacattttgaagcttcccatcaacctccaattcatgcatgctcccaaacaacccccttcacatagagtaagtacaagaagccaaggtagttgttgaggcaggagatgctgaatcacaacctgaagaagaagaagaagatgaggacaagccattctcctttacaccattttctgcactattacactcttcctcattgcctgcagccccttcaaacatgtagtcaatgttgtcctcaaaccccttctcataaaacaaatccgacaactccccaccctttccgaggggcacgtccgggactaggagggtgctgtaggcacagaagtt

SEQ ID NO: 8084 - DNA, 733 bp, Pinus taeda
  Predicted polypeptide sequence is orthologous to G1006, G22, G28
gggagagtattccgatcgactggggattcgacgattccgtcgctccgtctatgacctcttccttatccactgcctcaacgaagctcccgttatgtgaaaacgattcggaaaacatgattctgtgcggttaccacaatgaagggatgcccccaacgcccaaggaggagccggtgacggaaataaagaaggaagagagcttttccgtcaaacgggaggaggatgtccgtcaagaaacggtagccgcgatgccgaatccgaagaagaatgtggggaggcattacaggggcgtaaggcgaaggccgtgggggaaatttgcggcggagataagggactctgcgcgcaatggcgccagagtgtggctcggcactttcactacggcggaggaagctgcgctcgcatatgaccgtgccgcttacaagatgaggggatctagagctttgcttaacttccccctccaggttgtgggggaggacagtgatatatttaataccatgcggaggttagaaaaggcggagagtagtggtgagaatgagaatgaattgagtgggaagaagaagagggaacgtgaggaagcgagtgaagaagttgagtgggatagagaatgtcgaatgagagtggaagatgaggtgtgttggggtatgatgattaatgagcttctacgtggaacaccaccacttacaccatctgccattttcacgagcttcgacggtctcctctcccctcggcaacttat

SEQ ID NO: 8085 - DNA, 731 bp, Pinus taeda
  Predicted polypeptide sequence is orthologous to G1006, G22, G28
agtggcagcggcgttcataatagtatcaatgatcatgattatgatgatacggagaccaatggcatagccaccatgggatcctgccaaaatatcaacagcaaatcaatatcggaaggcaatgaaaatgaatttagacaacaagattgcgcttcttgttattcttattctttcaaggtgaagccacaagaagacgagaatggcgcgatgaaccagatctggggtaggcattacagaggagtaaggcggcggccctgggggaaattcgcagcagagatcagagatccctccagaaagggttccagaatttggctcggcactttcgacaccgccgaagaagctgctctcgcatatgaccgcgctgctttcagtatccgtggagccaaggctctggttaacttccccctcgctgttgcgccgaattcagagaaaggctcgccagtgggtcacatggaacgtaagagaaagagaagaagttgttagagtgttaacctggaaagaaatctcaatacgtagatctgttatgtgtcgattgtttgggatttttcgattgtaaaatccaaaaatatctagaaattaatgattagaaaagagtcatttgcaatgaaatgaaaatggggagtaatctaaagcgccatgaatcaacgagtgtgtatggaaaaattaacagttgcttctgattccttcccattctcatctcattattatctatcaataaatatattactgtgcag

SEQ ID NO: 8086 - DNA, 924 bp, Pinus taeda
  misc_feature (192)..(192): n is a, c, g, or t
  Predicted polypeptide sequence is orthologous to G1006, G22, G28
tcgcagcggagataagggactctgcaaggcagggggctagagtttggctcggcaccttcaataccgcggaggaggcggctttcgcctatgaccgtgctgcttacaagatgcggggttctaaggccttgcttaatttcccgctacaggttgcttcagggagcgataagacatgtagcagtgtagagaagccanagagtaatggcgagaattttcttcaacatctcaccaccaggaagagggaacccagtgccagtgctgaagtcgactctggcagagagtgtcgggtgaaattggaagaaattacgagggagaacgacatgatgtcgaaggatatggtggatgagcttttatatgggagaatgacaacaccgccactcacacctagtggaatcgacatgagcttctccaatttcctctgccctggacaacttatggtcaactgaggttgtccattcactttctctacaatttataattatttcaatttttttaaatccccactgttgatcttgatctcgatcttctccatggtatggattccatgctccacataagtatttcgtttaagtactctactaaagaaaataatacagaaatgcatgtgaaaaaagatctgtaatcaatggctagatttcttggccaattatgatttttcagtatgcaagcgccgaaatgaggagtgaggaggagatcactttcagggcctattcagcaaattgtccaagagacagtgaggaggaaatgcaaatttgtaattcgagaagagtctgttcgtttgacatcggatgtatcattgacctggtttcggtttgttccgtcaaagccaaatcttgctacagaacatttgtgtgtaattcttaaagacaattcttaaagttgacccttattaatctcagtgatatcctaccgtcattctattttttt

SEQ ID NO: 8087 - DNA, 900 bp, Pinus taeda
  Predicted polypeptide sequence is orthologous to G1006, G22, G28
gcgcggcggcaccaggttttcccgtccggtgctctccatcaccgttccgcggagggaatacttcgagtgggagaggcgttccgctagctggggcgcggattcaaggaattttgtgaccgcctgttgcccggcgtccatcagacggtgcctttcctgcgactgggggaagcttccgttagatgaaaacgattcgcaggacatgtttctatatggggttctcaaggaggcgacgcagaagggttggacgccgttaactccaaaggaaatcaagaacacagacgtcaaacagataaatcctcggcaggagacggcgcgtgaggtgtcggaaaaggaccagaagagcgggggaaggcatttccggggtgtgagacggcggccgtggggtaaatatgcggcggagataagggactctgcgcggcagggatctagagtgtggctcggtaccttcgacacggcggaggaagccgcctttgcatatgatcgcgccgcttacaagatgaggggcactaaggccttgctcaattttccccttgatttggttgctaagtccatggattccctcagtgaggatgagagttgctgtagaaagaggaaattgaatgggcaagcacagaggggagaagaaaagaggcaccaccatgggccgaatttcgaagagtgtggggtggaatctcaggaatcgatcgtggtggaggatggagagcagaagagatttagacgatgaatgaatattcgtgagcgtggggtggattctgaagagaaccgatcgcggtggaggatgcagagcaaaagtggtttactctatgaacggatattcctcatttggctgagggattcggtgaaagtgacttgtaaatattatgaatatttcatataaagttatctacactaattctttct

SEQ ID NO: 8088 - DNA, 915 bp, Pinus taeda
  Predicted polypeptide sequence is orthologous to G1006, G22, G28
aggcatttgatttcaaactacgaaaatggcaatgaacagcacacagcaatgtcaagaaccacaacaatatgcagaaatgagccatttacttgaagatttagacggcctatatgaagaatcgtccctctgtgcgatgatgagaaatagcccgtttgataccagcagaaactcgagccctgaagtagagagcttcatccagagcgcactcgcaggcaattccgtcgacgacaacagaggggaaacggagatggagacggaaatgccgactccggccgttaagccctcgcgtccctccttatccgtctccgttccccgacgtgaatctttcgactgggagaaattctctgtcggccgaggattcagaaatgtcgccagcgttacacctccgtgtgtcagcccttgcttatccgctgcctgggcgaagcttcctttaaatgaaaacgattcggaggacatggttctgtacgggatgctcaaagaggccgccaacaagggatggatgcctgtaacgcccaaggaggagacggcgatggaaacgaagaaggaagccgaagtttttcccgtcaagaaagaggccgaagtctttcccgtcaagaaagaggccgatgtccgtcaagaaacgcgaacacagcagccggtggcgaagaagaagattgtgggcaggcattacaggggcgtgcggcagagaccgtgggggaaattcgctgcggagataagggactctgcacggcaaggggctagagtttggctcggcaccttcaataccgcggaggagggcggcggtcgcctatgaccgtgccgcttacaagatgcggggttctaaggctttgcttaatttcccgctccaagttgcttcagggagcaataacacatgtagcagtgtagagaagccaaagagtaatggcgaagattttc

SEQ ID NO: 8089 - DNA, 807 bp, Pinus taeda
  Predicted polypeptide sequence is orthologous to G1006, G22, G28
acagcagggcagagcctaagcatgaacatgttggagttgattcgccaccatttgctggaagtggaggacgaaatggatattatgcatctgtatcacccaggaggaaatgatccatcctcttcatcgtcttcagtatcttcctccagagtcagctcggaatatctccatggcactgccgccgccacagcaagtggttcatgccaaaacagatcaccatcagaagacaatgagagttcacaatactcttctgcttctacttctgtatccacagtcacaagaagaacagaggcggtaaatataaatgtgaagccacagccacgggaggagcagagtgtggaaaagaacaatcaaattcactacagaggagtgaggaagaggacatggggtaaattcgcagctgaaatcagggaccccgccaagcagggggccagggtttggctcggcactttcgtcaccgccgaggaggccgcactcgcatatgaccgggccgccttcagaatccgcggagccaaggccgtccttaacttcccccttgctttcgcttccatttcagagaatggatcggccgtaggtcacatggggaacaaaaggaagagagggagaggagaaacaaacgaggagtgggcggcatgtgatcgggggagctcagttagttgagcagaagctgaaggtattcattatgatttgatcattttattattatgatcctgaaaatgtatgactgagattgaatttgtaataatccaacaattttgtgaaaatctatctccattatcctctgcgagtacacattgcaagattgtggtg

SEQ ID NO: 8090 - DNA, 691 bp, Pinus taeda
  Predicted polypeptide sequence is orthologous to G1006, G22, G28
gaaaaatatttataaacaacaatacaataaaagtcatctatcatttaactgcacttgccgactagagtaattacaatttctctaacgttctgaatcaacatagaacgggaaatcaagcaacttggagcgggaaattaagcaaggccttagaaccccgtatcttgtaagcggcacggtcataagcgagagccgcctcctccgcggtattgaaggtgccaagccaaactctagccttctgccgtgcagagtcccttatctccgctgcgaactttcccaacggccgctgccgctgccgctgccgcacgcccctgtaatggctaccaacgttcttcttcttcgccaccggctgctgtgtttgcgtttcatgacggacatcggcctctttcttgacgggaaaagcgtcggcttccttttttgtttccatcgccgtctcctccttgtgcgttacaggcatccatccctcgttgccggtctttttgagaatcacgcacaagaccatgtcctccgaatcgttttcgtttaacggcagctttgaccaggcggcggataagcaagggctcacagacggaggtgtgacgccgagggaatttctgcatcccccgccgactgagaatttttcccagcccatagattcgagtcgcggaacggatacggagagcaagggacggaacggctcaacggccgttgtcgg

SEQ ID NO: 8091 - DNA, 877 bp, Pinus taeda
  Predicted polypeptide sequence is orthologous to G1033
gagagttctttactcgggcagaggcagcgagcaaaactttcaataccagtgttacacgcctcggctactgccttctcagatcttgttcatatattgtgaagatgaagggtacaaaggccaaggttgaacagaagcaagtggcagagaagaaagctgcaaagcggaagcctgcgaccgaggcccaagctaaacggcaaatgaagaaggacaagaaagcgaagaaggacccaaacaagccaaaaaggcctcccagtgctttctttgtattcttagatgagttccgaaaggaatacaagaaatcaaaccctaacgcgaattcagtttccgccgtcgggaaagcaggaggagaaaaatggagggcaatgagcgatggggataaggctccatatgtggctaaagctgaaaagaagaaggctgaatatgaaaagtcaatgtcttcatataataagcaaaaggatgccagccctgaagaagtagctgaagagtctgacaaatcaaagtcagaagtcaatgatgaagaagaggatgaaagtggagaggaggatgatgaagatgatgatgatgagtgataaaatggtgttgactaactcgcaactcgctagactaggcatgtaatattataggatgatcttctgatcaacttaacttctgaattagattgttattgcctttttgacactcctagttttgcacaatttgggagtagtctgatcaatgtttggcagattaattctgttatctttttagcaggattttcgttaatcgtgttatgaaacgtttcataccaaaggatacattttgtaggtcatctgttatgttaatgggaaaggaacatttgtatattttctatcccatctatttttgtattggacatgtc

SEQ ID NO: 8092 - DNA, 909 bp, Pinus taeda
  Predicted polypeptide sequence is orthologous to G1033
acgcggggactcgcttctttgttattatctcaacattgttcgcttgtttttctatcgaggaaaattgcgaggcgagatttgtgtagctgcgttttactctgttacagacgatcgtctgaggctccaaactcacgcgttgctaaagcaagtgctttcttcaatgaagggagctaaagcaaaaaacgaagcgtctagcacgctgaagaaaattgaagacaagcctattggaaagcgaaaagctgcaaccaaggaagtgaagccaactagtaagaaggagaaaaaggggggcaaggctgccaaggatcccaacaagccaaagagacctgcgagtgccttcttcgtatttatggaagagtttaggaaaacctacaaggaaaagaatcctaatgtcaaatctgtatcagttgttggaaaagctggaggtgacaaatggaagtcaatgtcagaagccgataaggctccatatgttgccaaggctgcaaaaaggaaaacagagtatgaaaagaacatggcagcatataacaacaaacaaaccagcactgcaggtgacagtgctgaagagtcagataagtccaagtccgaggtaaatgacgaggatgatgatgaaagtggagaggatgacgatcaagagtagatatttcgaagccttggttgcccgaaatggtcctgtatcagttctgggctgacttggaaaaaaattgtaacctgactaattagctactggtagatgattttgttatttcctaccttcttttatagcgggcatacatgaaagggatttggtcactcaagtgtatgtcttgagtatctccatgtgtagttattcatgaacatgctattgacagctgtggtcatgttattgatgtctttaaaaacatgatcatgtaatcgtagataaagtgtttttgt

SEQ ID NO: 8093 - DNA, 812 bp, Pinus taeda
  Predicted polypeptide sequence is orthologous to G1033
cggccgggggtatgcagacaatacatgattagctgatcggggatcagaaggttcccatgtctgtaggaaaggtcgaattctgagagcccaagcacatgccagaagtgaagaagaacgaagataagcagacaggcaaagggaaagggaaaatcaagggcaaaggcaaaggcaatgacaaaagcaaaggcaaaggcaggcagaaacagcagcataaagagagagagaagaaaaccaaaacggaaaaggaccccaacctacccaagaagccagccactgccttcttctattatatggaggaatttcggaaaacctaccaaaaggagaatcccggagtcacaggaatgagagaaattggtattgcttgtggcatcaaatggaaagaactgacatatgaggagaaggccccatattatgatatagcaacacaaaagcgagcagagtatgagaaaattctggcagcatacagaaagaagaaggaggctggtgaggaagttgaggcacatgaggcgctgggcaaaacaaattcagtgataaatgatggcaaggaaggtggagaggaggtaggcgaggaagttgaggctcatcagggaccagacaaaacaaattcagagataaatgatgacaaggaaggtggaaaggaagctggtgaggaagttgaggtacatggagagcaggaggatatggaatgatactacatgcctgaggtgcacttttcatatggaacttgtagagtcagataggggcacataatcgatgctggagagagtcctggctaaaaattcttgagaatacctttaatgaatagctacagt

SEQ ID NO: 8094 - DNA, 926 bp, Pinus taeda
  Predicted polypeptide sequence is orthologous to G1033
cggccggggggtcatccatcttgctcatttctacttccgcctcctcttctcttccctcgtctagtgttttctttgcgttgtgtagtgtaatgtttgctgttgcttcatatcaatagtggtggaattttccttcactgcgagcagattttctaaggagaagccgacacaggaggaggaggagcaaagttcgtctgcatccaatttccagaacgatgaaggatgcaaaggctaagaggactgcagccaaggagactaagaataaaaatgttgaagccaagaagaagcttctcagtgtcaaagagaaaccaaacaagaagcaggccaaacccaaagcagtaaaggacccaaatcaacctaagaggccaccaactgccttttttgtatatctggaggagttccgtaaaactttcaaacaaaagcatcctgatgtcaaaggagttacagctgttggcaaagcttgtggtgacaaatggaaagaattgagcgaagctgaaaaggctccatacattgctaaagctgcacaaaagcgagctgaatacgatgtaaccatgaaagcatacaagaagaaacaggaaggtgtccaaagtgccacacctgaggaatctgaaaaatcaaagtctgagctcaatgaagatgatgaggacgacgaaagtggggaggacgatgatgaataaccgaacactctgttgaagaactgaattttgcgtggggaattatggttttcaagctttgacaagagttttgttttagtttgagatcagaagatttaccagcagatatataccaaatatttcattgctcattttgtatagcagatgatatcaagaagtttattgagctcattttgttgcagaagttgctgctaaagcttattgttattatactgttattttgtcttttaatttaatcctttcaactcatcacgc

SEQ ID NO: 8095 - DNA, 795 bp, Pinus taeda
  Predicted polypeptide sequence is orthologous to G1053
tttgtcttccatgctgttttgatttccttcccagctagttcccgatattttgattgaattttgcccttttcatagcttggtagagatgcagtcagaacaggtcctgctgccctccggtcccatggtctccaatggcagcttccacatgggtactgttgatacaagagggggccaggattttctaagcagagaatgctatgaatccctcctgaatttcaataatttcatgctgtatcctcctcccactctcaataccaatagcagccctgaggtctgcaaaccctccccgaaggggcgttacattcgtcaagattccattgcttccaccagccaatctgctcagacggcctgcaattctgcctctgatgaagccgaggagcagcagactgtgatgatagacgagcggaagaagaggcgcatgttgtccaatagggaatccgcccggcgctcccgcatgagaaaacagaaacacctggacgagctccgcgctcaggttgcgcacatgaggtctgagaacaggcaaattctcagcagtttcgacatcctgactcagcgctatagccaggccttggaagataatcgcctcttgaaggtccaggccatggaattgtcccaacagcttcaccagttccagcaagccatagcagcatctcagtcatcggcagctccaaactttgcactcaacgccttgcaggcttctcatcgtcataataataacaataacattattagcatagatgatgcagtggataacaacacaaacagtttaactcagtgccctgacatcctgctctg

SEQ ID NO: 8096 - DNA, 810 bp, Pinus taeda
  Predicted polypeptide sequence is orthologous to G1062
ctgtgcattcatagaataaatattctacaggctgcactgtaatttaggcgagaaatcgaataaaatatacatttgtttgtttacgatggagttggcagatgagcattccatcctccgctataagaaacccaagctctccaagaatgtcgtttccgagcgccgccgaaggcagaaaatgaacaagcttctctacactctgagggctctggttcccaatatttccaagatggacaaggcatcgattttagcggacgccatcgaatatgtggagaagctgaagcaacaggtggagagagctgagtctgacgttcaatccaccaacgtctcggcgctatcggcagatccccgggttgaggaaaccgattctttagcagtgagtttagacgctgccaacagatatggatccgatcgcaagtaccatgtccaggttgaggtccgcctggaagaaagcattgtggaggttcgaatccggtgcaagcaggaacacggaattcttttccatcttactcgggctctggaaacgctcccttttcagctcaaaaacttcaccttcagcactttgaacgaataccttcttctcctcaacgttgtgttgcaggtcgatcacggattccctgctatgagcgattacggactgaagcaatcaattgaggacagttttgggaagcagggcctcattctcacttcaggaaattccaacggccatttgtggcaggagttgaaataaacaaccctaatactggatacttcaaaattcactggttacagctgcctgggacctcttttatcgtatcagccaataagctggta

SEQ ID NO: 8097 - DNA, 772 bp, Pinus taeda
  Predicted polypeptide sequence is orthologous to G1062
tgatgggtgggtcgaagtcggcaggcaaaattaattatcttcaggctgcatccaagaatttgtatactgaaagaaagcgaaggaagaaattgaacgacactctttatacactgcgttctgtggttcctaagatcagcaagatggacaaacagtctataataggggacgctatcagctacgtgttagatctgcaaaagacgatccgagagattgagagtgaaatcgaaggtctgcgcagctcaagcaagggtgcccatactcaaacgattccacagactgtcaaccatctagcaaatgctgagttggtaaaacggtccgtcgaatccagtgataccaagaaatcgatggataaattgaaacatgcaaaagtactgcaagttgaaatttgcaacggaggggaaggtggaatatatcatgtgcgaatagagggcaaaaaagagactggtggtttggtgaagctcacgcgcgccctagaatctctacctctgcagatcatgaattcaaacatctgctgcttcgatgaagccattcactactccctcactgtcaacgtgaagtcattgggaaatgtaaacacggccaaattggaggacatgattcgaaaaacgacaaccagtgattgcttcgaataaatcaagtcaaattcgtgttgtatgggaggatcgggagattagggtttatgataatttttagtatagagtcctgtgtttccagatgtgccgacccgtatcgcaatatagctttttgacatgaaaatactttttgtaaagtt

SEQ ID NO: 8098 - DNA, 496 bp, Pinus taeda
  Predicted polypeptide sequence is orthologous to G1067
agcgtggtcgcggccgaggtacgcggggttcattgctctggtctccgagagcggctccttcctccggtgtccgccatagacctttctggttcattcttccgccgttgttacagctaccgtcacgcaacctgctgatggtggagagcttgttggtgtcttccttcggcgcgttcattaacaggttgttgctggcaggtacaggcgagtttcatgacgatcgagggtgcaaagatggtgcggagtttttctgccacacttgacctaaccaggaatattgctaaacctattgtcgaaggcgtatgacagagttctccttttgctacatgatttaccctgggacctgatgtttagttacggctcttagggttataggttattctgagggttagtttcatgagccgagctggatctcgtgcaactctgattctgttatgattgttcaatcttcagttgacttgtatataatggaatcggtcacaatgattacagtttgatt

SEQ ID NO: 8099 - DNA, 576 bp, Pinus taeda
  Predicted polypeptide sequence is orthologous to G1076
cagtcatcggcacagacgcccccagacagctataagatatcgaaccgtggaaccgtccatccaaggacacgactgcgctagccgtgggcggccgtcgcggggaaaccttgctcacagttccgcttccgccgaaaatgcagattcctcgctgccgctgacgagcgaatatcgccatgctttcccctacgctgcaccagtgggcgatctgatacttgctacgccaaaatctctcaacccttcgccgatcctaacatttactttcaaaatctttgccgcctcaagttacgccttactagttctatctccgagcctgatcgagccgcccaatcgaatcggtttcgtattcgattctggcatagcataaaggtggtcaaaattaccttcccggtcgctgcagatctttctcagaaacagaaaagaagatccccaagagctagaaatcaaccctagttaaaaagaacggacgggacaaaaccagtgcgtcgatggccatgtgggtggatgagaaagccacattctatggcggcttttcaaaggcagtctctgtttgtgagagtgggtttggaaaccaactaa

SEQ ID NO: 8100 - DNA, 926 bp, Pinus taeda
  Predicted polypeptide sequence is orthologous to G1076
tggacggcgagatgagtcggaggcctcgcgggaggccgccggggtccaagaacaagccgaaaccccccacaattgtccaccaggagagccccaacgccctcagagctcacgttctggagatcgccaacggctgcgacgtcgcggagagcttggcgaatttcgcgcgcaggcggcagcggggaatctgcattctcagcggaagtgggactgtgaacaacgttaccctgcgtcaaccgggcgcggctaacgcagtcgcgacgttgcacggaaggttcgaaatcttgtcactgtgtgggtcgtttctgcccaccactgagctctccggggctacggttcttacgatttatgttgcggttggacagggacaagtggtgggagggagcgtcgtgggcgccctggtggcctccggccctatcgtggtcatcgctgccacattccgtaactgcccttacgagcgactgcccctagatgaggacgaggaaccgttgcctatgccgctccaccctcccggagggccactttcccagccatcaaccctaacggcggcgcagcagcagcagttaccagatccgccaagcatgcccatcttcaacattcccccaaatctgctccctaacggtcagctccctcctgatctctacccctggccacagcatacccgtacccaatattaacaaaagtaaacctttcttccgctttgtgccagggccacttgctcactgcccctccagcagatcagctcattcataaatttcgtacaatatcatgtgtacaaatgatacacagacttgtaaagtgttttattctgtttagggagagttagatcccatttgtgggattgcttctgctcatcttcgttcactttcatcatcaaggagaagaaaaacaatggagcatttcaggtctgctgtaatagacttgtaaag

SEQ ID NO: 8101 - DNA, 917 bp, Pinus taeda
  Predicted polypeptide sequence is orthologous to G1076
gttattaaatagttgtaaaggagttcgctgctggagctctaatggagatttgagagatttgaggatacggatatatatatagatgggtccagccagttattttgagagataaaataccatttgttgagtgtcgcttgacagggagagacaggggttttgttttgttttttatttatataattttataaggctgatgctgtgatggctgaatttgaagcagcagggggaggagttacaggaggaatttcttctcatgcacactttcagcgagaatgccagacttctgaagaagaggaaagccgcagcagtgatttaggcggtggaggagtgggccgagggagatcacagacacagatcattcagtcctcctctggtggtggcggtggtggaggagccgagggaggttccgggactgtggaggttgcccggaagccgaggggtcgcccgcctggttcaaagaataagccgaagcctcccattatcataacccgggacaacgaaaatgctatgagacctcacgtcctggagatcaccgcgggctgcgatgtggcggagagtgttctgcagtttgtgcggcggaagcagatcgggctctgcgtcatgagcggaagcggcacggtcgcctccgtgacccttcggcaacccaccgtgcccggcgcgccgctaactttccgcggccggttggagatattgtccctctccggcatgtatgtgccggctcccgcggcttcttcttcgtccccgagctctctgtccgggggactgactataagcctcgccggggcacaggggcaggtcgtcggaggaagtgtggccggcgagcttaccgcggccggaccggttaccatcattgcctcttcttttacgaatccctcatatcaccgcctgcccgcagaactggacgaagaaaacgccgg

SEQ ID NO: 8102 - DNA, 827 bp, Pinus taeda
  Predicted polypeptide sequence is orthologous to G1076
caggccgccgggatcaaagaacaaagtgaaacaccccatgattgtccacaaggagagtgccagctgcctcaaagctcacatactggagattgccaacgggtgcgatgtagcggagagcttggcaacattcgcacgcaggcgacaaagggcagtctgcattctcagcgggagcggaacggtgcacaacgtcacgctgcggcaaccgggcacggcgggcacgatcgtgaatttggagggacgcttcgagatgttatccctgtcggggtcattcctgccaacggtcgagccctccggttctacggggcttacaatttatctcgtgggcggacagggacaagtggtgggagggagtgtcgtgggcgccctgatggcctccggccctatcgtggtaattgctgccatattctgtgacgccccttttgagcagctgcccctagacaacgacgaggagctgatgtcgctgcagctccaccctccccaaggactttcccaatcatcaactctggcgccggcgggggcgcagcagatgcccgatccatctaccatggccctcttcagcattcccccaaatctgctctccaacggtcaactgcctcatgacctctacgcctgggcgcaggatacccgtatgccatattaaagaaagtaccctttcttcttgtttgtcccaaggtcactgtcctcagctttatccataattttgtgtacaaattgtattgatcagagtttcaggtatacaaattatactcggagatgtaagcgaataattttttcactttaagttagacctgatattggcctcgagccgaattcggcacgaggcctcg

SEQ ID NO: 8103 - DNA, 855 bp, Pinus taeda
  Predicted polypeptide sequence is orthologous to G1089
cttgcatacattttgaacaactgcaaaaagaaatgtgctggtaagcatacttgcaacaaaatctatatctagagtcgcttgaaaaagtctatgatcttcttgaagatatcaaagatcgacacttgagaattgtccttggttgcagaatttgaatttccatagtggctgcctgtataagacgagccagagtggctgcctgtataagacgaaccagagtggctgcctatataagatgaaccaggccgagatactccttgagatggccatgaacctgctgaaggaaaagaagaataacgaggaacaggatcagggtcaggatgatgggtgttccaggaagaagagttgctcgtagattcgcgacccaagaaagatttacaaggggaaggtggtgaaacagtagtggggaacctagcagtattaaatatgctacttctcaccctccctctcacgcgagggtaatagagagggctgcaatagtctcgctccaattgggcatccaaattcatgaaaaacattcgagacctctctgagtaactagaacttacaatgttcactgtaacttgctggactctggctctcctgaatacccagagacgcctgttgtctaagctccagagggtaccattgtgtctcacaacgttcatggggggaaacacagtggctgcaaggagtcccttctgtaattgttccactgcatcatctattctcagaaaatcatacggttgtctgaacttaatggctatggagtcctgagtaaatctcagatcatctgggcttgcaatgagcgccaacatccttacaacttccaagtcttcttcaacaccagggcctcgtgccgaattcggcacgaaggaa

SEQ ID NO: 8104 - DNA, 953 bp, Pinus taeda
  Predicted polypeptide sequence is orthologous to G1089
tcttatttccctctgtatctatgaatcttattgttatatgttcttctggtgctacaggatgaaccctgtaacatgcatttatagtgctctgtagtgttctccaaccggtcggcttttctttaaagtgatagacacagtagttgttgttgtttgtggggttgagaagttacaagagaaaaatatgatgatgaatagcttcgatctgggggggtgctgcctcgcgcgctatggggctgcaacttcctatttcgcttccaagacggagcagatactgtccaaatatcgcccaatcgcgcccaagcctgtcgttcagaacactgctgggcttccggacgcagtgcaaaaccaacagccgcaaccctgcccgtcgtcgtttcgagcctctgcccgctcccgtaagagaaattgggaagccgcctccgcctccggagctgctgtaccttcgccgccgccgccgccaccgcgaccgcataagagagctgccaggggccgcgccggtgccccggacgtgcatttcgacggagggcacaaccgtctggagcgaagcagtgctaagagtaccgttatatcgccggctctgcgccactctgatacgagcgaggaagccgtttcgccgcgcggtgaaatctctgactccgcggccagcaagtgcttcgcctacacggcggccccgtcattcgggtattcttcttcctcggctgcctcctcttcttctttcgactcggcttttacgcagaaaagcaatggctctctcgagaaaggcacggatgctgccttcatggagcgggccgctgccagtgcgtctccgagtgttaatcttagcctccgagagcggaagtcgcccacgcagatcgccgttgcttctgaaagcatgcagccatgaccatggttggccgagagccctttgccagtgctgtgttagattccccgttgctcataatccccgaagcaga

SEQ ID NO: 8105 - DNA, 942 bp, Pinus taeda
  Predicted polypeptide sequence is orthologous to G1089
gccgcagaatagttcctgggatttcttcgacgacatgctctcgtacaccaaccccgaaccccaaccctccgttgaagaaccggagcaccacgaccacgatcacaaccacgatcacggccgcgaccgcgaccgcgctcacgtttacgccgacatcaagaaaaaccagcaaaaccaccacagagacgatgagaccgccaccgataccgacaccgacacccctcaagccgggatggctgaagattctcccgtcaagatgccggaaaagtctgccgcggccatggaaaacaaaatttccgacagaaaggccaaccacatgcagctgtcagtccctcccgacagagggggagctaaaggcggtggaaaggaactcttgaaggtcttagctgaacttgatgatcacttcctttcggcttccgagagcggttatgaggtctcaaagatgctggaagccaatcgcttgcattatcactcaaatttcgcagataataaaggtacaattaatcattcagaacaggtaatgcgcgttataacatggaacagctcatttaaaggcccatatggctcagaagatgggaatgatgatgtgcagggtaaggagaaggagacccatgcctctgtattggacaaactattagcatgggaaaacaaactttatgatgaagtgaaggccggtgaacttatgaaaatagagtatcagaaaaagattgcatcgctgaataaacaaaagaagagagggaggaattcagaagcactagaaaaaactaaagctgctgtaaagtatctccacacaagatacatggttgactttcaagctatggactcaacatcttcagaaatacagaggcttcgtgatgaacaattatacccaaatcttgtggaacttgttgaggggatggaaaaaatgtggaaaagcatgtacgattgccattgttaccaggagaa

SEQ ID NO: 8106 - DNA, 734 bp, Pinus taeda
  misc_feature (634)..(634): n is a, c, g, or t
  misc_feature (636)..(637): n is a, c, g, or t
  misc_feature (647)..(647): n is a, c, g, or t
  misc_feature (673)..(679): n is a, c, g, or t
  misc_feature (701)..(704): n is a, c, g, or t
  misc_feature (710)..(713): n is a, c, g, or t
  misc_feature (722)..(723): n is a, c, g, or t
  misc_feature (726)..(726): n is a, c, g, or t
  misc_feature (729)..(733): n is a, c, g, or t
  Predicted polypeptide sequence is orthologous to G1113
gtattgtttgtttcaatgacttcgtgtcgcgagatcgagtgcgcccgctagctaaatgtggccatgttttccatatggagtgtttggataagtggatcgactatgagaactacagttgccctctgtgtagatctcccctcttctagacacaggttggaatcgtcatcaatgattagaagtctactgattgctgttaattgttaatgtaagtctagcaggattggttctcgtttcttctttctttagttttttatggacattttgctgggcaaatggaaaatgtctttttaataaaatgtattgtggatttcctgacctcttaatctttgttctggactttggtgacaaagcaatttgctatctagagaaagtcattatcttttatttattttcagaaatctttttataaacaaagattgtgcaattaggctacttatctagacgattagttttattgggcaagattaggctgcgaatttgtggtagatatgtgacagtttatcacaattagctcaggttcaaatctcctcccttattccagtatataagctttatcaggtcgagtcttaggagctgtggttttttccgtcaagtggaatctgatttccttatctagaaactttcatcttcaaangnnatgaatatgntcccgtgttaaagatgtatatcaagnnnnnnntcggctcgaaactgctcacgcnnnntccggnnnntcccctgtnnttnctnnnnng

SEQ ID NO: 8107 - DNA, 773 bp, Pinus taeda
  Predicted polypeptide sequence is orthologous to G1113
cggccgggaggagtccctcaattagtgctcaaccttgtgtttgtcttggaattgagcaggcttctggccaactggcttctgtcccctttctggctatcagatcatcaatatggcgttcctctggatcagcccctcgccaattggcccatcactcctttaactaatcctgctagtcttcgttattccggcctcatcttctccgcttctcttgcgccttctgcccctgtttcccccaaccctgcataccctgaccagcagagcgttcgtgagaatttgcccgccgtcttcgactatgggagtctcagtgctgatcgccaggaggtggttgtctgtattgtttgtttcaatgacttcgtgtcgcgggatcgagtgcgccggctagctaaatgtggccatgttttccatatggagtgtttggataagtggatcgactatgagaactacagttgccctctgtgtagatctcccctcttctagccggctagctaaatgtggccatgttttccatatggagtgtttggatgagtggattgactatgagaactacagttgccctctgtgtagatctcccctcttctagccggctagctaaatgtggccatgttttccatatggagtgtttggatgagtggatcgactatgagaactacagttgccctctgtgtagatctcccctcttctagacacaggttggaatcatcattatcaatgattagaagtttactgattgccgttagttgttaatttaagtctagcatgatagattctatgtg

SEQ ID NO: 8108 - DNA, 862 bp, Pinus taeda
  Predicted polypeptide sequence is orthologous to G1133, G1137
gagatttatgtgactgtctgcatctaagtgcactattctttgtacttccctcagtcagcatgctaacagcactcaatgcacggatattcttgttattacattcattctcctcggtatttttgcaattcttggtttggatgtccacttcctgggtcagagtgaccagaagagagtcatcaaacaaaaaacagttgtcatttatgctagactcgccaactgattcttcaataatagcaggtccaaagtctgctacctcttctttatgtccctgttgattgctacctgttttcttggctgatatcccagcaatagtatcatccctaacttttgtacatgcctttttatttccactatattcacctggtgagtgaccagtgctactctcctgaccattgctgctctcctcttcatcagaactcaacagagcatctaaatctgcagtgttttcatgtagctgagtctgagaatctccagagtttcctttgcttaatacatcacagctcacacgaattgcaccttcattttcaacgacaggacaatcaataaactcacccccatagctgtccagggctgtcatgcacaattgactcattcccatatttggcatagttgtaaaagatgagggaatactgtccctgtaccatggcaaattaacatcccagaggcctgatgttcctgcagccagtacttcagaaattgtgtttttctccatggccatgttttcagggttagtctctttatttaccttgccattgccgggcaacatctccgaaaagctctgtactagtgcagggtgaaaagtaaacccacatctgttcatattatagtcacacatgaacatatttttgtaataatcaggtgc

SEQ ID NO: 8109 - DNA, 860 bp, Pinus taeda
  Predicted polypeptide sequence is orthologous to G1140
tggcggatttttgtttttgtttttgcccttgctgtctacgatttgtatgttaatcgcgcgagatctttcctgttgttgtaaatctcagtttggagtgacatggcccgcgagaaaatagaaattaagagaatagctaacgcgcccgccaggcaggtcacgttttcgaagagaaggagggggttgtttaaaaaagctcaagagctgtcgattctatgtgaagccgatgtagccctcgtcgttttttcttccaccgggaagctctacgactattccagttcaagcatgaagatgattttggacaagtatagtttatatccaactacgaatcaaaaggaaggacagccgaatcttgagcctgaaactcaagatatccgaaggataaaacaacaaattgaagagattactcagacattgagaaatatgcatggcgaggaacttgaagaattatctctaaatgagttgcaacaactcgaagaacaacttgaaatggggttaagtcacgtccgatcaaaaaagggtgaaaatattgttaaagaaataaatgcacttcaacaaaagggaatacgaatcatagaggagaatacgaaactccgtcgagagctaaaggaaggatatctcaggcatgtagaaaataatgatgcagaggagtctctcttaattgaaccattggaaaatcaggatcctcagtcatctgaatcaataactacttatgcttttaatttcaaattacataaatcggccatgaaagactatgaggattctgacacctccttgcagctggggttatcttcgcagtctaaattttgagactctcgcaacgtcatcttgagtgattatatttcaaaaggtccttcatattt

SEQ ID NO: 8110 - DNA, 844 bp, Pinus taeda
  Predicted polypeptide sequence is orthologous to G1146
tgttaacacccaaaaacgaggttcagagatttttgacgatctgtattgggaaaaagatgatgaacagggccgcaaacaaacaggaggcattttcaaggagttattgtcttcatttcaagagcgatgtaacacaaagccagagcgaattttatattacagggatggtgtcagtgatggccaatttgaaatggttttgaacaatgaattgggagcattgaaaaaggccattgaagctcttggctggactgatcaatcccaaacatcacaagctgaggaaccctcgcagaagagggttagaataggcaagtcaccgaaggttacattcattgtggtgcaaaagcgtcaccacacacgcttttttccaaatactgagaagagatgtccaactcttaaaaatggaaaccttctaccgggaactgttgtagactcggtcatatgccaacctaaaatatttgacttttatctctgtagccatgctggaataaagggcactagtaagccagctcactacaatgtactccaggatgagaatggcttcaccccaaatgatattcaacgattgactaatgacctgtgcttcacgtatgcaaggtgcacccggtctgtatcaattgtgcctgcatgttattacgcccacttagctgcaaaacgtgctcgtgtgtggcttgattcggggattagttctgagagtgggtctttccatggtagaagcgtatctggcatgagtactggctcaggaactcaaattctgtcagggacatttacgaagccattgcctcctgtacatggccgcattaagaactctatgtttttatataatcgggcattatttctatgactaggg

SEQ ID NO: 8111 - DNA, 900 bp, Pinus taeda
  Predicted polypeptide sequence is orthologous to G1146
tttacagagatggagtaagcgagggccagttttatcaagttctgttgtatgagttagatgctattcgaaaggcctgtgcatctctagaaccaaattatcaacctccagttacttttgtggtggttcaaaaacgtcaccatactagactctttgcaaacaaccatcaagatcgaaatgcgacagacaggagtggaaacatattgccaggcactgtagtggattccaaaatttgccatccaacagaatttgacttttacctctgcagccatgctggtattcagggaactagtaggcctgcccattatcatgttctttgggatgaaaacaaattcacagctgatggattgcagtccttaactaacaatctctgttacacatatgcgaggtgcacacggtcagtttctatagtacccccagcgtattatgcccatctggctgcatttcgggctcggttttatatggagccagaaacatcagatagtggttccttatctagtggtgttcctggtagtcgcatgactgcagctagttcaggttctcggagcactcgtgtacctgcaggaacgagtgttcggcccttgccagctttgaaagaaaatgtcaagagagttatgttttactgttagatttgatacatagatgtttgacatttttaagttctatatatgccatccctttgttgggtaggcattgagtgacgggccaggtgcatcactacgatgctttcaaattgcaaagttctagatttccaaaacttaagatcacactcaatcattacgatgctttcaaattgcaaagttctagatttccaaaacttaagaacacactcaatcacttccttttcacctcttgtactgtttgacattttttaattggctgcgggcatttagatgaagagac

SEQ ID NO: 8112 - DNA, 894 bp, Pinus taeda
  Predicted polypeptide sequence is orthologous to G1146
attagcaatgtaatcaggcctgcattttttgacatggtctgccaagcaacactgggtccaaacaccaaactccaactcgcataacctctttacagtagcataaaggtgcttgttctcttgttggggcattatgcagaggataagctcaagagggttaccattccgctccgctgagtctatcacatgttttacaactccctcaacattcccattgatctctgttgccggtggtgctgccaaatcagggttcatacgcacaccatatgtattgcacaattctggaagtttgctagaaaaagtttgaactgcttgaggtggaacatatttagaaaaatttatcactgcccaggaacttattttggcacccctccatatgacctttcctctcatattccatgaaccttctcttggattttcttcataagccttgtacattatctttggtggaggtaagaccctcccggggacttctgtcatcaacgtgttgatttgaatgccaaattcggcagcatctttggcagttgaatctctcaattgtcctccaatcactttagttctctcccttcggtcttggggatgtaaacaagttagatttaataaaccacttcgttgttgttcggttagaactttgatataaggctgatccatttgaatccgacaaagctcgatgggaatatatttctttttctctttagtaccggcttcgatcgccggaaagccccgcaatcggagagtcagcttgtactgttgttggaaatagtcgacaatagagagttgctctccattgctatcaaaacttaaaacctccaaaggcctatcagtcaaacctttaattcgataactatgcctgatatgaatagtttcgacacgaagacctttaagcaacctttcaac

SEQ ID NO: 8113 - DNA, 717 bp, Pinus taeda
  Predicted polypeptide sequence is orthologous to G1146
gcacgaggcggagaaatcgcttgttcattggattggacttgtctcactctcatgctggaccatcggctcaaagcggcaaaccaattccgtcagttattggcatgtcttacactgtcgatgagaaattgtctatgaccggtcactacttcttccgcactccaaacaagacgatcattactgatttggctgaagagtttgagactcccattttggagtacaaagagcgctcaaagtcgaagcaatggccatctcacatcttcatctatcgatctggcgtttctgaaggcgagtactcccaagttgctcgtgttgaaaaaactgctttgttgaagtgttttgatggacttgcaagcaaacattctgatttcaagaaacctggtttcacttttgtcatcgctcaacgtaacagtggcttcaagttgactcctactcaagctccagcaccgaatccacgtggcaagatcaatgatgccgaccgcaatttgaaacccggaactcttgtcagcaaaggtgttgttaatccgtctttggaacagttcatcttgatcgctcatcgtacaattcagggaactgctcgtccgattctttacactgttgttgctgatgaagacagtcaaggaagtggaaagcgaattccggctgatgagttgaaatacttgacttttgccctctgccacttgcacaacaatgtcttgggaactgtcaatgttccatccg

SEQ ID NO: 8114 - DNA, 841 bp, Pinus taeda
  Predicted polypeptide sequence is orthologous to G1150
cggccgggtagaaaacatcattaagaacttcacatcttccttggtgagaaggcgtggagagataggagtggccatgaatccgtctcctttcatttcggaatctaagcccatggtccagttcaatgatatgaaggcccttcaacaaactttgttgggtgtgcaggtaaaagccaaaggggagttacaaattttaataattgctatggaggagaaacatccagggtataatactctgaagcttattgcagaaacagatgtcgaattggtgacgcagtgttgtttgtttgatcatgtcaaaaaatgctcagatcgggcaacacaatctcaggcatcacaatatctggctaatttggcattgaagataaatgccaaagtggggggaagtaacgcggcgcttcttcatagcttgtctcgccagttaccgagatttggcagcgaccatgtcatgtacattggcgcagatgtaaatcatcctggatcgggggatagtacgagtccttccattgctgcagtggttggaagcatcaactggccctggtgcaatcgctatagtgcgagagtcagctatcagagtcacagggtggaacacatccaacaactcgaggagatgtctaaggaattactggacgattatttcaaagcaaacaagaagctgcctgataggatactcttcttcagagatggtgtgagtgagagtcaattcgatatggttctcaaccaagaattagaagccctcagagaagcagtagcccacttcaaaaactacaatcctcctgtttccttcatagtagctcagaagagacatcacaccagactgtttctttggtgatggagagcaacg

SEQ ID NO: 8115 - DNA, 797 bp, Pinus taeda
  Predicted polypeptide sequence is orthologous to G1198, G1806, G558
agcaaagaaagtagactgagaaagaaggcttatgtccagcagttagagtccagccgcatgaagctcagtcagcttgagcaagatcttcaacgagcaagaacacagggtgttttccttggggcgggattcgttgctgatcaaggtcacccaggtttgagtccaggtgctgctatgttcgacatggaatattcacggtggctggaggaaaaccatggccgaatgtgtgagctgagggcagcattgcaggcccacataccggacaacgatctacgcccgctgctagacaactgcctgcgcctctatgacgaaatattccggttgaagagcattgcagccaagacagatgtgttccacctggtttcagggatgtggaaaacgcctgcagagcggtgtttcatgtggatgggaggattccgtccctcagaacttctcaagatcctggttccacagctggagcccttgaccgagccgcagtttgtgggcatttgtaacttacagcagtcttcacagcaagctgaggaggctcttctacaaggaatggagactctccaacagtctctgtctgaaaccataatatctggaactctgacctcaccttcaaacgccggtaattacatggaacaaatggccattgccatgggcaaactcgccaacctagagggctttgtgcgccaggcagacaatttgagactgcagacattgcaccaacttcaccgaatactcactattcgccaagctgcgagatgctttatcgccattggggaatactttagtcgacttcgagcattgagctccct

SEQ ID NO: 8116 - DNA, 895 bp, Pinus taeda
  Predicted polypeptide sequence is orthologous to G1198, G1806, G558
tctggtttcgggatgtggaagaccccagcagaacgctgtttcatgtggatgggaggcttccggccatcagaaattctcaagatcctcattccacagatagaaccattgacagaacaacagtaccaatgcatttatagtctgcagcagtcgtcactccaagccgaagaagccttttctcagggcatggaagagcttcaacacactatttccgagaccatagctgcaggatccctcagctcaccttcaaacatggccaactacatggggcaaatggctgtggccatgggaaaacttgccaatttagaaattttggtaagccaggctgatagtctgagacaccagacattgcaacaactacacagaatcctcaccacgcgccagtcagccaaatgcttgctttcaataggagaatacaactctcgacttcgtgcactaagctctctttggtcagccagacccagagaatgagtattaatcactttgcagatcatcatttggataattaattaggttgggtccatagttttttcatcataatttgtactgcatggctaatttcctaccatggaatcagctccaattttagaattagaattcatacaacattgtgcattattaattcgatttatgctctgagatcagagtctcctgctcatcacgttaactttcaccattgatgatcatgatctgtgacttttagacacctgcatgctactaatcaggcttgcagatagtgaattcttagtgatagttttagacacctgcatgctactaatcaggcttgcagatagtgaattcttagtgatggtttacacaaaaatagtttttgaaattactggttgaaacttgactactgcaaaaagcttgaaacaccgagatacttttgtacatattt

SEQ ID NO: 8117 - DNA, 844 bp, Pinus taeda
  Predicted polypeptide sequence is orthologous to G1198, G1806, G558
gaggcctcgtgccgaattcggtacgaggttttttttttccatgataaattatattatagctgcaatgcatagaattctgaagaaattacactcatataattcatataatgatcaacttactgttacaacctagagaagagtgtcaatctatccacagctctctatcaattccgaccaccagcacctcctttgtaaactgaatcagccacctaaattttacatgtaaagtccagatggtcatgtgtacaataaattactgaatgaagcagagttgcaactcttcaaaattcagagcagcaagtcactttctgcacatttctgctgaatatgttactataaagatatctgtcgcatcttctttcttcctcactcttacaggtcaatctcttcatgtcttaactgcaagtactttggaaaatataccatcggcttttgccaagcatgtccttcaaaccaagttcagcaggttcaaatcccttgctgaatcagctgaagattaacaataaaagataatcataactttacgctggttcacgaggacgtgctgcccagagagaactgagcgctcgaaggcggctaaaataatcccccatagcaagaagaccccttgcagcttgacgagttgtaagaatgcgagacatctgctgcagcgtctgctggcgtagattgtctgcctgatgcacaaagttctcgagcattcctagcttgcccatcgccattgccatatgccccatataattagccacattcgatgcacccagtgaacctgctgccaaagtctctgcaagtgactgctgaagcgcctccatgccttgtgacatgcatcctctgcctgctgtgatga

SEQ ID NO: 8118 - DNA, 803 bp, Pinus taeda
  Predicted polypeptide sequence is orthologous to G1198, G1806, G558
cggccggggattccctgtcgcgaaaatcggaaatctgaaatctctgttaaggcacagaagaaacacagaggcagggcaggatcaagatttcaagtgagggtagagggcgcatggcaattggcagaatatctgtacgctcttcttcacgcgcttattcagacgccttttccccgtctccagtattcatatttatgtacatgcatagccatcttgggttagcttctcatctgcaacacatatgaattcacagtacgcacagtatattgcttaaagtagcaaccagccagctcaccatctattcatcaactggatacctcgggtgattccttcaggacacaaaatagtccacaaactggaacctccaaaagtatggaagcagatgtgaaggtggataatatgtcagaagatgtaaatcagctaacgcttgcaagatcaaaaaggtctgaccaagaagcaaaccaacctaacaacaaggtcttgagacgacttgctcaaaaccgtgaagcagcaaggaaaagtcgtttgcgaaagaaggcttatgtacaacagcttgaatctagtcgaataaagctgaaacaaattgaacaagagcttgagcgagtgaagcaacagggaatttccatcaatggacatttgggcgatcataatggatcaggggctgctgcatttggtatggaatatgggcgttgggttgaagaacaaaacagacaagcccgtgagctcaggggcttctttacaagcacacctgacagatagcgaacttcgtgttctggtggataatgctatagctcattatgatgaac

SEQ ID NO: 8119 - DNA, 765 bp, Pinus taeda
  Predicted polypeptide sequence is orthologous to G1246
catgggatatcgtcactctacagacttgggtgcaggtcgtcatgaacctaagcatcatcaccgcctcgttgccatccctcggtaaagtcatgtgggatctatgggcgttcggctcgagtcttcgagcaagtcgatccgtcaaaagcagcaaaacctccaaggattttggacacgagctcggcttcgagacaagcccgccacagtacgagcaccatgaaaagggaggtctcaatcaacccggccccgtcatctatgcacccgagaaggacgccgacgacgacagctggagcgagcaaatccttcataaagtccgcgagataggcagcgtcgagtcttacgatgcagtcattgaccattacgagaagtcacagcatcacaacgacgagaaacagcagctgcaggagcaagaacaacaacaacaacatcaccaatttcgatatggtcctcccccaccatcatcctcacattctttatcccgcgctcctgcaccagcatacaccccgtccggaagacggtaccaccactaccgccgaccagacgtattgtcgcccgtgattgagcgatcgccgtacattgacggtacgccgacaccgaagatgccctcttcaccttcgcagcattggggaattttccaacaccaacatcaacaacaacagcagcaacagcagcaacaccaacaacatcacgacgacgacctcctaaaaccccatactctcctcgcttggactcgcccaaaacgccctcatacgccgctagttcgcacta

SEQ ID NO: 8120 - DNA, 839 bp, Pinus taeda
  Predicted polypeptide sequence is orthologous to G1246
cggccgggggacttacgggtgagcgattcatgtgatgtgaagctcctcctcaatttcgtgcagctaaactagattcattccaagttctgtgtaaattatttattggttgtgacatcaaatacgcggagaactagttcatagctcccaagcgatggatgtggctggaaataggatttccgcgcggtccgattggaggatttcttgaaagatacggtctcttcagtcggagacggatatggcgacagacgttgtgttcacatgttgaatccctgctgattcggctacagatttcattctttggctttgcatttgcagtcttatggttttacaggaaaacggttgagtgtattggggtatcttggcgtatgacattgcttctttaaagtgtttgagttggagttccatcggaaggacatataaatatttctttgaagtatccgcagttggaaatccatagaagagacacactgttctttttttggagttaaagctacataggagagataaatcttcagagtatacttaaagacagaagggatgtatttttcagtgttgttttgactggtccaaactgaaaagaactcgatccatggtttttttcatctttgatgacttaaactatagtttatcgcatgtttttggagttttgacaaaaagccttctgcaagtatttcgttatcaaagtataaatttactgcacgactgtgttgaaatctttcgttatcctgaacagttacgtcgggatggtgatgtttagggataattgaaaagtcgtcatttattgatcttcaatgaagttgtgacagccttcaatacaccgacggactgtattcttctta

SEQ ID NO: 8121 - DNA, 804 bp, Pinus taeda
  Predicted polypeptide sequence is orthologous to G1272
tttgactgttcaatctgactggggcttccatttccaataggccttcttgaactcctttcgtcatcaataacaacaatgcattcaatgttgttacttttaataggcccaacggtaaacaaactcttctctccatcataagcaaaatctttgctacccagttcagtctcaccatatatttctttgactttatccataatcctcctgcacaagatcttactgacaacctctttttcgttactgttaccgttgaccccattaaccccacgttcaccagtgattttaacatcgtagtgaaatgagtcttggagatttgaaaagcctactctgaagtgattgcagagtaacttgacaggtctaccagctcgaccttgtccaggtcgtttagttagaacacgaggagcctctgggggcttctgtgccatctggggaggcagtgggggtgggggtggcagaacttcaacgggctcagtggagaaaggcccagattgtgttgccatttggggaggatttgggggaggcggtggcagaacttccccgggctgactagaaggccctggcagaacttccccgggctgactagaagaaggccctgctccatcgcccatgcctaacatatcctcggaatccattacgaaacctcaaagccagagaacagcagtatcactcctcagagccgaagacgagcgttcctccaacctcagagccagggaagagcgttcctccaaccccagagagaacactacagcaactgcaaacactgtaaccactggaaacgggatactgaagctaagtgttgaataacag

SEQ ID NO: 8122 - DNA, 935 bp, Pinus taeda
  Predicted polypeptide sequence is orthologous to G1324, G2893
actacctccgacctgatctcaagcgcagcaagatcactcctcaagaagaacgtttgatcattaaactacatcgccgttgggggaacagtttcaaatggtcaggtggtctagcattgcgcagaatttaccggggagaacggacaacgaaatcaagaatcactggagaactcgtatcaagaaaagactgaatctgaatctgcaagctgagagtggcagcaacaggatggatgcagacagtggcgtacagattgcagaatcaaagagttctgaattcctcgcaacttcatctgagagactgcctggcctagatagtctggagtcttccactagaatcacaagccaaattaccgaggaaatagcggttcaaccaaaggaaaccccatatctacaaagtcatagttctccaagtagcagagaagattgcgataatggattgcagggagaaattcgagaggattctcaaatcaatgaagatgcgcaacatggcgcagctttgcagggacatttggaaggatcagaggagctgtttgagaacgcggggttaccttatattttttcagtgggttctctggcaactctgctatcctctgatttatttgtagatgatggcgtgactctagatttttcctatatggtaccttcaccagatagcttcccagagatcgggagttacctgaatggttattctgatgtattatggaatgttctggatgaataaacatgaccgttccattcgcatcagctttacgcgtgtcgggatggctacgaatgtggccaggaacgatgaagtaaacgatgtaacgtaccagatcagcagcggttcctcgctttgtgtacacgcagattacgtcatgttttttctttcttttaatagtggtctaaaaaggcgatgttccaggtctgagacgaatggaaaatttggcactatttgaaag

SEQ ID NO: 8123 - DNA, 622 bp, Pinus taeda
  Predicted polypeptide sequence is orthologous to G1335
ttttttttttttttttttttttttgaaatgagaaaaactctcatgtttctcaagtactttctacttatttcctataatcgtgaccaacaactcgagcaccctgcctggtctcccccgggtacctcacgtcaattaataatcatagtgaagtaccaccgccgttgagcgattgcgtgggcgccccttgaggtcctttacacccccaactgccggtataagtgttgcaggttgtttccatgaagagcgttgagactccttcaccagccagcgattttgaatatcttcctccacccggcaggaacaccttgtgcctccgagtcgacagccgtcggtaaaccggtccacatgtaatcgactctgggtggcgagcctatctcgacgtcgtttccgcaacctggtaccagagacaagatcatggtaggaaaatcaaaaccccagagtcccggtcgtggacgaattggatgagtgtggggacatgggccagggaagtggaatcgacgtagaaattggactgagtagactctacagcttcaccattatgaatcggattgcggtatgatgtagagatgtggatgccagggcctgcaaaaccgccgctaccctttcacgttttttactcgcg

SEQ ID NO: 8124 - DNA, 973 bp, Pinus taeda
  Predicted polypeptide sequence is orthologous to G1335
tgtctgagggcaagagatccggaaaggttaagtggttcgattcgactaagggttatggtttcataacccctgatgatggcagcgaggacctgtttgtgcatcaggcttcgattcactccaacgggtttcgatcgctggccgagggagaggccgtcgagtacacggtcgagcgtgataatggcggaagaaccaaggccctagatgttacagggcctgatggagccttcgtccagggtaacagtggaggcggtggtggaggccgaggccgaggcgccggtagaggcggaggcggcgatggctacggcggcggtggttacggcggcggtggatatggcggtggcggtggcggtggcggtgggtggaacggaggtggtggtcgtggaggaggtagaggaggaggcggaggcggcggaagctgttacaagtgcggagagtctggccactttgcgagagactgcaccagcgatggcggtggtggcggcggcggcggcggaagctgttacaagtgcggagagtctggccactttgcgagagactgcaccaacggtggcggttctggtggtggtggcggcggcagctgttatcagtgcggtgatacgggtcattttgcccgagattgccctaaccgtgaaggttgagcatatcggaagcctgcccttcctctcttctcgatttccttcagcgttttgaatgttgtgcccgctgccgctactcacgccttccctaagatttcgtggtttctggcttttgttgttgtaagcctgttccagttttggggagttttggggaagcgaataagcccgctgatcttctatccagggggcagtggctgacacaggaattcagaagagatggtgcatttttccagttcttcactcttcggaatgattcacaagatcattcctttttatttatgctttttgtttatcacagctccggatacataatggactatgtttaatgcactatgttt

SEQ ID NO: 8125 - DNA, 859 bp, Pinus taeda
  Predicted polypeptide sequence is orthologous to G1341
ccaggctccacggagtaatttcagcataaattactctcaaattcacaattcagataaattgccgccccggcagcatgccaaaccactttctgcgagcactaaatcgaagcagaaaaaggcggtgaatagcaccgccaggccaccgccaccgccgccagctcccagcagcagcaaatcgtctctaaaatggcagtttttcactctagggttgatcaaaaccccgccaatgaaactggaagacatgcgccaaagacaagccgggaggcctagcaattacagtgcggctgataattccatcttgagacggtctgcctcctgcaatttctacaacgaagaaatcccaaagcctgcggaaagggagccgagattggcagactttaagaagaaatccaagtccgtcaaggagaatgtaaatctatggacagaggccgagacgcccagatcaaaaggggtaggttggagaatgctgaagccactggttgctttgaatggcggttgcagagcttccaccaattccgtcattcagtgctccaccaagaagttctcacacgacagtttggcagagcccaccaaggcaagcaacagaagtctaaatgtatctctgtatgacgatcagaattctccccgctgctcctccaaattagcggctcctgccaaaattggaggagatcgtgtaatagcatgacatcgggattacgaggtcgggatgggtgtgggatacggtacactcgttgcagggtatttattatattaatttgtttataaatagaatcatcattcaatgtaattaacatggatcaagcgatgtaatgcaattataatggtttttattaatacttgaatgcgaatgaagatttta

SEQ ID NO: 8126 - DNA, 911 bp, Pinus taeda
  Predicted polypeptide sequence is orthologous to G1364, G481, G482, G485
acattgcggcggactgcgggaagtattgttttcagtaattcccttaattgggtcccagaatacgttctcagatccgaaaacggttcagtccatcggaggttatagcgattcgaaggcctgaaaaccctaaaaatccttatccccctttgtctttgaatggcagagaactatggcagcccggatagcagcccccggtcggagaacgaatccggcggcggtcacatgggcggcagcgatttctctgtgaaagagcaggatcggttcctgcccatagccaacgtggggcgcataatgaagaaggccctgcccgccaatggcaaggtttcgaaggacgccaaagaaactgtgcaggagtgcgtctctgagtttatcagtttcatcaccggcgaggcctccgacaagtgccaacgggaaaagagaaagacgatcaacggcgacgatctgctgtgggcgatgacaaccctggggtttgaggactatgttgagcccctcaagatctatctccacaagtacagagaaatggagggcgagaaggtctctatggccaaacaaggagacccgactccttccaaggaaggtaacaacgccattaatggctcctcaattgaaaaccctaatgctaatgcctacagtggtttgaaccccggcggttataatagggtacagtcgcagtctctgccacatatgcagcaggctgcctatgggcaaccgccaggtggaatggtctatggccaccacggccacattatgggggcttacaatatgaccgccccaaatagcagtggtggaaatagcagtggtcagcaacagcagcaagcccccagaggccaatggtagaaatatttactttttcttttctgtttttctaatttttatgggttcatgtggggacagctgggtgccttagttaa

SEQ ID NO: 8127 - DNA, 958 bp, Pinus taeda
  Predicted polypeptide sequence is orthologous to G1364, G481, G482, G485
aataaaggcagcgagagggtgggaggtgattggcaaaagcgaaaaattaaaaaaggggatttgagcgaacgaacgaacggtgaagatacacagaggatctctcaacggcttcatctccgtcgtcgtctctcctccttccatctccagcgtccgatctgatcttatcaaaggaagcccttaaatccctccagctttccaagcgcgggttctgttgctgtatcccaggtccctggtcatatggcggaagctggcagcccgggcagccaggaaagtcctcgttccggggaacaaagcccccagtccagcgtgcgggagcaggacaggttcctacccatcgccaacattagccgcatcatgaagaaggcgctgccggccaacggcaagatcgctaaagacgccaaggagaccgtgcaggagtgtgtctcggagtttatcagcttcatcaccagcgaggccagtgacaaatgccagcgagaaaagaggaagacaatcaacggcgatgacttgctctgggccatgagcacgctagggtttgaagattatatcgagcccttgaaggtttacttgctcatgtacagagaggcggagggtgacaataagggatcttcaaaatctggagtagaccaatatggaaagaaagagtcaaatgtacatcaagggattccaaatatgcagcagtctcagatgcagcatcatcatatggttacaatgcaggggcaatgatctgtcatgatacatgagaggtcatgaattgctggttagtatgtagccgatcaaatttagatggctagttttgtgaggatcaaatgaaaacaattcatttaacttaattttatgttactgggcaaagcttttagcttgacctaaatgataggtagtcgtgatagctagctttattgtacatggaagttgtgatttgtatgttgctgtacatgtgaattgttgtcactgtaagcat

SEQ ID NO: 8128 - DNA, 908 bp, Pinus taeda
  Predicted polypeptide sequence is orthologous to G1364, G481, G482, G485
accaaatcggaaaaagaactaaattatttgacactttatcctaatccaacgggaatctatttggtcgctggtctccggcgtataacgtcttctgtgacgccacctggcgcctgctctcgattccagaattctatccggttgggtattaaattaaggtgattgttggttacagacgttctgtggacaccgagtgagtctcctagccttggaatttggcaccatctcgtcccgcagccatttcagttcgatctcccgccgtcagaaaaaataatccccaattctccagctgtccctgccgtgtctgcacgcgacaggtctgcccgggctttggtctgtggaatttcatgccaatttatcacctataaactccacccgcatctgcccacaaaccccacaagtcacacccctcttcgtcttctttgaaatctcagatgggttctgccaattagctcggatccttgcctcttcagttggttttgtgagcacacacgaggccaggacccgggtatcaacgattcccctcaactgacgtaacccatggcgaccactcggcatcagcgcagtcccgatagcagcccgcgctcggaggatgaatcaggagcgcacacgtacagcaaccaggatggttccgtgaaggaacaggatcgatttctgcccattgctaatgtgagcagaatcatgaagaaagcccttccagctaatgccaagatatcgaaagatgccaaggagacggtgcaggaatgcgtttcagagttcatcagtttcatcactggggaagcctctgacaagtgtcagagggagaagaggaagaccatcaatggggacgacctgctgtgggcaatgggaactctagggtttgaaaactatgtggagcccctcaaggtctacctgcagagtacagagaattg

SEQ ID NO: 8129 - DNA, 767 bp, Pinus taeda
  Predicted polypeptide sequence is orthologous to G1364, G481, G482, G485
cggccgggggtggaacaagcatgacgttgtgaatggtccacttttttttctcccctcccatgcccggtatttctctaaatgccgacgcaatggaaatatgtagtctgtaaaccctaaaacttgtaatgcccatagcaaatcatcagcgttcatagtcttacgcttgtttttcatgcacctgtcacacgccaccctggagagcagaggagttgcagctggtgtggtttgttcggttgtaataatgtgttttcaggaatgcagaggagatccgctggagaaggctttgggttattttctttttgtccttacatacagcaggttgctgtgattttgcgataaatggaaagtcaagagatgggggcacacttgcaactctgtcaagaatgaccgctttctctatgtttttggcggatatggcaaggacaattgccagacattcgggacagctggtctctccacgcacctccactgatacggttcttggagattgagtcagggcagctgatggtgttaaatgccataacttagcccataacccctcgggatcctatcctggatagacgctcaggattttatctcggaaatcgacggtgataaaccacaggtcttggttcaaaaggaattgggctagggtttcatcgggcatttgcatagtcattgcgaggcaatgcctctcgacgctggttacttctgcatttgtagtatggcatcttccattcggctcttcattcggtgaacccataccttcagcttctctggtttgcagt

SEQ ID NO: 8130 - DNA, 843 bp, Pinus taeda
  Predicted polypeptide sequence is orthologous to G1364, G481, G482, G485
cggccggggggacggtttggatgggttgttttgcaggtttctcacctgcggcgcgcgtttggttcgttggatgacaaaaaacacattctaattgtatttattcatctcccctccaagagagcagcggcagccatggcagacttagcgagctccgtcaccagtcaagaaagccctcactcagaagatacgaacaataacagccaaaaccagggttccaatgcccgggagcaggatcgattcctccccattgcgaacataagccgaattatgaagaaggcagttcctgccaacgccaagatcgcaaaggacgccaaggacactgtccaagaatgcgtttccgagttcatcagtttcattaccagcgaggcgagcgacaagtgccagcgtgaaaagcggaagacaatcaacggagacgacttgttatgggccatgggtactctagggtttgaggactacgtggagcctctcaagatttacttgcacaaatatagagaggcggagggtgacagcaaaggagctgctactagcagatctggtgtgggagatcctactaagaaagattcgagtaattttggagcattaccaaatattaggtgaataaattatgttcgataaaccagggattgaaccatattcaacaggtcagattttgcaggaagtggtcattagagaatctgtataagatgcttggaaggatgaaattgtgggattggaagctcctagtaataaaatacatgtttaatttttttgaaataataaaataacttgtgattaaagttttgccgagtaaccaatatgatcattgtacataagataagtgcatgactgtagctctctcatttt

SEQ ID NO: 8131 - DNA, 821 bp, Pinus taeda
  Predicted polypeptide sequence is orthologous to G137, G145
tcggagctgtctatcttctgtgatgcggaagtggccatgatcgtcttctcaaacacaggcaaactctatgagttctccagttccagcatgacaaagatactagaaagacatcggaagtgttccactttggtagaagatatcagcaaagatccacaggactcaaacacagagttgacggaattgaagagaaaaaccgataacttacaaagatggagaaggcatgttatgggtgaagaccttgatcaactaagtgtcaaggagttgcaacaactagaacaacaacttgaagaaggattaaaacaagtcaaattgaaaaaggagcaacaactggagggagcaaagaagtcgcgccataagaaggtaggtggaaaattgaggccctcgatattgtcattgttcttccaaagatatgaatcatggaatactttgtttgcaaagacttcaaatgatgaaacgtggttcctacgccataccatggctatgtggaaacaacagcttcagttgtcggaactgagaggaaaatatccatgtgatcagtatcctataccaatatccggctcctcgtggcactctactgctggaaactataacactcacgtcctgtcaaggcattgcgaaccgactctacatattgggtgcccgtctggctctactggaaaccatattcctggccatatgcaatcgggaaattacgacggtcgctaatagtggctgcgatggagggtgacaactcgtcaatttaatctcctacgtttattctttgtaaagagcatatttagtcgaacaattgcaataagttgatagatgctgataagcatcgg

SEQ ID NO: 8132 - DNA, 764 bp, Pinus taeda
  Predicted polypeptide sequence is orthologous to G137, G145
gtttatttcaagaaatgcaaataaccgctagacatatatttcacataaacgaatggagtatattttttgctctttcggcatcttgtctgtttatataaacctagctatgttaattgttgaactaatatacaatttacaaattcactaagggaaggtaattaaattcattggttatcaccgtcgagattagccattgtcagtgaactggcagataattcacataacatatcgtgaattaaattttcaaaacatccagccctgcgcaccgtaagttcccgatgttcttcggccagaagtagtgattccagtaggggcagacgggcacccaatatgcagagtcggttcgcgatgcggtgactggacgtgggggttataattctcaagagtagagtgcgtcgagctacaggatatttgtataggatactgatcgcatgcatattgtccttccatttcggacaacttcttctgcagcgacttgtttgtttcctccagaagctgctcctttctttgtaggtcttcaatcatgtccgacattaattgattctttttcgatatcacctggtgtagtcctccatcaagctgttgttctaattgttgcaactccctgatagttagtctatcgaggtcttcacccaaaagatgcctgctacacctttgtaaggttttaaccttttccttcaactgcgtgaactccatgtttgaatcctgtgtaaatcgagcggtatcgcgtcctgaatttgaacatgtccggtatctttccaata

SEQ ID NO: 8133 - DNA, 843 bp, Pinus taeda
  Predicted polypeptide sequence is orthologous to G137, G145
ctgtagtaattcacacttgaaaagtatggcgaatcgactaccatgtgataaaccgtagtgtataataatattttgcagacacatacacattggatttaaacatatcatgtgttgtgaatgggacaactatttttccatcgctcttttagcggccagattagcatacaagatttatgcaattaaactttgtcgacaagaaggtctaatataccagtagggtttgtttgcccaataaaacctccgctatcatagcagtaaatcaagcctactgctatacaatgaaaatagggttttttttaatgataatataattctaatttcgtaatttaccacgctttgggcttttgttgtgattgaagtaactgataatgataaatgttaaatatcaaacccaccatccttgcatgtattggttcggcgtttggttgtgcggcggctgatgaggagggacgatgctttcaggagccacaggctgataacctttggcgaagttcctcaatctggtccagcattacctgcgttttccttgacctaagatgtgtcagagcaacctccagctgacgttcaagctgctgtagctccttaacatttaacggacccagatcttcccccaacaaatgcctttgtgatcgctgcaggagctcaaccttacccttcaactttgtaacttcttggtgccaattctgtgcttcccggtccgaaacgcctgtggtatcttgcattgcatatgaacatttttcgtatctttccaacgtcttgttcatgctggaactggcaaactcgtaaagctttcctctggtagagaaaattattagcgccacttcggcatcgcacagcactgat

SEQ ID NO: 8134 - DNA, 877 bp, Pinus taeda
  Predicted polypeptide sequence is orthologous to G138
tatggagtttccgatctggtttagggtgaagtgccagaaaaggatatgcgaacttctacttgacatggcaataggcgatttgatggacatttttataatgctcgcccaaaccgctatcaggggcacacatttagatgctcaaaattaaacaaaacctaactcggccctttgtgagcgggtttcagttttaagaaaactatgtcattcgtcagagaaatacgcggccagtagcacatacaccattgctccgtcgtggacagggaccactcccagaactttggggaagggagagagctaacggccttcaggaagagaaagaaaaagtaggtggaatagtaagggcctgtttaagatggggcgaggtcgagtccagctgaggaggatcgaaaacaaaatcagtcgtcaagtaactttttctaagagacggaacggactgatgaagaaggcggcggagctgtcaatactgtgcgacgctgaagtgggcttaatcgtcttctccaacaaagacaaactgtacgagttcgccagttccagtatgaccaagattttggaaagatatcggaagcgttcaaatttaatacaagatatcggtaaagatccacagaattcagacattgagttgacgcatctaaaagaagaggttgaccgcttacaaagatccagaaggcatcttttgggtgaagaccttcatcaactaggtgctacggatctgcaacatttagaacaacagcttgaagaagcgttacaaaaggtcacattaactaaggtatttaaactcaggtgtaatattttgaaatcatacttcatattttagtgaggatatgcgatagtattagtatacatcaaatatttagtgataatattaatatatttaaaa

SEQ ID NO: 8135 - DNA, 779 bp, Pinus taeda
  Predicted polypeptide sequence is orthologous to G1384
gaaagcatggaaaggcgagatcagagtccggttgcagcccgccaccccatgagaaaacactacagaggagttcggcagaggcaatggggcaaatgggtagccgagattcgcctccctcagaatcgaacccggctctggctcggcacctttgacaccgcagaagcagcagctctagcatatgaccgagctgcttacagatggcggggtgagtgcgctcggcttaatttcccccatttgttctcaaaaaagtatcagaattcctctcccagctccaccaatggcaggattcctcgcctttcttgtgaaaaatctgatcagaaatatgcatataatggtgacccagttcatacgaatgtatataagggtcccccaattcggataactgcatacaacggcgacccagttcctatagatgtatataggagtgacccagttcgggtaagtgcatataatggtgacccagttcggataagtgcttatagtggtgatccagttggcaataccgttactttagcggaatccgagcttgaaagctcctgcagccatgaatccccaaataccaaagttgagagatttatatgggaggaagaggaggatgagaattggttgaacaatctgccggttttggaggcagacatgacatgggatgttctcagtggatgttcagatattgacactgaagtcagtcagactcgaacgtgtcacctctggtaagtttgaatttcaaagtgtctggctggattattgctacgaatgaataaaatatacagtcctattgc

SEQ ID NO: 8136 - DNA, 909 bp, Pinus taeda
  Predicted polypeptide sequence is orthologous to G140, G146
tgaggatccgctgcaacggaaacagtcatatctttctctctctcagcttttgcgttacgagatgatccggccgcgggtactgatttccccttatatctctctgcaggtctagacatccaccagtaagcagcttatcttgggcttgacaggcattagcaggaacagggttgccttcacgtaaggactagaatgggccgcggaaagattgagataaagcggatcgagaatactacaaatcggcaagtgactttctccaagcgtcgaaatgggttgctaaagaaggcgtatgaactgtctgttctttgcgatgcggaggtggcagtcatcatcttctccaaccgtggaaagctgtacgagttcgccaataagagtgttaatagaactattgagagatacaagaaagtatgtgcaaaggatatgcgatgggaaacaagtacctcatcgaagaattgcgaaaatctaagacaggaaatcgacattctaacaaaagttaacaggaacttgatgggagataatctctcagctttaagtctgaaggaactcgacctacttgaagctcggattcaaaggggaattcagagcgttcgatctagaaaggaacaaatattactggttcaaaacgatttcctacgtaacaagattgcagagtgccaatgtgaaaatgctagtgtaacactgcatatctataacgaagcacctcctcaatttgacacccaagatctgcttcaatgaaatttggttgatgcaattcaagaacgtcaataagaagatttaaataggtctcaatttctcgttcgacgtcgagaggaatgtcagttgttttgaagtttcactcttctgccatgtaaaactgtcaccaaaagttgggcttctattctatttagatagtagctctgttatttaattttg

SEQ ID NO: 8137 - DNA, 867 bp, Pinus taeda
  Predicted polypeptide sequence is orthologous to G140, G146
gaactaagtgactgattacttagatcatatccagaaggaacatgttggttaggcaataatgttgtaaatccatgtgttaggagcgaggaaagtctcttgccatttgtacattcttccaacttttcttgaagcatcatgttgtttatccttaacgtatgttccttactctgaagggctcttatttcatcgagcatcagttcgtgcttttttgctcgtacttgatttattcctctttgtaggcgactctctaattgatttagctcctcgaatgagacagagccaagcccttctcccattaaatatctgttagtaagttttagctgatcaatttgttgtttaagtaaatttatttcttgcttcattttctcgtctgaagtattattcgaaaagttcatatgttttgcagtctgtgaacacttttgatatctttccaatattgacctcatacttctgttgttgttgttgttgctggtgcccagctcgtacaactttcctcggctggagaaaacaatgagcgctacatctgcatcgcacagcactgaaagctcgtaggcttttttcatcagaccgcctcggcgcttgcagaaggtcacctgcctgtgcacgctgttctcgatcttcttgatctctattttaccacgccccattttgagcaaaatcccaagagtttctcaaaatctgagtgaacttacagaatagccgaggttccttccactagtttggactagcttcagggtttacttgggtttttgcagaaatattactcaagctctcatcaatgtcttggtatttaagaactgttgcagcagcaacacacaaaaatacaagaatccttccactagtttagactagcttccggggcactgg

SEQ ID NO: 8138 - DNA, 822 bp, Pinus taeda
  Predicted polypeptide sequence is orthologous to G140, G146
aaaaaaccaccaaaatactattattgcaaattgtttttcatgatttattgtcttatggatatatagacataggatacctcgtcattctccttaaatatacaaacaagaaagttggtagaacccatgttttgaagtcataatgttccacaaggaaacacatctacaacgtactatatgttacatctcaacatttgaactaagtgactgattacttagatcatatccagaaggaacatgttggttaggcaataatgttgtaaatccatgtgttaggagcgaggaaagtctcttgccatttgtacattcttccaacctttcttgaagcatcatgttgtttatccttaacgtatgttccttactctgaagggctcttatttcatcgagcatcagttcgtgctttttggctcgtacttgatttattcctctttgtaggcgactctctaattgagttagctcctcgaatgagacagagccaagcccttctcccattaaatatctcatctgaagtattattcgaaaagttcatatgttttgcagtctgtgaacacttttgatatctttccaatattgacctcatacttctgttcctgtttctgttgctgatgccaagttcgtagagctttcctcggctggagaaaacaatgagagccacctctgcatcgcacaagactgaaagttcgtgggctttcttcattagaccgcctctgcgcttgcagaaggtcacctgcctgtgcacgctgttctcgatcttctttatttctattttaccgcgccccattttcagcaaagtttctcaaaatctgaatctaatgccttccaacc

SEQ ID NO: 8139 - DNA, 795 bp, Pinus taeda
  Predicted polypeptide sequence is orthologous to G1419, G43
acgcgggggccccccggacgtctggggacgcctctgtatcgctttgtagtcgaattttctgcaatctcaccttgtgccctgattgcttctgtgttgcagatcacaggcgtgctggccgtgaatccagacactccaaatatcgtcgtctcatgctgtcgccgtctcccgctgtcccacccgtgcttgccgctgttgccacccgtttgtgaaccggtggatatagcattagtttgtagtttgagcgtttatttgcatgttggcattttagcttgagcatagtttgagcttgagcataggttggcaggtgtagatgtgcatgcaggcaggcgtagacgtgcatgcaggtggtgtaggtgccacccgtgcttgccgttgttgtgcttgccgttgttgccacccgtttgcccctgttgccacctattcctattactgcatggagcttcagtgttacatcctgcacaaatgccagagataataacttgccccccggacgtctgcggacgcctctgtatcgctttgtagtcgaattttctgcaatctcaccttgtgccctgattgcttctgtgttgcagatcacaggcgtgctggccgtggatccagacactccaaatatcgtcgtctcatgctgtcgccgtctcctgctgtcgatgagatgcagaccatccatgcttagcgacttcgtcgagaagttccaagagcatcatgtcatccaaatcgttttccttcagacagcactgaaatttcaggattccatcgataactttaaattcaaaatccagaggacataagatctgt

SEQ ID NO: 8140 - DNA, 895 bp, Pinus taeda
  Predicted polypeptide sequence is orthologous to G1451
ctcttgcagtttcaacagcagcatcatttgcatcttcaacagtttcaatgtaggtcgagtccacagttacagatgtatatttttcagcaacaacaggcgccacaacaaaatattcttcagcagcaagctcagaacttacaggaacaatccccacaaaatcatcttcttcagcatcagttacagcaaaactcatctcagcatcatcttttacagcaacaactgcagcattgttttagtgatcagcagcaaccattgtctgagcaacaacaatgccaacaaccatttcaagttccaaatgttggtggtgccttgtcccaaatcccttcatcccaatctcagccagcaataacattgccatcatccatgtgtccaaaaccattatttgcagattcgaatggaaatctttcttcagctatgacgattccaactatatctactcttcaaaatatattaggctcttcgtctggaggagaaaattccaactatttgaacttgcccagcactagctctgtagtccatcagcctgtgggaatgttaacaggacatggtattccccgtgattgccaaatttcctctacttcatgggttcaaaagcttttatcaaataatttggtcccctgtcatccaggtggacaagttgaacatcttccttcaggaggtcaatgtgttgtgccccaaacagaatctcttggccagtctaatattccatcatcatccatgccaatgtcattacctcaatttgcatcaagagaatgccctccggagcaggaaggaattcactctgattctcagagccaccttctttttggtgtcaacatagattcctcgtctttgattggtcctaatacagtatcaaacatgaggagtattggcagcagtactgatgcagtcatgc

SEQ ID NO: 8141 - DNA, 810 bp, Pinus taeda
  Predicted polypeptide sequence is orthologous to G1451
ggagttcagtctgattcccgagcaatcttctttttggtgttaatatagataacccaactttggctatttctgatacagtttctagtgcaaggaatgtgggcaatggtgcttatgtagccagttcattttctgttacggacttactgaatgtgcctccttgtgctcctgtctctgggttctctatgaattctaacatgggtgtgtctggaggtctagatgaaagtgggttttcacagcctccaccaaattttgcaaagatgaatgctcccacgagaacattcactaaggtttacaagctaggttctgttgggaggtcagtggatgtaacacgtttcaggggctatccagatctgcgtgccgagcttgaccgtatgtttggtctagaaggccagctggagaacccaagatcaagctggcagcttgtatttgttgacaaggagaaggatgttcttctccttggggatgatccttgggaggagtttgtcaataatgttcgatttattaagatactctctcctccagaagtgcagcagatgagtcaggaagatatggagttttggagttccattccaactcagcagcagacaagcagtagttcagaagactgtgtagctagaaattcttctcgcaacatcagttcagttctcacatcgactggatcactggagtattaagtgtagttcaattgtactatatcaccagttgtgttgtgtctttaaaggggggtcgtaaaaaatgagatgtacttcagttcataactcttaggtatgccccataatatgttcgtccaggatatctaaatgatgaagt

SEQ ID NO: 8142 - DNA, 591 bp, Pinus taeda
  Predicted polypeptide sequence is orthologous to G1474
acagtctacgaaggtgaagtggtgaaaatgcattagacattctacaaatgttgcacaaaggagattacatttgtagtgtttgggagggtcgagtggagaagctattttaggcaaataagatgcaacagagaggatgggaataggaaaagaaggcagcaaggagagaggatgaaagagaaaagttggagtttatcattcataaatgaagtgagtgatcacaattgtatagtctatgaaggtcaagatgaagataccgtagacattctaccaacacagcttggacgtgagtgactatggttgcagtgtctgggatggtgtagcgtttgttttcttgctccacatcacatgcacacccccacacaatgtgccttgtaaaagaggtgggtaaggtcgagcatgcaagaatattgacccttaaaccaatcaaccatcgtgctaaaatacaacgctactgccttggagaccctaagattttgggtgttcaatatgtttagatatgcttagattcctttttctgaaaaatttacattttatgaaaacattgtttctattactcgtaatagaagtacctggcccgggcggccgctcgaa

SEQ ID NO: 8143 - DNA, 995 bp, Pinus taeda
  Predicted polypeptide sequence is orthologous to G1480
gcccaagccctgcaacgtgtgcaggatcgcgagcgcttcgctctattgcagggccgacgctgcttatctctgctccggctgcgacgtcaaagttcacggcgccaacaagctggcgtcgcgccacgagagggtgtggctctgcgaggtctgcgaacaggcgcccgctgccgttacctgcaaggccgacgcggcctcgctctgcgtttcttgcgacgccgacattcattcggcaaaccccttggcgcgcaggcacgagagggttcccatcgtgcctttctacgagtgcgtttccgtggccaaagcgttcctccccccactgccgcaaacttcgtcgcttcaggactccgacgcgccgggtaccctggactacgatgatgacgacgaggacgacgagatctacgctgcggaggccgcatcgtggctgttgcccaatcctaaagcgtcggccgagggtaccaagaattgtgacgacggggtaagctgcttcggcgtcgacgcgggtcctaacaaggcagccgggggctatttcagcgttgtcgatttgttctctgacgtggatccctacttggatctggactacgcctcgtcgtttgaggccaccggcgggaccgacagcgttgttcccgtgcagagcaacggtagcagccacgatggcgcggtgtctacaccctcggattgctttgaaaccgataaggccgtttacagctataccaccaccacgtccttcagccacagcgtatcttcgtcctctctggatgtcggtgtggtccccgacgccatgcttagcgacatctcgaggcctcttaacggaggggcggcgctcgagctggccaaccccggcgctgtccacgtaggcgtccagtacgtccaggcggaccgcgaagccagggtcctgagatacaaggagaaaagaaagaaccgcacgtttgagagacgatcaggtatgcttccaggaaggcctacgcagagaccagggccgcggatcaaaggtcgct

SEQ ID NO: 8144 - DNA, 651 bp, Pinus taeda
  Predicted polypeptide sequence is orthologous to G1480
cggccggggacagtctgaacataaaataggccaccactaaaaagcccacatgaacctagttgagcgcctccagaattagctgagatatcagtaccgtcataataaatggcataataacagacccaccatctaggaacttctttgagagatttaggggttgttgcagaggagaatggtgaaggaagaagacaaggattggcacaatgttgaagggtgggatagagggtctcatgttgatcacaaagagtttctcagagggattggagggtggagaatgagtatgccaaagctctgtgatgtttgtcaggtatcaagctctgtaatatattgcagagctcatactgcacagctttgcttagtctgtgatgctaaaattcatggtggtagcaaggcttcgttgtgtcatgaaagagtttgggtttgtgaagtatgtgagcaggccccagctgtggttacatgcaaggcagatgcagcagctttatgtgtagcctgtgatactgatattcattctgccaatcctcttgcaagtaggcatgaaagagcacctgtgattccattttatgagtgccctaatatgcccactaataatacagttacacatgccaataatgataacttggactgcaatgttttgctgaatgaagatggtgg

SEQ ID NO: 8145 - DNA, 865 bp, Pinus taeda
  Predicted polypeptide sequence is orthologous to G1488
cactgtgacacaacaaagacacctcaatggagaacaggccccatgggacccaaaacattgtgcaatgcatgtggtgtgaggtacaaatcaggcaggcttgtgcctgaatacaggcctgctgcaagtccaacatttgtggtctctaaacactctaattctcacagaaaggtcattgagatgagaaggcagaaggaaatgcaggacgccctacagcaggcctccaaactgtacccaaatgacaaggaagggaatgaagatggggatgaatatgaggaggatgaggatggatcagatggtcaataccctcattttggctcggatgatgatacttacttagtccatacaaatcaggattacaggcatttcatatgatgcaacaattcaacagcaaattccctaccatctgtacaatttttaatactaacaaagcagcagggagggaggcaagcactcaagggggtcttattcacccatcacagcagtacattccagtgtgttcactgggggtaattggtagcacaaatatctgtctttcaagtatacaggatgatgatcaacaagcgagggaaatgatgactggcttgttgctggaaggaaggaagaggggatttcagaaccaatgcatttgcatttattctttaattttgtagattattggatcatctgtttcttcttcttctatgaaacgttgattatcttttgaaattagagacatttccaatggctgaattagggtgagatcattaaacttaaaacatacatgaagtccagttagtttatatatctattaatggcgaggcctgctagcctttactgatcatattcgaattcaatgtgatcattgtagtcatttatatctccacca

SEQ ID NO: 8146 - DNA, 897 bp, Pinus taeda
  Predicted polypeptide sequence is orthologous to G1488
ggtctcgcgcccggcgtctacgtggtcgaagccgacggcagtggctgtgcgtgcccgtttccgggcgagctctgcgtgccagacgacgccttggaggaactggaatggttgtcgagcttcgttgcggacgaatcgctcgctacggtgccagagttcgttgccccggtggagtccgtggcaacggtttgctcgccggccgagcgcgaggagagccaacgaaagcagagcaacgctttgctcgccggcgcgggacggacgtgggtgctggggcgtgctcggagtaagaggtcacgcaacgctaatcccacagctttcgtgagcgttgctattaagagctacgaaccccgaaccggacgcaagccggcggtgaagggctcggtctacgcagcgccgccggccgcggtcaaaaagaggaaaaagttgttccacaagaaaggcggaggcgggggcggtggcggcggcggggggcaggagagccggaggtgcagccactgtttagtccaaaaaaccccgcagtggagagcaggcccgttgggcccaaagacgctctgcaacgcttgcggtgtgaggttcattcaaattgccacagaagagtagttgaaataaggcggcagaagatagaccaacaacagttgccctcaccgcaggaaacttcaaccataacagacaattccatggcatacaacagctagcgaaccatttaacggactagtttctctttaatcattactaaagattcgacaccatggtcagcgcaattctattcattggtgtctaaccattctcaactgtactctgtacaaaaatttaggttttgaaattttatgtcatgagaaacctatgcagtaacatgtgctgttctgcacaacgtacttctcattctttaaaactgttatg

SEQ ID NO: 8147 - DNA, 838 bp, Pinus taeda
  Predicted polypeptide sequence is orthologous to G1488
tcgatgacctgctggatttctcaaacgaagaaatttcagcaccaattggagagaaatgcagtgatgccaacggagctgattcctccacaataaaagaaaccgcccatatggcaggaacaatgctaatatgcaacaacgattccttgcttgataagagaagtagttcccaaatttcaattgctgtaagcacagatattaaaggtcacaattctccaggagacatttgcgtttcagtaagtcatgatgcttcctcttctaccgcattcgatggactacttccatttttgttatttagttttccatgagcaaccctaaggtaaaaaatcaaataacaatcttacccctagtgtctgtctatttccatccctacaacgtgtagaagatgagttccttattaagttaatctccattgttgttttacagtgtgatgatttggcagaactggaatggctttcaaactttgtggaagactctttctccaccggtaacgtgcctacagagataactcatcatgttcttgactctgataagggctcatctagctgtactttagaaatatggcccgtgcctagccgagctcgaagcaaaaggtcaaggacacctgtttgtaattgggtttctcgcgtactgaattctccaagttcctctgcaagtatagtatatcaaaatggctctacttcagaatcgtctgaacaagccgatggagaagagtctctatctacaaatagagataaacttagcaagaccgagaccagccacgttacatcgaataagaaaggtgtggtgcaggtggatcatcatggcacacaagtcagaaaatgcagtcattgtgccaccc

SEQ ID NO: 8148 - DNA, 794 bp, Pinus taeda
  Predicted polypeptide sequence is orthologous to G1488
cggccgggggctgacactgtttgcttcttcgcaaagctgattgttgccttcgtattcactactctttttttgggtttcccttttgcccacaagcagttcgcaaggaaagaccagaggcagaatgaagtctgaggcagtgacaaagttcgaaacagttatcacgggggacttttttgaccaatttgatgacctgctggacttttccaatgaagaaattggagcacccattggagaaagcagtatcaactgtcccaaggatggcattttaggaggcagctcttcgacagaagctgtgagttccaatttcagagtagatgagagcgactctggaaaactgtgtattcctagcgatgatttggcagagctagaatggctttcaagctttgacccattcctagaaactgtaccggcatgtccttatgaacctgattttggagttgaagtcaaggaaaaatatgaagaagggcagaattctgataagttcagaagcccgagtcctacatcggtactggggcagaattctgataagttcagaagcctgagtcctacatcggttctagaaagcagctctgggaaaatttcaacttttagtccggaaatcactgtaccaggaaaagcaagaagcaagaggtctagagccccagtttgcaaatgggcttctgggattatttcccctgcatcctcagatgggttattggagaatggcccaactctttcagcagtgattcagacacttcgttaccaagccagtggaacctgaacccctgagaaatcatcagacaaaccactgggat

SEQ ID NO: 8149 - DNA, 800 bp, Pinus taeda
  Predicted polypeptide sequence is orthologous to G1506
aaacatgccactcacaaagcattcatgagctctccaggtcaactgtccagccaagttattacaggatcagaaaagtctacaagaaacactgacaacatgcaaataggtgggcctaatacagtgcatcctgtcacgcctgcttgggcaagttgtaacatggaaggtatatgccatgaaagcatagacacagggagtacttccaaggatgctgccggatttgaaataaaaccaaagggtagtccttcacttggtgctagcagcctgttttcttcaccctcaaaaagatgctcgtcatttgtatttgactctctaggagattttgcagatgaagactctgattcagttttgctttttgatgtcccttcaaacctgtcctttccacaggcagaacttttgcacacccctgttttgaaatgtaaagcccccaaggacattgttagtgatgccagcaaccttgagaattcaaacagtggtggaccagttgtcaactcagaggaaagtcccgattggggtagccttctatggaactcttcatttattggatctggccaaacactatctgttggaactgtactgaacccggataaaacacacctctgaatagttcgatcaatcggtgttgcaagtgatatgctatagtgtctattttgaagttcttgtttctttctgagagagccctcaaaccccaatttggctatatagaggggtaaatgtttcatcgagttgtggtcaagagtgtatgatagctagttcggatccttgtgcaactgtgtttgttgagttgaaagtatacctgtgat

SEQ ID NO: 8150 - DNA, 772 bp, Pinus taeda
  Predicted polypeptide sequence is orthologous to G1506
cggccggggcagaaaccttccacgggaaagatcttatttccaaaaccctactgttgcggtgtttcatattgctaaagccctaaatccagtgaagttttggtcttttgatcgcatgaagtactgagggccagaccaatgtggattgtctggtgcctaatctcgattgcgaacagtaaaaagggatttccgctttgcaacttaagcttcccggctttgccagggtttttttttcttctgttgcctgtttaatctcaacagccgcatacacggattgaatgtagaacaataaactaactacatagttggccaccctttaatggcggcggttcattgttgaaaaatcgttagcagaaatatcgatagtctgtatgtaaattggagtgcacgtggctaggatgacccagtgtcagcaaaatcttgtgggctttgtgattgatgtgattcaagtctgagttgtgttaaggtagcagcatttatcctgaattaagcaggggtactgataatgccagctttttgtggccgaggctagttctgagtttgatgcgacagatccacccgagttttggctttgtagccaaaggttttggttatggttttgaagccgaaggtctcagttgcagcttggtaaagggaggtcttctggaagtatgctgatattcttggtggtatgcactatcttcagtataaggtgtttctggattttccgaacgaaaacgctttttcatttgttttgataacattgactgtgtacagttgttatgataatgtatag

SEQ ID NO: 8151 - DNA, 673 bp, Pinus taeda
  Predicted polypeptide sequence is orthologous to G1521
ttgacggctggttttcgacatacagggacccggaagttacagggaaaagcgtctgttgcccttggcagaggcacccgagccgtctgttaacggaaatggtcagagggaaatggattctcagagatcactgcaatatgcgagaggccggattttggacaatcagaggcgcacgaggccactgccacggcgacgtttttttgggcattccagatttgtttcggctgcagagaaacgcaggcttgaagaggcgggtgctgccgaaaaggccctgacatggcgagccagcatatacagaaagggcctaagagctattccacctcgtcttcaaaatagaactaatctgaagcagaacatcacagatgaattgaatgaaagggctagaatagaacgccgattggaaccttggattcgtcgggaactggaggccatccttggggaccaagatctggcagtccttgttcacctcgtgctttctctttggttctccagactcaggaaacaagaagggacacggaatttgatcccctcaagcaatgaagatgagtttatgcaacagttggagccatttttaagtgacaaggcaaatgctttctggcatgaactgaggtgctttgcagaatctccgttcacaatgagtgcatatgattctatagtagagtatcaaagacctctg

SEQ ID NO: 8152 - DNA, 571 bp, Pinus taeda
  misc_feature (544)..(544): n is a, c, g, or t
  Predicted polypeptide sequence is orthologous to G154, G1797
ggagagagagatgttgggggaggatctggaatcatgttcaatgaaggaattaaatcagctggagagccaagctgaccgaggattgaagcatatacgagctcgactgactaaaatgctagtggatgaaattgatcaacttaaatggaaggaacggatcttaaccgaagagaacctttttcttcgtaaaatgtgtggtgatgaacatgtggatggttcggcttttagaacacctcccgcacaacttagaagcatccagaacattgatgtggagactcaactggttataagacctccaactgtacaacagcaccctgacgtcgatagtcctcgataactgttgcatatgcaaattttctactttcatgaaataaacaaacagtacaactgcagcctcattttgttcgccttttgtaaacgtataattactattgcatatgttagctttcctctcatgtttttgtgatatggaaataaacacgttgtggatcaagcttgaaattgatatcaaacctttagcatgctaaatgaaaatttgcacattatnaataaataagaaatattttagatattt

SEQ ID NO: 8153 - DNA, 450 bp, Pinus taeda
  misc_feature (388)..(388): n is a, c, g, or t
  misc_feature (399)..(401): n is a, c, g, or t
  misc_feature (423)..(423): n is a, c, g, or t
  misc_feature (425)..(427): n is a, c, g, or t
  misc_feature (432)..(437): n is a, c, g, or t
  misc_feature (444)..(444): n is a, c, g, or t
  misc_feature (446)..(446): n is a, c, g, or t
  Predicted polypeptide sequence is orthologous to G154, G1797
gatggcaaggggaaagacacagatgagaaagatcgagagcgcgaccagcaggcaggttacgttttctaagcgcagaaatggattgatgaagaaagcttacgagctgtcggtgctctgcgatgcccaactgggactgattgttttctcccccagagggaaggtctatgaattctccagtacctgcatgcagaaaatgttggcacgatacgaaaaatgttcagaaggaagtgacacgagtacatcaaaagagcaagatgtccagtgtttaaaacgagaaagtgcgaatatggaagaaaggattgaaattcttgaatccatgcaaagaaagatgttgggcgaggagctggcatcatgtgcattgaaggatttgaatcagttggagagccangttgaacgagnnntgagaaatgtacgagcgcgaangnnncggannnnnngcgaagngnatgc

SEQ ID NO: 8154 - DNA, 779 bp, Pinus taeda
  Predicted polypeptide sequence is orthologous to G154, G1797
caattcgatcttgattttccagagacgatgtgattgaccattctgtgggcaaaagagagagaggagaatggtgaggggaaagacccagatgaaaaggatcgagaacgatacgagcaggcaggttacgttttctaagcgcaggaatgggttactgaagaaagcttatgagctctctgtgctctgcgatgccgaagtgggacttataattttctcaccaagagggaaactatatgaattcgccagtcccagcatggaggagattttggaaaagtataaaaaacgttcgaaggaaaatggcatggctcagacaacgaaagagcaagatactcagtattccaaacattccaaagaaaagcttgcaaatatggaagaacagattaggattcttgaatcaacccaaagaaagatgttgggggaagggttggaatcgtgttcaatgacagaattaaataagttagagagccaagctgaacgaggattgagccatatacgggctcgaaagacggaaatattggttgaccaaatagaatgtcttaaaaggaaggaacgtctcttaagcgaggagaatgccttactcagtagaaagtgggttgatcgtcaatccgtggacggttccggttcaacatcatcttcaattggattgggaagcatcgagcagatcgaagttgagacacaattggttataagacctccaaatgcacaggatcactgttctgtaaatagtggccattgaaattattatttaaactgatccatgttatcaaaattttctatgtgat

SEQ ID NO: 8155 - DNA, 753 bp, Pinus taeda
  Predicted polypeptide sequence is orthologous to G154, G1797
gaggcaatacgagtctcgacggtatagagacagttttgtgttgagagacttgaagaatactcgtgtaattactaattactaattttattggcctatctatcctcggattccaaacagagttcaaaaagctggttcggctatcgttagcagtcatgaggtcgcaattttagcgcctctttaatatctgctgggtgcttgttctcattgcctggaaccagatctacaggagactgtaattcactgttttgcactgtagaatggagaggacaagaatggtgaggggtaaaactcagatgaggagaatcgagaacgccaccagcaggcaggttacattttctaagcgtaggaacggactgctgaagaaagcttacgaactgtcggtgctctgcgatgccgaagtagcgctgattgttttctctcccagagggaaggtccatgagttcgccagtcccagcatgcaaagggtgttggataagtaccaaaagtattcacaagaaagcggaataagtgataggacgaaagagaaaaatactcagcatttaaaaggagaaattgcgcaaatggaagaaagggttaatattcttgaatcagcacaaaggaagatgttgggggaggatctagcatcgtgctcaatgaaggaattaaatcagttagaaagccaagctgaacgaggattaaaccgtatacgggcaagaaagacagaaatactaatggatcaaagagaacaacttaagagcaaggaacggatgctca

SEQ ID NO: 8156 - DNA, 852 bp, Pinus taeda
  Predicted polypeptide sequence is orthologous to G154, G1797
cgagctggttgggctatttcaggaagccattattgggtttagatttttgcagccggcattttctgctggtgtttgttgcggttctccgttccgcgggtctgattgattaattaaagagcaagagtgacgaaaggagtctggagaatggcgagaggaaagacccagatgaagaagattgagaacgtgaccagcagacaggtcacgttttctaagcgaagaaatgggttgctgaagaaggctttcgagctctcggtgctgtgcgatgcagaagtgggacttattgtattctccccaagagggaagctctatgaattttcgcgtccctgtatgggaaaattgttgcagaagtatgaaaagaattcacgagaaagtggtataaataatgcggctaaagagaaagatactcagcattcaaaacgcgaaattgcaaatatggaagagaaaattaggatcctcgaatcaacagaaagaaagatgttggggcaaaatctagcatcatgttcagatgaggaattaagtcagctacaaagccaagttgaacgtggattgaaccgtatacaaagacgaaagaatgaactattaatggatcgaattgaacaacttaaaaggaagtgtgctgatctcgaaggaggttcggttttgacatcatctgtgctccagcctggaagcacccagtgcattgattttgagactcaattagttatgggacttccaaatgtataagatcaccttcctaaactcatcttgttttcattatacaaataagctactgcatccttcctgttattttgtaaaccaattctcaacagtgtgaatcaagattagaatgtgagtgtaatcctttttgtattt

SEQ ID NO: 8157 - DNA, 653 bp, Pinus taeda
  Predicted polypeptide sequence is orthologous to G154, G1797
actcaatcaactttcaccctctatttattcccataaacaccacaagtatcagcaatttactccaattgaatcaaagccagttgtatactccacatcacaatcaaaagtatcagggtctcgctcaccaagaaggtcaaaatctggatcacaatcttgaaagatagaaaatgggtcttgatttggagttgttggcctttaggtataataaggttgcgcttctgcatcttgatctactccagctgcaatgtgaaagtatgcttatatatggatctactcctgctgcaatgtgaaagtcttcttttatatggattggtatatggatctctaacttggttatgaccgactctccatgactttgttttcaaccacaccatgttttattaattgcttatgtatgcctccattgttgcccagttgttgtccaaatgtttatgtcgatttgtttcttgcaaactggtaaatattggcagtttcaaataaaatgatgagggaaacttcagaatcaaagagaaccaaaagcttgatcaatttcttgagcagtcctctcttgcgtttggagaaggaatcacctcgactattagggttttggatgtgtttcagctccaacttctttcccattttgaatagtctgtagaacctagaaacatatacta

SEQ ID NO: 8158 - DNA, 871 bp, Pinus taeda
  misc_feature (108)..(108): n is a, c, g, or t
  Predicted polypeptide sequence is orthologous to G154, G1797
gagaatgggaagggggaggactcggttgagaaagatagagagcgcgaccagcaggcaggttacgttttctaagcgcagaaatgggttgctgaagaaagcttacgagcngtcggtgctctgcgatgtggaactgggacttattgttttgtcccccagagggaaggtccatgaattctctagtacctgcatgcagaaaatgttggaacgatacgagaagtgttcggaaggaagtaaaacaacaagtatagcaaaagaggaagatcccaaggctttaaaacgagaaattgcgaatatggaagaaaggattgagattcttgaacgcacgcaaagaaagatgttgggcgaggaactggcatcatgtgcattgaaggatttaaatcagttggagagccaggttgaacgaggcttgagaaatatacgagcgcgaaagagcgaaatattggtgactcaaatagagcaacttcaaagaaaggaacggatgtttagcgaagagaataattttctccgaaagcggattgtcgatccccattccgttttgacaactcctgcaagtggatctggaagcctccaaagaagtgaagtcgagactcaactggttatgagaccgcccagttaaaatgctgattttcttgttaatagttctcattgataatcactgtattcatatctgtgttattaatttattatgaaatgtttatgttaataaaaagtaaaggtgcttgccaaatagcatctcactgctcaacccttaaaaaaggtctcccatgcaggtaactcattgttttttaaacaaagcgcgtgttcaaaaaatagtcagtatgcaggcttactatcaatacatatttaaaagttttatttttatatatttttt

SEQ ID NO: 8159 - DNA, 859 bp, Pinus taeda
  Predicted polypeptide sequence is orthologous to G154, G1797
tagcagacaggttactttttctaagcgcaggaacggtttgctcaagaaagcttacgagctgtcggtgctctgcgatgccgaagtgggactcattgttttctccccgagagggaagctctatgaattcggtagttccagcatgcagaaaatagtagaaagatatcaaaaatattcggatgaaaatagtatgaataaaacagttagagaagaaaatactcagtctttaaagcgggagattgcaaatatggaagaaaccatcaggcttcttgaatcaacacaaagaaagatgttgggggagggtctggcatcatgttcagtgaaggaattaaataatttggaaagccaagctgaacggggattaagccatattcggtcacgaaggacggaaattttaaagaatcaaatcgatcaacttaaaaaaaaggaacgcgtgttaagtgaggagaatgcttttctccgtaaaaaatgtgctgaggctagatatacggatggttcggtttcggcaagccccacaaatggagttggaggcgtagaacagattgaagtcgagacacaattggttataaggcctccaaatgtacaataccgctttcctgttaaaaatcttcattgtaattccttgctagtctgatggatgttattttcaaattcaaacatgatcttgatttattatgagtattcttatcttgttaagtttcaaaagagtaaaggatgaaaactcattttaagttcaacctcattgtttaacaaaactaaaaaatacatatatattagccttactctgaaaagactaaattagggcttccagaggatgactgctgtaattagtaatttttttatataaatctgctttccatgc

SEQ ID NO: 8160 - DNA, 992 bp, Pinus taeda
  Predicted polypeptide sequence is orthologous to G1646, G715
ggacaggagagggcaggcagccatggaccaccacaaccaccaccaacatcatccatcttcttcttccggcggagcggcgccgcaaggcatgtctcagggctatccgggcggggcagctgcacagccctcgcctgtgggcatgcagggacaggccgggcagatagtgcagactggtcttcaccagagcggagggcagcaggccttccaccaccaccacatgcagcaacaacagcagcagcaacagcagctccatatgttctgggcttttcaaatgcaagaaatcgagcaggtgagcgacttcaagaaccaccagctccccctcgcccgaatcaagaaaatcatgaaggccgacgaggatgttcgcatgatatcggcggaggcccccgttctgttcgccaaggcctgcgagatgttcattctggagctcaccatgcgctcatggatacacgccgaagaaaacaaacggagaacgttgcagaagaacgacattgcggctgccattaccagaactgacatattcgatttcctggtggacattgtgcccagggacgacctcaaggaggagggtttgggtttagggtttgccagaggtggcgtaacccccgagggttctttctattaccctcctccttccatgccccaatcgccacatcagcagggaatgatgggctcctcttccatcatgatgggcaggcctgttccacttcagatggacccatcggccatgtatatgcaccaacagcagcagccccgtccctatggaatgccaactcatcctcaccagcccatgtggcagcaccctcatcatcctcatcagcagcagcaacagcaacaaatgccggacggacaaagttatggacatccacatcagcagcagcagcagcacatgccggatggccagccttatgggcaacagcagatgacagatgaacattcttatggaacttcccctcgttctgccaactgagaagacaagtgtatttttcacccac

SEQ ID NO: 8161 - DNA, 833 bp, Pinus taeda
  Predicted polypeptide sequence is orthologous to G1666
agagcggcaacaggccagcaatttgacagagtccacgggctttatcagtacaaaacttggaaaggattggcgctcacgacattcaaaacaaggtagtggtttcatacattggaagaacaatggtaattgtgttgttggcatcaaagcagtggcatccccgcagaggatattgaagaaggtcttgtttaaccttgctcgcctccacaacaaatgcaaagaagacccaggttactcccctaaactgggagaagaagaaattggcagcaagttggtgggtcgcaaaattgggcaggaagatctcagtgttagccatgtactggcagagcgcaagcgaagggaaaaattgaatgagaagtttatcgtgcttcgttctctcgttccttttgttaccaagatggacaaggcatcaatcctgggagacgccatagagtatctcaagcaacttcagaggcgcgtagaggagttagaagcatccagcaaactcatggaggcggaaattaagaagacccagaatcgaaacttaccaaagcgatcaggctctacagaaaacatgagaatgtccagacatggagtaaatcacgtggatagttgcctgcagtcttcttgtcttgatggggaactcggttggacgttgacagacacgaaacagccaccctcgaaaatgccccggttggaatctaagcgaaagctgaacgacttccataagaaaggatcatgcacactggcagcagcagcggcagatttggatgtttcagtttcagtcatcgaagacgatgctgttttggtagaaatacaatgcccctgcaaacatggcgtgcttctcgatataatgc

SEQ ID NO: 8162 - DNA, 789 bp, Pinus taeda
  Predicted polypeptide sequence is orthologous to G1752
ctccccctggttccgtgactactggctccgtgaatgccatgtagacaatgccgatggcctcagcgacatgttccccgaacttcctgacgacatcgacgaattcgccgaacttgaactccagctagaagaaaccgtccttcgaggccttcctgaaattgaagagggtgatcagcagaatgaagaaaacaggggaaaatatttcacagagaagaatgaaggtaatcgagcaacgggactttaaccagtttggtatggaatgtttttgtattgctaatgctgttatggtcctgactgattggttttcaatttccatcaggtaatgaacctaaagaaccgaacgcgaaattagccgcagaaaggacactgggcctgaagaacagtgctcatcggcaggaacctcaaagttataattagtattttggatgagggtttggttctatgtacaaggactggagatttgatcacttcatttgtctactctactccaagtagaacaattgtgacgttgttgctggttcctcagcgtcgttgttttgttgtgagacactgtacttttcttcttgttacagttgcagaaaattggatgcatgtgaccgaggaggggagtatagattcagcattcgatgtttatattcaattgtaaagctcagtggaatgtgggttggttatagaatattggggaggatgatgataatgactgtattcatatatgtttgaaaatggtaaatttaagaggatggtaaaaaataattttgcaaattataactttatgatatggtataaatttgt

SEQ ID NO: 8163 - DNA, 819 bp, Pinus taeda
  Predicted polypeptide sequence is orthologous to G1752
gaaaggccctggggaaaatacgcggcggagatccgagattccacgaggcacggagttcgagtctggttggggacttttgaaacgggcgaggaggcggccatggcttatgatcaggctgccttcgccatgagaggctccaacgcgattctcaatttcccccttgaagttgtttgcggctccttcaagcgccgccaggtccttcctgcttccagcgtcaaattctccggcggtacctctgaaatttcctccggcgtgaccacctccagtacgcagctttccgactgccacagccggatccagccgctcgacgaatatcactccagcacagccacctcggcgcctgcgaggcccgctgctgttaggcttgattcatgcagaaaaagacgccggctggccccacctccggcagataggttggcaaccaatatatctgatgaaagccacagcgtcgataaatctagcggagtgttactaatggcggagccaaagcgtgaggaaacgcagtcaatattggagttggaggctctggatgtggattacttggaggagcttctgctgtcctcgcaagaagatgctgctaccgcatttgaattttgatatttgtttctccaattccgtgtttcatctgatgtactgtttctgcatattgttatagtcatctgtagataactgagctgggattctcggaccaaagggccaattttcttggtaacggcatcaattctaaatgtaatataatgaattttcatttattttgtgattactttcgcacggagatataagtaattttaattatttggctgatagtttattaattta

SEQ ID NO: 8164 - DNA, 677 bp, Pinus taeda
  Predicted polypeptide sequence is orthologous to G1760
ccgcgtgccgaattcggcacgaggtctacatggaaataccattcccgcggaggacgaagggtcaacattgactcctgagcgtgccctcactgggggacagggcaagcagcctgctcacaaagaaaaggagaaagtttcaagtaattttttccaggaggctaaacggactgatgaaggacgcgtcggagctgccaatcctatgtgatgcgcgagcggcctccatcgttttctccaacagaggcagactctgtaacttctcctgtatcaggtcccgcatgtttattgaacgtcagctttggatccaacaatggaggatatgctcaattaaaacgtatgtgttgcgagttgtggatggattccctattaatcatttttatttttattttagctattacaattttcccagaaaagagaagtaaacaatttaaattgtttttttaactgacggttataggcttttgaggattatttttggatacattgagcgctcccaacttgtaaataaagactttattttgcgtagtgatgtttggggggcttatgaatatcaatatcagaaaaggttgcaggggtcacatgaggaaaggatattttaaaggaaaatatcagtaatcttactatgactgtggatatatatatatatactggtaagctttagactttatttggttttattc

SEQ ID NO: 8165 - DNA, 802 bp, Pinus taeda
  misc_feature (745)..(745): n is a, c, g, or t
  Predicted polypeptide sequence is orthologous to G1767
ctgctgaaaaacatactcatttgattccacaagaaaaatgatcttgaaattccaggaatcaagcccatggacaacctttggtcatgttgctgccaatggagcaatcctggagtcctttgagggagaaatgaagctgcacatagttgacctgagcaacactttttgcacacagtggcctactttgttagaggccttggccaccagaagtgatgacacccctcatcttaggttgactactgtggtcaccagcaaggaagccacagccatgaaggtcatgaaggaaatagggcaaagaatggagaaatttgcacggctcatgggggttccatttgaattcagtgttattcatcaacaccatctccacaagctcaacgttggtgcccttaaaatcagaccagatgaagctctggccatcaactgcatccacagcctgcaacgtgttaacaagaatggaagggattccatattgtccacgttctacagcatgaaccccaagatagttactgttgtagaggacgaagtagacctgactcatgaagattttggtgattgttttagtgaatgccttcgttttttttccttgttttttgattctctagaggagagcttctccagaaccagcaacgagagattaatgcttgaaagaaccagtgcaaggagcattgtgaacatattggcctgtgaggattctgaagtttatgagcgcagggaaaagggtgcacagtgggcttggaggctcaaggangcaggatttatacatgctgcattcagtgatgatgttgttgatgatgttagggctctt

SEQ ID NO: 8166 - DNA, 606 bp, Pinus taeda
  misc_feature (394)..(395): n is a, c, g, or t
  misc_feature (400)..(402): n is a, c, g, or t
  misc_feature (404)..(404): n is a, c, g, or t
  misc_feature (472)..(473): n is a, c, g, or t
  misc_feature (495)..(496): n is a, c, g, or t
  misc_feature (542)..(542): n is a, c, g, or t
  misc_feature (544)..(547): n is a, c, g, or t
  misc_feature (564)..(566): n is a, c, g, or t
  misc_feature (569)..(571): n is a, c, g, or t
  misc_feature (588)..(590): n is a, c, g, or t
  Predicted polypeptide sequence is orthologous to G1781
attttccgctgtttccaatccatctgcaagcatattgccaccatcagtaggtcaacaaccatttgatggaaggaagagtgaacttattcaaaatagttccatcaactcagatgatataccctctgctaccacattgggattgggtgataattgtcagccatgcattcttcatgtgaaaccattcagacacatagcgggaagttcatcatttagtccaaggttagattcatctcgacttctgaatgggcaagctaagcaaaaagatcaggaaaaacctggtgtcagtcccattcgaagtcggatattgaacgatgactttgagtctgggaaatctttgcacgagaatgaatcttctgagcaacattattttccgtcaaattacacaccctcgcannaagannntnatgtggagaaagatgttgcttatagaattcaatcaaagggtttattctcagattcgtctactgagacnnggggacttgaagtattaattannacacagaatggaagtggaagttctaaacaaaatggacattccattncnnnngctgtttcacttgtgannnatnnngaacaggggagccttgnnnatggtgttcatatacg

SEQ ID NO: 8167 - DNA, 864 bp, Pinus taeda
  Predicted polypeptide sequence is orthologous to G1781
aggatgattacagcatgagaatagaggccagcaataaaaatacttacatccatatatcattacatatggacttaacctatccaacaaagttactcactaacttaggacaaaactgaccttaaagctgctgcttcaatatacaagggccaccaacaataagatttttgatgatcatcttatgaattctaggtatgtttagaagattaaaacagaaggaaagactaaaagaaaaatcagcaggctttgattattattagattgatcagatcactttataatacctagaagggacggcgaccatgtcctgttgctgctgggtctgcccccgaaggtcccctgccatgcataggcataggcaagggcatcttgtaagtcattaccattgggcggttgtgggcactaggattacatgcctgatattgcaggtccggctgaggttgatctacttgaagctgcttgctcatggaaagtttctcgccctccagttctctatacttgtccagataaaccttgaggggctcagcgtagacttcgaatccgagagtggtcatggcccatagtatgtcatcgccgttgatggtcttgcgcttttccttgtgacacttgtcggatgcttctccagtaacaaagctaatgaactcggagacgcattcttgcatgatttccttggcctccttggagatcttggcgttggttgggagggttttcttcatgatgcgccccacattggctatgggaagcagccggtcttgctctcgtatgatggattgtgaggaagaagaagatccattattgtggatgccggtagactctatgtcagaatgagggctgctctctccaccactgtggtctcccatttacgaa

SEQ ID NO: 8168 - DNA, 780 bp, Pinus taeda
  Predicted polypeptide sequence is orthologous to G179
ttttgaatgcaagcatatttagataaatattttatgaaagaactaccatcaaataaactaaacaaactaaacaactggttgtgtacctgttcatgaacatatatacttccactgtcaatatccacaagttgtattcaaagatatagcataaatcgaaagagtgcagcacccattagaaaattaatagactgtcttatagactgtcggcattatgttgcagtcccatcattcgtttattgatgctgttcaaagttcccgggaagataattacggactgaagataaatgctgcaataatggggagacggtaggttggcgttgctggtgaagtatgtcaggctgtgcaatataatagatcacacacgggctctcatgattatgtctgcccaggtaactagttatgactactcctttatcacgggagtcgcgttccactgttttcttcacatcacagttgctatccgagcatctataatagttcctcggattggtgctgttcttcacgaatttcttcccgtacttgcgccacttatagccgtcttctaggatgtcaatttcggatctggtcagaaaggcgtatttgagaggtcgttctgcctttctcttcctgctgctcttcttagggcttattgcctcctcaagctcatggctttggatcacattagaactgtgatccagatgaaagccccggatgcacggtggattactgtaaagagagtccgcatattcttgctgcatacctggtccagtgttgacatcttttatgttgttaacctcatca

SEQ ID NO: 8169 - DNA, 819 bp, Pinus taeda
  Predicted polypeptide sequence is orthologous to G1804
cttcctaaggcagaggcaattgtacccaagcaggcccagtttctcctatctgctgcaccaccggtggctcaggaatttgctaaaatcgcagttaatatcatacttaaaggtgatgtggctgctagaggatatgcaaaagcagccagtgcattgcaaataacagtagatgcagtggatcagggagtgaaaatgctccgtgacatcttcataagatcagctcaatccaatttgtcagctgtccagatgactgaatttcttaaagatcttgggttccatagtgagacaagagaatgcttggtagattactgcagtcaacgattcggggaaataaggggtctggttgcagttccaagacttaatgtgtcatcatatagaaagctggaatggcggcttgatgtgcagcttggtagcagaagtctgtttcaccagacagaaccatccttccttctgaagctttcattaaatcgagaacatgtgggaggagtgccatcatttggaggtaaacaaagccagtccaaagcactaaacaacgaaagaactgaaaaaaaagttatctatttggaagcaaactatgcaactctgaagacaatctcctcccagttagaacaggctctggctgagcgcaggagcaggcgtagccgcggaatactacagcaattgcagtaaagatctggacaattttctcctttcttgtctccagctgtagttgtatttggtcctttgtgttggcctacatgccatgcaaaaggaaaattgtttttttcattaatgcaaattatccatggggatatcatgcttttccacccgaagaggccagat

SEQ ID NO: 8170 - DNA, 911 bp, Pinus taeda
  Predicted polypeptide sequence is orthologous to G1821
tggagctcgatcttcggtcttcatcgatatcataatctctacctctatctccatcggggcttcgttgcctctgtatgtttgtaggtatgatgtccgaagttggcagcccaacaagccaggacagccgcaactctgaggatggagaaagggagaactgtgctgtgagagagcaagataggttcatgcccattgctaatgtcattaggataatgaggaaagttctacccacccatgcaaagatttctgatgatgcaaaggagaccattcaagaatgtgtgtctgagtacataagcttcatcaccagtgaagcgaacgatcgttgccagaaggagcagagaaaaactatcactgctgaagatgttctctgggctatgagcaagttgggttttgatgattatgtggagccattaactatttacctccagaaatacagagatgctgaaggcgatcacagaggctcaatcaggggtgaaccccttccaaagaaagagatgagtggtctagctaatttgtctgctggttttcagatgggtcatcctcctctttatggcacctcaggaatgggctattacaaggattcaatcacaggttctaatatcaattatgatccctatgctcagtataaatgatcaaagttgaattgatttcccaatgatgattctgttcctatgagattatgaaggtttttctcaagtcaagaggtcctctatctaaggtggtaatgattttggttcgtttccacctacagattttctgcgttattctcctttaattcatgtgacagtgagttactctctttattctctacccagtgataaactgttgagaatagactgatggatgcgattctatgtttctagggttttattaatttaaaagactgcctatcttaaatatatctatgaacgttt

SEQ ID NO: 8171 - DNA, 888 bp, Pinus taeda
  Predicted polypeptide sequence is orthologous to G1855
taaaaatgataaccctgatgatgcttggtatagaaaaatggaaacctgcataacaccacttccagaggtcagtgatatcgatgcagttgcaggaggagccttagaaaagtggccgaagcgtgtaacagctgttcctccccgaataagcagtggcagtattcctggaattactgctaaaaaattcaatgaagattctaaactatggaatgacagggtagcaaactacaagaggcttataggacaactgggtcaaggaagataccgcaatatcatggacatgaacgctggtctaggaggctttgctgctgccttagtcaatgatcctgtgtgggttatgaacgttgtgccatcagatgctaaacataacactcttggtgtcatctatgagcgaggattaattggaacttatcagaactggtgtgaggccttttcaacataccctcggacctatgacttaattcatgctgccggtctcgtgagcatgtaccaggacaggtgtgatttaagcgacattcttctggaaatggaccgcatcctccgccccgaagggactgtgatcttcagggatactgttgatgttttggtgaaagtggagcacttgattggtggcatgagatggcgaagtcagatgatggatcatgagagtggtccctttaaccaagagaaaatccttattgcagttaagcaatattggactggaaaagcagaagatagaagctcctaaagcagggccatgttttctttttgtgttttatgttgtattcattggttttgggttttgagaggattataaggggttgctctctattctcaacttgtacaacaattcaaatttgcctggcaagggtgaattggttttgtttttaagacggtgtttcttatcaagaa

SEQ ID NO: 8172 - DNA, 759 bp, Pinus taeda
  Predicted polypeptide sequence is orthologous to G1855
cggccgggagaaaagcaggagttattgaaatgccttatacctgctccgccaggctataagaatccattttcatggcccaaaagtcgagatttcgcctggttttccaatgtaccacacagagaactcagtgtagagaaggctgtgcagaattggattcaagttgatggagataaatttcacttccccggtggtggaaccatgtttcctcatggtgcagatgcttatattgaaaatatcaataaactgcttcctttgactaatggatcaatcaggactgccattgacactggctgtggggtcgccagctggggtgcttacttgttgaataggaatatcttatccatgtcctttgcaccacgggattcacatgaggcacaggtgcagtttgctttagagcgtggtgttccagctatgattgggatcatggcatctcgccggcttccatacccagcaagggcttttgatatggctcattgttcgaggtgtctgattccatggaataaatatgatggtatcttcttgatggaagttgatcggatcttgaggcctggtggttactggattttatctgggcctcctataaattggaaaaaacaccataatggctggcagcgaacaactgaggacttgaagcaagaacaagatgaaattgaggatattgccaagcgtttgtgctggaaaaaggttgttgaaagggatgaccttgcaatatggcaaaagcccacaaatcatcttaactgtaataaaataaaagcgaga

SEQ ID NO: 8173 - DNA, 843 bp, Pinus taeda
  Predicted polypeptide sequence is orthologous to G1855
cggccggggatactcatgaccattttctgattcacggagatttatgagactcgtcgcatgagattactggaagctgtgctcgcaattcattggaggaatgattgtcaaggtgcccaagttgctatcaggctcagctgctaattcttcaagattcttgagattcagagcataagctcattgtaaacagtgattgcaattcgttggaggaaagattgccaaggcccgcttgctaattcctcgggatatatgagattcagagcatgagatcataaccagtgactgcgattcattcaaggaaagaatgccaaggcctaccttctaattcttggagatttataagattcaaggaaatattgcgaaggtgtccaattttttagcagattcaaagcacaagatcactataatcgttaattgcaattcactcaaagaaagatttctaaggtgccgaagttgggattaggcaagatggtgaaggactacagcgcaacaaacagattttatcagttttattctcagaaacgaagtgttatgcagatcattgcgttacttgtgctgtgctcttttttctacattctaggaatatggcagaacacttattcgacacccataatccccgccggactggattgttctaaatacaagatagcgatatcctcatcttcatctgtttccttagattttgaggcccatcatatgctgggagtggatgatatttcaaattcaaatataagtttcgcaccatgtgatatgaagtacagtgagtatactccatgtgaagatcctgtgagtctcccaaatatgacagagaaatgctcaaatacgagagcgtcattgcccagaaaa

SEQ ID NO: 8174 - DNA, 777 bp, Pinus taeda
  Predicted polypeptide sequence is orthologous to G1855
cggccgggggaaaaaggttgttgaaagggatgaccttgcaatatggcaaaagcccacaaatcatcttaactgtaataaaataaaagcgagagtcttcaaggttccaccaatttgtgaagatggaaaccctgattctgcttggtacaagaattcggagacttgcataacccctcttccacaggtcaaggatattagagatattgcaggaggggctctggaaaaatggccacaaaggctaacatctgttcctcccagaataagcagtggaggtatcccggggattacagctgaaaattttactcaggatacagagctttggaaagctagagtgtcatactatggaagtatgataggtgatcttaagaaaggaagataccgcaacatcatggacatgaatgcttatctgggtggtttcgctgctgcctttgtcaatgaccctgtttgggttatgaatgtggtgccatcagatggtaaacacaacacactcggtgtcatatatgagcggggattgataggaacatatcagaattggtgtgaagcattttcaacatatccccggacatatgacttaattcatgccaatgaagttataagcatgtaccaaaacagatgtgatattactgacattctgcttgagatggaccgcatcctccgcccagaaggaatagtgatcttcagagatgatgtggatgctctggtgaaagtgaaacatatagttgatgggatgagatggaaaagtcagcttgcaaatcatgaggctggtccccttaataggca

SEQ ID NO: 8175 - DNA, 864 bp, Pinus taeda
  Predicted polypeptide sequence is orthologous to G1888
cggccggggaactccactcctaccatattttcattggtattcacgtgggttttgcaatcccatcacgcggccacagccctcgttagcgctctccccgcccctcttctagctctttgaccatgatttaataccagtggctagtggcttctgcagatatgcaggagattcagcgcccctagaaagataatactgaaatatacaatatactgttgtgggaaggctggatcagtaatcctgaatttgttgtggattcggaaaaaagatgaaggttcagtgcgacgcgtgccagagcgcggaggcatctgtgttttgctgcgcagacgaagctgccctttgtatgaaatgtgattccaaagtccatgatgccaacaagctcgccagcaagcaccgcagactctctctcctcgagcccagttcatcatcctcctcggattctcttatatgtgatatatgtcaggaacgaagggcgttcttcttctgtcaagcagatcgggccgtcttatgcagagattgcgacttgtctatccattctgccaacgaattgactgcaaaacacaacagatttctggttcccggcaccagagtttctctgaaaccaatagagactttggctgcccctgagaaagctgtggccacggccgctgtcaccaaggcacttatcccgcctgtccaaaagatgccggatcatgcccagccatcaatggatctgcctgtagaaaccgtgactgcaagtaccagtaacagcgagttctcacagtacttgagcgaggttgagcaattcctaacctcggcttcccctgagcgtctagactggggtgatcagctgagctcacgctattggaaagtatatggagtcggcttggg

SEQ ID NO: 8176 - DNA, 824 bp, Pinus taeda
  Predicted polypeptide sequence is orthologous to G1944
gtcctcccgcggtggtggacggttcgagcccccgcggcggctctcagtattcgaaacgttacaaatccggtggccgcagcagctaagatcaagatcagcttcttttcacactaaaatttactcttattcagatctggaatctctgctgctttcagtaatgctctagaaaacacacaagaaattccatataactacactgagatttataaagaaattcaagcctataagctgaattaagcagagtacagtagagtatttatgaatgaaaggagagatttccccggccttcatacttcagggccgacttcattcttacacccaggattccaacagcatcaccacctccacggctccacgaatctcaatgctgctgctgctaataacaatgctatttctaatgtcaatccattctacatcccacagggaggcattgccagtaacgctacactgcgcttcatgtccagtcctccttcatctttagcaattggcaatgccaatccaaataattctcctccagaagggcctgctgcttcaccgggtcctcataatccattacctcctagaatgggaatgaatatggggtttcgttcagagcctttgaagagaaagagaggaagacccaggaaatacagtagtgatggagtaggtttgggattatctccattgactcccagctctcagtcattatccgaaaaacgagcccgcggctccggctccggcgccgggtccaacaagaaagttcagttggctgcacttgggagttcgggtcatgggatttactccacacatcatcacaattgaagacggggagggatgtgtcgaag

SEQ ID NO: 8177 - DNA, 827 bp, Pinus taeda
  Predicted polypeptide sequence is orthologous to G1950
ccagaattttcagtgtagtgcaaacaagggaaacctattgcgccatttttgttacgaggggagtgaagggtgccgacaacagtcaaaacgccgttctgagttgaacttgacaaacaggtcttcttttccagtgttttgaagaaagcaaagccatggcggaagacatggacgtggacacaaaagaagtaactggcatcgaggacgcggatctgttcagggctgcagagggtggagattcagggctattcgagaagctctcaaggaacgaggtggagcttaacagagtgagatcaatcaggaatgaggacgcgcgttctcttctccatgttgcagcggctgcaggccatcatcaggtcgttcgcatattagcaggtcttgatccatccgtaagcggtgtgaacaatggtgacgaggaagggtggactccactccattctgctgtgagcagtggacatgctaatgttgttgaagcattattgcaagcaggtgcagatgtttctgtggcaaacaatggtggtcgcacagctttgcattatgctgctagcaaagggcggcttaagattgctcaagttttaatctccaatggggccagcgtcaggcgaaaggacaagtttggttgcactccattgcatcgggcagcaagtgcagggcacccagaaatatgtgaactgttgatagaggaaggtgcagacattgatgccactgacaaaacaggtcaaacacctcttatgtatgcagtaatcagcaacgacaagcaggttgctttacttctagtaaggcatggtgcagatgtcgattgtgagacaatgaaggttatacagtccttg

SEQ ID NO: 8178 - DNA, 795 bp, Pinus taeda
  Predicted polypeptide sequence is orthologous to G2
acgaactttgatccttacttatatgaaaaagaaattcttgaagaaagaagagagagtcagacttctacaggttgtgaccagaatttggaccttagccttgggattggtcatgttccaacgcaattaaagaaaagcccttcatacaaatctagggcagaagaagacagtcaaccgaatcacattggaggttcaacctattcgaaccatacacaggattcgaaggttttgtcatgtctcacatctaaaggggacgagaacgctgtaccggagtttcaggtgttgcctcgtggtcatgccctatattggaattctcaggtgctgcaagttccagaggccatgaaatacaaggaatctgaagctcacaggagtgaggataatgcttatgagcaaactgcaacatcagggagccaattatatcctgaccatctcgggaactgcaagaaattgaatatgatggaggatttgaaagagcaaagctttggagtccctgcatcaactgtacccttttggcctatgagacaacaacaattaggatggacttggcaactgcatgctaagggaccaactagtccagtattcaccaccaacagatcctcctcatcaggattctcaccgcaaatccataccgcattcgttccttcaacacacgggtctcacaacatgggattacaatgggcagcgcaatcgactgatccctgcatggttcaaaccccaagcccacatctgtcaactcgtctgaccaatggaactgattccagcgaccatatggtgggttcaaatcttgattttccagcc

SEQ ID NO: 8179 - DNA, 598 bp, Pinus taeda
  Predicted polypeptide sequence is orthologous to G2
gggcaaggccctcacctgttgttatcatagaagggtaaattatttagaaatcgatgctgacgatttccctactgccatttgcgtgatggatctcagccgaacgtgttaatttctataccaggtggcctttctgtgattagttcatcttggtataattcaggctcgaagtttgttactgctcctgccccattgcatctgatggcagccctatcataggctcttgcatcttcgatctcactatgactcccatcacacttgtagaatgttacactgttgtactgagagctcctagaccgcgggtcatgcctgcttttcttactcggttgagtgccttccatcatgccttttgatgctcaacaaggtcgggtgaatcacagaacgttacattcgtccagcgagatcaggttagggtatcaagcggtggtttttccgggtcttcgaccgggaaaaattgttgggtaacgccgtcgtttccacccgggttctcattggcatgcaatatcagattcttcggcatgattttctattcttcttgtgatgcctctggtggtggttgaacttgacatgtgccgtggaaattttcttgtgagggtccctg

SEQ ID NO: 8180 - DNA, 524 bp, Pinus taeda
  misc_feature (423)..(424): n is a, c, g, or t
  misc_feature (449)..(451): n is a, c, g, or t
  misc_feature (456)..(458): n is a, c, g, or t
  misc_feature (471)..(471): n is a, c, g, or t
  misc_feature (497)..(500): n is a, c, g, or t
  misc_feature (518)..(521): n is a, c, g, or t
  Predicted polypeptide sequence is orthologous to G2053
gtcgctttggcatcgatttaattataaatgtggtggtttatctgtggaggagcatctgaaagactgtcgaagttctgtgacaacaaacatggaaaaggaaagcacagagaaccaaagactctgattgggattctgttagatacatccaaaccagccttggtttaaattcagaaatatcttaaacaagtgagatccaggaaactgaccgggagcctgaccagtcccaaatgaagacaaatacaatgttatttgcagaaatttcgaattgtggaataaaacacacaagcagcgtggaatagtgatttgaactcattgcaaggagcaacttatggttggtgaggcaaatagtataaatttgcccataatgtaattgtttgcttgtgttgtgactttcatggtggctctgactatgagttttaaagnnatatatgccattgtgcttggcgacnnnatgtnnnaaaactagtgtantatggcaaactattgtttcttttgtnnnntggatggtattttttctnnnngat

SEQ ID NO: 8181 - DNA, 905 bp, Pinus taeda
  Predicted polypeptide sequence is orthologous to G2071
gaaccaacgaacgctggcttcaaggttttcgttttatctttcttatttcacttccttggatttagtttcctttccgatcctgaaaccgattcattgtgtgagttttccgcgaattaactgatcagggtttcggcctctgtatcaaatgttttggggagcttttctggtttgaaatgacgaggcccttggcgaaatcactgttttccctaagctgaatgactacaacccatcttcaaggcatctataactgtaaatttcgatacctgggtcgatccgtgtgcgaccctcgtccgagaaaagagagcacagcagcattggtaggtctcgggttcaatacacagctggggaagaatttcaaaataaaacgcaagcctcgggtttgggctccagaggcacacacgacaataatacatcataggagtagcggcgtaggtcgtgtgttcaaaccccatccagggaaaataccgtgaagctcgcttgtcgcaagttcgactgacatcgactgaattgcatttcttagtcggcaaaaatattaaagagtcaagacaaagagggggttacgggagcaggctgcgggttcgatcccaagataaggaaaaaagaaagaaaatttcatgaattgggcctgtagattccagtcacgaaattaaaacctatcggtctcgtcttcgagctaaagttggggaaaaagctaagctctcagggaatgggttcccgcacaatgctgtcctctaatggtggccggacacctcagttccaaccgctcgttcgtcagaattctttatacaatttaacgctggaggaggtccagaaccagctcggggacgccagcaagccgcttagcagcatgaacatggacgagctcctgaagaacatttggacacaagaagaaagccaggctatat

SEQ ID NO: 8182 - DNA, 814 bp, Pinus taeda
  Predicted polypeptide sequence is orthologous to G21
cgtcgcgtgccagtttcgatgaacatgagcatgcccgcagtccatgtgcaaattctgcttctcctcctgctttaacaaactcctcttcattttctgattcctctgacggaaactgcataccttccatattcaatgcggttgaatccgcttccactggaagctccgcctcggattgtacgcggagattaatgcacaatagaatgcgtaagcgtcgtagacaggagattaataatgcagacgagcctggcgaagtggagtctgccgtgtgtaatggagatgaggagcagggggtgagaatcaaagaaaagcggcaccgtgtttacaggggcgtgagaatgagaagttggggcaaatgggtttcggagattcgagagcccaagaagaagtccagaatttggctggggacgttccccatacccgagatggcggctcgggcccatgacgtagcggctttgagcatcaaggggaaatccgcgttccttaattttccccaaatcgcctcgtcgttgcctcgccccgccacattgtcccccaaggacatccaggccgctgccgcggtcgctgcggctgagtttcacatgccttcagaagaagatcgtagtgaggatcgatcccttgaccccgtcgggatgaacaatgcgatccctagtcatacagactctgtgatccctgcacagtccaggaatatcgaagaagcagcagccgtttccgcgtcgaattcgatttgggtttcgagttttctttcggagaacgagtggatgaccatatacgacgatatagtgttggatctgcccaatattgtgggaaacatggc

SEQ ID NO: 8183 - DNA, 707 bp, Pinus taeda
  Predicted polypeptide sequence is orthologous to G211
taatttaaggatatgatccattgagacctgtacaccgggatcaattggtttctggatcattgccagagagtagttgaaattagaaaatgggtcgggctccgtgttgttcccaagttggcttgctcagaggaccctggaccgccaaggaggacaatctccttaccagatatattgaatggcatggcgaaggtgactggagtaatctgccagagaaagcaggtctggggcggtgtggaaagagttgcaggctgcgatggctcaattacctgagacccactataaaacgaggaaacatttcccaggacgaagaagatctcataattcgcctgcatcggctccttggcaacaggtggtcgttgatagcaggcagattgccagggcgaacagacaacgaaataaagaatcactggaatagtcatctgagcaagcaactaagaaagcgagggatcgatcccctcacccacaaacctctcgaaccaaaccctgaaaatattgcagaccattatactcatgaaaatagcaaagccagcagcctccaagatggccatgcacaaattgggcaaaatcaagagaaacaagccacagaatcatcacccactgatcaccaaaacactgctactctattaatgcagcaacctgttcatttccccaaagcaaacagatatatatcattgccttcaggggctaataacaatagtgaccattct

SEQ ID NO: 8184 - DNA, 840 bp, Pinus taeda
  Predicted polypeptide sequence is orthologous to G2157
cttccgcgattatgtggacgactttaagaacgattccaactctaaagaacgagggtcgaaccattagcgtccagagcagaagcaaatggacaaccagagacaactcttaaaatgaaagccagaagctacgctcggaggggaaggagaaaaaggtgatgaagtagggctctacaggccgagagaaaagccgagagaagcccaagccctggagttctccaatgggtgcaacgtgggagagacagcagggaatctctgtgttaggtggcagtggaattgtgattaatgtcaccgtccgccgacctgctgcgaaatcgtatcctttcacggccgctgtcgggaagaagtactttgttttcctctgcagagttctttaggtcgaggcaaacacactgggagaatcagggaactcgcaattggacatcacaagggttttaaacattgtcatttggagggaattcctgcgcgttttaaccactggcatttgaattgatagagatattccaggtgaaggcaaagaagagtgttcacaatcgtggaagaaggtgaaacgaggacgttttgtgcaggtctgagggatcagcctcattcttcgtctgcaatcaggttaaaaggaaggatcaaatattaaattatggagggaatggaacatttttataagtaaatttaagacttgttttttgatccatgagacaaacctataatatgattccatgtgtatttggattatgattaaaaatggctcggattaaagatgaattaaagatgaattagtaggcggtgatcaatgtacatttcttaatcagacatggtctttggaatgagcttgtttaatattgatac

SEQ ID NO: 8185 - DNA, 871 bp, Pinus taeda
  Predicted polypeptide sequence is orthologous to G2157
ggaacttggtgaaaaaaacagatatctacattgagtagatagagacgctgtgaactactctccctgctgagaatagaagtgaaaagcgcaggccgtcttccatggcaaacaggtgctgggcgaataatgtaacgatggcgggagtccatccagaggaattttcatactctggttcccacgtttgtcctcaatctgaaaaccctaggatcacttcccaaacaagcagccgatcaaagaaacagagtgtaggtgatggcaatgacagcaatgcagaccgtaatgtcactcgccaaacaagcaaccgatcaaagaaaaggagtatacgcgatggcaatgacggcaatgccaacaaggccgatgagaaacgtccggaaatgggtgttccagtgggaacctgtaagcctcgcggcaggcccaagggctccaagaacaaatccaaggctcctctttctgaaaatcctgaggcaccagaaacactggagaaccgtatttttgagatcgctagtggggtagatatcaagaagacattggagaagtttgcgctgaaaagccagctaggaatcctcattttcagtggcaatggcgccgtcacgaatgttacactcatgcagcaggcagttccagggggaatggtgacatattcaggacccttaggaattatttcactttcaggagtgatccatccagctagtggcgctgccagaattacagcgattttagcagatgggcatggtatgatagttgctggtgaagtaacacggagcctggtagcatcagatcttgttactgtggtaactggagtggcccctaagatacttacgagaggtaaatgtgaaatctttggaggtctagcctcttcgagttttcaaat

SEQ ID NO: 8186 - DNA, 757 bp, Pinus taeda
  Predicted polypeptide sequence is orthologous to G217
ccatacgtgatagttttggtgctatcttgatgtttatttgctactatttccttttccagtgtatatgtacccttttacagtgtgtttcccttagcactttgtataaagattaactttctggattgaagcttttcatgcctttgtctattgcgaagctactagggattccatgttatagcggatatacaaagtgtttgccaaagcaaagcaaaggaatttccacaaagacgccggattttgtcgaggttgttttgggatcgaactttacatatttgtagtgagtatattattgatcgggaaactttgctaagagccaagttaatgaatatataaatattattcctaggtagggttctggataaaattgcggtaagatgaggattatgataaagggacgtgtttggaaaaaaaccaaagattaaactctgaaagcagttgttatgaaacatgagaaaaatcaatgggcacatatttcttctctgctcgtttggaaatcagcgaaacaatgcaaatctcagtggtatgaatggttggacccctccatcaaaaagtacctttttcgtggtaaccactatgatactactgcacacaagagcagacacgactgccactagctaactcaggtatgcatcttacacccatggtaggccttggctttttacttcccatggttttcaacaaaagtttctggctttaatactcctctccaggttggtggtatgtgcctacccttaaaggagtcttcttggttagtgag

SEQ ID NO: 8187 - DNA, 889 bp, Pinus taeda
  Predicted polypeptide sequence is orthologous to G2226
aggggtggccagacgcttgcagaagaggagaaattagaacttagaacttatgggtttcccgagcttccccggtgtatcagcatggcttctactgatcatctctacggtcctctcagtccaatgcatcaaggacattgctaattcaatttttcatattttccacatgatcttctccattagaacttctgctaataacaatgatacccaattcatgagagactcggctcggctcccttttgaagaagagaccccagtattgggctcagggctggcgcaattgcccccgatagctgaagaaatcaggggaagcctgcctgttactcattatcaatcatcacccacaaatgcccatgtggtggaatgtgctgtttgtctgtcaagttttgaggaaggggatgatataaggcagcttccatgctgccatttctttcacagagtttgtgttgataagtggctggatcaccaacagacaacttgccctctctgcagagcatctcttgtgccagaggagacagccaataagctgaggagaagggaacaagaactcacagaggagctcatgttttggttctcttctttccatggccatggattcaacagcatgtggtggttaaggtagctttttgttgttgtatgctgttcaagttttttaaatttattctcagtgcagatagattatctaagatacccatccaagggtttcctctgttttttctttatatataatttagctttgtccttactttcagaaagtaaggacacccaatctgtcaattgttgtgggatggcccatcagtcaaacagttaggcatttcgcctggatcttgtatatgaagtactgtacatatatataaattttttcgttctctatatgcaaacatgcttgtct

SEQ ID NO: 8188 - DNA, 809 bp, Pinus taeda
  Predicted polypeptide sequence is orthologous to G2226
cggccgggggggtggggtgggtttatttattaggaatctgaatggatggatctatattacgcgtgtcaagaatttgtatgaaaaccagagggtgcaggaattagaccaaatacggtgagacaggttgcctagaaggtgagcacagccgagggtgcaggaattttgagcaaatacagtgaagaaacaggagcggtgggaaggtatttgctgctgagcagagaaagatggggctttcaagattcccagacgcgtttgaaggaggagtgataccacttttgatcatccgcacagctttgtctatagccatggtgagggacgttctcatctcgtttcttcaaaaaatgggtctcaaagtgattacagagcaaccagaattagcccaatcatctaggtcatttgtatatgctgaagaagaagctgctgaattgggctctgggcttgcagagctggccatgaccactgaagaaattggagataagcttcctgtatcactgtttcaagtgtcgtcgtcgtcgtcatcttgttcttgttctggttctgatggtgatggtgtcactgagtgtgtggtgtgcttgaggaaatttcttggaggagaggagattcgaagcctgccctgccgtcatgtgttccacaagatttgtgtcgacaaatggattctggattatcagaatatgacatgccctctttgcagagtatgccttgttttttctgtagaggacgagttgagaagataagggaactggtaatgcagttttagtcctagttttcctgtagaggatgagtagagataaggaactggtaatgcggtc

SEQ ID NO: 8189 - DNA, 967 bp, Pinus taeda
  Predicted polypeptide sequence is orthologous to G227, G242
aacaatcatcacgagatgaaattcccttcagaatgggatttctgagattcgatccttgatctgttgctgcgatctgatcacattttattgggggtttagggtttaagttttctctgctaatggcatcgatgaaaggaaaatctccgggccacgatgagcccgatcggatcaaggggccttggagccccgaggaggacgcagcgctgcagcatttcgttcagaaatacgggccacgcaactggtccctgatcagcaaagcgattcccggccgatctggcaagtcctgcaggcttcgatggtgcaaccagctgagcccccaagtcgagcaccgccccttcactcctgaagaggacgccactatcgtgagagcccacgcccagcacggcaacaaatgggccacgattgcgcgcatgctcagcggcagaaccgacaacgctatcaagaaccactggaactccactctcaggaggcgttgccaaggtgggggcgccctcgtcatcgacgacgagatctccagcggcgccgacgggtttcgaaaacggaacctcagcgaagacgccgatgccagccggaaattcaagaagctcagcctcgggacgacgacaacgaccacgaccacggagcctagcacctcctcggcctcggatcggagcgactcaagtctggtatttggctcccctcatgtctacaaaccagtgcctcgtccagctcctctggccctgactagcgaacccaatttaaatctaaatcatcacgaggcctcctgttcgagcaccgacccaccgacttctctttgtctatcgttgccaggcactgacgcccctgcaagacctagcgttgtccccattgccctgccctcgcctgtcacttcttctcctgttgctcctccgggatacatcaaggctgaagaggccatggaatggatgaactctgccataaacaccacattgactcaggtgcttacccc

SEQ ID NO: 8190 - DNA, 941 bp, Pinus taeda
  Predicted polypeptide sequence is orthologous to G227, G242
ggtctgcagttcgaatccgattacgatcgtgttgtgctgaaacaatgggagttccaaaggacgaagcggcgatggcaatggcggtggcggagcggatcaaggggccatggagtcccgaggaggacgcatcgctgcacaagctggtggagaaatatgggccacggaactggtctcagattagcagaggaattccgggccgctcggggaaatcttgcaggctacggtggtgtaaccagctgagcccccaggtggagcaccgccctttcagcccacatgaagacgccaccatcatacaagcccatgcgcggcatggcaacaagtgggctacgattgcccgcctcctccccgggcgcaccgacaacgctatcaagaaccactggaactcgactctgcgacgtcgctatcatggcgagaaagaccagagcaacgggctagctgtgaacttggagtcggcagctgaggacaaagaaacgatgactccgatgacacctgtcacagccacggcaacggcaacggcaacggcaatgccagtggctttagtgttcccaacggctgcagacaacgtcaggaagcggagcaacagtagctgcagcgctaatgacaatccaggagatgccgaggtcgaatcctgtaggcttaagaggctcaatttttctgaatccccatctagctctgaaaatattaataataataataataatgaagaagctgttagtggccattgcaattcggccgctgccccgggttcgagtcccgggcaacagctgcatcgccctgttccgcgacaatctgcttttaattgctatgaagctgtgaaagtgcaggaggaagcgtctgcctctgtttctgcttctggttcggctggcgctttcgatcctccaacctccttaagcctgtcgctgcctggaagcgcttctacaagcgagaataacagcagtgga

SEQ ID NO: 8191 - DNA, 961 bp, Pinus taeda
  Predicted polypeptide sequence is orthologous to G227, G242
cgaaaagggcatcgttgtccacctggacgacgaaatcagcagcttagacgccgctcgcaagcggagcagcgacggcttctcccacgatggcagcagtgcgctggaggacaacggatgtagcagctgggaagtggactccaagcggctgaagagactagaagaactgggaacagagcagggccccgaggttgaagccgaggtcgaggtttcggaccggagcgacgccaacccgggacgcgtgctgtacaggcccgtgccggtcgtgtcttttttcagttcattcgggaaaaccgttgcgaatctacaggaaacggcggccggcgcagtcggtgtcgatccgccgacctcgctgagcctgtcgctgcccggactcgatcccgcgatcccctctccgaagctgtccactcaaaaggactctcacaacaatagcacagttaataacaatattcctattccgccggtggtggaatacatgagagcagacgaggcggtggtggagcgactcagcaccgccgtcaaggccacggtggcaagcatgctaacgcctgttctgaactcgtcgccacgtggctacaacccaccggctgtgagcagcgaccttctggcgctgatgcgggatatggttgcgaaagaagtgcagaaatatatgtccagtcatcaccagcccggcatgtacacaccgctctccccccatcccgagttcttgggagccgctaatctggtgagaaatgttgttctcggcggcgccctgcatctcaacaaatgacaatctcgatttgcagtgacgagttcgagtctcgggcgcggccgaagggcgcgtgagaaatcagacctcccacaactttcaaccgaggactcgaaactcagaatcatgtcgtgtctatgcataataatttttggaatgagaaggtggctgagtgctgtatagagagaaaggcaacgcctacttgccatccacact

SEQ ID NO: 8192 - DNA, 871 bp, Pinus taeda
  Predicted polypeptide sequence is orthologous to G2290
ggccagtgtcgtgatctggaaaagtaaaactgacctgctgagtgctcaacacccaagggaccatctccagcccaccctgtcacagtgagcatgtccataatggctaaaaagctcagtgtggacaacaatgcatcggcagtatcagagtccgcttgtagttgtatttctgaagatcttaaaatgcctcagggcgaggtctgcagttcgaatctccaggccgccttagggccttgcctgaaggaggcagataagcagcacctcgtaggggatggagatgagaaatctctgcgcggagaatgcattaagctctccatcatgctggttttcatggcctctgcctcagttgcagtcttagcccctgaagctttgcctgctcttctttcatctattcacagccattttctcctcttgtccaccaagctctctgtttacaggcttagggcatttgcagacttccagggaatttggaaaaagtctcaaatctctggaagtgaaattcacttggcattagttggaactttaattggccttatcttcttggccctaaggttcttcagtcttttcactgggagggacccaatgatcccaaataagccgagtgtttctgctgctgtagaaatttctccggatttcaaagcccaaaccccaagtgagtcgggaagcagtgaacatgtttcagcagagaatactccctgttctgagaaacaggaccctatttcgagcccattagaggatagccccgtgccttggaaggctatctccaagcctgaagttagtctccttttcgagtattctccagcagagatgagtacttcagagaaaaaagttaaccatggggccgggcagtcttttttaaccagagatgatactg

SEQ ID NO: 8193 - DNA, 310 bp, Pinus taeda
  Predicted polypeptide sequence is orthologous to G2296
cggccggggatgttgatttctgccagaatcacaatgccttcatagatcgcagcgatgaaatgaatattagagggtcttattttcatgtttgtcgattcgggttttaatggatttctgtttttgggtttggcctttgggcaactcatcctccatctgacgtgaggatctgtgggcgcccatgaaaaggcctaaaatttagcaggctttgttgagtcgctgtatccgaaataatcagttgctatagcgaatattgccctgcaaaatctgttatacagcacatttctaaagagtcctaatgactattcgtttt

SEQ ID NO: 8194 - DNA, 846 bp, Pinus taeda
  Predicted polypeptide sequence is orthologous to G2343
agagaataaaatctctctagtgcggacgaatttctgacccgaaatcttcagataacatcatcaaagcagcttggatttggtcgaagagagtgctttcgccagggttcctctggttcagcaatgaacatggcgaaggggacaaggaaacataaccactatcaacgggctgccagttctggtttgcaacatttacggagcagcaggtgtttctgtcgcccacaaggggaaagtccagagaagcttccccatatctatcaagatcctcattcatggttgctttgtaaaagtttgcactaaattggtcacaattctgctcaaaatttccccagtctgcaacttctggggttatggtaggagtcagaatttgagagcatcctgcgcctgagtcaccatacaaatcaatttcaggtgctggatccatgtcgacgtcatcaatggcgatctgatcgagaatcatggcaattggaggttgttgagaggctccctgattggcggcggcgacggcctttttcttcaggcagctgcgccagtaattcttgatttcagtatccgtccttcctggcaagtgttttgcaatctgtgcccacctgttatttagtctggcctgaagactgatgatgacattctcttcttcagtggaaaaattcccacgcttaatccctggcctcaagtagttcatccacctcaacctgcaactcttgccacaccgctgcagtccagctctctctgaaagtgatgaccagcaaccatggccgtgtgtagtgatataagtgatgagcttcatatcttcctcgggcaaccagaagcctctctttacagctttcttgctacagcaattgtgcacta

SEQ ID NO: 8195 - DNA, 891 bp, Pinus taeda
  Predicted polypeptide sequence is orthologous to G2344, G929
gatcttgctaccagggaccagcaaagtccagcagaggcggtcaaagcttcatagctgttggcagtgactgtcacatgtgtatagtggagcatggatgaaaggaaatagtctgatttcttttgggttcgctctcctgaaagctggagaacatttggtgactttctggtgcttttaaaatctgagtaatcaactttatattctctgaagaaaaaggcgtgtacaaaaaagtttttaaaacaatggagaacacgcctacacatactggcattgatggcagtgctccagacgagcagcaacctcaggctgatcctgtgcaacaggaggctccgccacctggcatgataccgccacctgccatgactttgctacctcctgaatttgtgatgccacacactcaactcgaactaggacaaacaatggtgagagctgcatatccttatccagatccctactttggaggcattgttgcagcatatggtccacaagctgtgattcatccccatatgttaggggttccccatgctggtgttccattgccatcagatgcaattgaggagcctgtttatgtcaatgcaaagcaatataatggaattttgcgacgtcgacaatctcgagcaaaggcagagtccgagaacaaactgataaagaacagaaagccttatcttcatgaatctcgacatttacatgcactaaagcgagcgaggggatgcggaggtcggtttctcaatgccaaaaaaccagatgaggtgtcacaggaaaataattcgaatggtagtattgtacttgtatcaagtgttgataaacctgctgcagaaaagaaaaactcttcacagcagaacacagattcctagagttcaaagcaacaatactgtagtatggctaggatatgtt

SEQ ID NO: 8196 - DNA, 847 bp, Pinus taeda
  Predicted polypeptide sequence is orthologous to G2344, G929
cggccggggaaactcggccctgaaagcagtcaaatagatgaacagcagaaaccaccaattcaacaacagcaggtaccgtcgactggcatattgtctgcacatgcagagtctgtgatgcggcaagctcaacttgagttaggacctacaggcaatgctttttggcaagctcaagctgcatacccatatccagagcccttctacggaagctatgttgcaacatatggggcacaagctatgattcctcctcatatgtttggagtgcagcaagctggtcttccattaccaccatcagacatggtcgaggaacctccagtgtatgtaaatgcaaaacaatatcgtggaattttgcgacgacgacaatctcgggcaaaagcagagtctgagaacaagctgataaaaagtagaaagccgtatcttcatgaatctcgacaccgccatgccttaagacgagcagggggttgtggtggtcggtttcttaacaccaaaaatgatggaagcaatgagaaagatgtgtcaggggataatgattctcatgattctacaggtcaaagtaataaggtgctaaatcctgattcaggaaaggatggtacctcacatgatttgaatgggattcaacacataggtaatttagcaccaattggcaatggcatcagtgctcattctggaacagtctctcctggtcaagttggagtgggtgaaagtgtgtcaaatggatcacattacacatataatcaaaggcgaggatttcattcatctgcatttcatcctctttcagtcagcactacagagagtggccaagttggaggcgtggtttccagtggaggccaccatacagcagtagcaaccc

SEQ ID NO: 8197 - DNA, 609 bp, Pinus taeda
  misc_feature (391)..(391): n is a, c, g, or t
  misc_feature (405)..(405): n is a, c, g, or t
  misc_feature (465)..(465): n is a, c, g, or t
  misc_feature (509)..(509): n is a, c, g, or t
  misc_feature (521)..(521): n is a, c, g, or t
  misc_feature (524)..(524): n is a, c, g, or t
  misc_feature (527)..(527): n is a, c, g, or t
  misc_feature (533)..(533): n is a, c, g, or t
  misc_feature (536)..(536): n is a, c, g, or t
  misc_feature (564)..(564): n is a, c, g, or t
  misc_feature (575)..(575): n is a, c, g, or t
  misc_feature (580)..(581): n is a, c, g, or t
  misc_feature (603)..(605): n is a, c, g, or t
  Predicted polypeptide sequence is orthologous to G237
cttgtgggctgagtgtattaaatttattgatgctgagttacttcttttggcaagtcaagactcattttaggaagcatttctatttagaggccaaattcatggtgtaacctgagcttgagaaggccaaatatcctgtgcaaaacgaatcattatccagtccaaaaaattgctacaggaaggccgagttaattgttacaggagggccgagtcatccccaattgtgatttcactgtcaaaggaagctgagtctgttgctcttcaaaggttcaagtcattgctccaagcatactacatttgctctgattttttagggccgaattttctgtagcaaaagaccaccaattgttgggcttgtcatcagtttttgcagaaaaaaaccttgatacttcanaaaaatggtttcangttctaaaccctcctttttattccaatttcccatggtgaatataataaaattctgattgnctaattgacaaaaaaaaaaaaaaaaactccaaggggggcccgtncccattcccccnatnatnaatctnttncattccttggccgccttttacaactctnactgggaaaancctgnntttcccactttatccccttcannnatcc

SEQ ID NO: 8198 - DNA, 493 bp, Pinus taeda
  misc_feature (430)..(430): n is a, c, g, or t
  misc_feature (442)..(442): n is a, c, g, or t
  Predicted polypeptide sequence is orthologous to G2394
tgcctcacaagatacaaagacaatgagcttctgaaggagcttccttgtacacacctattccatgtgggttgtgttgatcagtggttgaagatcaattcttcctgccctctatgcaaacgccaacttaatggatcaatgattatggctgatcatacttcttctgcatcaagatatgagatttttttctgatcataatttggggaaactacaaaatatttcttttttaatacctgaggctaattaattccaatacaaaactagcccattcatcggcatttatatgaagatgatcgatctcataaactgtactgccactgcaatctgtggacctaatcatctgtatggacaatgaaaaaactctggtaaatagttgaggtatggtccgccattaatactgcaggcatattccagctttgggcgtgtttcctcntttgcaaagcanaagctcaagtcagtttatactctatctatctgcaagatgattccgggatca

SEQ ID NO: 8199 - DNA, 581 bp, Pinus taeda
  misc_feature (447)..(448): n is a, c, g, or t
  misc_feature (459)..(460): n is a, c, g, or t
  misc_feature (518)..(521): n is a, c, g, or t
  misc_feature (523)..(525): n is a, c, g, or t
  misc_feature (536)..(539): n is a, c, g, or t
  misc_feature (544)..(544): n is a, c, g, or t
  misc_feature (552)..(553): n is a, c, g, or t
  misc_feature (557)..(557): n is a, c, g, or t
  misc_feature (559)..(561): n is a, c, g, or t
  Predicted polypeptide sequence is orthologous to G2394
cccaggcaaaggaaagaggagcttccacttatgacattgcatctctacccactcatagattcaagtccatgtcggatgttaagagaaagaaagaacaaattacagactcagatcaggagaatgatccaaattatgttggtggtggatatataatattggacacagtaggaaggaagagatctgtttcagccgaggatgcagaatgctgcatttgcctcacaagatacaaagacaatgagcttctgaaggagcttccttgtacacacctattccatgtgggttgtgttgatcagtggttgaagatcaattcttcctgccctctatgcaaacgccaacttaatggatcaatgattatggctgatcatacttcttctgcatcaagatatgagatttttttctgatcataatttggggaaactacaaaatatttcttttttaatacctgannctaattaattnnaatacaaaactagcccattcatcggcatttatatgaagatgatcgatctcataaactnnnntnnnactgcaatctnnnnacctnatcatctnnatgnannntgaaaaaactctggcaaata

SEQ ID NO: 8200 - DNA, 693 bp, Pinus taeda
  Predicted polypeptide sequence is orthologous to G2394
gtgtatacggaggtggggatggcatggataaacaacacagagggcctcaaagacgtgctgaaacgtcaccatccagagttggtagagaaatggatcctcgtgccgaattcggcacgaggtttttttttttttttttttttttttttaagagatctgatttaattataatgttagtcaatacaactcatgtacagtatgcaacacacaaagttcatgtgctttagctaaaggtcacaaagattccagcagtggaatttcctgattcacactccctcattacgagaacctctctctctctgttcttctgtttcatgaacagattcagcttctacttcactagaatcaccaatctcaagcttgcagagaggacaagatgcattaattttcagccatttgtcaacacactctacatggaaatggtgcgtgcaaggaagctccctcagctctacatcatctttgtatttaccaaggcaaatgcaacaaatcgcatcttcagcagaaacagatctttcattctctgtaccagctgctacaaagccaccctcgcatggactgtctgagtcagattcattgtcatctttaggatcaatactttcacgttcaacttttcccttgaacttgtatgttggcagggaattaatgacttctgatgaagcaccttttgtctgcgtctggtcttctcgaaaaccaaga

SEQ ID NO: 8201 - DNA, 773 bp, Pinus taeda
  Predicted polypeptide sequence is orthologous to G242
atacatcatggtttaaaaggtttttttcagaaagaaaagtaatatattatattgaggcaatatatacatcatggtttaaaagatttggttcccatatcaatggtgacaaaactcataagactcctaggacaggtaagaaacagattttgacatataaaatgagaacactgagcaccaaagaaaaacatgtgatggtgcaaaaatcctcgacatcctcgaaaatggaatcctcatagaagaggaagaaatatataatgaaaacactgagcaccagataaatgagaacactgaccaccaaataaaaacatgtgatggtgcagacatcctcgacaatgggatcctcatagaggttggaatcatagacaatggaatcgggatagagatcatcgttgtgttcctcgtcggtatcctcttcttctgtggtagggccgaggctcagcagctttgctctgtaccccatttctcactttcagtgccacactcacaggaactgattttcccaccacagttaccattccctttttgatgtccacttctattgaagtaaagtctccaaaccctgcaacaacctcaacgatccttttctcgcttccctccttatcctcaatagcccgattcatgcgtccaaaccctccaacagcctccgctctctgcacacccaaataatggttgcttcccatgttctcagtatcgcatttcgaccccactttcttttcggctattgtcttcgacatatatactaccgttggggcttcaaacttctcctgcttcgc

SEQ ID NO: 8202 - DNA, 821 bp, Pinus taeda
  Predicted polypeptide sequence is orthologous to G255, G664
gttcatggagagggttgctggcgctctctccccaaggccgcaggtctgcttcggtgtggcaaaagttgcagactgagatggataaattatcttcgccctgatctcaaacgagggtttttctccgaagacgaagatgatcttattctcaaactgcacgccctccttggaaataacaggtggtctttgatagctggccgtttgccaggacgaacagataacgagataaagaactactggaactcgcatctgaagcgaaaacttatcagcatgggaatagaccccctaacccatcgtccttttcaaaagacttctcaccatcatccctctcctccacagaatgttagagaggctgaaacaacaccttccattgggattgttcaagatttctttcgttgcccgtctgaacttagcaccaaatccgagcaaatttcagatgctgcaagcggactcgcgcaggatgagcaaccccacccgaacctgaacctgaacctgaacctggagctctcaatagctcgctcctcagtccatggagtagcagagaaggaggacgttgttaattcccagcaaggcgaaagcgatctgagtgagggaaagtgatatttatgtcattatggagactgccctccccctccaatgcaacactgagatgatataaatgtccctttcccgctcaccaaagccctacggggcaataacgaatacatgaaaaccgtttggctcatagcaagtctagttttcaacacttactattatttaaggaacgtaaaaagtctccagttcaattgatgtattttgtgacattttgctttgttagtcactta

SEQ ID NO: 8203 - DNA, 754 bp, Pinus taeda
  Predicted polypeptide sequence is orthologous to G255, G664
atcaagagaaaatgtcgagtaaagggttcgatccgcatctgaagcggggtaactttcagaagaagaagatgagctaatcatcagactccattcgctcctgggaaacaagtggtctcttattgcggggagattgccggggcggtcaggcaacgagataaagaaccactggagcatacacatgaagagaaaattgtcgcgtagaggactccatgcgcagactcatcgctccttacgcccgcctcacaacagtaccactgccctcaactctccacccggtcccgatcaccagattctggcgttcgagagcaggagaagggcagagatagcagacttcttccaacttgaaggtttgaaatgctcgccgatcgagtcagcagcttctacagatgaagagcatccctgtcccgacattaatcttgatttgtgtatgggcttgccctctaattctgcccccgcctgacttagtggcacttgcagtgaatctatgaagcctatttaattgaattggattatcagtagatgtagagtgagtccagaatcgaagattcactgggatgtacaaatttcatcgatggttgacgtgaaacccaagtgctagtaacagtcgagtcttcaagaggtgaaagcctcctcgccgataaaaaaaatgaatgatattcgctctctactgttcctatcaaattggaggttgagattgggttcattagaggttgagattaggttcattagataatcatattgttagtttgagtgc

SEQ ID NO: 8204 - DNA, 744 bp, Pinus taeda
  Predicted polypeptide sequence is orthologous to G255, G664
agatggggagaacgccctgctgttagaaggctcatactaacaaaggggcctggactcaagaagaagacgctcgccttgtcgcacacattcaagcacacggcgaaggcggctggcgctcccttcccaaggccgcagggttgctgcggtgcgggaaaagttgcaggctccgatggataaactacctgcgtcccgatttgaagcgtggaaacttctctgaacaagaagacgagctcatcatcaaattccactcccgcctcgggaacaaatggtctcttattgcacggattttgcccgggcggacggacaacgagataaagaaccactggaacacgcacatcaagaaaaaattggtgagaatgggactcgatcccaagtctcatctcccacttggcgaaccccgtgacagcaacactacctacaccgttctggcctctcccaagcacaaaatcccgccgttccagagcccgagaaccccggacatagcagatttttttcaatacgaccgctctggaagctcgacaatggagctcgtcgcttctaaagccgaagagcatccggaactgaatcttgatttgtctataagcttgccgtctcattcgacccccgccacaaccagagcttcgacagtccatagaaccgtagactcaaactctaattctggaagtggactttggtgtctcacagggatggaagcgatatcgtgaacaaaatgcgggtgtttctctcattacagggttatctcac

SEQ ID NO: 8205 - DNA, 916 bp, Pinus taeda
  Predicted polypeptide sequence is orthologous to G255, G664
tccttcgttggcaataagtggtctttaattgcagtgagattgcccggacggacggacaacgagataaagaactactggaacacacacatcaaaagaaaattgctgagcaagggactcgacccccaaacccatcgtccactcggccagccaaacaatacccccgtcactcggcctgttcccgagcacgaaattccggcattccagaaccctgcaacgccggagatagcagacttgttacagcaccaccgaatggaaagctcgcctatcaaaccggcagcttcggatgcggaagagcatcccgacctcaatctgaatttgtgtatcagtttgccgtctaattcggccccggccgtaaacagagtatcgagcgtcgatacaacagtagattcaaattctaattctggcgtcgggctgtgctggcagtttctctgacggaggtcgtttcaataacagggtgtggattatcgcagcacgaccacgctaatgaacagtgccaaaggcacaaggactcgtggtggaaagatgtttatagtgcaaagatctccgacttgcttatagtggaattgaaataatgtgttggagggcgcagagacggtgggaaaaaggttttgtgtgttgcaggtctggagatatggtggggaagtgtatggataataggtatttctataatctgcaattctggtgcaattattcacaacagttagcatttatcaaggaaaaatatagttcgttttgtgttctcagtcgtaggagatataccagtaccagtacattatctgcttgcagggtaagttgaagttcattacattgcaatgccggtgccttatcgccctcatggccgtatttttaaagacaaatcccacgctgcttcagcctgcaacaagctatctttactctcattacactgatacatgcc

SEQ ID NO: 8206 - DNA, 888 bp, Pinus taeda
  Predicted polypeptide sequence is orthologous to G255, G664
cgtacataaaaatccttgtgagagaaactgctatgatttttttcacaatattcggttctaataacctttgtcaaaatttatttgttggtgaagaaattatgtctagaatattttacagtcgtatcttgtaacccagatcaaatttcctaataatcaaacctcccaacctaaatataaacacaaaacagtccgcaacccaaagtaaaattcgaatccgtggttccatccacgctcaaagtctgttttcggcgcggggcgacattgatggcaagctcatacacaaatcaagattgaggtcaccatgctcttcattttcagaagcggcgggctcgatcggcgagctttccgactggtcttgttggaagaagtctgttatctctgccgttctcgggctctgcgaagccgagatttcgtggtcgtcagcgaacggagagctgagggtagtgctgccattgtcaggcagccatagggagcgatgggactgggggtcgagttccctgctcaattttcttttcttaatgtgggtatcccaatagttctttatctcgttttccgtccgccccggcaatcgacccgcgataagagaccacttatcgcccaagaggttgtggagtttgattatgagatcgtcttcttcttcagagaagtttccacgcttcagattaggacgcaggtaatttatccatcgcagcctgcaactctttccacatcgcagcagacctgcggccctgggaagggaatgccagccgccttcgccgtgggctcgaatgtaggcgatgagtcgggcatcttcttgttgggtccacgccccttggtttgtattacccttctcacagctcaatctcctcatcttcacagagagacgagtaaagtgcagggactagggat

SEQ ID NO: 8207 - DNA, 617 bp, Pinus taeda
  Predicted polypeptide sequence is orthologous to G255, G664
aaagttgcaggctgttatggataaattatcttcgccctgatctcaaacgaggaggtttttctgaagacgaagacgatcttattgtcaaaatgcacgcactccttggaaataagtggtctttgatagctgggcgtttgccaggacgaacagataacgagataaaaaactactggaactcgcatctgaagagaaaaattatcaacatggggatcgatccactggcccgccgttcttttcaaaagtatcctcgccatcatccttcggctccagggaacgttgaagaacctgagacagcacgttcgaacgagaatgtccaagatttctttcattgctcatccgatttaagcgtcaaatccaagcaactttcagatgcggcaagcgtactcgcgcgcgatgataatcccgacctcaacctcaacctcaatctgcagctgtcgataacgtcaatccacgcggctgggaacaaggacgttgtaaattccgagcaatgcgaaaccaatgtcagtgaaggaaagggttatgtatctcgttatggagaccacgctccctctccctctcctgtgataatgtttcagatgagataaatgccgctttttcattcaaaaaaaaaaaaaaaa

SEQ ID NO: 8208 - DNA, 863 bp, Pinus taeda
  Predicted polypeptide sequence is orthologous to G255, G664
atactagtaaccattaaaactaagtatataacgtgtgaaacctattaataaggaatttaccaatctataaaaccctgtatcggggaaaccgccacggtgcagaatatccgctctcgcagtacccgccatagtatacttgcagccctagtggataacacactgcgctgacagagacaaatttgaaaccacggttcgatggacgctcgaagctctgtttggggctgggggtaaattagacggcaaactgatacacaaattaagatcgaggtccggatgctcctctgtcgcagcttgctcgaaagttgagccttccgatcggtggtgttggaagaaatccgttatctccggcgctatacagttttgaaacgccggaatttcgtggcaaggagcaggccgagaggcgcaggtagtgttgctgttgtggggagggccagggcagagagggcgatgggacccggggtcgaatcccctgctcaccaattttctcttgatgtgggaattccagtagttcttgatctcgttgtccgtccgtccgggcaattttgctgcaatcagagaccacttgtttccgataagggaatgaagttggatgatgagctcatcttcttctgatgagaagtttccacgcttgatatccggacgcaagtaatttatccatcggagcctgcagctctttccacatcgcagcagccctgcggccgtgggaagcgaacgccaacagccttctccgtgggctcgaatgtgagcgatgaggcggtcgtcttcttctttggtccacgcccctttgtttgtatgagctttttcgcagcagggagatctccccatttgacacagagacagattaggaagctttcgctgccagg

SEQ ID NO: 8209 - DNA, 859 bp, Pinus taeda
  Predicted polypeptide sequence is orthologous to G255, G664
gcctcgttgcctacattcaagcccacggcgagggcggctggcgttacctccccaaggccgcaggactgctgcgatgcggaaagagttgcaggctccgatggataaactacctgcgtccagatctgaagcgcggaaacttctctgaggaagaagacgagcttatcatcaaactccattcgcttctgggcaacaaatggtctcttattgcagcgagaatggccgggcggacggacaatgagataaagaattactggaacacccacatcaaaaggaaattgctgagcagaggactcgatccccaaacccatcgctccctgtgtccgccccacaacagcaacagtaccctaagctctccgtccgttcctgagcaggaaatttcgccgctgcagaacccgaggacggcggacatagcagacttcttccaacaggaccggtcggaacggtcaccggtcgaaaacaccgcttgtaaagaggaagagcatcccgacctgaatcttgatttgtgtatcagcttaccgtctaattcgaccctcgctgcaaacagagccatggatccaaattcaaattctggtctcggagtatggtgccacacaggtccgcaaataaactctgacccgcgctgtgagaacagatattgtgaaaggaattcatttacagagttggattctagcagcgggtcaattcatggcatattggatttgcaattaagtgctcttggtgtccagtaacgacgattatgaggggagagatgatcttgtttgctgttttggtataattttagtgttggtgctctgtatatatgtggctgaagacaacggccttgtgaagaattcgttgatgaggttggctataggtaaag

SEQ ID NO: 8210 - DNA, 830 bp, Pinus taeda
  Predicted polypeptide sequence is orthologous to G255, G664
tgcaaattccaaaaatataaaaaacatcaaatttttatttcaattgtagatttcaaaaaaaaatcaaatctgttatcagactttcaggtcaatagcagattttctttatatcaattataaataacagattttctttctatccatagatttcactctttatgtccattacaaattccaagaatataaacaacatatcaaatctatataataaaattggccaaactgatattaatcagtgtccgaaactgtgcaggtggtctcttattgcagggagattggcagggcgaactgacaacgagataaagaactactggaacagtcacatcaagaagaaattgctaagcaagggactcgaccccaagacccactgtcccctcggccagccctacaactccaacaataccagcgtcacccggcttgctcctgaccatgaaattccggcattccaaaaccctagaacaccggagatagaagacttcttccaacgcgaccgatcggaaagctcgcctgtcgaactggctgcttcagatgtggaagaacattccgatttgaatctgaatttgtccataagcttgccgtctaattcggcccccgccggaaacagaccttcgaacttcgatagaaccatggtttcagatcacttctgtccgtggaccgttaactcgagaaatgtttggaaggccggagaaatgatgatgtaaacgataaggtatttccttaatctccaatcaggtttaattaatgtacaacggtaatacatgatcaaccggcacaaccacaaacattcaaatccatggcagttgcactgagtcaatgctatcatttaaatc

SEQ ID NO: 8211 - DNA, 894 bp, Pinus taeda
  Predicted polypeptide sequence is orthologous to G255, G664
aggcgcctggaccaaagaagaagacgagcgtctcatagcacacattgaagcccacggcgagggctcatggcgttctcttcccaaggccgcagggctgctgcgatgtgggaagagctgcaggttgcgatggataaactacctgcgtcctgatctgaaacgcggaagcttttcagaagaagaagacgatctcatcatcaaactccactccctcctcggcaacaagtggtcgcttattgcagggagattgccagggcgaacggacaacgaaataaagaattactggaacacgcacatgaaaaggaaattgctgagcaggggactcgacccccagtcccatcgtcctcttggcctgccctgcaagactagtctcatctctcggcccgtccctgagcaggaaattcggacgtttcagagtcctgtaacggtggaggtagaagatttttttcaaaatgaccgccctgtgagctcagccatcgagctggctgattccgacgcgaaagagcgccccgacctcaatcttgatttgcgtatttggcacttgcagtgaatctcttgtcccaattacagctggagggagaggccaaatttgcctaaaggactgaaagtttaaatctcacatttgaaacgtacgtttcaagttccagcatcagcgtccacaaagtagtttcatttccccctgaaagttttttcagaaggaatccattaaaaattctttgatcctctgtaaatggtccaattatcgttggggactgcactgcaagcccatttttaatgtgcagatggttaagagatcttttacgagggtcgtagttcgaggtctcattgacctttctgtaaaaattgattgttcccaagatttaatacaattttgtagttgagcatgatgatatttgg

SEQ ID NO: 8212 - DNA, 873 bp, Pinus taeda
  Predicted polypeptide sequence is orthologous to G255, G664
cttctctgctaaacgatgggaagagcgccttgctgtgccaacggtgacagaagcaagggagcctggaccaaggaagaggatgacaggcttacccaatatattcaggctcatggagaaggatgctggcgttctctccccaaggccgcaggtctgcttcggtgtggaaaaagttgcaggctgagatggataaattatcttcgacctgatctgaaacgaggaggtttttctgaagatgaagacgatcttattctcaaactgcacgccctcctcggaaataagtggtctctgatagcgggtcgtttgcctggtcgaactgacaacgagatcaaaaactactggaactctcatctgaagagaaaactcatcagcatgggggtcgatcccctgacccgtcgtccatttcagaggaattctcgccatgatctttcgcttcccgagaaagttgaagtgcctgaaatagcaaggccgcgtgagattgtcgaaaatttctttcacagtccgtcagaattatgcggcgactcggagcaagtttcagatgctgcaagcgaatccctagcgcgcgatgagccctccacactaaatctcaacctggagctctcaataaactgggcttcaatgcacgtagctgtgaaggaggaacccattttaaaatccaaaccaggcgaagaagaaggcgcaggtggtcgctttgatgaaaagggatatctgtttcgatatgaagaatgcccggttgggaaaagtctactgagatgagatgaaaagttagatgcgcagtaatgtgatttatgcatgttgaacttattttgatggtagaaactggaaatgttttggaatccaaaggatagtaatgaggtcaattgtttgatcaccaaa

SEQ ID NO: 8213 - DNA, 826 bp, Pinus taeda
  Predicted polypeptide sequence is orthologous to G255, G664
gacccttccggctaagctgcttcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctcagaagaagaagacgaactcatcatcaaactccactccctgctcggcaacaagtggtctcttattgcaggcagattgcccgggcggacggacaacgagataaagaactactggaatactcacatcaagagaaaattgctaaacaggggactcgacccccagtcccatcgccccctcggccagccgcacaacagcaacacgacctgcccctctctgcccgccctcgagcacgaaattcttgtgttccagaggccaagaacgccggagatagcagatttctttcaatacgaacgctctgaaagctcgccgatggaaccggccacttctaaagacgcggaagagcatcccgacctcaatcttgatttgtgtatcagcttgccagttcattcgccccccgccacgagcagggcttcgagcgtcgatagaaccgtggattcaaaacctaattcggtttcttgtcacatggggttgcaagtaaattatggtgtgcaatgtgagaacagatattgtgaagagagtgcttccggtgtctcgagtttttacacgctcgtcttatagaatatttgagctttat

SEQ ID NO: 8214 - DNA, 887 bp, Pinus taeda
  misc_feature (845)..(845): n is a, c, g, or t
  Predicted polypeptide sequence is orthologous to G255, G664
agatctccctgctgcgagaggctcataccaacaaaggggcctggacaaaagaagaagaccaccgcctcattgcttacattcgagccaacggcgaaggcagctggcgttcccttcccaaggctgcagggccgccgagatgcggaaagagctgtaggctgcgatggataaactacctgcgtcccgatctcaagcgtggaagcttcacagaagaagaagacgaactcatcatcaaactccactccgtcgtcggcaacaagtggtctcttattgcaggaagattgccggggcggacggacaacgagataaagaactactggaacactcacatcaagagaaaattgctgatcaagggaatcgacccccagtcccatcgtcctctcggccagccctacagcagcaacaatatccccgtctctcggcctatttctgacctcgaaattccggcattccagaaccctagaacgccggagatagcagacttcttcggacatgatcgatctgaaagctcgcgtgtcgagccggcggttttggacgcggaagagaacgcagacctcaacctcagtttgtgtattagcttaccgtctacccctgccgcaaacggcccttcgagcgtcgatggaaccgtggtttcaactcctacttctggcctctgactgttaaccgcagaaatgttggaggggtggtgatataatgagtgacagtatagataataagtgaccaattgtcaccaacacaggcattctggtcagtggcagtgaatatatcctaccattttaaatgaaattccatcctagatgacagggcgcagataaaggcaatggatatctatcaattggatggctaanatactcaagctacaagatctgagcagttgatggtggaatttc

SEQ ID NO: 8215 - DNA, 745 bp, Pinus taeda
  Predicted polypeptide sequence is orthologous to G255, G664
gctgagatggatgaattatcttcgccctcagctgaaacgtgggaatttttctgaagacgaagacgatcttattctcaaactgcacgctcttcttggcaataagtggtccctgatagctggtcgtttgcccggtcgaacagacaacgagatcaagaattactggaactcgcatctgaagagaaagcttatcagcatgggcgttgatcccctgacgcaccgtccttttcaaaagatttctcgccatgaccagccgttttcggagaacgttagcgagcccgaaatagcaagttccggtaaattcgttcaagatttctttcactgcccgtccgaattaagcgtcgagtccgcgcagctttcaaatgcggcaggcggatcactagcgcgagatgggcagcccgacctcaacctaaacctcgacctggggctgacagtaacctgcccctcaatccactcagaagggaagcagaacgttgttaattctgagcaaggcgaaaacgatctcggtgagggaatgggatatttagcatatcattccggagagtgcgcccctccaatgctcctcctgagatgaaatgacaagtgccttttgcatttacacaaaccctaggcagcgtaacaaaatcatgaaaaccgtttcatttctgagacctggtctcttgttcaaaattttcgctaatgtttattatttgttgaacgtagaatgtctcattttcaatttatttatctagtgagcttttaacttgtt

SEQ ID NO: 8216 - DNA, 324 bp, Pinus taeda
  Predicted polypeptide sequence is orthologous to G2574
gctgaagtccaatccaaattccatggtctccttgagcagtaatagcaataataatagtaatagtttctattctgtatttggggcttcgggcctcaaattggagctcccttcaagccaatcagcggggtctgctggaagcgcagacacgccaaagtccaatctatcttttacaaatttttcctcctcttcttcttcttttcagcaaaccaactgcctgatttcagaggcggacagttttaatgacaacaactcgggactcctggaagcactactcatacaggaaacacagtgtcgtaataataataataataaagatttggattc

SEQ ID NO: 8217 - DNA, 847 bp, Pinus taeda
  Predicted polypeptide sequence is orthologous to G2575
tgtgctgcagatatgacataaaattcttacaacgatggaggaaattgggaacacaagtataaagttgcatctataagcccaattgcagcctcagttcacctgtgagaatttctaacagtaatatgtagagaatgaatatcaatcaaacctcaaatggatttgattcgatccccttttacagtttaccatatctacaaaaaaaaaagccatgaagtcccataagcaataaaaagctcataacgcattctttccttgctctcgcccatatatatatatattatatatatatttttccttgttcttgttgctatatagtaatgaataaccatgatctccagactgttctttgatttgaagggcacctctagtagtataagttgagtcaaaatttgcgcataccaggtgggacgatatcctccagtaaaccttgatcaataagtggctgctgggaaagattggtgggcattagatgagttgagtgaggctgggaattaccatggtgggactgaggcagaagatgagggttcatgcaggacttgatggacccaaggtggtgaaaattattagtagaggaaggggaagcagctgggacctggttagtactactcatcatcattgggtggggagggaatctgatcaatggcgtttgagtgaagggagaattcaatctttgatctgaaaagtgggattgggattctgctgacccacgcaatatggccaggcttggatgagaatgctgtccttcatatgtcgtaatcacaattcctggatcttctgacgaacgctccactctcttcttcactgagcattttccatttgtgcaacgatagtaactccggggaaaggg

SEQ ID NO: 8218 - DNA, 803 bp, Pinus taeda
  Predicted polypeptide sequence is orthologous to G2575
cagagttccttgtttcggatgaggaggaattggaccattcctgcgggagtgagcatgcggttgagcagaaaaactactttaacaatgtcaagcccggatcaagtatccaaagcagcgagactcaggagactataagtcctaagaagaacaggaagagaaaagcagagcgaggtgtcaaatatgcatttctgaccagatcagacactgatattttggaagatgggtataagtggcgcaagtacgggaagaaatttgtgaagaacagccccaatccgaggaactattttagatgctctgacaacaactgtggtgtgaagaaaaccgtggagcgtgatgcccgtgataaggcaattgtcgtaactacttatctgggcaaacacaatcacgaaagcccatctgtaatctattatactctcaggcctgaaatactagtccaggtaccacgccagacgaccggttcgccaatcgagcatttctcgcctgtgtgtacttatcttccagagtgtttccaacaataccaataaatgggtgatgacactgcaagataatatctagagtttttcatagaggttgtgagatttgggatccaactagtggaaattcgcaatatattagttcatgaaccggtacactgcaggtagtccactgcaaggtagttgtttgatactcacgtaaatatactttacatttgaaaataagtgtgcggtcacttcgacagattgtgtctaattggacagactgtgttcggcttatttatatgattaagaatccagtgcatctcataagaaaattaaatattttat

SEQ ID NO: 8219 - DNA, 791 bp, Pinus taeda
  Predicted polypeptide sequence is orthologous to G264
ggaaaaccttgcttccctgatatgcctgtctctttaggggtttcggatatttatacatcttcagctttgtcagatttgaactcctcgtctgggttgccagaaatgtctgtatctttgagatcacaagatatacaagcatcagcagggttagtagggtcccttcgatctgacattctatgtaacttgagtttgagtcctcactcttcttcgcttgaattaagtaaaatagatgacgcaacaaaagctatccagtcaggcagtcctgagaatagaagtcttataggatctaagacgggtagcaatgatgggaattcagaagccatagatatggaggtaagattgcgatatggtgcagcaaaaactactgtgcaggagggttcagttaatggtaaggccagagggacaggtaaaggcatgggtgctgagacaaccaggaagcggatcaatgatgtgttttgggaacagtttcttactgagagtccacagccaatagacacagaggggactgattcagagagtcaggagagtagtaaggatcaagacgatgttgtacctgaatatagcaatttctgtaatagaaaggagaatcttgatcaacttacactacagatggggcaactggcatcatcagtaaatctttgacatcagattaagcatgagtattgaagtgactgcggcactaacaacaggagaatataggaatgccagtaaagttaattgtttctgaagaacaccagcgggttctagcctgtaggtgtatcttatgttgctctgtttgatgcttctttcaa

SEQ ID NO: 8220 - DNA, 854 bp, Pinus taeda
  Predicted polypeptide sequence is orthologous to G268
cggccgggggaacgtggtgttccagctatggtagcagtgtttgcaacacatcggctcccatatccaagtcaggcttttgacctgattcattgttcacaatgtcatgttaactggactcgtgatgggggtattttattactggaggtcaataggatgctcagggctggaggttattttgcttggggtgcacagcaggataaacaaaaagagaacgtgcagcaagctttgaatgatatgaaggatcttgcaatccgtatctgttggaagcttgtgagtgaagatggccttgttgcaatttggcagaaacctttcaataataattgttatgtcagcaggcgtgttggggttgaacctccattgtgtgatgtgcatgatgaccctgatgatatatggtatgtgccattgaagacatgtatctcacgattacctgagaatggctccggaggaggttggaccaaatggcctcaacgcttgtatactcctcctgaccgattgcagggtgtagatatggaagcatacatatcaaaggatgaggtgtttactgcagaagcaggatattggaaaatgtttgtgaaaagcaatttacataggcttggctggaaagtacataatgttcggaacgttatggatatgaaagcaaattttggagggtttgcagctgctctaatagctgaagatgctgattgttgggtaatgaatgtggttcctctaagtggaccaaatacattgcctgtgatttatgaccgtggtctgattggagttgctcatgattggtgtgaaccatttgatacacatcctcggacctatgatcttctccatgcttctggcctgttctctattgagaagagaagatg

SEQ ID NO: 8221 - DNA, 789 bp, Pinus taeda
  Predicted polypeptide sequence is orthologous to G268
cggccgggcacagccagtatacaaacatgaggagaagctacaagaagcttggaaagatatggagaaccttaccgcaaggatgtgctggaggcttgttaaaaaggatgggtatattgcaatttggcggaagcctttgaataacagttgttatattaaccgagctgtgggagttgaacctccattatgtgatatacgtgacgacccagatgatgtttggtatgtgccactgaaggcttgtatcacccgattgcctgaaaatggctatggacaaaatttgacgaattggcctgagcgattgcatactccacctgagagattggagtctacacagatagatgcatatctagcaaaaaaagatatttttattgcagaaactggatactggaatatggttgtgaaaagctacttacgcgggctcggctggaggagacagaaatttcgaaatgtgatggacatgagggccggtcttggcggatatgctacggcactgctagaacagcaaattgactgctgggtaatgaatgtagttcctgtcagtggaccaaacacgttgcctgtgatttatgatcgtggactcattggggttcgtcatgattggtgtgaggcatttgatacatatccacggacctatgatcttcttcatgcttctggtctattctccagcgagcagaaaagatgtaacatatcagacattttgttagagatggacagaattttgcgtcctggtggatatgcatatattagagataacagagtagttgtttccgaaatagagccaattgcaaaggc

SEQ ID NO: 8222 - DNA, 601 bp, Pinus taeda
  misc_feature (2)..(2): n is a, c, g, or t
  misc_feature (4)..(4): n is a, c, g, or t
  misc_feature (32)..(32): n is a, c, g, or t
  misc_feature (305)..(305): n is a, c, g, or t
  misc_feature (453)..(453): n is a, c, g, or t
  misc_feature (459)..(459): n is a, c, g, or t
  misc_feature (556)..(556): n is a, c, g, or t
  misc_feature (572)..(572): n is a, c, g, or t
  misc_feature (580)..(580): n is a, c, g, or t
  misc_feature (588)..(588): n is a, c, g, or t
  Predicted polypeptide sequence is orthologous to G2724
cnancattatggccggggggggcggttttaantaagtagacgccttctcatcatcaatttgtccccaagcctgggcgattagtggggttttccttgtggttgttgtgtgtcgtgcttatccatgagccaatatgcatataatcggcgccaccgctctccttagagcgactcgaacttcgttccacccctccatagctcgagctgtttcgacatccaatttttcttcggcatcttccccgttttctcctcgatctcagtcagttgcagccctcagagggtttccaaccggttcccaggccgtaaantctttaaatacctcgtctttcgcaggcgatcagtcgcggtttcggagcttgctagggtttcaccactggaatttaaatcacgggctcagagcgcacgcgagatcatcaagctgccgttctcaagccctgtcgaacgggaaaatgtccnaccatnggcgactgagaatgctttcaagcatattttgactggccttcctaaaactggtggaaggagagtttggaaagtattacaagccttacagctctcaatngatccaaagggacaanttatactncctttatnctgtcaaaaattc

SEQ ID NO: 8223 - DNA, 760 bp, Pinus taeda
  misc_feature (613)..(613): n is a, c, g, or t
  Predicted polypeptide sequence is orthologous to G2724
gttaaagttttaagccccttgtcagtaagcaatcagagagtcaaagcttcaactttggtgggctaattctatggcgttgagaacctggtggaaattttctgctgtgggagatgaggaggaaccaaagacgaggaaggggccctggactgttcaagaggacatgcagcatattaggtatataagttcgcatggagaagggcgccggccttttcttgccaaagcagcgggcctaaacagaactggcaagagccgcaaccttatggggatcaactacctccgacatgatctcaagcgcagcaagatcgctcctcaagaagaacgtttgatcattaaactccatcgccgttgggggaacaggcaattcctcagccaattgcctcagccttagaatacgactccgtttcaagtggtcaggtggtcccgcattgcgcagaatttaccggggaaaacggacaacgaaatcaagaattactggagaactcgaattaagaaaagactgaatctacaaactgagagcggcagcaagacattggtacagacgatagcgtgcaaactgccggctcaataggctctgattcctgcaaagcttcatctcagagactgcctggcctangatagtgtggagttttcctctagaatcacaaggcaaattccccgaggaaatagcggttcatgcttatccaagtagcggagaacattgcagggagaaaattggagagggttctcaaatcaatgaagatgcgcaacaaggcgcatcttt

SEQ ID NO: 8224 - DNA, 748 bp, Pinus taeda
  Predicted polypeptide sequence is orthologous to G274
ggccagtctatgatattgcgtatatatgtctgatcctgtccattcacattattttcctttaatggactgcattccacccatgatttctgtttcctatttataagctcttatgcttcactgggtttctattatttcaagtgtccacggcacgctgcaccagaacataagttaggaagattttctgaactgctctccggcttcaaatttgagatacaagatgaggtcgaaaacaaattcagcagacagcaggaccaggagttctgtttctatctttattgttttgggattatgctgttttttctacatactgggtgcttggcagaagagtggctttggaaagggtgacaggattgcagaggaaatcaccaaactgacagactgtacaactttgtctctaaattttgagactcaccacaatgaaggagataacgttgaactttctgaatccaaagcaaagatatttgaaccttgtagtgccaaatacattgattacacgccttgtcatgaccaaaagcgagctatgacatttcctagagataatatgatatacagagagaggcattgcccaccagaggatgagaagctacattgcctcattcctgctccaagaggatacaaaaatccatttccatggccaaagagccgtgactatgtgccatatgctaatgttccctataaaagtcttacagttgagaaggctattcagaattgggttcaatttgaaggtgatgtgttcaagtttcctgga

SEQ ID NO: 8225 - DNA, 704 bp, Pinus taeda
  misc_feature (24)..(25): n is a, c, g, or t
  misc_feature (484)..(485): n is a, c, g, or t
  misc_feature (514)..(515): n is a, c, g, or t
  misc_feature (539)..(541): n is a, c, g, or t
  misc_feature (616)..(621): n is a, c, g, or t
  misc_feature (631)..(632): n is a, c, g, or t
  misc_feature (634)..(636): n is a, c, g, or t
  misc_feature (693)..(699): n is a, c, g, or t
  Predicted polypeptide sequence is orthologous to G2747
gaaggccaccaataatatggcagnnctcatggccatggagcatttcctagaaatcttgagggactcaaatttacacaacaccataattgacgctaattccgaattgataattaattcggtcaagataattggcaatggctcagtaccagagaaagtgtcgagacactggaggctactgcaattttatcaacatattcaatcccacttgcagaccatgaaaacccttagttttatccatgtgcgcaaaacaaccaatagattatcggatattttggcaaatgaaggtgtgctctgttccaaaagcaatataagatatgactggataaggactccccaaggacgtctatgggaagaatgctccaaacaggcggccttgaatagagagttctatcaaagcaaggaaaataggcaggatgaagactaatggagacagaggatttttggtccacagggggaaacaatatatggcaaagtgcgagcaggnngtcagatacccctctaaattctacgtaannttttcaggggggaaaatgctcctnnnactatgcacactcatggttctcgggtgagaaactataaacaggcctagtcttcacatggaccctaataacattannnnnngccttttaanntnnntggggtcgttgactcatttaaaatggtggcaagttgatgccatcgcaacaatcccannnnnnntgcga

SEQ ID NO: 8226 - DNA, 706 bp, Pinus taeda
  Predicted polypeptide sequence is orthologous to G2789
ccctaacgcgctcagagcccacgttatggaaattgccaatgggtgtgatgttttcgacagcgtggcgaattttgcacgccggagacagcgaggtatatgtattctaagtggcagcggcacggtcacgaacgtgaccctccgccagcccgctgcaccgaatgcaattatgaccttgcatgggcgctttgagattctgtccttgtccggagcctttttgccccctccagcgccccccggggcaaccggccttacaatttacgttgccgcagggcaagggcaggtgatgggaggaagcgtggtgggttccctactggcatctggttccgtgatagtaatggccgcctctttcatgaatgccacttatgagcgtcttccgttagatgatgacgaacccatcccaatacagcccccgggttcggtttctcagcaacagcagcagcagttagcagatcaatccaacatgcccctatataacttgcctccaaatttggtcaactgtcaaatgccatccgatgtttatgcctgggcgcccgcgcggcctcctttttgaggctctacagttcgataaattatcaccagtgaacgaatttttgtagttgttacttctttgcattgctggtgcctgtgtcaatggactggtcaaggcgggagaaatatcgaagtcagagctgccccactttctcttgctactgctgcgatggaggat

SEQ ID NO: 8227 - DNA, 953 bp, Pinus taeda
  Predicted polypeptide sequence is orthologous to G2789
acaacatatatttgacctggcccagcgccccagcgcagcccagcccagatcaaatctatgcagatgcttgattagccttctcacgtcctccccacaatccaaaactttcttgctgcttcagatgaagccaggcacatagattcaacaccttatctgtgatttgttttggttcttgatctgacagtgacagataacaatatattttttggttggtttctactgtgtgtgttgattcagaagcaatagggatagagaaggggaggggatttttagaattgtgaaaggtacagaaaaggcggcatattggagtccagaagaagaaagggaagggatgatggcagagatggagatggaatgtgcaggcagctgaatgtgaagaaaaaggaagagttgagctgagttgagtggtggtggacggggaatgtgtcaatggtggggatggatccaggagcaccatcaggtcatgctcattccctgccacctccgttccagacaagagacgtcttgcacggttcagaggatcatgatcacaacaacgggcccgggagggggcagaagcgcgaacgggatcacaacgggaagtcagggttgtcaccggaggcaggcgatgaaggcgacccgggcggcatgagaaaaccgagagggaggccaccgggatccaagaacaagccgaagcctccgataatcataaccagggacagcggcaacgctctgagagcacacgtgatggaaatcgccaacgggtgcgatgttggcgagagcgttgccactttcgcgcggcggaggcaacggggagtctgcattctcagcggtaccggtatggtgaccaacgtcacgctccggcaaccggctgcaccgggtgcaattgtgaccctccatgggcgtttcgaaattctgtccctctccggttcatttctgccgcctcctgcaccgccggggagcaccggggttga

SEQ ID NO: 8228 - DNA, 901 bp, Pinus taeda
  Predicted polypeptide sequence is orthologous to G2789
gccctggcaaaaggtggttggctgggaatgtggcgttgcccggagtcgatccgggcacgagtccaggcctggggcttggacatgatcccgggcgagggcatggccgtggtctgcaatacagggacttgcacagttccgaagacgaaagtagcgaggatagcggatcgaagaaacgagggcgggacgacaacaataatgacaacaacaatgccgccggcaagtctcaggaagatcaagacggtgggggcgagctgggccgaaggtcgcgcggccggccaccggggtcgaaaaacaagccgaagcccccaataattatacaccaggacagccccgatggccttgcagctcacgttctagagattgccaacgggtgcgatattggggagagcttggccactttcgctcgaaggcggcagcggggagtctgcgttctcagcgggagcgggacggtgtccaatgtcacgctgaggcaaccagccgcgccgggcgcgatcgtgactttgcacggaaggttcgagatcttatctctttccggctcgtttcttcccacgccaacgcccccaggggttacaggcctcacaatctatctcgcaggcggacaaggacaagtcctgggcgggagcgtcgtgggcgctctcgtggcctccggttcagtcgttgtcatggccgccacattccgtaacgcccctttcgaacgcctgcctctcgatgaggacgacggaccgttgccgatacagctccagcccccgggtggactctcgcagtcatctggtctggcggcgtcgcagcagcagcagcagttgccggatccatccaccatgcccctctacaacgttccccccaatctgctccccaacggccaactgccccatgacgtctacgcctgggcacagcatcagcg

SEQ ID NO: 8229 - DNA, 932 bp, Pinus taeda
  Predicted polypeptide sequence is orthologous to G2789
cctggcaaaccggtggtgggcagggaatgtgccgatggggggagtcgatccgggcgccgggtcaggccccgggtctggacatggacatgggcatgggcatgtttctggtcccgggcatggccacggtctgcaagccagggacttgcaaacttctgaagatgaaaatagtggtaacagcggatcgaagaaacgagggcgggatgataacgacagcaacgccgcgggggccaagtctcaggaaggtcaggacgggggggcggagatgagccggaggcctcgcgggaggccgcccgggtcgaagaacaagccgaagccccccataattatacaccaggacagccccaacgccctgaaagctcatgtaatggaaattgccaacgggtgcgacgttgccgaaagcgtagcgacgtttgcacgcaggcggcaacggggaatctgcattctgagcgggagcggaactgtcacgaatgttaccttgcggcaaccgggcgcgcctaatgccatcgtgaccttgcacggacgcttcgagatcttatccctgtccggggcattcctgccaccgcctgtgccgcccggggcaacaggcctcacaatctatcttgcaggcggacaaggacaggtcgtgggagggagcgtcgtgggcgcgctgctggcctccggtcctgtcgttgtcatggctgccacattccgtcatgccccctatgaaagactacccctagaagaagacgaggggccgccgatgcctatgcagcttcacccccctggaggactttgccaatcacccaatctgactgcggtgcaacagcagcaacagcagcaacaacaccagcagcagcagcagcagcagatctctgatccatccagcacaatctacgttcccccaaatctgctctccaacggccaactaccccatgacgtctacgcctgggcac

SEQ ID NO: 8230 - DNA, 909 bp, Pinus taeda
  Predicted polypeptide sequence is orthologous to G2791
ttttgggcaaaggtctcactctgaagacaaaatgctagccagagaaaatagatctggagatactgagcatgatgatcttcaagggacccttttgacatcttatacaggaccacaaggaggtcagacagtgctacctagaactccaggggcacaatcccatcaacagaatcttagcacacaaactatacaatcaggtgaaggaacttctctacagcagtatggaaaccattcagctgtttctcagctgcagtctggggctggtggtggcaatgctgcaaatggagctgcaaggccacgtgtcagggcacgtcgaggtcaagctaccgatccacacagtattgctgagcggcttcgcagggagaggattgcagaaaggatgaaatctttacaagaacttgttccaaactctaacaagacagacaaagcatccatgcttgatgagatcatagagtatgtcaagtttttgcagctgcaagtgaaggttttgagcatgagtaggcttgggggtgctggtgcagttgcacctctgattgctgatgttccatctcagggatcaggtggtgtcatgtcaacagccttgggccaagcaagtgggcccttgactctgtcacaggatggtcttgcttttgaacaggaagttgcaagactcatggaatcgaacatgacctcagctatgcaatatttacaaaataaaggactttgtttgatgtccattgcacttgcaacagctatatcaagttcaagtggaaagcctgtactggctactgtgccaggaacaggtgttgatagtagtgagaagcaaaattctgacatgcaatccattgtcttaccttttagtagcagttcaacaaccatgggactcagagctactgcatctggcagtgacgcccctataaatgagaattcaat

SEQ ID NO: 8231 - DNA, 539 bp, Pinus taeda
  Predicted polypeptide sequence is orthologous to G2791
acctttacctcgaagagaatttcagagagccgacaggcctaatccttaagaaaggagctctgagctctgctgcttacaattttcgagattaaaacgaatggcggtgaccgtgcaatattgtattccaggaccaagtacttaggacagaatcaggtcacgagtggctccactccacaatacgatgttcatcgttttaatcacaatacaagtttgttagtccaagtaagtgcgctgctgcagacagtggggcacccctcgtgggctttgactgcctgtcatactgttccctccttgctcctgctcttgctctcgctgggctgtggtgagttactaacctggttcgacccacaagggcttctcactagggcgttaggccgcatggatctgccagatattgtggttgcaagggacagaggcatgagacacaggcctttgctttgcagaaactgcattgctgaccccgtgttttcatccatcagttttgctacctctccttctgttatggacgatccctcctcatctctgcaaatattatcagt

SEQ ID NO: 8232 - DNA, 876 bp, Pinus taeda
  Predicted polypeptide sequence is orthologous to G2791
aaggtacaagaaccaacagtagccagaactcttctccagacggtctagcattaacagaacgccaagtagcaaagctaatggaggaagacatgggatcagccatgcagtatcttcaaggcaaaggtctctgtctgatgcccatatctctggcctcagccattaataactccggtgcgagaccccaggcaccatccaccccttctcttcaagggctattgccacctaatgccaacgacaggcagatactggaaccctcgaactcggcactctccgccctcacgtccacctccatgaccatacagtcatccatcagctcgcctgggagtggaataacggagcaaggtgataatgcacacaaggcagggaacggaacaaggaatccaaaggattccagagaagccaattccgttacgaagtccaacgggataggaggcccagctctttccaagaacgccgttaaaggagaggacgaacctcaaaggaggacgggccagtaaacagcaccaccttgctaacggaaactgtaccatacttctattaacgccagattgcatgaaattgttcaagcatacgaaatttacttttcacatgcttcaacaatttctaaatagtcgtagtcgcagtcgcagtcgcagtcgctctatgggagagcattcattcaaaaatcccaaaaacacacttcaaattttcctttctcctgaagtttggtgtttatttttattgaatgggtaaaagaatcgagcaagtctatcaaaataaggcacgcgccccactttgatgatgccttatttacatagacttgcataaatatgacattatgtatggttgacccaagcgctttgttaatcactacgtaagttatatcttaagttggat

SEQ ID NO: 8233 - DNA, 875 bp, Pinus taeda
  Predicted polypeptide sequence is orthologous to G2791
cggccggggaactatatcgggagcttctgattctcgggtagcttgtgatacagaagctctgtctgtctcgggtagccgtatcacaagctttgtaagtctctcggtagctttgtaagaagagaattgtttcgggtagctgtagtctctcgggtaacggaaatcatttgcaaactggtggagaagctttgaatggtgctccaaggatccgtgcaagggctcgtcaaggtcaatctacggatcctcacagtgtagctgaacggcaacgttgtcagagaattgcacaaaaattgaaagctttgcatgaccttgttccgaatgctaagaagactgacagagcatcaatgctggatgaaataattgagtatgtcgaacttctgcagatgcaaataaaggttgttccccaatctcttgcaagattgaatttctgcagcctattataagctcagtgcttgttctcaaagctcagctgttctgcaggttgtgagcgccagtaagcttggcagtgttggttcgtttgggcctctaactccgaatgttgcagctgaggcatcagctagtctgcttcaacctggtggctcgctatttgacgaaggccgagagtttgagaacaatattgtgaagttcatggagagggatatgaatggagctacggagtactggcaaagtaaagggctcgatttgattccacttgcacaggcaagggctctctttgattcgatatctaatgaagtcgtaacctaggggggctcggatcatctcggtctcaggtttctattgacaaactaaacacggaactaacgctagttgttcacgtgttcttggaatgggatctgttggatctggcagcgatttaagttcaaagggaaacgaagcga

SEQ ID NO: 8234 - DNA, 834 bp, Pinus taeda
  Predicted polypeptide sequence is orthologous to G2802
aagaagatcttggttctgtataccaactttgggaagcacaggaaacctgagaaaacaaattgggtgatgcatcagtaccacttgggggtgcatgaagaagagaaagaaggggagcttgtggtgtccaaggtgttttaccagacacaaccaaggcaatgcaattgggaaaggaccagttctgatattgctggcagtgccatcaccagaaatcaaagtcaagaaatgactccaattcatccaggagatgcaagtttcaaaaattatccagctgctgtcatggtgggaaaagcaatgacagacattaatcccggaccatcctgtacttataacgtcgatggagtacaacaagcgagtgcagaccaatttacatttgcatcatgccctaggagcttggatgaaggaatctcagacagtactactggtaaaggatcagaaagctcccactgtactccgcattcgtgcgacgaacacgaagaacacgagcacgatcagcacaacgcaattaacgatgctctgaagcgcgggttccccatgtccgcaggcggaggcggccatgaaattatcgccttgcgcttcaacagaagatccgatggcgtaaacgtggagctcaagtcctccggtcgccatcgtgggcaatcgtccaatgcagatgtgacgtgcatggccggggaatcccaagaaccggatcatgacggcgacttggacgctgtggaaggaagcctgtccagaccccaagtactcatacctcatgaaaagatccagaatgttgcaggcaaatcatttccccagaagctgtcattcgaagaagatatattcatgtaccctactggaatg

SEQ ID NO: 8235 - DNA, 806 bp, Pinus taeda
  Predicted polypeptide sequence is orthologous to G2802
attctttcacttatcctttatcagattcatttgtatttcacctgacagtgattccagttttttttccttactgggagcatctgatttttcatggttctatatgaaagctttggatttcaaattatttaggctaatacgtgtgttctattttgcaatccagcttctaattcttttattctttaaaatataaaaaattataaatgagtacatttagcaagggtttccatttttctaaacctcaactcttgtgagctagctccactctgtgtttgggacgagcagcagcataaaatggtttgttaatggcgggaaagaatagaaactccacagggagttctcagttgattgatgccaaacttgaagagtatcgaattaaacaatgtcctgcatgtggtcatcaaattgaacgccaggaggctcttcaagattggcctgggcttccttgtggagtaaaatttgaccctacagatcaggagcttatagaacatctacaaggaaaggttggcttagataattccgcccctcatcctttgattgacgagttcattccaacaattggaggggaagatgggatctgttattcacatccagaaaaacttccaggaacatctcgtgatggcatgatatttctactaagactgagtttatcttttggttacaggaatatctcgtgatggcctgataaggcattttttccaccgaccttcgaaagcatacacgacaggcaccagaaaaaggagaaagatacaaacagcctgcgatgagagcagtgaaggcgaaacaagatggcacaagactggtaaacc

SEQ ID NO: 8236 - DNA, 532 bp, Pinus taeda
  misc_feature (401)..(403): n is a, c, g, or t
  misc_feature (447)..(449): n is a, c, g, or t
  misc_feature (474)..(476): n is a, c, g, or t
  misc_feature (481)..(481): n is a, c, g, or t
  misc_feature (483)..(487): n is a, c, g, or t
  misc_feature (524)..(527): n is a, c, g, or t
  Predicted polypeptide sequence is orthologous to G2826, G2838, G362
cagcagcaccgtggaattaatcgcatagtaccgttggagttcttgccaggctctgtcaatgcgttatctcagcttccattcaacagatcacaatacgatcaattaaacgaacgatgcagaccttcaagtcgtgataattatggcgagacaatccggcgggagagacccataattaggatcttcggcatagaaatcaatggaaaaaccgaggacccagattcgtgcgccgatgttgtaccggaaaattccaaacaaataatcaaccatggactcatattgccggagatggggtcagtggacagcgggcgcgaaggcacgagagcaattttgtccgatgattgtgtgaaattcgaatgccgatattgttgtagggttttcccgacgtctcaggctctcggcgnnnaccagaacgcccataaacgagaacggcgccgggcaatgacgagnnntcagagatcgccctctgacagttcnnnctatncnnnnnaacagaatagtattgatctgtttagccgtgagagagnnnncgggt

SEQ ID NO: 8237 - DNA, 856 bp, Pinus taeda
  Predicted polypeptide sequence is orthologous to G2826, G2838, G362
gcagacgcggcatgagcagcggccacagcagcgcttctgctggcctgaatctgtgctcgctttgcctgctgccgttctttcttgtgcgcattttgatgcccacccaatgcttgagaattcgcaaattctctgcagcaatattgacattcgtactttctgctgtcggaagccgaattgctcccactttctgcagcctgtgctgcactcgatctgtcttctccctccacatcctcttcattaaccttgttgtcatcatcatgatgcgccgaccctgatgatcggttctcggcttcaaccgttttttgcctcagttcaaacccaaacaatttcatggatttctctcgcttacagcgcccctctgcagcttcatcggtgacctcttcgctacactgatctttctgctggtgataatctctttgggtggtactgaaactccgctgcaacggtttaggagttgttactgtcactgtctctttcttgttcttgatttccatggaagtggatccaagatgattgctgcattcttcttgggccacctcctctcccattgaggtctcagtggggtactgcagagaagccaaattctcatttgggtagccactattgagaaacagagcagcaccaatattctctttcttctctccttctttcaagatgcaggcccttgtgcttgtgcctgcatctctatcctgacatgcatcggtgtacagtggagaagcagatgcagaagcagaagcagccttgttgcagtggatcaatgcttctccttcaggcctttgtcgcttggacggcatggaagccgaggaggaatagcccaaaaaggagaaggtgttaataattccaaaattgggtgtct

SEQ ID NO: 8238 - DNA, 994 bp, Pinus taeda
  Predicted polypeptide sequence is orthologous to G2826, G2838, G362
atccactgagccagtggaggaagaactagtgattgaagccaaaaatggagattcagggaaattagaagatgtgggtagcccagtagaggctggagaaagtggtagcactagcaattgcctgggatcatctgctcaagaaaatcggaaatatgaatgccaatactgttgcagagagtttgcaaattcgcaggctctcgggggccatcaaaatgcgcacaaaaaagagagacagcaggccaaacgcgcgcacttgctggccaccaggagcgctgctgcgagtgccaacagaagtggcgccactgcatggtgcgggaacataaacggtaacctctaccacagaaatttccttttcaataattcctacttcacacgcatgcaggtgtttcaagaagatttcccgacctttcagaccccacaagctgttgcagctccatcaatcccgcattatatcttcagttaccagcagcagcagcaggcgcccgtgcagagctcgctgcctggattaatggtcagttcccaatgcgggcagttcggattaaacgaagtcagacaagtccctatttatggggacaatgtcaataactattccttcaaccccgccactgccctaccccaacctccagtgcccattccagcttctctccattcaagtggcctgtcaaggatcagacaagccagttggtcgattcggcctccttgcagatcgggcgactggcaatcagaccatgcagctcctgttgtcatgcccgtggaacgcaaatcttcttctgacaagtttggactggaattggatcttcaattaagaataggtcctaatgcgaatcccaacagtcactttgagtaagattttatgcttctttgggttatttttcctgtaagcttttcagacttttttcaatgaatgcagagagattaaaacctaaaacctaaagagatttcgctaagtgatcaggattttccattctctgtagatttcctgcttatgctggcagca

SEQ ID NO: 8239 - DNA, 753 bp, Pinus taeda
  Predicted polypeptide sequence is orthologous to G2982
ccatttgggctccatgatgatgcatatgtactgaaagaaatgaacttttgtaaaaggccatttagcactggtgtagatagtggccatgaagattgctgcaatggaaccgcactcgctgaatgcaagtcacctgaatctaatgtgtgccagaatctcataccatctcattctccattgccgagtgttggagcttcctatcctatgtcttctactcctgggagaacgtactctactccacctgttccaggcatattaaaagctcgtgtcaagcatgaaaatatgacataaatgaaaccaggtgttgcttttgtgtaaatgcgtggctattgtattcaccacatgaagtacatacaattgatgatttcctgccattcattgaagtggagtcttcagtgattggcagttaacgttatggattgagcaatttccacaatatggttttctaccagaagctaccgagtgcatgtgtcaaatggattggtaatcttttgttacatcaaaattgtagagctactttttctgttgagaaagttcacgagtatgccatgaataggggaacatagctatgaaatggggaacatagctatgaatagttatattgcaaactgaaaaacaccatctgaacattgcagaatgcataatgataagctatctgacatttgagttatttatggtcctatgaattgctgaaactaccgcatagactattgcaaagcaatgtctcagtaattaacataatgccagactgcacag

SEQ ID NO: 8240 - DNA, 729 bp, Pinus taeda
  Predicted polypeptide sequence is orthologous to G2989
cacactaattacataaaataagcttatcacagagtccattccaataaatactcggtaaaacatccagagaagaagtcgtttaaaaacaatacaatagcaaaggggtcatctccctttcaaaccctattatgttgaattctagataaacccaaaagaaaacagaaacacgaattcaccaatccatcatacttcaaggcaagctcatactgttcctcttctttttaaattttcttgatgttgttcacagcataatcgtagcagcttgaagctaaaccccaaagccacaagtcttgacaacctgtggaagggtggagagggttttccttctgttgacattggagggaaacctaaaggtgttaccgtcaatttactctggtgcaagctcatactgttcctcttctctttaaaggttcttgatgttattcgtggtagaatcgtagcagctcgaagctaaaccccaaagccatggatcttaacaacctgtggaagggcgaagagggttttccttctatttacatcagagggaaacctaaagttgttaccatcaatttacagtagaaggtagggatgtgagtgttttaagggagagtccacctgctctgagggactccatggaggctttatgtacacatgcagctatgtcgaatggtaggggcaaaatctagtcgcaagaatgctccctctacagcttcctcgtgccgaattcggcacgaggcctcgtgccgaatt

SEQ ID NO: 8241 - DNA, 854 bp, Pinus taeda
  misc_feature (62)..(63): n is a, c, g, or t
  misc_feature (70)..(71): n is a, c, g, or t
  misc_feature (78)..(78): n is a, c, g, or t
  misc_feature (825)..(825): n is a, c, g, or t
  Predicted polypeptide sequence is orthologous to G2992
ggcctgtgctcattccctttccgcctcttctctgcaacagctcgtaacgagagcaacaaggnncgacagnnggagcancgataactgtacacctgaatggccaatgctggactgaagcgaatttgcagaagacacctttctggaaaatgaaatcaaggcggagagtggtcgcgggttcgattcaagccggatgctgaaggcagcgtaagagacgaagcagcagttatgttttgcggcggcgacggtgagggtttgatgctcgaacagagggcactggggcacatgatggatctgggaaacacccagcatatgcctgtttcgatgtcggcaccttacggtgtgtatcccagtggcaacggcaatggaaatgccgccatcattatggtgctcccgcacgacgagagctcctccaatcccttaaatcctcaaaaccctataaaccctcgaaaccctatggaggcggcgtctgcaccgcttgctaccaaggttctgcgctacagagagtgccagcggaaccacgcggccaacatcggtggccacgccctcgatggttgcggggagttcatgcctgccgaagacgacacgttgaagtgtgcagcctgcgggtgccaccgcaacttccaccgccgagaggtagagggcgacgagcaaccgccctccaactgcgagtgctgcctccgcaagaagcgtggcggcggatcctcgtcagggccgggatcccctgctgccccttattaccccctccctttgccccacggttcctcggctccccatgtgctcatggcgctaagctctggtcttaccgagtccgatgaccccgatggncatacccacaacaacagtaataataacct

SEQ ID NO: 8242 - DNA, 888 bp, Pinus taeda
  misc_feature (14)..(14): n is a, c, g, or t
  Predicted polypeptide sequence is orthologous to G2993
gccgcaagcacgcnggatggaaaaccgcctgaaaaaggatcagaaggcagaaaaacggtgagatacagagaatgccagaagaaccacgctgcgaatctgggcggacacgtcatggacgggtgcggcgaattcatgcccagcggggaggaggggacgccggagtctctccgatgcgctgcctgcgaatgccaccgcaacttccacagacgggaagtggagggcgaggaggcccaaaccgcctgcgacgtttgctatcacaagggactcgtctcgggttcgaatctcatcccgctgtcgttcccaccgccggccataggcgttcttgggcgggctctccctcagatcattgcggccgcacccgtcaataataataacatgaggagcagccccgcgtttgcgccctcgccggagtccgaggaacaggcggacggaaacttgccgtcggggaagaagcgattcagaacaaagttcacgcacgagcagaaggagcggatgctggcgtttgcgcagagagtggggtggagactgcagaaacacgaggaggctgccgtgcagagcttctgtcaagaagttggcgtgaagcgacacgttctcaaagtgtggatgcacaacaataaacacgccatggccaccaagccccacgctgacaacaacaaccacaataacgacaatacggccgcggctaatagcagcagcaataactcaaccccataaaaattttcagtaagctctgttatttcgctcccatcttctcaccagagttttgcttcttcaggcttccaaatattcgtcctgcaggcaataaatctatatattttttaaagtatatattgacactgatgatgtcaatactaagatacttgctatttttttttcttgctccaaaga

SEQ ID NO: 8243 - DNA, 864 bp, Pinus taeda
  Predicted polypeptide sequence is orthologous to G2993
cggccgggcagactgcagcagatttacggcaagagcctgggcatcgtggagggaatgagcccacctgaagatctcaggtctcaggttcaaggcatgaggcccccccatcatgttcacgaaacaacagcagcagcaacaaggcccggccctcctcctcctcctgtacatgaagacatgaggactcaacagcatcagcagccgcagcattacccacaagagaataataggaatgctgataatatattgattaaggctgttaggtacagagaatgcaggaagaatcatgctgcaagcattggggggtatgcagtggatgggtgtggggaattcatgccgagtggtgaagaggggactgcgggggctctgaagtgtgcagcctgtaattgccacaggaattttcacaggagggaagcggaaggggagaacaggtgtgattgccatcacactcgtaggtgatgggtttttagggttagggttttaggattggagaagcattatctttgtttattttgtattgggtttattgttattgatgttgttgattgaagaacttggtatattttatatacggggaaaatagggaatttcttcaattgggtttttgtttctgttgtgatgtcacaaggtggataagtgctgaataggttttttttaattgtgaatggatatttataagacttctgttatatttcacggtgaaatttttgcattgaagaaacaaagttaatacgtgatgatattattttattgatgtaactgtcaaagccatcaatagatattgtatagcatgctaggtacaaacactttggtgcatcttgattgctgatcatcttcggagcctttgggcacgttaaatcatttttc

SEQ ID NO: 8244 - DNA, 841 bp, Pinus taeda
  Predicted polypeptide sequence is orthologous to G2993
cggccggggccaatctcggttagctatggccccatacatgagtcttccaagctgaaaatattgacaccaggtggcaatggggctgccgcttcagatgagcagcagcaacaagtacagcaggcagcagcgaagaaatcggtgagatatagggaatgcatgaagaatcacgcagccagcattggaacgcatgccattgatgggtgcggggaattcatgcccagtggggaggagggtactctagaggcactcaaatgtgcagcttgcaactgtcacaggaatttccacagacgagaagttgagggagaaccaccgtgctactattgctataatccaaggaaggatggcagaaagaggccttctggtggtagtcccttgccactggcccttccctctactagtccttctggggtgatcaccaggccttctccgcagatgataatggccttcggctccggacccactcatgaaaacgatcagcaggagcatgacttgggcagcctccatgggcttcatggagctcaaatggcgatgcccattatgaagaagaggttcagaaccaagttcacgcaggagcagaaggacaaaatgtgcagttttgcagagaagctcggctggaggatccagaaacatgacgaggcagcagtccagcagttttgcatggaattgggtgtcaaaaggcacgtactcaaggtgtggatgcataacaataagcatacactaggaaaaaagatttgaaattttttatgttctttctcttccttcttccgtgctgatcaaacttgtaggacaacttcctttcaatgaatgtcacatgacagacttcttgtttcaatgttcatga

SEQ ID NO: 8245 - DNA, 745 bp, Pinus taeda
  Predicted polypeptide sequence is orthologous to G2998, G2999
ccagactgagcccgctgtttgtgacacaattaggagaggagatggggtgcagagcctagacatgaagttattgtcctagactgcatttacaattttacaagccacagggtcgagtcctggtgaggccgagtaaatgatagatgtcagcgcgtatattcagcaactgaatatctttgataggacttgcagtgcattgtttcgcattatgtgtgtgtaacaggcaatggaatttaggattgggggtgcggacagctgaggaggcgagaaactagtttttgggttttggaattcattaatggagatgggagctgggggcaacgaagccgagatcgggatgcccatgtcagtgagctacggtcatatggcggcaatccacgaagcgaattcgaagccgaaccatagtaatatgggcgccgacaactgcagcacggcttcggatcaggagatccgcccgctgtcacacgaggcggcggcggcggcggctggggcgtccctggcaaagccacgcagtgtgaaatatcgagaatgcctgaagaatcatgcggccagcatcgggggccacgcaaacgatggctgtggcgagttcatgcctagcggtgacgaaggcactctggaggccctcaagtgcgctgcctgtggctgccaccgtaatttccacaggcgagacaccagcggcaacggaggcgccgacccctcggcagccgcttcctgctattattgctgctacggtagcaacggcaatggc

SEQ ID NO: 8246 - DNA, 802 bp, Pinus taeda
  Predicted polypeptide sequence is orthologous to G3032
atctggacgagaaattattattagctgtacgctaaataaagaggctgaagatgaaatcgatcaactgacggcaaagttcaggagttgcctcatgaaaaccatatatggtgaagctggtgcttcagatgatagaaaccctcatgtggagaagggtccgaacttgatgataacaacgatcgtagttcaccgcagctccatctcttctgacaattactgccaccactcatcctgtgacaggaaaaactctcttattttgaagcgcgagagttccctttctgaatggggaaaagctgatgctacaaagaagattgaaactccccgagatgatgttggacgggcaaagctaccgcttcctcctcgccccagggaagcttcttacagaaatccactccagatgagctcgtcccgcggggattcgattgagttgcaaccaccaagtcctttcgtacaatttttcagtccccaagaatcgttggcccgaaataacgtgcagtcaacgctctccaaaatcgcgaaaaaacagaaggagatttcggtaccatttactctttctgcaataaagttcattgtttatgcatctgatcggggacattttactgctagatttttttatttgatattttagaattccaaaactcgttcttgctgccactggattttaggttaagttatggaggaacactctaactctggtacgccaatgcggaaaacctgaggtctgtgctatattcggctgttacctatataattgtttcctccctttctttaattgtgaaaactactttacatacattttcttcat

SEQ ID NO: 8247 - DNA, 859 bp, Pinus taeda
  Predicted polypeptide sequence is orthologous to G3055
cggccgggggagaaccctcgaatccccgcctcttcagcctgctttcccattcggctctcctaatccgcaggcgggaggtattcccaggccccgcccctctgccacgggttccctacagaagaccaagctctgcgcgaggttcgaggccgggacgtgcaccttcaacgacaattgtagctttgcacacggtgcggaggagctccgaaggccgactgcgtttgggggtggggggtcaaacatcgccggatcggtgaatttgcagagatttcacaagaccaggccgtgtaagttctttttggggggcaattgtccttacagagagaggtgcaattttctgcatgatacggaacagggtcagtttaataacgcggctgtggtgagagcggcttcttctaccaggcctcctaactggaagactaagctttgcgtgaactgggggaattctcagaactgtaattttggcgataagtgccattttgcacatggctttggaggtatgtagggggatttttgatttctctttggattcaacagacagcaattttttaaaattgtttttgtttcgaagagttttcattatttcggattcatggattgttattgcatgtaattatgccagatgaagattcggatcccttcgagtctcaatcagaaatgaatgtgatgacaaactcaattttatccccttttagtagtataacgattattttggaattaacggatgccgaagtgcacttcctggggcgtcgactctatttcctgattagaaataccgtggactggtggctgattgcgggcgttttttgtgtgattgcggaaaatatcgactctttacattggccctgaatctgggacaatg

SEQ ID NO: 8248 - DNA, 862 bp, Pinus taeda
  Predicted polypeptide sequence is orthologous to G3060
tcgatgtgggtactcgacggttcacccttctgacatcgtatatggagatcccgccagattcaagcagccaacctttgtttctcctgaaatggagtcgttaccaacaggtttaggaagcaaatcaaaggcatgcaccaaatttttcagtacatctggttgcccatttggagagaactgtcatttcatgcactatagccccggtggtgtgaatttgatttctcaggtgtcaaatttgggaagtggtctgcgcacagcttcaaggaattcaacaggtcccccaactagcattttgcctcctgatcaggcagctgctgtacagccatacaagacacggatgtgtaatcgccatgggactgcagaaggatgccggtttggagataagtgtcattttgcccacagtgaaaatgaactgaagaaaggaaatacacttgctcctgtagagagggaatggacaagctcttatggcaggccagttcctggtggaggtagacttgtgcagcatgaggctacaacacctggaatggcagctgcagcttcatttggttcttcagcgacagcaaaaatcagtgtcgatgcttctctctctggtgccattattggaaaaggtggtgtaaactccaagcaaatttgtcgtgtaactggagtaaaactagccatcaaagatcatgaatctgattccaatctaaagaacattgagctggaaggtagctttgatcagataaaacaagcaagtaccatggttcacgagctgataatgcaaactagggctgtagctgcaaaaccatctgggtttgtttccaacaatttcaaaacaaagctgtgtgagaatttttcaaagggtacctgcacatttggggatcgt

SEQ ID NO: 8249 - DNA, 970 bp, Pinus taeda
  Predicted polypeptide sequence is orthologous to G3060
gtatctgctttcctctgatgctcgttttcactcaaacgcagttagtgtctgtttgtggaacggcggcattcgcgactcaggtttgaatctcgcctcgcttcggcagcttgtaagcatggagtccttcgagcccacgttgaagaaatcccgcggttacgacacagatggtgcaaatggtatgccctggacctcatcctcgtccgctggaaacatgaatatgaatcctggcatgaatctcagttctggcgttaattatcactctggacctaaccccaaccagggtcatgggttcaatcccaatgcagcaggggctaatcctaaccctaaccccaccctcaaccctaactccggggttaacgaggttatgcaagggccgccccagggaggatacccacctgcgatgggcggagggcaatacgcaggaggctcaggagcgtcatacggaggaggttcatatggagggggttcgtatgaaaatgggaaccattccacccattttgaagtgttagggtttcaacagcaacatcagcagggaagtaatgttaatgtgggggatctcgagtgcaggcgttataaaactgacgagggctgtccttatggccttacctgccgctacaagcacggcccaacagatgaaagggattttaatattcacgtcccttcttctggaggcaagtcaaaaccttgtatgaagttcttcagtacatctggatgtccctatggtgaaggctgccacttctcgcattatgttgtgggaggcattgctgcccttggtttggcgcctgttcaaactatgcctgctgccactatggcaccaccaaggaaacagcccggaccaattggtgatcccagtgctactgtcagtggttacaaaactagactttgcaatcggttcaacactgacccgggttgccgttttggagataaatgtcactttgctcatggggagagtgatttgcgttcatctaat

SEQ ID NO: 8250 - DNA, 868 bp, Pinus taeda
  Predicted polypeptide sequence is orthologous to G3067
cagcaagacgctgccagctctatacactctttatcagcttcctaatatatggtcactattaaaaaagtcataatgcagcacactaaaggtattaacctgtccaaagaattcaaatactctaccaacatccatctcttacaatggaagatttagagtaatgaatgagggcaaacaagaagatcaggctgtggggttgcttacaaaaccacaaacaaatatgacaggtaactaaaataagtccaaacacaagaaatgggccaatcagtatacgtaaggttaaaacagtcagctgtttttttagaccttatacatcacaacaaagcaaggaagcactgccttaggattaaacacaaataactcatccagattagagtagattcctgcctgacctgctaatgaatcatatccaccattgaaacactcatctgggtcttgggacttgttaacccgccctgcaataactctgcaaactagcattgctctcttatcctttgattcatcctcctctgatacctcaatggaatcatgggcttttccactgcttgcggtggtgtaaattccttttccattctcaacttttgaggagaatccatgtcggatgatattgcagacattgcaggatggaatgttgcataggttagttaatccattcatacccagtgaacaagagaatgtgatgcagtggaaacgaagtagttcgttgccatctgctatgcaccttgggtgcttcttggctgacttgttggctttagcctttaccatgtctctgtaatcttcgaatttgttgatggtcttctggctattgtggattttcagaaccctctctatcttgcaaggtgtctcctttttaaccagctggttggaagaa

SEQ ID NO: 8251 - DNA, 893 bp, Pinus taeda
  Predicted polypeptide sequence is orthologous to G3075
cttgcgctgcatttgccatgatttcaaaaattacccttgaaatacagtattcttctccatcctcaaagagatgcattgtcaaaataagtcatagatgcttcaaaaaattatgaaatctcacaaacattgctcaaatttccgctgaagcccttcgggctaaagcatctgctgctttaactttctccggcacaaagtctgcatataaagaatgtgagttccagattatttgagaaagttaattcaactttaataaatcaaaacacaggtcatggagaaacaccaaggtaaaggactgcttaattatactgacgtacaaaattaacagtattaacacagccatatatctattacgaactgcatcaaaggaatttagttgaatccattataaaattaaagcatggaaacaaacacatcactaacctgcaagaaactcgtacctcttctggttagccacagttgaagaaaaaggcttgtagcttaaaatatttttggtctcctccaaaatatgttcgaatgagtccacaacaaactgttccaagaacttctccgctgctttgttaatgagaaaggctgcttctacattaatccgaatatcaccctcgctcctgattacacgcctcactctggctgtggggaacgccagagttgtaggagtttccggccttgggaccttgatgtgcgaactttttacaggacggcttggggtttccgcctcccccatatttggagaagaataagcgccattatcggtggggattttcgttggtgaggttttctcatctgcattttcctgctcctcgctgaaatctgaagaagactgtgcagaagaatcggattttggagtgttagctgccttcattttcggaagaaacatgaagtgagcgagcggaagt

SEQ ID NO: 8252 - DNA, 573 bp, Pinus taeda
  misc_feature (26)..(27): n is a, c, g, or t
  misc_feature (53)..(54): n is a, c, g, or t
  misc_feature (523)..(524): n is a, c, g, or t
  misc_feature (537)..(538): n is a, c, g, or t
  misc_feature (545)..(546): n is a, c, g, or t
  misc_feature (551)..(552): n is a, c, g, or t
  misc_feature (554)..(557): n is a, c, g, or t
  Predicted polypeptide sequence is orthologous to G309
ctggcaaacgctgggtatactgtaanngcctctgatttagcccatgttgcacnnaaggtggagcaactggatagcattatggggacggatcaagacccgggaatatctcacttggcttccgaggctgcgcattataacccgtccgatttagctggctggatcgaatcaatgttcggggagcttaatccaggcgcagacatgccagttccgtttggggacaggggatctctgatcgattcttcacaggttcataacccgattcatgatgatcccagtctttctgctatggacttggcactcattcatgaatatggcttgcagtttaatggaagccaagcatctaaccctcagggtttttccccggattctgatccctctgttagatgcaatattttctctggaccgcctctgcgttctggggattctaccacacacacgaactttcaggcgcggagctttagtgcccagtccagcgacgagggttcgagtctctctagtacccgcttgggaaccgcacaacagnncatagataatggnncgcaagnntcagnnannnncgtggtgcacttgctt

SEQ ID NO: 8253 - DNA, 911 bp, Pinus taeda
  Predicted polypeptide sequence is orthologous to G309
ggaaagacggtgaggggagttccactgtctgacctcagggttgctcaggggcctaccatggcggctaggcgaggctgattgctcgggtgggagtgaggtgtgaatagtttattgatgtttagttctgtgaatagtttattgatgtttagttttgtaaaaagtttaacagaagatcggatgctgcagggctgatacggttacggtttcgttacggctctttttagagccttaggcagcttttggggtgtttttttttctgtgagtggaattgaagtagaagttgaagctgaagctcccctggatgctccagaggcttcacagatatctcagtttctggaataggtggaagagattgaggttggttgtttgtatgtatgtacagtaggcttttgggtttttctttgggtttctggagtggctatatggatcatgaaggcaagaggatggcatcatttcccacttgtcgtcagaggctgtgcactataatccctcggacctcggtggatggattgaaagtatgctcagcgagcttcatgtccctattcttcctccaacagatcagccgtttcagttccctcaggcagcagcggatcaatcctctacggttcgggaagcgagcaattcggtgccggaatcttccacttcgacttcgaagggcaccagatctgtgcagaatgttgaacaggaccaacagtacaggttaaatgggtccggggccgggttgtttgagccgcctgaggtcctggatcgatcagaattccagcttcatggctatccgggccaagggggagtacgagataatgggattgatcgcatgttcggtaactatggcggccttttttctcaagtattagacgtctcggacctcctagtcgatgaccctgatgttctacaggaaccaccaccacagg

SEQ ID NO: 8254 - DNA, 740 bp, Pinus taeda
  Predicted polypeptide sequence is orthologous to G326
cacaaccaagctttgacagtgaagcattagcccaagcacgaggcaatgcaatgttgcggtacaaggaaaagaaaaagacaagaagatatgagaagcactttcgttatgaatctcgcaaagctcgagccgatgtaaggaagcgcgtgaagggtcgctttgtaaaagcagacaaagaatgtgatcaagatgcccttggaagtagcaattaaaggtttacctctgtagtaggaaatgttcaacctgcaaattattttgaatattttcaaatttggattgcctttaacatcaagggaaatgttctttgaaaacaacataccttgtttgtttggcagaatgtgtgcataatgctaaacaggaaatgatgctgtgaaggacagtaagttgaatctggtccataattggtggccagggcagcgtttgatgtaatcaatctaggtccatccatttcatcactcagggttgtctgttatctttgtattgtaataagtcttcaatataactttcctgatgaatgaagtcatgacattttggtttttcatcacagttcaatgcattcttcctgtgtctttctgaagatgtcaaaaccaaagtgtagacatacaacatatttgaggtcaccagccccacatgaaggtattgggaatgatattacagtgcattcccattatttttgtggggcaaattgatcttgtatgctattaatttgatacagtgaatttatatatcatttgtgtggctgt

SEQ ID NO: 8255 - DNA, 458 bp, Pinus taeda
  Predicted polypeptide sequence is orthologous to G385
actccgataattacactgcaattcagacatctgcacagtgcaatgcagattttatctgctgcactgtattgcatatgagattattggtggttgtaacagagtctaaacccagcttggctgttggtaaatggctgacaagcacctgaaaggccacagtgagtaatgaacctcctctcgtgagcgggctatccaatccactgctgttgctactgttgctgctgctgttcgccccttcgaggagtgaactagtagaagatctattttgaccgtctggaagaatggcaaatccagaggggagaagggctatgtatgaaggatcctccccgctcatagcaatattgattgctgggacgtccacgggggcgtacactataacagacccagatgcatctgtgcaactctcctgcagtattagctctacgttttggcttgacctggcccccgggcggccgctcgaa

SEQ ID NO: 8256 - DNA, 747 bp, Pinus taeda
  Predicted polypeptide sequence is orthologous to G385
ggtatagctgccaagtacgtgggcaagcccttgctttcattcgggccaccacctctcagttccctccctcgttcgaatcttgatctggcagtgggaagctatggtgtgcagccgaacttagggccagatatctatggatcgtcatcagggggagaaattggaaacaggtctcttgttggtcctacagaaggtgaaaaacctatggttgtagagttagctgttgcagccatggaagaattagtgagaatggcacaactgggggaacccctatggtcctcacgtccggaggatggcactgatattcttaatgaagaggaatatattcgcacctttcccagaggcataggtccaaggccctatggattaaaggccgaagcatctcgagagactgcggttgtaatcatgaatgctattaatatggttgagactctaatggatgtgaatcaatgggcaagcatgtttcctggcattgcatcacgaccagttaccgtggatgtgttttcaacaggcgttgcaggcaactacaatggtgctttgcaagtgatgcatgcagagtttcaagtaccctctccactagtgccaactcgggaaaattacttcgtgagatattgcaagcagcactcagacacaatatgggctgttgttgatgtctctctggacagtttacgagggaattcttcttcggtgataagatgccgaacgcgaccatctggttgtctcattcaagagatgccaaatagctattct

SEQ ID NO: 8257 - DNA, 812 bp, Pinus taeda
  misc_feature (449)..(451): n is a, c, g, or t
  misc_feature (680)..(683): n is a, c, g, or t
  misc_feature (721)..(723): n is a, c, g, or t
  misc_feature (732)..(734): n is a, c, g, or t
  misc_feature (737)..(738): n is a, c, g, or t
  misc_feature (762)..(763): n is a, c, g, or t
  misc_feature (765)..(765): n is a, c, g, or t
  misc_feature (769)..(770): n is a, c, g, or t
  misc_feature (772)..(772): n is a, c, g, or t
  misc_feature (784)..(785): n is a, c, g, or t
  misc_feature (791)..(798): n is a, c, g, or t
  Predicted polypeptide sequence is orthologous to G4
tcactattttcttcatcacgccattgctttgtgttctgcgaaggcagcaacagctgttttgaaaacaaaaggatgtgtgaaggtgccataactacggatttcattgccgcgaaccaatcccggcgtatttctgccagggatttttggccggatttcgataccttctatgacttgttcttcaatggcggagccgtgtctgaatccatcaataaatcgggcagcttcgacgacgcatacaaccggaagaataagacgagcaagaatattttcaactccaagcatgaattttcttcaggtgctggaaatgaggccattcctcctttgaaggatttcgaaaagtcctcggccaagagcaccaagaggaagaggaggaatatgtacagaggtatcaggcagcgtccatggggaaaatgggctgccgagattcgagatcccagaaagggcattannngtttggcttggaacgttcaacacagcggaggaggccgccaaggcctacgatacagaggctaaaaagatcagaggtaagaaagccaaacttaactttgctgatggctcctgttctgtaaaaatggacagtagcaagaaaatgtcaaggaagaaagtaaagtcatgtacaaaaacccctaatttattattggggttgaatatgaacagtgaggtaaaacctggcttattannnnattactttgcaaacagtcaaatggaaccctctttgggnnnatgtcttcnnntcnnatcttccagtctatggctccgacnntntggnntntcggtactctgnntacctnnnnnnnntgctccatttcgaa

SEQ ID NO: 8258 - DNA, 884 bp, Pinus taeda
  Predicted polypeptide sequence is orthologous to G4
catgatcagtaactttaaaccttcatattcaccaaagcgtgatctattagagggttactgtctaaacggccaaatgaaaccctctctgaaggatgtctgcagatcggctcttcaaaactatggctacgatgatatggagtatggggactctctgttcttaaaacccagagctccatttcaaagcaattcgaacgtatcaacagtccaatcttctgagcaaagcaatttgagccaaactttgcagaaatcgtactcttgtgagctctgtagccataactattcagaggtgagcaatttcatgtccactgcgtgtagcgatgtcgcacatttcgaaccggtgaaatcttcccatccaggaggtcattttcattcagatcagagcagcatctcacttgatggggcacatttcccatggggtcatgaaacaaaaaccccagaaattacatctgaatatgatgacacgaatgagtctccatttgtagccataaaaccccaagtcaatggtgttgttaaagacagatctgttcataccatggacgtcagcggtggaacacaaactttttgtgtgaattcttctatggaggtcaacgatgggacacaacgttctgctgtgaacatccccattcaggtcaacagtggcacagaatgctacaaacagaggataacatcatgcagcttcagttttccaaacaattatcagctttggaatcatatcttgggttgccagagagtcctaataataaagcaaccatggatggatcaacagaagtagcgggtcatgctccaggctcttttccacatgaggaatgttccctgaaaccatggttctttgaggacttcccaagttcaagttcagtttatcaaagcaatcttagtgatatgtg

SEQ ID NO: 8259 - DNA, 874 bp, Pinus taeda
  Predicted polypeptide sequence is orthologous to G4
cagaggtgagcaatttcatgttccctgcttatggtgataccccaaaatttgaaccagtggaatcttcctatccagtaggttattttgattctgatcatagcagcaactcatttgatgaggaacatttctcatgggctcatgaaatgaaaaccccagaaatatcatgtgtatataatgatgatggacatgaatctgtatttgtggacataaaacctccagtccatggtgttgttaaggacagacctgtggatacctctataaacgtcaacagtgggacagaaagttttggcgtagatacctctatggaggtcaatgacgggactgaaagttttggcgtagatacctctatggaggtcaatgacgggacagaatgttttgctgtggatatccctgttgaggtcaatggtggaacaggatgctacaaaacagaggataacatcctgcagcttgagctttctgaaaatttgtttgctttggaaaaatatcttgggttgtcagagggtgacgcagcaggctcttttccagatgaggagtggtccttgaaaccatggttctttgacgatgtgccaattttagctttacctcatcagagcagtcctggcgatccgggaacttcaggttcagtttatcaaagcagtgctggcttttgcttttaaagtttactgttaaaaaaaagcagactggtttgaattttgtgttgcatgtccatgtacagcatgtagagtcttttaaacttgtgtgttgcactttttatttatgtttttaatttgtttgtgtgtgtaaagtctcttccaaggctactagaattcatatgtagtagtttggttctcaaacatttgggataatagagttcatctatgttatagattgtttg

SEQ ID NO: 8260 - DNA, 1032 bp, Pinus taeda
  Predicted polypeptide sequence is orthologous to G4
gtaagcaggcaacgacgcctgttttgctttagagtttaacagaaaagaagaatgtgtggaggtgctatcatctcggactttataataccccctgcgagccgaggccgccgggtgactgccagggatatatggcccgattttgataagttctctgagtttattaatggaggtgctgcggtggagtcctttgatgtcagcgttgatgtcgatgacgacgaggaggattccgacgatgacgagttcctcgattttgaggagagctatcagaacaagaagaagaagcagcaacagccgatatcccccaccaagggtttcgagcttcctttagctcggggtcttgatggaccggcggccaagagcgcggtgagaaagaggaagaatttgtacagagggatcaggcaacgtccatgggggaaatgggctgcagagatcagggatcccagaaaaggcgctagggtttggcttggtacctttaatacggcggaggaagctgctcgggcttatgatgcagctgcacgaaagatcagaggtaagaaggcgaaagtaaattttgttgatgagccaccaccctccgttaagaaggaaagtaataatgctaagggttccaagaaagggtccagcaagaaaataaaatcatatactaccccaaaggctgactttttcgaaggtttcaaaacggcgaaaccttcgattgcccaatacaacttccatcagaaattcccaaaccctagctgtgatgatctagggtatcaaaaccccttatcgccattacatgccatctgcaatcgaaactttgtcgccaaacagtcaagttccgcgttgcctgcatactccactgagttttctgatttcgatgattccgaggtcgataatctggtaccccagcctgcgagttttgaaccgatgaaaaacataaataaacgaaaagggtataattcctttgagtccgacaccagctgtgtgtctgctgatagatcccatatctcgtgggttacagaagtgaaaacccctgaaatatcttctgtaccaaaa

SEQ ID NO: 8261 - DNA, 722 bp, Pinus taeda
  Predicted polypeptide sequence is orthologous to G4
cggccggggacaaaagtttcagttggggttgggagaaattagacactatgtgtggaggcacggtaacttggaattctaacccggttagtaagagtgagcgagccattttggaggatttatggactagtttgcatggagttcgccggcattttcatgagtccttctttgatttgtacagttcagatgacgatgatgattttttggattttcctgatctttttaaagaaaatttaagtgccaagggtttacggattgccaagaaagaatgccctttagctggaggggggcttgctacatatccttcccattataaaggaacacctaacaccacaagagattctcaatgcaaaggagcagccaagaccacaagtggtaggaagaagaagaagactatgtatagaggtataagacaacgcacatggggcaaatgggctgcagaaatcagagatcccaaaaaaggaatgagggtttggctgggtacctttgatacagcagaagaagctgctagagcttatgatgcagaagccaggaagattagaggaaagaaagcaaaactcaattttgctgatgacttgttacctcccaagaagagtaagaaggtggtaaagaagcttaaggataatatgattacagaagactcacataaaaagacatgcatgcacttgccagaatgttcagcaagctcaggtattgttcagagccagaaatccaatgtgaaggct

SEQ ID NO: 8262 - DNA, 796 bp, Pinus taeda
  Predicted polypeptide sequence is orthologous to G409
ttttacaattcctttgaccaggaagaaactggagatgaagaccttgatgattgtatccatccaccggagaagaagagaaggctgactgctgaccaagtgcagttcctggaacgaagctttgaaatcgaaaacaagttggaacctgagcgcaagatacagctagccaaggagttgggcctccaacctaggcaagttgcagtctggtttcaaaaccggcgggcaaggtggaaaactaagcagttggaaagggattatgatattctgaaatcacgctatgagaatttgagagttgattatgatagcctgctcaaagaaaaggataaattaagggctgaggttaccttcctaacagacaagctacacgacagtgaccatgaagccctcacaaaggattctgagtctgctgacaagaaagtctatccccagcctgcctcccactctgactgtgttggggagcctgaaagaagtactgctgccaaggatacaccaccaggttgtaaacacgaagatcttctgagctctggaacagatagcagtggggtcctggatgaagatagtcctcaccatgttgactgtggtcattcatccttggaccatgtgaactctcatctttttgaagcagatcagtcagacctctcacatgctgaagaagaagaagaagaagaaggcatgagtgaaaaactgcttcctcagacatacgcatatcatctcctcaaaagtggaagacggtgcttacccagatgcttcaattgcgtacaatgacatgtttgttttggaggatcaagtacagcttccc

SEQ ID NO: 8263 - DNA, 783 bp, Pinus taeda
  Predicted polypeptide sequence is orthologous to G409
agcaactagtgagctatagcattgaagatcatcatagctcgggaacagatggaagtgctgtcgtagatgaggaaagccctcctcacattgatagtgggcattcttcggttgtactattgggctatagcactgaagaccctcttagctcgggaacagatggaagtgatgtcttagatgaggaaagccctcatcacattgatagtggacattcttcggttgtaggctatatcacctcaacccgtgtttcacacattgaaacagatcagtctgacttttctcatgttgatgaagaacgaggcatgagtgaaaagcttgtatttcctcaggactgtcataatctgaaaatggagtgtggacttttcccagaggcaccaacaacatcttgtaattatgtattttccatggatgattcatggtgggactggtcataagtagctaattttctatttagttcattttgtacgatctatctcatcacagcaaaatggtttaaacttaaagtagagatccactctccattacttgagaaagtagacttgacatggtaaggtttgtcctccaggttgtaaatgttctggagagtgggttctctgaagcttcctctatctatcaatggatttgccatgttgaacttgtttttggtttacatgttttgggaatagatatggcaaactattggagggacagcaactgaagggctgctctctttgatgaattttctaagacaaacagatctttgtactttttctgtaatgtaatctttgatcttctattaagttattt

SEQ ID NO: 8264 - DNA, 839 bp, Pinus taeda
  Predicted polypeptide sequence is orthologous to G409
gatggacaacaagcttgagccggagcgcaaaactcagttagctagagatttgggattgcagcctaggcaggttgcagtctggttccagaatcggcgtgccaggtggaagaccaagcaattggagagggaatacgacattctgaaatcaagctatgatactctcagggtggattatgataatttactcaaagaaaaagataaattgagatctgaggtcatttgcctgacagacaaactacatgccaaagagaaaggtttggaaatccaaacaaatgatttggagacaacttgtaaaaaagcattcatccaatccgattcccagtttgagagcttggagaaatctgggattgtttccgaaggcatgactgcttcttttgatcagcaactagtgagctatagcattgaagatcatcatagctcgggaacagatggaagtgctgtcgtagatgaggaaagccctcatcacattgatagtgggcattcttcggttgtactattgggctatagcactgaagaccctcttagctcgggaacagatggaagtgatgtcttagatgaggaaagccctcatcacattgatagtggacattcttcggttgtaggctatatcacctcaacccgtgtttcacacattgaaacagatcagtctgacttttctcatgttgatgaagaacgaggcatgagtgaaaagcttgtatttcctcaggactgtcataatctgaaaatggagtgtggacttttcccagaggcaccaacaacatcttgtaattatgtattttccatggatgattcatggtgggactggtcataagtagctaattttctatttagttcatttg

SEQ ID NO: 8265 - DNA, 1231 bp, Pinus taeda
  Predicted polypeptide sequence is orthologous to G450
caatagagctgcgcagattaatcatgtcttgcagtgttggaggcatggagaaatcaagtacgggcgcacagcaggagaataaatgcagtttggatattttcgcagagaccgagctcaggctcggactcccaggggtagctgcaggagaacggcagaggatctgtggaaaaagaagtttttcggaggccatggaatccagaaattttagcattccacaggaggaggctcataaattccatgaacccaatttaggcacagaaaaacaaatggtccgtcctgccaatgatcctccaaaaatgggaccaactcctcccaaggcacagattgttggctggccacctgtcaaagatttcaggaaagtcagaacaattgctgcatccagctctctttatgtgaaagtgagcatggatggagctccctatctcagaaaggtggacctcaaaatgtacagcacctatcatgacctctcctctgcactcgagaacatgttcggctgcttaattaccatgggcaagtgtggatccagtgggatcaaggagagcaatttgatggatgtggtgaatggatcagaatatgtggctacttatgaagataaagatggagattggatgcttgtaggcgatgtcccatggcagatgtttgttgattcctgccaaagagtgcggatcatgaaggcttcagaagctattggtttagctcctcgggccatggaaaaatgaaaaaaccaggaattaacaggaattacagaccacccataacgatttagactctatccacatacatgattattggagttattgatttttgggaggctaaattgttctcaaactaattgtaacgtggtgcaatatgcacgtggtgagctggctgctcttaggttattgattgagatggaatatgattgttcatccacgatggctcaagatccgctgtatcagaaaactattttcagttattttttataaatggtccgattgttttaaatgttttcctataatcctttgacatagcgataaaggaaaaattctacatgcactttccaggatttgataattctcctgaaatattatttttgaaaggtctcacccctctctgtatatatgatttgtgtgatgagaaaaatgtttgacacccaaaagaattttaaattctataatgtagatcactgtgaaaaaattggaattgacgagccggaaattttgtgactccgcaaaattgaagcactgttttc

SEQ ID NO: 8266 - DNA, 1236 bp, Pinus taeda
  Predicted polypeptide sequence is orthologous to G450
gcacgagatcttttacaagtattcttcctttttctcctcttttggggttgtttcaatcttgggctctgatatcttcagaggaaggactaggactttttcgttacaggttgtgcagaatcaacatgtcttgcagtgttggaaacatggccatggtcctggagaaatctggtgggaacgcgcagcatgagaagagagatagtttagatttcgcggagactgaactgaagcttggactcccaggagtagctgcaggggcacgccagaggatctgtggcaaaagaagcttctcggaggccatggagtccagaaattataccattccagatgaagacattacaaataccagcacacatgaggaccttgataaattcaagggacccatagtcaaagaaaaacaaatggccctttcagccaatgaccctccaagaatgggacctccacctccttccaaggcacaggttgttggatggccacctgtcagagatttcaggaaagtgagaacagttgctgcatccaattctctgtatgtgaaggtgagcatggatggagctccttatctcagaaaggtggacctcaaattgtacagcacctaccacgaactcacctctgcactagagaagatgttcagctgcttaattatcatgggcaagtgtggatcccttgcgttgaacgagagcaatttaatggatttgcccaatggatcagaatatgtgcctacttatgaagataaggatggagattggatgcttataggcgatgtcccatggcagatgtttgttgattcctgccaaagaatgcggatcatgacggcttcggaagctattggtttagcgccaaggaccatggaaaattgtaaaaacaggaatagagtccacccataatgttctttgttcagtgaatctggaacctgattattcatgatatttttttgacttttgaggagggcatattcaatcagcctctatctaacgcatgtgttagaaattacgatagtcgatccaataccctgcatgggatcggatggtcgctgactgttttaattggagaagttaccagcttgggggcgatcgcgcctccgtctgcggaatcccgactaatctatcctatggatttatagaactggcattttcagaagctatgtgtagtaaacaaatatggtggtcaggcaaatacagtttggaggacccagaaatttcactgtaaatgattattggaatgattgattatttagaatct

SEQ ID NO: 8267 - DNA, 1209 bp, Pinus taeda
  misc_feature (1129)..(1129): n is a, c, g, or t
  Predicted polypeptide sequence is orthologous to G450
agattcattcagaggaaggactttacattacagttgtgcagattaatcatgtctgccagtgttggaggcatggagaaatctggtacgagcgcacagcaggagaataaccgcagtttggattttgcagagactgagctcaagcttgggctcccaggcgtagctacaggggaacgccagaggatctgtggaaaaagaagcttttcggaggccagggaatccagaaaatttagcattccacatgaggaggctcataaattccacgaacccaatttaggcacagaaaaacaaatggtccgtcctgccaatgatcctccaaaaatgggacctcctcctcctcgcaaggcacagattgttggctggccacctgtcaaagatttcaggaaagtcagaacaattgctgcatccagctctctgtatgtgaaagtgagcatggatggagccccctatctcagaaaggtggacctcaaaatgtatagcacctaccatgacctctcctctgcactcgagaacatgttcggctgcttaattaccatgggcaaatctggatcccatgcgctgaacgagagcaatttgttcgatgtgcggaatgggtcagaatatgtgcctacctatgaagacaaggatggagactggatgcttgtaggcgatgtcccctgggatatgtttgttgattcctgccaaagaatgaggataatgaaggcttgagaagctattggtttagctccaagggccatggaaaatgcaaaaacgggaattacattcagtgaatgtggaatctcacgagggttgaatggtagttctttgatgtgcgtggtcggcatatttgatcagccagttgctaaggcatggattagaaattacgatggtattggttggtccaatcggcggccgtggtatcggagggtctggtccgactgactgtttcaaacgaagaagttcgtgtaagggggacaacattactgataatatctcaattgtacaaaaaggtgaacacgctctctccaaaacatggatcaaatattttggttttaaagaatctgcccttctcctcaacttctgtgcagtatgtgtacaaatttatcaaatacaaagctaatgggtacgggaattccactgtgtaaatctgaanaatttttgacaaattttatgtcaaactaattgtaacctgttccgcaatatgtacgcgttgagcaacacgctaattttgtt

SEQ ID NO: 8268 - DNA, 772 bp, Pinus taeda
  Predicted polypeptide sequence is orthologous to G450
aacaccgtcttcacgatgaatctgtaatcttatatacattacaattgagcaatgtttcgtatccatgacaagcagctcttgagctacagaaatgaatatacccaagtgtcattatgccaaatagcaaattacagttttacagttcaagggctaacgttgcctttcagaacgatagaatttaagagaagttaacatgttgaatccttaacccactgtcataagcctgcactgggatgaggctggtcttccattattcaatacttgttgagacagaaatccagatttttggtttgagattaataaatcaacaagtgaatcctacctaagaatgtatcagaaacagaaagattgccaggatggttcccaaatcttccagttcaatagcagatccattgtgtcttgcttatattgccttcgtttcagcgaaatcaccaatttctgaggttttcaaagtcacaagataaaaattttggacgccgtgattttccctaatgctccaatcttgtcagacgacgttctatttgaatcaatcgaaatgcaaagcagcttccagagaatgggtcatacgtgaaccctaaatcttgtttttacatttctccatggacctagctaaaccaatagcttccgagaccttcatgatacgcattcttttgcaggaatcaacaaacatctcccatggaacatcaccaagaagcatccaatctccatctttatcttcataggtaggaacatattctgacccattcagcagatccatcactttcttctcgtt

SEQ ID NO: 8269 - DNA, 891 bp, Pinus taeda
  Predicted polypeptide sequence is orthologous to G489, G714
ttatgggggttgtcagtggtccacctcagatgccctatggtacagctccttatcaaacagctcagttggttgcaccggttgctccagcctctgttgttggaactgttcagtctcctggccagcctgcatctgcatatcctgcaactgctgctcagctagctgcacaacatcagctggcttaccaacatcttcatcagcaacaacaacagcagcaacagcaacagctacagattttttgggccaatcagatgcatgatatagaacagacatcagacttcaagaaccatagtttgccgttggctagaatcaagaaaattatgaaggcagatgaagatgtgaggatgatttcagctgaggcgcctgtgatttttgcaaaagcttgtgaaatgttcattttggagcttaccctgcgctcatggattcatacagaagaaaataagcgacgcactttacagaagaatgacattgcagctgccataactagaacagatatctttgatttcctcgtggatattgtaccaagagatgagttgaaggaggagggtcttggcattcccagaggacctgtacctgttggaaccccagccgaagctataccatattattatgtccctcagcagcatccagcagcacaggttgcacctcctggaatgattgttggcaagccagtggatcctgcaatgtatgctcaacaaccccgccctcctgttgcttatatgccgcagcagatgtggccacaacaacaaatgccagagcagtccaggggcccatcctctagcagttaggtgctttgagttgttttctgttgccagcaacaggtagatggtaagaaggaaaattgacaaagccctattttgataatgttgaaaggcatttgctcaagttcactct

SEQ ID NO: 8270 - DNA, 891 bp, Pinus taeda
  Predicted polypeptide sequence is orthologous to G489, G714
gggcagcgcccttttggtgcttagcagcgatttgaaacacgaatttgccatttgttgaagagtcgaagagattttcgactggttggagttcctaagttttggaaaatatggataagcaatccacaatgcaacacatgccgattcggtacgatgtaacgccttatcaggctgcgcagaatctggcccctgttgctcgtggaacgtttccacagcaccagacttcttcatatgttcaagcagctcacgctttccctcagtctgcccatcataatcagttggcctaccagcaccaacttcaccaacaccaacagcagcaactccaccaccaccagaagcagcaggttgattttttctggggcaaccagatgcagggaatcgagcaatctgtggatttcagaaatcacagcctccctctggcgagaatcaagaagataatgaagtcagatgaggatgtcaggatgatatctgcagaagctccggtggtttttgccaaagcctgcgagatgttcatcaatgaacttactctcagggcctggtttcacactgaagaaaacaagagacggaccctgcagaagaacgatatagctgcggccatagctaggactgatattttcgattttctggtcgatattgtgccgagggatgagttgaaggaggatcaggttatcaatcttggaacccctacagcttctctctcagttggaagcagcagttctaacgctggtggtgctaattctttccctttttattatctacccaaccagcattctgcgccacgtggagtcgttgttgggaaacctatggatcccgctatttatatgcaacagccacggtctcctgtggcctatatgcacaatatgttgcagcggggatacatgcacacagacgaat

SEQ ID NO: 8271 - DNA, 893 bp, Pinus taeda
  Predicted polypeptide sequence is orthologous to G519
gcatcaagaaggctcttgtcttctatgctggaaaagcacccaaacgttcaaagaccaattggatcatgcatgaataccgtcttgctgttgttagcaggcctgcaagaaagaaaggcagcttaagactggatgattgggttctctgtcgaatttacaacattttgacaagtgctgagaagttagcactagatcagaatgaaagctacatggatgtaccaatggaagccatcgatgaaattgagatggtgaatcaaccctcctcaacttcaatcgagcatagcggtattgaacagaacgggccatcttctgaccttttgaacaaatcgggaccatctccaacaagccacaacggggttccacctcgtgctctgcccatgaatactaataatatcagttcgccgaacctggacttcttccaaaagacaatcaccccttccagtgccggtacccctaaagctccagtgcagaatacagaattcaacccaatttcctcctccatcaaccagcaatggataaattacaattcaatagacttattgtcaggattgcatactgattccaacagttccaagccatcatcatcatcaaaccccattttagagaaagaagaagttcagagcagcttaagattggaaacttcttcaccagaggagcaaaagccattctttaatttcagtctggaaggtctagaataccccttctctcatctagaccaaataactcttcctgatccttatcaagactactttacaagttggaccggttcagacctaccaaggttttatgctaacgacatgcgcttctgttgagtagtttgaccagttcaaacctaccaagttttttccctaacaacatgcacttggtcatgaacttacagcaaggcttattggccc

SEQ ID NO: 8272 - DNA, 825 bp, Pinus taeda
  Predicted polypeptide sequence is orthologous to G519
gatcagactgagattggttccaagaagaagagagtgaaatagagtgaaatatctctatcagaggttaggcagggtagaagcaaccggtcatcgaggtcaggaatagcagaagcagtagcaggtcagagaatccggagtattgagaagaaaacactggcataagcatgggaagaagagatgcagaggcggacttacaattgcctccgggattcagattcttccctacagaggaagaattgattgtgcattacttgtgcaggaaagcggccttgctgccactgcatgttcccataattgcagacgtggacctctacaaatatgatccatggcagcttccagagaaagccctgtttggagagaaggaatggtacttcttcactccccggaacagaaagtacccaaatggttcaaggcccaacagggcggctggctctggatactggaaagcgactggtgctgatatgcccatctcttctaccgcttctagaggagtaaagaagagagtgggcgccaaaaaggcccttgtcttctatgttgggaaagcacccagcggctcaaagaccaattggctcatgcatgaataccgtcttgccgatattaacaggcctgcaaggaagaaagacagcttaagattggatgattgggttctctgtagaatatacaacagaaaaatcggtgctgagaaattagcactagagccgaaggaaagcttcaatgatgtaccaatggaaaccattgacgaaaaggagatgaagatcagcccacctcaacttcaatcaatcatagcgccattgaacagagcaacccgtcctttgaccatttgag

SEQ ID NO: 8273 - DNA, 972 bp, Pinus taeda
  Predicted polypeptide sequence is orthologous to G519
atgacacagaagggtggaacagaaggacagatagatttgcctccgggtttcagattttttcccacagatgaagaacttgtagtccattatctctgcaagaaagttgtgtctcatcctcttcccgcttttattataggagatgtggatctctacaagtatgatccatgggatcttccagaaaaagctttgtttggagaaaaggaatggtattttttcaccccacgggaccgtaagtatccaaacggttctcgccctaatcgggcggcagggtccgggtactggaaggccaccggcgcagataaacccatcacgacttgcggcgggaggaagcgagttggagtgaagaaggctctggttttttacaaagggaaggctcccaaaggatccaagaccaactggatcatgcatgagtatcgcatggcagaaatcaatatggcagccaggaagaaaaacactctacggttggatgattgggtgctgtgccgcatatacaacaagaagagcagtgctgagagactagaagagaagaaattggctgaagaaatggagtcctgccacgatatgcaggaaactgtgggaatccacgatatgcaggaaactgtagagcagcagaagaaaacgcagagtgtcccttcagagccatctcccactgatgcttcaactgtgtctgcagaagctggactcccatccacaaattcatccctttttaaccctcatcttcctgctcctcccatgaatcctatctgtcaacaccagagcaccaccacggatgaagtccagatgaacattaaactggcaaaccagctcattcagaagcagcagcagtcagggcagtgcttgaatttcaacttgggtctggacattgtgcagagccctttcttccagttggataattcagagccatcttctttgttcacccataccaggaattcatggacaactacagtatacagagatcttattagactctca

SEQ ID NO: 8274 - DNA, 858 bp, Pinus taeda
  Predicted polypeptide sequence is orthologous to G519
cggccggggaaagaaattacatttgagaagcaggtcagagcatcaagtgtattaaaagaaattacagtagcagagaaagtcagagcatcaaaagaattagcagtagcagaagcaggtcagagcatcaggagtattgagaagaaaacacaaggataaacatagccatgggtatgagtagaagaaatgcagaggctgacttacagttgcctcctggattcagattcttccctacagatgaagagctggttgtgcattacttgtgcaagaaggcagcctctcagatgatccctgttcctataatagcagaagtggatctctacaaatatgatccatggcagcttccagagaaggccctttttggagagaaggaatggtattttttcactcccagggatagaaagtacccaaatggatcaaggcccaatagggctgccggttctggatactggaaagctacaggtgctgataagcccattactgctaaaggtggaaagaagcgagtgggcatcaagaaggctcttgtcttctatgctgggaaagcacccaaaggcacaaagacgaattggatcatgcacgaataccgtcttgctgatgttagcagacctgcaaggaagaaaggcagcttaagattggatgattgggttctctgtcgaatatacaacaaaaagatcagtgctgagaagttagcacaagggcagaaggaaatctcccatgatattgtaccaatggaagccatcgatgaaaaggatatggataatcaaccctcctcaacttcaattgagcacagtggaattgaacagaacaacccatcttctggccgtctgatgaaattggaaccttctccaacaagccacaacg

SEQ ID NO: 8275 - DNA, 812 bp, Pinus taeda
  Predicted polypeptide sequence is orthologous to G522
ttgcaacatggaaggacaccatggcaatgccaatccacagtcagcagctacccaagaagatcaacaaggtgttaacacatacaatgaggagcaggttactgactggagagtgctggataaatttgttgcttcacagttgagccaggaggacgtgtcaaaggatgctaggttttctaatgaaacaatgtaccccatacctgatatgactgtgcttctgcgacagtctaataaacatgagcagcaagcagattatgcctcaaattccaactgtgatgttgatctctggagctttgcaggaaaatgaacagccctctaccatccaacaattacatgaacaaatggtaactttaactggcttttcatgtacataataaattacatctaaaggcatcagatttgataggcagtttatggtcgatttattaaccctcagtccttgagggggtgctgaagacaattggaagaaatcagacaacagagttacatgggaacaatcaataaatatgtggtcagatcattaaggaagtcttgcagccctctgtaaaatgtagacaaatttgtacaccaataagctagctgggtgagctatcatattaacatgtagaatttcacagtgagtgggatatacctaagctggatacttatagccctgcagtacattaattgtgttaaaacttctatttatatccctttagttccatcatgcaacttttaatagaccagtacatgaactggtcgtctactgtatgctatgaccatagtcagaatgcaatgttattggattaccactatataattcactgctaaatttt

SEQ ID NO: 8276 - DNA, 875 bp, Pinus taeda
  Predicted polypeptide sequence is orthologous to G559
tagtgattacaacatacgaagggcagcacactcatcatagtcctgcactgttgcgtgggtcatcgtctggaacttcagatcaattaacccactttggaggagcagcagaccatcatcgcaccgcatccccttttaacactgctcagtcacccagcttcaatatacagagcctgagaatggcggtgcaggtccctcagcgcactaattattatggtatgggcagtttacaggcacatgatccaatacaccggggcagcagcaccttacagcaccaacaacaaattataagatcaattcagcagcagcagcaacaacaacagcatgatcattctcagcaccagcagcagcatcagctaattcattcccagcaaatgcaacccccatcggtcgaccagggtttgctggaggacattgttccaccaggcatgcgcaaaaatccctagcagcttatttctaaacatatatacatagttatatatacatacttatcctgtttcgaagaacatcgccattactgactgccacagttcatgttggacgtgccatatgatctgcaactccacgtgaggtacgcccagaaattttatccttaatgcccatgatgtttcttgaaaacaattttatggccagcagctggatcttcccctctccatgcatatattgcaaccagatcccgtggaatgtttgcagacttcttaacagctaggccaattctcggttcggtgaaacgatgataattccggtcttagttctttgttgcttatcgctcttaattaaattccttttagaaagttgcagcaccatggattcatagtctattgacattatctaaacttttgactaggatcacaccagcacaaatttaattttatgaa

SEQ ID NO: 8277 - DNA, 851 bp, Pinus taeda
  Predicted polypeptide sequence is orthologous to G559
cggccggggtcatagcaattccatggatggttcatcttcctcgcaattaaatcaactgtcgtcagagtctttagagtccaagaaggcgatggcagcaaaaaaactccaagaacttgcacttattgatccaaaacgagccaagaggatattggcgaatcgacaatcagctgtacgatcaaaagaaagaaagatgcgttatatatcagagttagaacgaagagttcaaacactgcagacggaagcaactactctttcagctcagcttacattgttgcagagaggtacaacaggactaaccaccgagaacaatgaactgaaactgcgactgcaggctatggagcaacaagcacaacttcgggatgctttgaatgaggctttgagagaaaaagtacaaaggctgaagattgctactggccaactttcatcaaacaatacaaatgccttcaacatgtctgcaactgcacaacaattgccattgaatcgatcttttttccctccaacccaacattcacatcgtttgaatcaacaatttcagccatttcagcattctgcatctccaatgaataatcagccattgatggggcagtctcaggtgcatcagaactttccccagtatggtcctgcaggccaattgcaagtgcttgtgggcagtcaaggcgggcctgctgtagaatcagaagtgtcctctagttctgttaaccatcctggtagttctgcgttttagatggagagaatttgtggaagtgacacagtattaatcagtaagtgggagttctggctttatcagtggccaagattgctgttctcatgaaaatccttgtgcgtttacggtctttgttttgattgttaca

SEQ ID NO: 8278 - DNA, 880 bp, Pinus taeda
  Predicted polypeptide sequence is orthologous to G562
tgctcaacagcctgattacatttcattatttcttgtctgtttcttctttcctgtagcttgcctgtctcggtctttataaattcgaagcaataagttgaatggggatactgcagtcctgcctcccattgctgcgctctgctcggcactccgggtttcatttcatggagatcacttattagattcgctgttatgcgcagagaggtatagaaacctttcaagtccgcaattttccattaaattagaacagcccccttacagagtttaattgatgcttggtggatgcgaggccgccctctgggcatctgctgcagccagctcgctgaccgattgtgattattatttctctggtgatggtctgttgcctaaggtccttctcccccacccactgttttttctgaaggctcagtattatagataccggagattgaggtgaactgagacaggggcgaccgcctgttgtcttgtgtggttagaattaaatattttatggagaaaaaggggaaagcatcggtgaacagaccgaatccaaccaatggatcactgcatagacatggtcacatgaacagctctgcgacagcaggatgtgttcatggacctactggcaatgtcaacctcaaacaacaagatgagcaaagcttgcgcagatctcggagcttctgtgggcgcccttttcaaacggaaaagtcaggggaagtttcatcttcatcagcaaaatctaaaaagaatgcaacaacgatgatgagaaggcctaagacacatccagagcttctcaatcgggatgctggggatgctgcccctcttttaatgagcaatacgaagatgaatactcctgcggaggcattgagtgtgaataagttgctggtgaatgtgacggttgaac

SEQ ID NO: 8279 - DNA, 922 bp, Pinus taeda
  Predicted polypeptide sequence is orthologous to G562
ggaaggggtagtacagctggtatttcaacagcaatttttccagcaactgctcaacttatgccgtctggtcgcgattgtgttcctcccgagctatggatccaggatgagagggagctgaaacgacagaggcgaaagcaatctaatagggagtcagctagacgttcaaggttgcggaaacaggctgagtgtgaagaattggcaacaaaagttgagaccttgactgtagaaaacatggcacttagaaatgaactaaaccgaatggcagaggaatgcaaaaaactaaccgcagagaatgcttccataatggagcaactgaagttgaatggacaagatatgacgactattactcaagaaaatggttcaactaagatatcattgcagtcggtaaaacctgaaggcaatggccattttcatgatatatctaggggaatcaattcgaattctactgaaagaaatgaacaaaggcagagtgagacctgtgattcaaacgggaaggttcatacgttactagatgcgaatgctcgttccgatacaggttaaaatatgcctctaatgtgttttgatttaagttagttggcagatggaagttcgggagtccataccgttttgcttgttttgggctttctccaaacttttcatgcactaatatagtgaccgatgcttgttaatctagaaatttaattagcctggcttatgaccaagaccatttctgtaaaaaaaataacccacgataaacattagaagaggtgggttcagccataactacgatcatatcattatttggtacagctaacctgctatgagtagtttcttactcgggtcatgtaattcttctcaatggcccaattcagttctagtttctccgttacgagacaacagggtgtcaaaatcatgaacaaagatggcagttttcattattttg

SEQ ID NO: 8280 - DNA, 758 bp, Pinus taeda
  Predicted polypeptide sequence is orthologous to G562
ttcaatgacccgacacagtcccaaggattgcagggcaatcatcacacgatcgtaccgttttggaacaactactcagcattctcgcctcaacaatacgcgagacgccatcccgagatccggcgtccatcggtaccccaactaatcccggtccctcctccatctccatccagctcctctgtcgccacgccagacgaggtttatcccattttcaagttccaatcatcggtcggctcatcgccaaatccatcagcagtggcctcagacatcatgagagcaaactcgaccttggtgacctcaacacagacttccgccaccgcaaatggggatacatcttgcgatgagttttccacgacccgctcggacgtcacgcgagacgagtttttgtctcccgctaatgatgtgtaccttgcggagttccattccatctcgccgcactcccccgtgacaccaatcccatacgtgcagcgagggttcggatatcgggaggagcgtgctcggggccgtgacggcaggcgccggagggtgagaacgaaacccgcccaccggcaaaaggaaagttccggatcttccctgacatgccttcttcaagctgcggagccccgtaaatccagtttcacctccgattcagatggtgcacctttgaaattaccacaagaaaactggcgagttattggcggtggcgttatgttaggcaccccaacgagcgcgacatcccggcggaaattaaagcgactgcagtcgtgcgcgtgcgtggtcga

SEQ ID NO: 8281 - DNA, 806 bp, Pinus taeda
  Predicted polypeptide sequence is orthologous to G562
cggccggggacattggaagtgtgtttgaagagtaagagcagtggaagcagaagagattttgaagccatgaagcaaagtaagattgggatttctgaggattctcagtttacagcggatgaaattgaagttgcagacgttatgacctgcttccgccattactggagattctttcttcgatggggggcaaagcgcaagcgatccgcctttcagagagatgaaagcagcgccactcacaactccaacctgagtccactcagtatccctgccagcgaaaaccagtatgaacttgaaaacggcggcatggctatggtccctccccaactaccagtccgccgcctacaacctatatctcgtcccaactcaaagaatgtgagaggaacgaatcggcccaggaaacgagtgaccaagaaaaagacgcatagggagctgacggaggcactggttgaattgagcttggaaaatgcaagattgataaaggagttagagcagatgaggaaaacaagtcaagacctgaaagattgcaatgttattatgaaatcacagttggcattgtgccctgagaaaaggcaagagcaaaacataccttacacaccttggtcgtcatcatctggtttagataccagacagaaaacagcaatagctgcctcatgtgatgattttcaaagatgtgatgagcatgaacaatttgagaaatgttccggtagttcagctttaggcttggcatatgacaagttccagaggcttggaggaccaatgtatccttgttcctctgaggcctcacttgggtttgagaagatgacgcaatt

SEQ ID NO: 8282 - DNA, 809 bp, Pinus taeda
  Predicted polypeptide sequence is orthologous to G567
gatttgcggctgggagattcacatttttctctgaaagcctttgctcatgattttcaataaactttgataatatgtaaattgttatgacctgtggtatatttaaggctataaacatcatctcgaatcctctttactggtgaggttccacctgcagttttttttgatagatgtgcacatctgctgatttaaatttgtcacaaagatttgcggctgggagattcacatttttctctgaaagcctttgctcatgattttcaatgaactttgataatatgtaaattgttatgacctgtggtatattcaaggctataaaacatcttctcgaatcctctttactggtgaggttcgtttttttaatagatgtgcacatctgctgatttaaatttgtcgcaagatttgcggctggggggttcacatttttctctgaaagcctttgctcatgattttcaataaactttgataatatgtaaattgttatgacctgtggtatatttaaggctgtaaccatcatctcgaatcctctttactggtgaggttccacttgcagtttttttgatagatgtgcacatctgctgatttaaatttgtcacaaagatttgtggctttttctgtccagatgccagagctttatacgttggagctgcgagcagcactgcttcgggaccaattggtattccagcacttcctccgcagcctaaaagcggaaatactcaagtgagaacaactagtggatcctcaagagagcagtcagatgatgatgaccaagaagtgggacccagtgaacaaagcatggatcccagtcatgtgaa

SEQ ID NO: 8283 - DNA, 761 bp, Pinus taeda
  Predicted polypeptide sequence is orthologous to G568
ttctacagctaccttgttgagcaaaatactgcgacgcaattgacgagtgctaggagaaaagttagactgtactttgctgctgcgatgtttaaaatttagcgagaagtctgagctgctcaaaggtgttatttggtgggatttgcgggatggcttcggcttcctcttcttattcatcctcctcacctcgcaggccgaaaccaaagccaaaagttgactggaacgctgcaaatcggtcgaaattaatgtcaccggatgttattatggaggaaattgagagtgcgattgcggccacggagtacgagcacgcctcccggcatttgaaagcagcggcctcctccgatgtcgaagccgccgaccgagctttcagatccgcccgcgctgctgttgcaaaaggggatttcgaattaggtatggagctctcaaagcttgcactgctcaattgtccttctcaaaaaactaacgccatctctaagatacagaacctcattgctcatattaagcaacaacgagctgcaagcacagaaaattagccctcaattccattgcttccggtcattttaggttttcacttgctgaagatttcaaacccttctatgtgaattaaaaataaatgatttaagatcacgctgcttctaatgtaatacttcctttgctgctttcaatttttttattatttaagtagacggggactggatgtgtgtattcgatcgatgttatctacattcatttcttccaacatttttatgaaattagtggttatg

SEQ ID NO: 8284 - DNA, 865 bp, Pinus taeda
  Predicted polypeptide sequence is orthologous to G598
tgaggatgccggggatcgaaacgagggcgatgggaataatggtagaagggataacatggctctggtacctaccagtaccacgactacggaaggaaatcgagagcagagaaattcaggtagagattacttcgcgcttgttcccgtggatggagcccctgaatcaacaggttccacttcagatagggacgctccaacaagctcttgggacgcccagcataacgagggagccattgtggaaagtggaaatgctaatgccgaaaacactgcaaacaacagaggatttggctcctctgcttcctcgctgagaagtggtaatgagaaccctgtgcccactccaaagcaactcgctctacagaaagaggtcactttacagaaggtcaagaaagacaaagtagaagccaaggccctcgcttgggaagaagcgaagatggccaaagttgataacagattcaagagggaggaaacaattatcgaggcttgggagaacgagcagaaagtgaaagctaacatcaaaatgaaaaaagtggagagaaaattggaggaaaggagggccaaggcacttgaggaaatgcagaatgagatcgctatagctcataggaaagcagagaacaggagagctgtcgccgaggctagaagaggtgctgcaaaagccaagatatcagaaattgctgacaaaatacgctcgattggaaagctccccagaaaatttctcttcttgtagaaatccattgctataaaaattctcttcttctagaaatttactaatagtacagcattcaattctatgctacattattcaacatttataggctgagtattgtttatttggaacgtttactaatagtaaagcattcaattctatgct

SEQ ID NO: 8285 - DNA, 635 bp, Pinus taeda
  Predicted polypeptide sequence is orthologous to G634
accccagcagtttggtttgccgcagcaccagtccgactcgatgcttcctcaatttctcgcttctctgactaaagaatctcctcatttccagacttcgcaaacatatgagaatgagtcccagcagtccagggatcaaaccccgctccaaccgaccaccgcagacaccaagccgaaggacattggtgaattttcgtcggatttaccccacctggtagcctcgcctatttccagcaggccgcctgcggtgactggaaccgatgtcgtttttaaacaggcgatacacggccccgacgagaacaacaacaacaataacgcggcggaccttggagacgatgacgcttttggcggatccggagggagccgatggccgaggcaagaaaccctcgcccttctcaaaattcgatcagaaatggacgccgctttccgcgatgcatccctcaaagctcctctctgggacgaagtttcaaggaagctcgcggagttagggtttcatagaagtgcaaaaaaatgcaaagaaaaattcgaaaatgtgaacaagtattacaagaggactaaggcgggaaggtccggccgacaagacgggaaaacctataagttcttcaaccagctggaggccttatatggcaacaccgacg

SEQ ID NO: 8286 - DNA, 794 bp, Pinus taeda
  Predicted polypeptide sequence is orthologous to G634
gatagtttcgtactagtggacgtggcagtggtactgcttccgccgtttgagaatcccagagctccctgacggtagagtgaatcaagttgttgaaaataagggcaggtcttcgaattctcaggcctctttctgttactgtccttggcttttctgaaatatttgtttatgttctcccacttttccttgcatctcttggcactacggtcgtatcctagacgagacatgtttgaggcgatctcttcccagagggggcccttggcgccggcttcttgaaacctgcgttccatgttcgtacgcaggcggattaagctcataatttcaggtttcggccatcgtttgttgttcggatcgtaagtttctttttctctgttaaccaagtcctgctgatcctgagcttcaggattcatggtattctgaggaggcggcagtgtgaatatttccgggagctgtagattttgcccggtgattttctgcagagcggaaataaatgccgcatcgcaggtcgccgcacgggctcgttcgttggaccagagctggtgctcgcgttccaaccgagccgcttcttgacgtctccatgcttcttctctgctaactctttcttgctctctttgttctaatgtatctagaactttctcgagccaggcttcttgcctgtccatgaatttcttcatctgcgcgtcgaagtacatcttcatcttcgatttccagctcttccgtttcctttttcctcggctaattatgtgattctcctgtatatcgtgactgtactcgtcatccgaagaagaatccgaaga

SEQ ID NO: 8287 - DNA, 937 bp, Pinus taeda
  Predicted polypeptide sequence is orthologous to G634
ccaagcctgaagttcatgcactgataaagctgagaaccggactggagcccagataccaagacgccgggcccaaaggcccgctgtgggaagaaatctccgctggaatggcccgcctcggctacagccgcagctccaagaggtgcaaggagaaatgggaaaatatcaacaaatactacaagaaagttaaagaaagcaacaagaaacggccggaagatgcaaagacttgtccttattttcaccagctggaacaattatacaagaaaaagatcttcggtaatgcagccaagcaagaacacccgaaccaggaggacgcccgcatcgagcaattacccggcggaaacaacaacaatagcgacagaaacgagcgccaaagcacagacggcatcctggtcattgtgccgcctccaggatcgtcatcggacgcaaagaacagcaatgcaaaccctaacaataacggtccaccgattccttcgagcagcggagcaatgcaggcaacgttctttacaagcccggagaatggaaccggcgccgatcagcgagctctgaagaagccagaaggccttgtgatggacgtgatggacatggacgacatgcggtccgcgccgcagcatcaacagcaatccgttgtagacgattacgatgatgataaaatggacacagaagaagaagaagaagacagcgacaataacagcgagcaagaacatcataatattattcctattcctactatagccactactcacgacaggcagccgacgacggtggtcgatcatctgccgtttgccgagtttgttcacgagagccgaacgagcactacagccgccgccacagctgccagttccttcatggccatggtccaccgcttcgctacaaccgaagctcccgagttcaaaacctctaaagcataaaccgccgcctaagattataaattatcatc

SEQ ID NO: 8288 - DNA, 880 bp, Pinus taeda
  Predicted polypeptide sequence is orthologous to G653
ctgaaacaagacttgtggtaggataagttttccacagtgaccttctcaagagggtatgctgtttttccacaggtagcacatttgtcttgagttccagagaacatcattgacactttactaggagatcttgtcatttcaggagaaagaccgtcaattcctttgcttgatctttgggactgaaagttcttgttgaagttgccgctctctctgaaaagctggtcaaagtgaggcttgcaatatagcactccctccattgacgagtaattactcagcttaagcgttcccttacaatggttgcatctgaagcaagccttgtggtaagaaactccatccgcggacagttgatccacaaaataaaccgttttgtcacaagctttgcacttctgctgcgttccggtgaaggccatagccacgatccgagaaattttattgcaaaataatggtccttaagccctcggtttctaaatggccgtggaaatctttctcgccccagtgtttgccttagaatacaagatctggcagctcctatggggattcagacaggctcttgccttttctacagcgaatagtcaatctaatacttctaaaactccattccaacccgttctgctgccggtgccagctaaagggcagaaggttgctttatatcgcaattccctcggtctatgagcctcaaaactgtaaatgctggaattttaatacttttcttcgttgaaaaaaaaaattaaaaccatacaactagcaagtcgtcctcggaaattaacgaaatttgaccgaaaacgatcaatttttgggcacctgaactgagtgctctggacgcggagaaaacacaagaacggactcgaacccgtgatctcccgataaaaggggccacaaaagt

SEQ ID NO: 8289 - DNA, 800 bp, Pinus taeda
  Predicted polypeptide sequence is orthologous to G707
gaattggaggcgcttttcaaggagtgcccacatcctgacgagaagcaaaggttagacatcagcaaacgcctgaaccttgaaactcgacaagtgaaattctggttccagaaccgtcgtacccagatgaaaactcaacttgagagacatgagaattctatcctaaggcaggaaaacgaaaagcttcggtcagagaacttgtcaatcagagatgccatgagaaatcccatctgcacaaactgtggaggacctgctgttctgggcgagatgtcctttgaagagcagcaacttcgcattgagaatgcccgcttaaaagaagagctggatcgattgtgtgcactagcagggaagttctttggcagacccattccttcaatgccatctgttccccttatgcctaaatcatccctagaccttggagtcggtggcatgcccacttcgttgccctcggctagtgcagacttgatgcatggacctgctggtggtcgaacaggaaacataataggtattgagaggtcgatgctggctgagcttgctttggcatccatggaagagttgttcaagatggctcaagcagatgaaaccctttggattccgaacctggatgctggtaaagaaactcttaactatgaagaatacatgcgccaattcccttccacaattacgccaaagcctataggccttgccactgaggcgactagagaaactggcatggtgatcacaaacagcttgaatcttgttgaaacactcgtggatgtggatcactggaaggaaatgttcccctgcatgatatccagggcagc

SEQ ID NO: 8290 - DNA, 823 bp, Pinus taeda
  Predicted polypeptide sequence is orthologous to G707
cggccgggattctatcctaaggcaggaaaacgaaaagcttcggtcagagaacttgtcaatcagagatgccatgagaaatcccatctgcacaaactgtggaggacctgctgttctgggcgagatgtcctttgaagagcagcaacttcgcattgagaatgcccgcttaaaagaagagctggatcgattgtgtgcactagcagggaagttctttggcagacccattccttcaatgccatctgttccccttatgcctaaatcatccctagccatctatgtaaaaatccatttattacacccaaagttctatctttctatcgcttcaccaagagacagtccatacgtatacgctggtctggatttaatacaaatgcacataatattactggacgttcaagggctccaagatgcaatgtttcaattggcaaagttgagagcgtagcagatgggtcaatgggtttgcaaaccaggcctcccccagcagaaacttgtaggacactgatggagctgtccttagaaggcactctttgtacattaactcaagatgggtggcctttcggcgatgctgtcgagtttgcagttgatgctcaagggatgcctgtgctctgcttggatcctctgtcaatgcattctcagcatgtatcgcttcataaactctgtagtttgcatgtgaagttggagctgcctggatgtagaaagtcacaatgcactctgatgggcactctttcgaagccagaagacaggatactcaagcagaagctgcaatcaatatgggctaggagatttggtgaagtaaatgaagatcatttatatgtaatagctgtgg

SEQ ID NO: 8291 - DNA, 837 bp, Pinus taeda
  Predicted polypeptide sequence is orthologous to G707
cggccgggtcagcgaatgacgactgacttctgtactagtctgagtccatcaatggttaacaactgggcaacgttatctggtgatgttgatgaggatattcgagtgtccacacggaagaacatggagaaccctgagttgcctggccgtgttgtgctctgtgctgccacttcagtctggcttcccgttactcctcagaaatcgttcgatttcctgcgagatctgaatcgtcgaagccagtgggatatgctctctaccggcgaaacaaagcaagaaatgacccgcattgtgagggggcaagatcgtcggaacagtattagcctcctcgcatcaaatggtatcaatatggatcagactgcattcattttacaggagtgctgtacagatgcttgggggtctattattgtttatgctccttttgacattgcctccatgcatacagtgatgcagggaggtgaatctgattatgtttctgttttgccatctggctttgtgattctcccagatggccttggtggtacactgactgaaactgaaagtagctcaagtagtatgcagaaaaggggatctattctgacagttgcattccaaatattgttagccaatatgacaacaccccggcctgccatggaagatgtgcaagcggtgcaacgattgatctcctacacagtacaaaaaatcagaacagcgttgattttggacgatgcttgacagaatctattctattcttactagttctcaattttgaagtgatccgtatttcattttttccttatttatctgttccaatctagactacctgcaaaggatcagccactacctgcaaacgatatcaaagat

SEQ ID NO: 8292 - DNA, 870 bp, Pinus taeda
  Predicted polypeptide sequence is orthologous to G748
tcaattacaacgggtggcatttttaaagcattccagcccaagacagaagagaaggattcagtgaaagcttctacacaggggttgcgctcaaatcctgcagcattttcaagatctatggcttttcaagaaagcacttagaacttttctcttttcaccttcatttctttcagggaaggctttaagccattttacgaaagctctcataacacccaagaagatgttattgggaaatttcagtgtacattgtaaagtatttggtttcttactttggttagcagtccatattttctggttggcaagtctagtcagattttggagttgtatcaaagagtgtaaaagtttgtgtcatttgccttcttatccaagcattttttacaaatttgcttgtgctgtgaagaagtggcattgatggtcacgagctgtaaattgctagaaaacatgataaatgagggtataataaagcggcaagagcttggatgactcaagaagcaagaaactatctgacagtcaaaagtggttattggcgttatcacaagagaaagagagtttcctgacatatttggagggatgttcatcgagagcagttttatatcctagccctttttcttcttcgcattcttgaattagtcaggagcatctttatttggtggagcaagacagagccacggttgaatattagaacattgtataatctttcattgtcagagatgagagtgtagatgctagtgtcttcaggtaggctttacgttacgttgacattacagccaaagaatcagtctggctagtttatgtgatcacgaaccatgaagctgatctgtttcttttgtctcatgaaaatggcatcatgcctttgtgggtggatatggaaaa

SEQ ID NO: 8293 - DNA, 866 bp, Pinus taeda
  Predicted polypeptide sequence is orthologous to G748
tatgggtggaattttccaaacccagcatggaatggcgctgctgctgctcttacccctggttggcccggtttgtcttggcccatggttcctggatcctactttcctccgcctcctcctcctcctgccggatgggggcctgcaccatgggtttctggaccctgggccgccgccgctgccaccactgcttctaatagtcccgctgttgcggattctgggtctccaactctgggtaagaggccacagtctgaagatgggtgtttgtgggttcccaagacactgaggattgatgatccaggggaggccgcaaagagctcaatttggacaacattaggcctaggggacaagccggagtctgccatcactagtggggggatttttaaggccttccaacccaagacacagggcgctaaagattcaagaaaggcttcgcaagctctgcaagcaaatcctgctgccttttcaagatcgttatccttccatgagagcagctaatttcattcaaacagcccaatccagcaaaatgatgagtttgtgcagaaatactggttttgattataagagcagggttcagacatatatccatgttcttaccgtggcttgggaggtccatactcggacttataattgagagagccctaatagattgcctctccctccctttcatgctccggggaaggtgttagcagaacaaaatcatagagagagcctatatgaagagagattgcctgttaatgctgttcaatctaccctttacagtattttcttcctgattgctcacaagagctgattgggagatatacaatctgtatatgattacaatttttgcttccttttgggagtctatgcttaacttttctattttggaa

SEQ ID NO: 8294 - DNA, 786 bp, Pinus taeda
  Predicted polypeptide sequence is orthologous to G748
gagaggattcaggatttccgggcttttgaaaagaaagttagatttattgatggaagtggggagattgagtttcggaattccgtgtagaacggggtgagttgcgaggagatttgcagtttggggattgggttttttcgagaggggcgatttgattttcccatttacgatgtcgaaggattgcgtggtggtttgtttgagtggcaacgacagaattcatggtcatgcggacgagaagggattcgatcccgggttcaagctcttcgggaagactatcccggtgcgcgcagcggaggaaataaagcaggaggaacctgtttctgggcagcagcctggatctcacaaggaacagagcctggaaggcgaggaggaagttcagcaggagactggtagcagcagcgaggatgggaaggacgagagtatgaacgagggaaaaagcggggggcagaagacggtgttgaagaaaccagacaagcttctgccgtgcccaagatgccagagcatggataccaaattttgttattacaataactataacgtgaatcagccgcgtcatttctgcaagaattgccagagatattggacggccggggggacgctcaggaacgtgccggtgggtgccgggcgccggaagaacaagcattccgtagcggcgtccacggtatcctcgcattaccgtcaggtaatctcggcggcttccgagtgtggccttggggttcgaaccgatgaccaggactctggcgtcgaccaggttatgatcccctgtgccgcgctgcctgcatcctgtgt

SEQ ID NO: 8295 - DNA, 676 bp, Pinus taeda
  Predicted polypeptide sequence is orthologous to G748
atggtggctgtaaatgctgaaataatgcccaaattcgaagggaagtctgcgaaatccctggattcaacattcaagctgttcggcagaacgattgttgtgaaaaatccctgtgatagcagcagcaatggtattcatgtcgatgggattccagctgaagcagtgaattcagcagtccccaaggcttctgaaacgcatcatcatgatgagaaacagaagcagaatgaggattcagagaaggtgggtaaaaagcccacaaagcttgtgccctgccctcgctgcgagagcatggataccaaattttgctatttcaataactataatgtcaaccagcctcggcattattgcaggagatgccagagatactggactactggtgggtctctgaggaatgtgccggttggggctggtagaaggaaaaacaagccctgcttcggaattaatcacaggcagatcatggatgacactgaaactggttggaatgatgtgcagggccaggcttctcgtgggaattctgataaattggtcaaggttgagccattttatcctgaattcgagaagtttagagagggcttgaatgaagcggcaacgccgaaagaaggtaactctaaaccccaatccataatccaatcccaatttgacgattattcacatcctagtacagtgaatttggctagag

SEQ ID NO: 8296 - DNA, 835 bp, Pinus taeda
  Predicted polypeptide sequence is orthologous to G748
cggccggggaattttacccatatggctaaagagctagaaagtgttcagaaacccagctgttcaagtgagaaaacccagacaagtgccaccaaggcagattcggctgagcccgtggatgacctgacctctgattcaaatctcaaatcagaacccaaaaatatgagtccagacgggtcttcttcgtcttcttcttctatgaattatacagggagtccttggcctgtgtattacaatggatgctggggaagctttcctccaggtgtcgagggctctgagaaaaatagggtgccctggtacacaccaagtacaggatttttgccaacaggtttgaactggcctgtgccttctggagtaatgtggggcttgccttggatggcagggaatgataattctgaatcaaaaacattaggcaagcaccagagggaggaaacaccacaggcagtacctgaaaacaagaatagatctctttgggcgcctaaaactttgaggatggatgaccctgaagaggctgcaagaagttcgtttttgacaaacttggggttggaaaataagaaggaaggatccatcaagtctggggaaattctcaaaggatttcaattgaagatggacaacaaagatgacaaaaggacgacttctgtgcaggttttgtgtgcaaatcctgcagcactctcaatatcgtcttcttttcttgaaagcagttgatgtatgcttaaactgctttccaatatgatttggatatgttgttcgtagatgggaaaacgttgttcacgcatttaagatcatacgatactttgttcctgagagtgactagttagatcactgcatctacagcttt

SEQ ID NO: 8297 - DNA, 418 bp, Pinus taeda
  Predicted polypeptide sequence is orthologous to G811
cggccattatggccggggtgaaggtttggaagcatgaacctatgaagtcccgtgtaactgttgacttcagttaaagtcttttggacaaacatgcacacgttcattcttctttggccttaacaatgtgattcataataataatttgtgggatagttatttgtgtattgtattgtggtgtaggatctctcagagctaataatgtctgggagaattttattaatctactgtgttttatacactatctaaagcaagtaggttcctgttgtacgtgatcaagatgaaaagttgttatggcgagccttcacgggtacgatacgatggtttggctgggctaatttgccagtgtgaaagagttctgtgacatatcatattgtgatagtcatgcatttatatatttttacacgggttgattcatttc

SEQ ID NO: 8298 - DNA, 832 bp, Pinus taeda
  Predicted polypeptide sequence is orthologous to G865
cggccgggggcatcttctgcagtctcaaatgtgcccaaccatactcgagctgccttcttaggatcacgaatctctgcggcccattttccccacggtctttgccttacccctctacaacgtttcttttttggtggattctgtggctgtgggagttcatcatctctcttccagctaattccctcttgtgaaggagaacgttcctggtgctgatgttggtgtggcatggttatgcttggtacttctacataacatcaacaatgcggtgagacccattaacatatatttattctagaatctatctctacatatcaaagagctcaataatcatcctagaaagtcgtagattttgcaaattcccatttctatttccccattatttagcaaaattgtactttagagaattcagcgcatgcttgaagaattcgcaggctatagattttggatccttttcgaacacagggatgtcttggagaaataatctcagtgaacgatatcaatgaacttagtgttatcaagattgtggatgaaagaacttgtgtttgtcatgagtgctctatagataagtacaatctcctgaaaaagggttccatcatccatgaggaggttgtagaagagagaaaacctgacaaggaatccaccataaaaaaagtaacagatttacgaatcggtagaaggtcaagtacattgaaaatcgggaatcctgttatacccatctatcatcttcacttttttttcctaacgttattgtcattctttctgtctaaagcatatgcccttattgaaaccggaaccgaatattgatttatttaaatctgttgtattattgcccctc

SEQ ID NO: 8299 - DNA, 449 bp, Pinus taeda
  Predicted polypeptide sequence is orthologous to G896
ttttttaatataatatttttttgtatttcacttcaatgaaaacatagatggtgtagctggacgttaatcaccatatacgattaaattctgtacatcatatacaattaacttctgtacagcattcagagctctccacatccaaatctgaatccacatccacatcatgaacactaatagcttcccacttcctggtctcacaaaacatcaataggtgatgaaacccaactatgtacttgcccagtcatcctttgaatgcagtgccaggatgcagatcaatatggatagggaataaaattgaagaaatctgcaaactcacccatcgtgtctatcgggacaaattcaggggatggcaaagaactgtgagggattgcatacatcttctggtcaataaaatcttgacagacatttacagtatcaaaggtacaagaatatggatggccattttcctc

SEQ ID NO: 8300 - DNA, 521 bp, Pinus taeda
  misc_feature (102)..(102): n is a, c, g, or t
  Predicted polypeptide sequence is orthologous to G896
gcggaaaggaacaatgggaggtgaagccatatcttttagcggatgtgatgatgaccagacctctgcagataccaaggcgctttcaaagattacctcaacagngagccatgacttacagttttataagggcaattgagaaaggagaagggaaaacttatgggagtttgttaagctctatgagtgatactgttcgtgaagcacgccgtaagcaaggcgacagttataaagcaggcaaagtccaggccagaatgccttcgactcttacaagtatgcttctcgaaggtggcagttataaaccaggcaaatttcaggagccacaattgtcgtcttcttatccatttgatgtcaatgagacaccattttatttgtgatggaagattccttatctgtatctctatatgtataagggattgaagatgttcataactttgtattcttgcagagttgtaagagttaagtttgtattttcaagaaattgtaagtgagagataaaacatattaataaataatattataatttt

SEQ ID NO: 8301 - DNA, 777 bp, Pinus taeda
  Predicted polypeptide sequence is orthologous to G896
ctggtgggttgtcccaattgcagagttgaggtgtggcttcatccccaagttgctggttttcgctgtcattactgcggtgtttatgtcgggattcgccaaccagaaccctactaccggccgaatcccgtcgggagacgaccgatgatgccaggtcttcgaaattttgataaacccaacaaatattttaacaaacccgtacaggagcccattattattaatcccccactggttcgagtctccggtaataaaagagccgttctctgcgggatttgttacaagaatacgccatacgagctgaaaggctgcatcaacgatgtgaactgtatgaaatatctgctcacaaccagattcaacttcccggaagactctatagttaccctcacagaggaagagaaggattccaaaagaatccctacaaaacgaaacatccagaggtggatgcgttggctggtgcagaattgccaacctggggattctttagtgtttcattattctgggcatggctctcaacaaaaagattacactggccacgaagttgatggctacgacgaaacgctgttgcctcttgactttcagacagaggggatgattgtggacaatgagatcaacgatacgctggtaaaaccccttccttctggagctcgactgcatgcaatcatcgatgcttgccatagtggcactgttctagatttgccctacgtctgcctcatcaaccccagtggaggaaaatgtacgtgggaggaccatacacctcaaaatggtatgcggaaaggaaca

SEQ ID NO: 8302 - DNA, 957 bp, Pinus taeda
  Predicted polypeptide sequence is orthologous to G896
catatcgcagcatcccgcggcagtgctccgcctcaaggttaccagcaacaccactaccagccatcggctcctcccgcctccgcggccagtccccaacgctattcgcctgcgccgcccccttcccacggcaggaagaaggcggtcatctgcggcatttcttacaaatactcccggcacgaattgaagggctgtctgaacgatgccaactgtatgaagtacttgttaatcaataaattcaaattcccagaagccagtattctcatgctcaatgaagagcaaagagatcctcttagaataccaacaaagcacaatatgcgaatggctttattttggcttgtgcaaggttgtcagcctggagattcattagtgttccattattctggacatggttcacaacaaaggaaccttactggagatgaagttgatggatatgatgaaactcttcttcctcttgactttgaaacacagggaatgattgtagatgatgaaatcaatgcaacaattgtcaggcctcttcctcgtggtgttagacttcatgcaataattgatgcctgccatagtggcacagtattagatttgccgtttttatgccgactaaacaggagtggacagtatgtttgggaggatcaccgtccacgatcaggtacatggaaaggaacaaatggtggggaagccatctcctttagtggatgtgacgataaccaaacttctgcagatacttcggctctctcaaggatcacatcaaccggagccatgacatattgttttattcaagcaattgagaagggatttggaacaacttatggaagtctattgaattctatgcgtaatactatccgtgaaacacgggcaggcactggtggtggtcctgtcacttctctcatcactatgcttttaactggaggcagttacagtggtgggcttacccaggagcctcagctgacatctacagaacct

SEQ ID NO: 8303 - DNA, 873 bp, Pinus taeda
  Predicted polypeptide sequence is orthologous to G896
attgccgaaacgggatatggcttcctccagggtttgatggttttcgctgtgactactgcggtgttcatgtcggggttcgtctaccagaaccatattactggccgaatcccactgggagacgaccgataatgccaggtgctcgaaattttaataaacccagatatttcaataaacccgtacaggagccgactattgttagtcctccactggttcgaatctctggtaacaaaagagccgttctctgcgggatttcttaccgaaatacgccatacgagctgaagggctgcatcaacgatgtgaattgtatgaaatatctgctcacaaccagattcaaattcccggaagactctatagttactctcacagaggacgaggaagactccaaaagaatcccaacaaggcaaaacatgctgaggtggatgcgttggttggttgaggattgccgagccggggactctctggtatttcattattctggccatggctgtcaggaagaagattataaaggcgaagaagtagacgggtacaacgaaacgcttttgcccctcgactttgaggaggcagggatgattgtggacgatgaaatcaatgagacactagtaagacccattccacctggagctcgactgcatgcaatcatcgacgcctgccacagtggcactgttctagatctgccctatgtctgtgttttcaaacccagtcggggcatatgtgagtgggaggaccacacacctcgaagcggtgcacccaaaggaacaagtggaggtgaagccatatcttttagtggttgtggtgatgaccaaacctctgcagacagtaaggctctttcaaagattacatcaaccggggccatgacatttagttttattaaag

SEQ ID NO: 8304 - DNA, 601 bp, Pinus taeda
  Predicted polypeptide sequence is orthologous to G896
acgacacgcatcaatacacaacctatttatatacatatacacatgctaccccatacccccacacactacacgcacagcaacacgctgctactgcgcgggctccgaggacgcagcgaatccacgctacacgccctcttctcacgccacggcacgatcaaactactgcgcgtgattgcacggtgcaatgtggccctggtggtgtatggctgcgagggggaggcacggactgcgagggaggcgtgcacggaggaggatctcgtgtacaccaagccagtggatgacgacacattgcagcaccacatcttgtcagtgccgcagttggaacgtaatttcttgttgtcaccaccgccctcacctccggaagactggcagcccactgaagaggacatcaatcatgtaccacatctcgatctgcagccgcagcgcttggacggcaagacagtgctattagagggcagtgcgactacaccgagcattataggagattggtgatatactacagcgctctagtctcacttcttctcatgtacataacaccggatcggatctgttcaatttcgattgttagttgtaaataaagcgaatattacactaaagaagt

SEQ ID NO: 8305 - DNA, 703 bp, Pinus taeda
  Predicted polypeptide sequence is orthologous to G921
ggcttgaagcgattctttctccgcaaatcttcaatctctgagacttccgaatacccagatgtgatggaaggtcgcaacaacaagaaagcgatacttgtggctgagataagtcgcatcaatgacgagaataagaacctcaactctttgttgaagcaaatgagtacgagctataacgacttgcagaagcatatcacgtctctgctctgcagaaaacaacagcgatcctgtgttgatcgaagccagatattcaatccagatgatgtaagagaagaaaaatccaatttgagaatattttctcccggacctgatgatgtccactccggcagtccagtttcccaccattcttatacttcttcagattgtcctgaacgaatttgtgaaaaggagggtaagaaggccaaattaatggaagatcagcagctgccatcaaagaaacgaaagataaattacatccagtttgaccagattcagaatgggatgattaattcgtctatggttgatggcctacctgaactttccctaaaatcttacaattcttcgattttttctcaacaagtgaaaaaggaggggaagaacgccagagttatggacgatcagcagcttccttcaaagaaaaggaagataaattacttccagttgggccagactcagactgggacgactgtaaaatcgtgtctggatgatacccagatctgtgaagagc

SEQ ID NO: 8306 - DNA, 668 bp, Helianthus annuus
  misc_feature (649)..(649): n is a, c, g, or t
  Predicted polypeptide sequence is orthologous to G1033
acataaaagtaaagacactatgtaaacctaagctaccgcacgatgaactgaatgaggaaatgcaaagcatcaagcataacaaagtataaactatgaacatcaagttcaagtctctcgcaaacatttggcgtagatctcaatcatcatcctcgtcatcatcatcctcatcgtcttcttcatcatcgcccccttcctggccgctttcctcatctacctcagacttggatttttcagattcttcatcctcgtcagcagcgctctcctgttccttgttgtaagcagtcattaatttctcataatcggtcttcctttttgcagctttcgcttcatatggtgctttctcagctgcactcaaagatttccacttctctccaccagctttcccaacagcggaaacagctttcacatttggattctctttcttgaatgtcttcctaaactcctcaaggaagacgaagaaagcacttggaggtctctttggcttgttaggatcttttgctgctttacccgccttagccttgcttttgccgacggccttagcaggtgcctttctcttccctacctttttgtcatcaacaggcttcaagctgtccttctttgcagctcctttacccttggcacccttcatatctgaaactagaggattggnaggaagtgtgatccggtga

SEQ ID NO: 8307 - DNA, 294 bp, Helianthus annuus
  Predicted polypeptide sequence is orthologous to G1150
gttgaaggggtcgtggatgatggaggtggtagaggcaggagccaaggagtaggaggttatcctggtggcaacagaggtggaggccgtggtggtcgtggatgatgtgacgggtgcaaaggacgtctctcgttttcatatccctattttttttttttttcagtagggtttgtattcaatgactggtttggttatggggattaaaaatgttgttcctgaaagtgttgtggaggatgaagtccttggtatattgtaaaattcaagttcaactgtttaagagattaaaatttaagcgtg

SEQ ID NO: 8308 - DNA, 585 bp, Helianthus annuus
  misc_feature (68)..(68): n is a, c, g, or t
  Predicted polypeptide sequence is orthologous to G1247
ttttttttttttactttttcaccttcccttaaacgaatatttaaagttcgttttttatttttaaaggnttcacttttcacaatgaccgtagttttttcgcgatttaccaatatgtcgtcatcacgtaaatattcaacaccacaccgcatcaatgcatggtagctcccgctagttttaatcaatcaacccgtgaagacatgataaaagaaaaaagaaacccaatgtactttctgagttctcacatattaacccctgaacttttttacataggtaaatccttaaattttgttgagagttaccaaaaatatgtgtatttgttaaaatttttggtaagtgggcaaatcaaagaaaacctaaccaactttcctatttttaacaggtaaaaaccttaatgccttttaacttgattaactcccttaacttgttgaaaacatacatataaccattttaccactattaaaagttgaacattgacctggataccatgtatttgttattttatgacatgatatatgggtaaatttggtattttaaagtttaattccattcttttccttatggggaaaaactcaaaaaataaaaaaa

SEQ ID NO: 8309 - DNA, 598 bp, Helianthus annuus
  misc_feature (553)..(553): n is a, c, g, or t
  Predicted polypeptide sequence is orthologous to G1335
agtggtggtggtgataagactaggtggtggacggcgactagagtggtggtggtgaggagattcagatagtggccgacggctggagtggtggtggccggcggcagatgcggtggtggtgagggggagattaggttacggcggcggaggcggcggtggaggtggtgcgtgttttaagtgtggtgagactggtcatatggctagggagtgttctcagggcggtggaggcggtggtggttacggcggaggtggtggtggttacggaggtggtggtcgtggtggtagtcgtggcggcggcggcggttgctataactgtggtgaagaagggcatttctctcgtgaatgccctaatggcagcaaccgttgatctggaggagggtgaagggtaaatatgtctttcgacatttacttactatcctgtttttactttttttttgttgttctatgttgggtgatctgaatgcttgttatggttttgagattgttagttggtttgtgatggtttatgattgacatttgctagatctagggtttggatttggagtatatgttctanattgctatcagcaatggaaaaaagtttagtttttggattctgtgt

SEQ ID NO: 8310 - DNA, 366 bp, Helianthus annuus
  Predicted polypeptide sequence is orthologous to G1335
aattcggccttatggcctctgtgcgggggtggtggtggtaggtacggcggcggcggcggcggccgtggaggtggttacggtgggagtcgtggtggcggcggcggcggttgctataactgtggtgaagaagggcatttctctagagagtgccctaacagtagcaaccgttagatctggtttaagttgatggtggatgattaagggtaaatgtgtcttttcacatttgcttttagctttttttattttggtttctttgttgatgaaagaagactatggttggttttattatgaggtttttgttgttgggtttttgatgctttagttatgaattatgaatgatatgatgttaatttacgttttatggag

SEQ ID NO: 8311 - DNA, 872 bp, Helianthus annuus
  Predicted polypeptide sequence is orthologous to G137, G145
gatatgggaaaaggaaggttagagttgaagagaattgagaacaagataaacaggcaggttacctttgccaagagaagaaatggtcttctcaagaaagcttatgaactttctgtcctttgtgatgctgaagttgctctcatcatcttctccactcgtggcaaactctatgagttctctagcacctctagcatgctgaaaacacttgagaggtatgagaagtgtagttttgggccaccagaacaaagaaagccagccaaggaggatcttcaggaacaaagcagttaccaggaatacatgaggcttaaagaacgctacgatgctttgaaacaactcgaaaggaattactatggtgaggagattgactcgttgactaccaacgagctcgagtcgcttgaaaggcagcttcattgttcattgaaacagattaggacaataaggactcagtcgctgatcgataagctttacgaacaacaaaagatggaacaccaactttacgagtacaacaagacgcttcgactcagattagatgaagaaagccaagcagaggcactccaatgggatgtacacgctcacgcacacgcgaatggaatggtttatgggcatcatcatcagcaccaagtgtctcatcctgcacatggtgcgttttatcatccgactggctgcgaaaccacattgcaaatcgggtaccagactgaacaaatctcgggagcgacctcgtcgagcatgagccatcatcatcatcaaatgcagggttggcctgcatgaaacaagattctatgtttgcttgttaaatcaccagacttaattaatattgtgttgttgtgggacatttggtcttagctaatttttygttaatgtgtttatgttaaaaa

SEQ ID NO: 8312 - DNA, 1200 bp, Helianthus annuus
  Predicted polypeptide sequence is orthologous to G140, G146
gttttttttttttttttttgctataagtcttgaacaatatatatagcaaaaaaatgattgaatatttggtattaagatataatgattaaggttaagagggtttattaatttaaaggacaaaaaagtcgttgtctactttataaatactcatcaaccatcccacctccccattccattttctgcaatctttcctgttcagatttgtgggaaaccctcaaaaagcagagagagatcaaaaaggtgtatccatgtcttttcccaatgagtcaggtgagatgtctccacagagaaaattgggtaggggaaagatcgaaatcaaacggatcgaaaacacgacaaatcgacaagtgacattttgcaaacgccgcaacggtttgctgaagaaggcttatgagttgtctgtactttgtgatgctgaggttgcgcttatcgtcttctcgagccgcggtcgcctctatgagtatgccaacaatagtgtgaaaggaaccatagataggtacaaaaaggcatgcctggatccaccaagcagtggctctgttgcagaagcaaatgctcagttttaccaacaagaagctgcaaaactccgtcagcaaatcgccaaccttcagaaccaaaacaggcaattttataggaacatcatgggtgaatcactaggaaacatgccagcaaaagatctcaagaatcttgaaggcaagttagagaaaggcattagcaggatcagatcaaaaaagaatgaacttctgtttgctgaaatcgagtatatgccaaagcgagaaaatgagttgcataacaataatcagttcctccgagcaaagattgctgaaaatgaaagatcccagcagcaacacatgagcttgatgcctggaagttctgattatgatcttgtaccacctcatcaaccatttgatggtcgaaactaccttcaagtcaacgatcttcaaccgaataacagttactcttgccaagatcaaacccctctccagttggtgtaattcatgatgggcataaaggatttggggtttctacttgctataacatcttcatggtgattaatatggttttatggtttgttacaaccttattctaagtatctagtttgacttttgtgttcttgttttatttgccatgggtgccacaatgtgtattttatgaaacaacttgtttttccacgggttatcttctttgtattaaaaaaaaaaa

SEQ ID NO: 8313 - DNA, 1098 bp, Helianthus annuus
  Predicted polypeptide sequence is orthologous to G140, G146
ccaatctgaaaatcaagtttagtttcttcccaaatttcttgaggtgaagtacatgtaatttacttcaggattcatggaaaattctgaggctattgagcatgagcatgatttcagctgcatcgatcgatccatgtcgtttcaaaacgaggactcgggggacatatctccacagagaaggattgggaagggaaagatcgagatcaagcggatcgagaacactacgaaccgacaagtgactttctgcaagcgtcgtaatgggttgctcaagaaggcctatgagttgtctgttctttgtgacgccgaggttgctcttatcgtcttttcgagccgtggccgtctttatgagtatgctaacaacagtgttagagggacaatcgataggtacaaaaaatcatgcttagatccacctagcacgggttccgttgctgaagccaatgctcagttttaccaacaagaagctaccaaactgcgtcagcaaattgcaaaccttcagaatcaaaacaggcaattttacaggaacatcatgggtgaatctttggcagatatgccggggaaggagcttaagaaccttgaaagtaagttagagaaagcaattaacagaattcgtgcgaaaaagaatgaactattatttgctgaaattgagtacatgcagaaaagggaacttgagctgcataacagcaatcaattccttagagcaaggatatctgaaaatgaaagagctcagcagcagcacatgagcttgatgcctggaagttctggttataatgaccttggaccacaccagtccttcgatggtctaaacgatcttcaaacgaatgagttgcaactcaataacaactactcttgccaggaccaaacccctctccagttggtgtgataacgacatggggttctccattactcgttcggccggagctataataacttgattatgattaattgacaaagactagacttatattcttatattaacttgcttgatttagtacggatttagttcatggctatctaagccagagagctctaaatatatatgtgtacttttatgattatgtatgtgttttaatattatgaagcagcttatatgttaaaaaaaaa

SEQ ID NO: 8314 - DNA, 611 bp, Helianthus annuus
  Predicted polypeptide sequence is orthologous to G1451
ttgcggttgacccgcttctcctgagtggttcgtcacaatctcttcttcaccaagtcgaacaactgggccctacgccgcacacaaacctttctcagaacactaatctttcacaaaacacggtttcgttaccacctttcccaggaccgaacaatgatcctcaaagtaatcttttatttggagttaacatagataactcgaatctttttatgcaaggtggtgacggtggttcattgactatgccgatgacttcttccacttataacggtaatacaggaaacgggttctcagtcaatccgacaattacatcttcaagttgtcttactgagtcaggtttcctgcagtctcctgaaagtgcaggtcaaacaaacccaccgacccgcgcgcttgttaaggtttataagtcaggatgttctgggttgtcactcgatataggtaaactcagtagctatcatgagctgagaagtgaagttggtcaaatgtttggtcttgaaggccaactggaggacccgttgagatcaggctggcagcttatatatgtagaccgggagaacgttcttcgtctccttggtgacgacccttggccggagtttgtaagcaggatatggtgcatt

SEQ ID NO: 8315 - DNA, 566 bp, Helianthus annuus
  Predicted polypeptide sequence is orthologous to G15
ggaattcggccattatggccgcttgaccggaacaaggatctttacttggggacattcagcacccaagaagaagccgctgaggcttatgatgtagcggccataaaatttcgtggagttaacgcggttacaaatttcgacatatcgcgttacaatgtcaaaaagatcattgcaagtagtacccttttagctggtgagctagctaggcgaaccaaagacgtagacactacaacggagctcttgtcagaccaaccaccggctcaaaatggcgagcccaagaccatatcaaccgagcacactaccaacaggaacatgttggactggaaaatgacactctatgatcaaaaccagactggaccagggctcgatgtggacgagacaactaaacttggagcacatttatcaaacgcttcttcattggtgactagtttgagcagctcgcgagaagatagccccgagagaaattcttctcgcgatgcatggttcccgacagcagcagcagcagcacaaatgagagctcatatcccagtctttgctgcatgggcagatgcatgatcatgaaactgaaa

SEQ ID NO: 8316 - DNA, 538 bp, Helianthus annuus
  Predicted polypeptide sequence is orthologous to G1789
gatatttcctcatcttaattacctggggtgttcaacttctctgcattgaagaaatggcttcaagttctaactggacgtgggagcaaaacaagctgttcgagaactcgttagttacgtacaatgacgaccctgatcgattccaaaagatcgctaaaatcgtaggtaagagtgtggaggaggtgaaggttcactaccaaaaccttgtccatgatgtgaatgctattgaggctggcaaaattccgctgccaaactacaaaaccgatgaagccaaaggacaacaaaacaaaaagaaatgaatttggaatatggttattcaagataaatttaagtagtgggtaaaagaatagtaatttaataaagtccccaccccctgtgtgttttctcttgtattttctatggaaatatgtatgtttagtgttcttaatccaattaagaactgcaagatatatagttatctaatggtaatatcatatgttgttgggccaaaaaataaaaatgattgtataaattaaacatgtcggccgccttggcccaatcg

SEQ ID NO: 8317 - DNA, 1437 bp, Helianthus annuus
  Predicted polypeptide sequence is orthologous to G1804
atactcttaacgagagcggaaagaatttcgggtcgatgaatatggacgagtttctgaacagcatttggaccgctgaggaaaaccaggcccacactcaagcccaccctcccacggccgccaccattggtggtggtatctccacttccgccgcgatggccactaacggtgctagtagtagtgggcagtttttgatgggaatcaacgcgaattcggctgaaccgaatatgattgctaggcaagtaagtttatctagacaagggtcgttgactctcccgggcccgttatctaggaaaacagtcgatgaggtttggtccgaaattcaaaaaactcgacaagatcaccaacagccaagcaatgacaataactcgtgtaatgaacaagttcccggtgcccaacgccaaccgacttatggagaaatgaccctcgaggatttcttagtgaaggcaggggttgttcgggaacaaaatcatccgaatgctcctcctgttccacagcaagttccggcttcttttgggctgtaccccacaaatggaaacaatcggattatcggacctccaccgagctcggcccacatggtaaggcccatgttaggccttagtacaggtggcggtgcaagtgttatcccaccatattcacccctaatcagggagacaccgggttatcccggaggaaaacgagcaggcaattatcaacaacagccgcctccatacggtggcattgggggtaatgcaggtggtgttgctggtggttatggacaggggctcgggattggatcaccaccgagtccagtatcttctgatggaattgctaccactcagctcgatagtgggaatcagtatgcgctggaaatgggaggcataagaggcggacgaaaacggataattgacggtccagttgagaaagttgtggagaggcgccaacgaaggatgataaaaaaccgcgagtctgctgcaagatctcgggctagaaaacaggcttacaccgtggaactggaggccgaattgaacatgctaaaagaggagaatgctcaactcaagcaagctctggcagaaattgagagaaaaagaaaacaacagttttcggaagaaataaggatgaaaggtgtgacaaagtgtcaaaaagtgagagacaagtcaaggatgttaaggaggacttcaagttgtccaacctgattgccagtcaaatagacatccagtaacggttttttgtatttcgtgcaaacttgaataacagatgacatattatattatatataggtggtttggttctttgttgtatgagaaaactgagggatgcaagcacgctggctagtcgggatcaccgggaaagtgatcgacgatgcgtcgatctggtcggtcgaattgtcccgtaaaagccttggcggctgcttgtcttcgtatctcgtgtgaattatagtcattatagatttgatcttgc

SEQ ID NO: 8318 - DNA, 861 bp, Helianthus annuus
  misc_feature (746)..(746): n is a, c, g, or t
  misc_feature (748)..(748): n is a, c, g, or t
  misc_feature (805)..(805): n is a, c, g, or t
  Predicted polypeptide sequence is orthologous to G1821
ggttctagagagagacaattccctcccttagagagagaaacatatggaacgtggaggaggtttccatggctaccacaggctccccatccaccctacatctgggatgcaacagccggatatgaagcagaagcaaccagacacaaccaacaccacatctacagaagacaatgagtgcattgttagagagcaagaccgctttatgccgatagcaaacgtgatcaggatcatgcgaaagatcttgccacctcacgcgaagatctctgacgacgcaaaagaaacgatccaagaatgtgtttccgagtacattagttttgtgacaggtgaagcgaatgaccgttgccaacgcgagcagagaaagactatcacagctgaagatgtgttgtgggctatgagcaaactcgggtttgatgactatatcgaaccgttgactgtgtatcttcatcgctacagggagtttgatgggggtgagcgtgggtcgataaggggtgagccgcttgtcaagagggctgcggctactgctgaccctggtccgtttggtatgggtccgtttgtgcctggttttcacatgggtcatcataatgggttctttggtcctgctagcattgctggtttctttaaggacccgtcgagtgcggctggccagtctgggcctgctggtttcgagccgtatgctcagtgtaaagactaactggtttcgattttcgagccgtgtgttggttgggttgtttttttttttctgtttggtngnttccttggccctgggagcaacaaaatatattgggccaaactttggccggggagtgcncaaaaaaaacaaaactaacatattttcctgccggcgggctttgcccggttggctct

SEQ ID NO: 8319 - DNA, 508 bp, Helianthus annuus
  Predicted polypeptide sequence is orthologous to G189
ttttttttttttcttccataatcggaaataatggataatcttaccatatagaacacttaaaaaaaagatcgatccagatacacataaaataaaagaaaattaaaaaaaaagtctagtaacaaatcaaatcatccttttgttgacactacagccatacaaagccctttccctttacaaaggtagcaatggagatttacattttgttttccatgtaagctacatatataaggatccgatagaatatgattttcgggagtttaagaagattcaagaactatagccgccggcgtgtcgttcatattatgagaatggttatgttctccttcgtaagtaacaataagcattgcaggatcatccaaagctctttcaacatgttttcttgctggacaaccttttatactactacacttataataaccttttggatggggagatcctttaatcggttagtgaccgagctggctgcacggggaattatccgggggttttttccgcttattattgcaaa

SEQ ID NO: 8320 - DNA, 266 bp, Helianthus annuus
  Predicted polypeptide sequence is orthologous to G2057
ttttttttttttttctccggggcaaaaagaaaagcacattatctacttaattagcatagaaagagggggtccatggttgacagttcgctctcgcatcttacatgatagaccaaacaaccatactttgtggcaccacgacgaagatacactcatcggcccaaactcctcgagctcgaaaccaccagtgcccctcccccaagaatcacgcccaagcgatccccccaaattaacaaactgagcggcccatgaacacaccgcacaccacc

SEQ ID NO: 8321 - DNA, 566 bp, Helianthus annuus
  Predicted polypeptide sequence is orthologous to G2157
atggcctctgggcgggaagtggtgattgcggcgacatttactaacgcgacttacgagcgcctgccgttggaagatgacgtacgaagaaggggctgacatgcaaatacagcaaacttcaggggtcaatgctggaaatagtcctccatctggaggggctcctcctcatggtgataacataccatcttcttcaatggcgatttacaatcagccccctaaactattgccaaatggtcaaatgcatcaggatatgttttggactactcctccacgctcttcaccgtctaatttctagctattgtcaaaccaagttcctctcctttgtagaagaatagggtagaaactacaaaggtagaattttctttttcttggatgatattttgattagggtcgccaaccttgttttgttgtaatatcaatgtgacttatctatttagtttggtggtagtttgatggttttgaagcgccgttaaaaaaaggtaccggaaataaaatttcccggccggatgggcccaagggactatttactcgaaccaacttattggtggggcccccaatccagcacactg

SEQ ID NO: 8322 - DNA, 374 bp, Helianthus annuus
  Predicted polypeptide sequence is orthologous to G2417
ccggtctcattctgtgaagaaagcaggtcaaagttgcggatcaaagtttttgacaggatccgggatcgaaaacctccatgttcttgaagttttgctacaaatgatgtattgaagggggggtttggttggtggataaagaagtttggtgcttctttgtgtttaggttttagtccttttcttgggggtttctttttggtgaattatctccttttgaagggttcaagacaataataatgttgctggacatatattatataaaaagacaaaagggaaggggtgggggttgcatatatttatattattatatatttttgacgcacatgaaaaagagttaaccctttgatttttatatgtttaatcttttggttgatggc

SEQ ID NO: 8323 - DNA, 372 bp, Helianthus annuus
  Predicted polypeptide sequence is orthologous to G2639, G2640
gaggtaggtaacttcccatcagaagtgacaacacaagcagacttcagatgtgtaagagttagctccattgatgaaaccgaagaccaatttgcatatcaagctgcagtaaatattggtggacatttgttcaaaggaattctctatgatcaagggcctgaagatcagtacatgggcggcgacacctcttccggcggcagcgcaggtatcccgggtagttccaccgcagccgcaaattttatcggccattcgctatactcatctcttggcggcaacgattacatgaccagtacgcaattcttccatcaaatttcaagagattaaataaatcacataataaacgccaattcgacttgttgaaaaaaaaaaaaaaaa

SEQ ID NO: 8324 - DNA, 741 bp, Helianthus annuus
  misc_feature (584)..(584): n is a, c, g, or t
  Predicted polypeptide sequence is orthologous to G280
tttacaacacaacacacacttgcattcttcattaaaacctaaaaattacaataaccacctactaacataaaactaacaagacaacctcacggagccttttttttttgttaaaagtaactctatttccagatacgaaattcccaaatccagagcaacaacactctacccacttgtacatcacacatcaacacttgtactcaactctaaacttaagaatcccacatccagtaacacatctaacaccgtttcttttttccatcttctcagttatctcatgaactcccaaaactcaattagcttcaacaccggcaggctccggctgcaccttacgcggccgtcccctcggccggccggttttcgacggcggcgttggcaccgtcgcagccttaactttcttcgccgacggtggagcattcggatccttcttcgggcgtcctctgcctctcttaacttcagaacctgccgttgccggtgacgtcaccgccgccggagtctcggtctccgccgcggatggatccttagccttcggaggacggccgcgaccgcgtttcgctggtgtggcggagtccggaccatgtagttgntatttgaaaccactagctcaccgttttcaacgagtttgttcaactgatccgccaggatatttgtgtgttcttccggtaagcttccgcaagttgattcgatgtagtttgagatcgacgatgtgcttgaaccgtccttctctttcagagcatcaatcgc

SEQ ID NO: 8325 - DNA, 621 bp, Helianthus annuus
  misc_feature (603)..(604): n is a, c, g, or t
  misc_feature (607)..(607): n is a, c, g, or t
  Predicted polypeptide sequence is orthologous to G3074
gcgcgggattgagctggcacccgggtaaacggccatgatggccggtgcacgggggagaggaagaggccgtggcagaggtagagtatctgcagaacgagatcctccccccactgaacctgaatctgttcatcacagcaggaagcccacaaccgacatccactcggagtccatcactgcagacgacgacgttgttccaagcagaggcttcgatctcaatgctggccttgatgagaatacagataaagtgtctgctgctgcatcagatggtgctgcgccaccacaaccaccaccaccagcagtggttgcagaacctagcgaagttgcaaataatgagtaccctgggtggtcagtttcagaaatcgacaggatggccattgaccctcatcttgcacacgccaactcaaggttggatgaggaagatgaagactatgatgaagagtaatgcttctattatttctatttgactgcttcttcgttggatatgtatgctggatgtattcatcatttctttggtgttggtgtacgcatattatcctacttcatggcacctgtaacaaaatatttaacatttatgtatgtgctttaggcttaaatatgggcgannctntacctctggcaagg

SEQ ID NO: 8326 - DNA, 473 bp, Helianthus annuus
  Predicted polypeptide sequence is orthologous to G3074
tttttttttaaaccgaaccaaatcttaaattgctttattagaatttcaagcgaattcgaatcgacttgcctcagtttgggcaggtgggtcgctttcaaatgttttttgagcatccctactacatgatcatagaaatcctcatgccgattgcaaagaagataaacagacatgcgatcaaattatactgtgaatagctacagtacaaaacattaaaaagaaacaaacggaaacaaactgagcatctttaagttcatcttttatttgcatcaaagaaatctagcagttcatcattattcttcatcataatcttcatcttcctcatccaacctggagttaatttccgccagattgcgagtgtcaattgccatcctgtccatttctgttaatgacaacccaagataatcttcattcttaagttcaccaggatttgctgatgaggaaccgccactaccaggaaccgcctgtggggtgga

SEQ ID NO: 8327 - DNA, 709 bp, Helianthus annuus
  Predicted polypeptide sequence is orthologous to G309
ttttttttttttaacagcaaacttttttttttattattaagggtgagactgaatgaagataatctccacccaatccactcatagaaagtacaaattccaatccaccccctctaacttcaactaattaccaatttaaaccctcaattttcagaaagtaaaaaaccactttaatcaaaaactaaaaagaaaaatcataatgtgggccatcagctatctccaatttttccttatttccttaaaaactcttttgatgtaccgagttaatccaccaccaccactgagtcaactcggtggtttgactccgaacccaccgagtcgatactcgagttggtttcttccgagttcaccgaattttccaagccgaggtggttatgagcggacgagtatgccacccgagcatcaaacacccatcctcttccaccactcggtaaccatcaccacccgcgaacaaagccaacaacatactcgcttgcttaaacgcgttcgagccaagatgaaccgcttcaaacccggccgagtcaagccgagtcttccactgagtcaacgtttcatgcctttcaactcggtccacaccttcacatgcaaccacgttacagatctgtttcccccaatacacctctgacataaacctatcctcactgctcaccggcgatacaccaccgtcgttaactccaccgtcaacttcgccgtttaactgtggcaccacccg

SEQ ID NO: 8328 - DNA, 804 bp, Helianthus annuus
  Predicted polypeptide sequence is orthologous to G363
tttttttttacaagataaatagttttcttcaactttattacaatcacctgtacatgattcatctttcctttcgaattagaaaaagatgtagatataaacaatataaaggacatcttcaaacttaaaaccttaagactcttcggatactacgctgcataaaagagtttgttacctgaaacctaagaactgaaatgagagacagcaaactattaactagactctgcagacgataggcccgcttcatgagagtaataaggtttgtaatagtgaatctgttctctttaaaaacacttgtacagttgtacccgattcgaatcacagcttgagattcaagtcaagtgttattggatctggatccggatcagatggctgcgaatccgccatttgcggatctaaataataacctccatgccacattctttcctgaccatgcacacggacccaagcgtctgcggctgctgcggttgcaactgcatacttattattattaccactggcttctgccactgctgtcccggtaatcggtctgtgtacaaccgagtgagcttgcagttgcacagcgagtgtccgactgtacgcaggcgtgataagcgaatgatatcttctagcagcatctctctccctcttgtgtgcattttggtgaccccctagtgcttgtgcactgtagaatttcctcttgcagaagtggcataccttcaccgcgaccggtctcgatggcgagtttgtttgtagcttgcctgaggctaagatccagcccctgttgtgatgctctccatcttacctttggtattcataagactgaag

SEQ ID NO: 8329 - DNA, 702 bp, Helianthus annuus
  misc_feature (15)..(15): n is a, c, g, or t
  Predicted polypeptide sequence is orthologous to G4
ttttttttttttggntgaatttaccactttaaagtttttaacagttggttcaaacaatctgaagtccataaagagaaacaaaagcaacatttagttttcaaaatattatcatccatacaaacataactaacacaaaataaaaataaagatcttacaatcataacatagttgattgttaagctatatactctgcatataaccgaacgaaatcgacacaccatgcttatttgtccgcccatcgttaccaaacaatagcttagaacgatccatccaagatggcgggaagatcgctgaagctccaaagatccacctcatttccaccatcttgagtagcatccgcattcagaaacgcatcaaccgaagaagcatcccagctctcttcgaaactcggcatctgaaacagcggttcatcagcagaaaccatgtttacagggtcttgtttcagtttctttgcaggattcatgttagccatgaagctgacatcatcactctcggagaaaacagacgtgatttcaggagttgttgcgcagtgatcccaaccgaattcagcggaacaaccaaacgagttgctccccttgatcagacttaaaataaaaaaccccagaaccggtttaagggcctaaactggtttacacccatatcctcaacagttgcaggaaacgttaactttgaggcttcggtttcaaagaaccctcggccggg

SEQ ID NO: 8330 - DNA, 622 bp, Helianthus annuus
  Predicted polypeptide sequence is orthologous to G409
agaggtaggtttggaaggtgaagtggcaggaggagtaatgacggttgttggtggagctagtgtcggtgaagcagcaggtggagtagtgacaggtggcggtttggttccagaaccgtcgtgcacggtgtaagactaagacacttgaaagggattacaatcgcctcaagtcttgttatgatagcttgacggctgattatgagtccatcgtcaaggaaaacgaaaagctcaaagctgaggttgtttccttgactgagaagatgcagtcaaaggaggtgtcggaaacctcagccgtcggtcaaggctccggctcagccgttgaggaaggcggagatgtggcagttccatcagacaatgtaaaagtggaggaccactttagtacgggtagtggtggaagtgcagtggttgatgatcatgaaggcccacaacttgtggacagtggtgattcgtatttccctgatgatgattaccctcatgaatatgtagtacctgtggatcagtctgaagaagatgacggcagtgatgatgggcagaaccgttttcgatacacgtttgaagctgcggatcatgtggaagacatgggctaggctggtgggtttggtcctagacataaatataaatatat

SEQ ID NO: 8331 - DNA, 410 bp, Helianthus annuus
  Predicted polypeptide sequence is orthologous to G409
aattcactagtgatttcgagcggccgcccgggcaggtactcgatgaatccgaggttcccttctcttgcagcatcattttgtcacttaattcttcaacctcagattttagtttctccttctctttaacaagatcctcatagttggctttgagtttattgtaactttcttgcagatcatcatagtccttctctagctgtttattcttccaacgggctcgtcggttctgaaaccagatcgcgacctgtcttggctgcagaccgagttctttcgcaagctgaattttccgttctggctcgagcttgttatccgactcaaaacttttctccaggaaccgaacttgatcacccgtgagccgccgtttcttctcgggctggtgaaagtacctcggccgcgaccacgccaatcgaatt

SEQ ID NO: 8332 - DNA, 774 bp, Helianthus annuus
  Predicted polypeptide sequence is orthologous to G450
aattcggccttatggcctcgcaacggggaggctgcgggtggtggcggtgcggcgtttgtgaaggtgagcatggatggagctccatacctccggaaagttgacctgaaaatgtacaaaagttatcaagatctctctgatgctttgggcaatatgttcagttccttcactattggtacctgtggatcacacgggttgaaagatttcatgaacgagagcaagttaatggatcttttgaacaattccgactacgttccaacctacgaagataaagacggggattggatgctcgtcggagacgttccctgggagatgttcgttgattcatgcaagcgtttacgtataatgaaagggaaggaagccatcggacttgcaccgagggctatggagaaatgcaagaacagacgctaaactcgacgaacaaactcaaccgcgacatcttgcttgttcggtctttgtgtggcatgcaacatcaagtatagtgcgcgatggaatgagcagacgatacggttcgtgtttgtacttattgttttataataaactctttatctggattgggaacttgattgttggttatattgtgagggtaatgtgtatttataaacttgggtgattgaaattcatggacataaataggcaagagaccaataaatatcattagtatgttctatgtactaccaaatctaaggtttttaccctttgttttggtgatttgttgtagtattatgtttaataatctatgtaactcatgttgtgaagcaaaaaaaaaaaaaaaaa

SEQ ID NO: 8333 - DNA, 386 bp, Helianthus annuus
  Predicted polypeptide sequence is orthologous to G591, G793
ttttttttttttgatttaaagccaccccccactataaaaactttataatccccttagtcatcccccactagtctcaccaattgacacaaaaaggcacaacatatcaagcaaatgtttgacatctttccttgaatcttgtgggctttccattattcttataaaacattatgagtggtggaaaaagataaaggcaaatatgatgctactttcaactaaaaacatattggtgaatggtgattgcattcaagctagggctaaaactagaagtttatgggaatgttattttttttggcttataaagggggttcggattcggctttggcaatcgaggttgaatcgattggttgtgtgagaacgatagagtatgcaaatgatataggcttgat

SEQ ID NO: 8334 - DNA, 675 bp, Helianthus annuus
  Predicted polypeptide sequence is orthologous to G993
ttttttttttttagaaaaacaaaaagtttctatttttcttgggattttactagaattaaacttgatccctacattgagctttctttagctcaattatctttaaatttctaaaaatcaatatacaaacttttgcaacttgcaacttgcttcctcctctattccattcccaccactttccagcttcattccccatcatcatcatctctagaggaaaaaagtagaccaaaatgttaccacacaaaccctccaaacatgagagattgttacaaagggtcaataatcttttgcttcttacaattctccattcccaacaacaccatttctatgttatttctctttccattgcaagtgctgctatcaagagcaagagtattattattagcactaaatatgttgactccaaacaacctaaacatttggactggttgtactggttggaccggttggaccggttggattggtcttgaactcgtgttaccagatccggttttcgtcttccagtcgatgtaaagttgcttgtctggaccggtagatctttgaaaactaacaatgtcaccggcttttaagttcttttcctttacaaaccggctccaacctttggtcaacacgtagctttgactactgttccagtaagagtaacgaaatctccatactttcataccaatatcttcgaaa

SEQ ID NO: 8335 - DNA, 490 bp, Lactuca sativa
  Predicted polypeptide sequence is orthologous to G1006, G22, G28
aaagacaatgataccaaacattgccactgttaaatctgagccggaggtttttgtgggatcgccggagatttcaagttatgaaaatggatcgccgccgcagacggtgggagttgatgatgtgacgcaacagaaggggaaacattacaggggtgtgcgacgacggccttggggtaaattcgcggctgaaattcgggatccggcgaagaatggtgctcgggtgtggctagggacgtttgagacggcggaagatgcggcgtttgcatatgacagggcggcgtataagatgcgtggttctccggcgaactcatcggaagatcgatcgctcaagaggacaaagaaggtggaacaaatccacgtggcgaatagttagtggttgatggatgctgactgtaactgtggattaccttttttttttttttaatttcgtattttatcgtgtaaatagctgtttttttgtgcataaatgacaaatttattatttttttattct

SEQ ID NO: 8336 - DNA, 918 bp, Lactuca sativa
  Predicted polypeptide sequence is orthologous to G1006, G22, G28
cgcggggataccattaaatttgtttacataacacctaccacccaaaagcaaacccacatttcatctatggaaaccctttcttctcctttacaatctggttattccgtttttgatgccattcgcaagcatcttttggatgaccgggatgaggctcccgagatgctaccagctgtgacaagtcccagcagtgatcagtcctgttttagtaaagaaaatggtccggagtctttgaagaagataatggaacaggaatctggtgaaggtgaaaaccatacaaaatcagaaaatgttaagaaaaagaagaagaagaaaacaccggctgcaaatggtgaggatgatcctgtggaatggactcgttacagaggtgtgaggaggcggccatgggggaagtttacggcggagatcagaaatccagagaggaaaaaggcgagattatggttgggtacttttgacacgccggaggaagctgcggtggcatatgacaaagcagcatttcagttccgtggtagtcgagccaaagttaacttccctctcttgctttgccaagatgtatggaagcccgaatcgtcttcctcctcgactaatgcagatgtcggaaaatgcaagaaaaaagttgcggtggatccacccatgggcaccaccacctccgcccttgtacgtcatgatgatacccatacgttaagcacgatagaacccccagtttccacgaatattgcggttgagaaggagtcaaggagcgataaagacctggttacgaagccttgtaaaagcacagtgcattcgccaaccacctcggcctccggaactgaagagatgtgtgaccttgactcaatctgggatttcaaacatgtacattaccacctttttcaccgatggtatcggttggcgattacaccttgcagtcaagcaaatcatcct

SEQ ID NO: 8337 - DNA, 829 bp, Lactuca sativa
  Predicted polypeptide sequence is orthologous to G1033
ttctgttctcttcacttcccgatcacagatcgtttctcacttctcgctctagatatgaagggtgccaagggtaaaggggcagcaaagagggacaccttgaagcctgttgatgacaaaaaagtagggaagagaaaggcacctcctgctaaggctgttggcaaaagcaaagccaagactgcgaaagcagctaaagatcccaacaagccaaagagacctccaagtgctttctttgtcttccttgaggaattccgaaagacattcaagaaagaaaaccctgatgtgaaagctgtttcagctgttgggaaagctgggggagagaagtggaaatcccttactgcagctgaaaaagcaccatatgaggccaaagctgcaaaaaggaagattgattatgagaaactaatgactgcatacaacaagaaacaggatagcattgctgatgatgatgaagaatctgaaaagtcaaagtctgaagtagatgaggaaagtggacaggaaggtggtgatgatgatgaagatgatgaggatgatgatgaagatgatgattgagatcaatgcttttttttttcagcaaaatctgtctgaattcattttcagaccaaacaaatatttgctggaaatttgcatgttcatgttcatagattatggtcatgtcttatctatgtgtactttgcattttacacttcagctcttgcagagtgtttagcttagattttattaatgatcttttattttatgtactttatctatgatttctcttttattttgacttgagtgttaaattttacgttgttgttaagtgagtttcctttcaaacctttgtaggtaaact

SEQ ID NO: 8338 - DNA, 693 bp, Lactuca sativa
  Predicted polypeptide sequence is orthologous to G1033
cggggctctttcgttcttcagaatcatactgtttttggctcgttttcacttcaacgatcacagatcctcctcatctttctctcaagatatgaagggtgcaaaaggtaaaggtgcaacaaaaagagacgcattgaagcctgttgatgacaaaaaggtagggaagaaaaaggctgtaggaaaaggcaaggctaaaggagggaaagcagaaaaagatccaaataaaccaaaaaggcctccaagtgctttctttgttttccttgaggagttcagggtgacattcaagaaagaaaaccccaacataaaggctgtttcagctgttgggaaagctggtggagagaaatggaaatctatgagtgcatctgaaaaagctccatttgaagctaaagctgcaaaaagaaaatctgagtatgaaaaacagatgaatgcgtacaacaataaacaggacgatgatgctgatgaggaatctgacaagtcaaagtctgaagtagatgaggaaagtggacaggaaaatgctgatgttgatgatgatgaagatgatgatgaagatgatgattgaaatttgtaatacatgaaaaacttgtgtgtttttatttcagtcttcttttgcaaatgtaaccctcaaaactttttccctcttcagcctaatgtaaactcttaactaagttcttgcaatgctagtttaacttaaaatta

SEQ ID NO: 8339 - DNA, 721 bp, Lactuca sativa
  Predicted polypeptide sequence is orthologous to G1033
gcggggatcgcaacgaatcaaccctaaccctagattttttgctaagtaggatcaaacgatgaaaggaggcaaatcaagcggtgctacgaggaaagccgataccaagttggctgtaaagaaaactgcagccaaggggaaagcagctaaggatcccaataaacccaagagacccgctagcgccttctttgtgttcatggaggactttagaaagcagttcaaagaagatcaccctgacaacaaatctgttgctgctgttggtaaagctggtggggcaaaatggaagtcaatgtccgactctgaaaaggcaccttttcaagccaaagctgacaaaagaaagaaggaatatgagaagaacttggacacctacaacaaaaaacttgctggaggtggtaatgatgatgatgatgaggattctgacaaatccaagtctgaagtcaatgatgaagcagatgagggtgaaagtgatgatgaggaagatgatgactgaatcaagaaagtggaagttgattctgtgttgatggtttgataagttacttgctttgtagtttcatgttactgattagaatagatttggtttttatggtgcacaggaaaaaggaaatgtaactttggttggctctaatgttagcttttgtatcttccaaatttacccttttggggtggttttctgtttagaacaaatatcctttgctaatgcatctttatctttttcgggtaaaaa

SEQ ID NO: 8340 - DNA, 798 bp, Lactuca sativa
  Predicted polypeptide sequence is orthologous to G1033
gcggggggccttatctcaacgaaaaaccctaaccctaaaatcctcaattcattcggatctaacaatgaaaggagcaaaatcgacgaagaaggctgatagcaagctcacagtgaagaaaactgcggctaagggaaaggctgccaaggatccgaacaagcctaagagacctgctagtgccttcttcgtcttcatggaggacttcaggaagcagtacaaggaggagcatcccgacaataaatctgttgctgcggtgagtatttctagccaatttcttcgaatctataattgtttagaaattccgtttgttatacttctgcttatttgattgtataaacaacgaacaggttgggaaagcaggtggaacaaaatggaaatcgatgtctgaatctgacaaggcaccttttgttgccaaagctgacaaacgaaagaaggaatacgagaaaaacattgatgtttacaacaaaaaaaaggctgctggtggtaatgatgaggatgatgattctgataagtcaaagtctgaagtaaataacgaggaagacgaggaaggaagtgacgaggatgaagatgatgattgaagtgggttttatatgatgtagaatcagaagttaaatctgttttgtagtttcatgatgataatattagcataatgtagatctttagctatggataattttggcttggttattatggtcataaaatagtattgattagatgttagctatcatggtgcacagagagatctgaatagttttgtttgcttttgtgttcttggtagtttttaatgaaatgcatcatgtt

SEQ ID NO: 8341 - DNA, 820 bp, Lactuca sativa
  Predicted polypeptide sequence is orthologous to G1033
cgggggtgtgtgcattcacacagcaacacgaatacactagactacacccaaccaaagcatatctcttcacgcatttcctctcctcttatattattctcccttcgcctctctttcccttatctccataccttcccttccttcaactcaccgagttcactcccatttccaaacgagttacgtcatgaagggagccaaatccaagtccgacaccaaaaaagccgatagcaggcttgctgtgaagaagaaagcagcgccggctccgaagaaagctccggcgaagaaggctaaggaagcgaaggatcctaacaaaccgaagaggcctgctagtgctttcttcatcttcatggaggatttccggacacagtacaaggaaaagcaccctaacaacaaatccgtgtctgttgtcgggaaagctggtggtgataaatggaaatccctttctgctgctgagaaagccccatttgcagctaaagcagagaagaggaaggccgaatacgagaaaacactccaggcatacaacaagaaactggctgaaggaaaggacgctgaagaggaagaagacgaggaatctgacaagtcaaagtcggaagtccatgacgatgaagaagatgatgatgatagtgcagatgatgatgatgatgaagacgatgagtgaaaagaaaagaagaatatgtaaaacaagaatttgggatcttaaattaaaagtttttgtaagccttctttttaagagaaggttaatttggaagtgaaaaatatcctcaatcttatgtgtacttttaatccgtaatttcatctcaatgataattgtagcttttagatt

SEQ ID NO: 8342 - DNA, 945 bp, Lactuca sativa
  Predicted polypeptide sequence is orthologous to G1048
cggggttcatatacataacctccctcaaaagcttcttcaaaaaaacccctctccatgtaaatctttctatggaagagcaaatcgattgggataacctctttgactttgatgccagtttctccgatccctcccctaaccctatccttccaatttcatcaccaaatcacgccaacagccagtctcctttgtctgtcgatgatatcgaacagctgcttttaaacgatgacgacgaaactcacaacgctgatgcgttgaactcggttcaggatgcggtcgatgtgttcttccatgatattttgcttgattcgcctttagacgtagaaaaatccggtgaagttgtcgatatttctgatggagataattcggtggaggatcagaacaacgaagctatcgttgatcacaaagaagaaaaggagaattccgatgatgatcccaatgatcccctcgacaagaagcgtaaaaggcaactgaggaacaaagatgcggctctaagatctcgagagaggaaaaagatgtacgtaaaagatctagagatgaaaagtagatactatgaagcggaatgcaagagattaggttcgatgctccaatgtttcatagcagaaaatcaagcactacgtttttcattacatagtagtaaggcatacaatgcttccacaaccaagcaggagtctgctgtgctcttcttggaatccctgctgttgggttccctgctttggttggtgtgcatagtttgccagctcgttcttcccggcctgcacctgcaaaaactaggggcagctcaactggaaaccgtggtagaagaaagctactaccaaatctggttgtaaggaaggagggaaagtaaatctgtagagagcctctttcccttttggttggaaaaagattcaaatcttcaaggtcaagaatgagatcaagcctttgttctctagaatttgtaagcaaaat

SEQ ID NO: 8343 - DNA, 761 bp, Lactuca sativa
  Predicted polypeptide sequence is orthologous to G1062
ggtggtggtagtgatgggatgagtgagaagaagaggaagagcagcggtggcagttgggatgatgtggataacctgagtttggatggctccggtttgaattacgattccgatgatatcacgatgaacaccaccacaaattttgaagaaaatgggatcaaaattaacggtgggaatagctctaatgcaaacagtactgtcactggcggcatcgggagcaatcaaaaggggaaaaagaaagggttgccggcgaagaatttaatggcggaaagacgtcggagaaagaagctaaacgaccggctttacatgctcagatctgtagtccccaaaatcagcaagatggacagagcttcaattcttggcgatgcgatagagtacctgaaagagcttcttcagaagatcaacgaccttaactatgaactcgaatcaaccccatcaacctcatcattgacacccaccaccaccataaccacccccggcagcggcacccccaccggtttctaccctctaaccccaactccgaccagtctcccttcaagaatcaaggaagaactttgccccaccgcgatccctagcccaactggccagcctgcaagagttgaagtaagacagagagaaggaagagcagtgaatatccatatgttttgcagtaggaggcctggtttgcttctatcaaccatgagagctcttgataatcttggtttagatattcaacaagctgtcataagttgcttcaatggcttcgctcttgatgtttttcgagc

SEQ ID NO: 8344 - DNA, 711 bp, Lactuca sativa
  Predicted polypeptide sequence is orthologous to G1062
gatgttttaattagtcaaaattcttagctccgatcatggtggccactggtgagaatcgaaaagaagctacctttgcgggatggtttttggggctggggacggcggtcggacatagttcttctttcacatgttgatgaaacgccggcggtgtgggtgtcaatggatggaatcttggtgaattttgaattaaagacccttgtggtgatgcctctacttcgatatgaagatcgttgattctttgcagaagctccttcacgtaatcaatggcgtcaccaagaattgaagctctatccatactgaaacacaattcaaatgttataataactagaaaagaatagatattttacatgaaagttaaccagataccttgctgattttgaggacgacggacctaagcatgtaaagtctgtcgttgagcttcttcctccgacgtctctccgtcattaaatttttatcaagtagacccttcttcttccctttctgatccccggcgccgatcgtaacagagctcattgcattcgaattgcttccgattccgtttccatttggatgttcactggtgggttcgatttcgtcggaatcgtaattacatcccgatatatccatggtagctgtttcctcaagctcgtcctcctctgctaagctcctcttcctcttcttatcgatttccactgccaccgctattactctctgctctcttcccccaatttg

SEQ ID NO: 8345 - DNA, 742 bp, Lactuca sativa
  Predicted polypeptide sequence is orthologous to G1062
gacacacagtcgatgttcgttatcagtaacaacactctcctctcctctccactctgcattcaatcatacatttaaaccctaaatttttcatttgaatcttcaaccaggtgatgatgcccgacggtggtgctgtttggatggaaggaggaggaaaccaggatgaaattggaacatcttcatggacgccggccaccaccaccaccacaaccgccaatcaccatcatgttcttggaattgaagctgctgcaacatcatgcaacgaagaaaccacagccgccaacacttacgcttctctcaccaccttgaaatcaatgcttgaatccgagtggtatcaacacaacaatctcaatctctctacgaatccttctgataacaattcaatcttcttacctatggattcttcttcttcgtgttcgccgtcgcattcccaccacccgttctctctccccgacccttcgccgtcacactcatatcccttctttccccccaaattcaacaacccttatgacattgggtttgatttcggatgcgaccctggcttcttacctaatcacacttccaatttgatgaatttttctgggttatgttcgcaaacccacatcgccatcccggagctttcttccagttccgactttccggccaccaacaatagcaacgacacgagcgacattggaggacctgggttcaatccgcagttaacggcgtttgatggttttcatggcgctgcacccatgaatcctct

SEQ ID NO: 8346 - DNA, 368 bp, Lactuca sativa
  Predicted polypeptide sequence is orthologous to G1089
tcggccttatggcctgccatcgggctgagctgccttaaccccagttggcagttaacaagattgaggaggattggaattgcgattattgcaagtggcagtggactgattcgtcggaggaggtagcgggcggttgccggagagattagcgggaattggaaaagatcgctgctaattttctttaggaagatgatggtctagggacccacgtctggtttttgtcttttcttctagctcattaaggctattgtacaatggttggagccagctatagtttttgttactttgtactcattaataattagacaagatgtacacacccaatacatgactaatacacgaccggtggggcccgactatccttttttccc

SEQ ID NO: 8347 - DNA, 931 bp, Lactuca sativa
  Predicted polypeptide sequence is orthologous to G1134, G2555
cggcgggggttgcagagcatttactcctgtgaagcggtgacgtagcagttgtttcctccaatccacctcttttcactcatcttttttatcgtaaataaattaaaaatctgtagtagcaagataaacacgagttgcttaaccaaaaggtaatccaacagaggagtaaagatgcaaccgacaggcagtggcggtggtggaggactatccagattccggtcagctccggcgacatggctggaagcactgctagaatcagaagaagaagatgtaatcattgacccaccaaaaccacctccacatcagcaagcttccattgcaggcacccccaccccctccagacctacttacgttgatcccaatatcttcttacctagccgacagaacagctctcccgccgaattcttttctgagatcaacaatcctgatgcctatctctccaattacgacgactacctctcatcgtcctaccacaacgttaaaccatccagggctgtcgatgtagacgaccaacaacccaagttcaccacacagctcagcggagatcagagcgcgttgttggatgttgagatggataagcttctgggggattcggtgccgtgtcgagtacgagcaaagcgcggatgtgccactcatcctcggagtatcgccgagagggttagaaggactcggattagtgacagaataaggaagctccaagaactggttccgaatatggataagcaaaccaatacggcagacatgctagaagaggcggttgaatatgtcaagtttctgcaaagacagattcaggaactaaaggagcaccgagacaaatgcacatgtgtggttgacgattgataacagaaaagaagctaacctttttttgatcgtggttcaagggatcataatggaggactatggtgcttatccaaaatctcagatcaaatatatt

SEQ ID NO: 8348 - DNA, 952 bp, Lactuca sativa
  Predicted polypeptide sequence is orthologous to G1140
actcttcatcactgttgtctccaagaatccaccccaaatccatcttcttccttccagaaaagaagggttatccatggcgagagagaagataaaaataagaaagatcgataatataactgcaaggcaggtgactttttccaaaagaagaagagggcttctgaagaaagctgaagaacttgcggtactttgtgacgccgacgtcgctttggtcatcttctccgccaccggaaaactgtttgagtatgctagttccagtatgcaagagttactcgggaaatataaactccactcgactaataacgtcaataaagttgacgcaccttctctcaatctacagctcctggaaagcgaagagtcaaggatgagcaaagaggtacttgacaagaatcgagaattgagccacctacgtggcgaggaccttaatgggttaactctagaggaacttcaacgtttggagagcttgcttgaaggaggcctcaaccgtgtgctccagacaaaggatgaacggattgcaaacgagatagcaagtcttcaacaaaagggttttcagttgatggaagagaacaagctcttgaaacaacaaatgatgagtttgacttccgtaggcaagaggccacggacaacggctgccgagttggacaatattgtaattaacccagaagatcaagtgcagtcatcggaatctgttgctaccaacgtatacagttgcaacagtggacctcctcctgatcaggatgattggtctgatacatcgcttaaacaagcgttaccctttaattgacaatggcaaaccgtcgaggaaaaggagaagggcgatggatggttgtggtatttgaagggaataagaagtgatgtattgaaataagtgtgtaattgccatgcttggttttgtgcttgttctatgaaaacaaaatgaagactttaactcgtattttgaaggtatctatctagt

SEQ ID NO: 8349 - DNA, 697 bp, Lactuca sativa
  Predicted polypeptide sequence is orthologous to G1146
gatggagtgagcgaggggcagttctatcaagttttactttatgagcttgatgcgattcgaaaggcatgtgcatcgttggagccagattatcagcctccagtgacatttgtggtggttcaaaaacgtcatcacacgcgattgtttgctaacaaccatcgtgaccgcaatgctaccgacaggagtgggaatatactgccaggcaccgttgtcgactccaagatatgtcatccaaccgagtttgatttctatctatgcagccatgctgggattcaagggacaagccgtccggcccattaccatgtgctgcgggatgagaacaagttcgcagctgatgctttgcaatcactcacaaacaatctctgttacacgtatgcaaggtgcactcgttctgtgtccattgtgccacctgcatactatgctcatctggctgccttccgtgcacggttctatatggagccagacacatctgacagtggctccatgacaagcggccgtggtgcagggacaaggagcacccgtgtgccaggggcaaatgttgctgcggtcagacccctacctgctctcaaggagaatgtcaagcgggttatgttctactgctagaataccctaccctacccttccatttcatgtatgtttttgtgtctactactactactactacctttgtgctggataaattacaacacactatgtgtgt

SEQ ID NO: 8350 - DNA, 905 bp, Lactuca sativa
  Predicted polypeptide sequence is orthologous to G1146
cgggggacatgatgaacaaaaaaatggttaatggtggaacagtcgccagctggatttgcataaatttcgcacgaaatgttcaagataatattgctaaagctttctgtcaagagcttgcacagatgtgcaatacctctggcatggcatttaatcctgaacccgtgcttcctgcatttactggtcgtcctgatcaggttgaaagagtcctgaaagctcgtttccatgatgcaatgactaaacttcaaccccacaaaaaagaacttgatttgcttgttgtcattctcccagataacaatggctcactttatggtgatttgaagaggatctgcgagactgatcttgggattgtttcacaatgctgtctaacaaagcatgtgttcaggatgagtaaacagtaccttgcaaatgtagccttaaagatcaatgtgaaagttggaggaaggaatactgttcttgctgatgcattgtcaagaagaatccctaatgtcagtgatgtcccaacaatcatatttggtgctgatgtcactcaccctcaccctggagaagattccagcccctcaattgctgctgttgttgcttctcaagattggcctgagattacaaagtatgcgggattagtctgtgctcaagctcatcgccaagaactgattcaagatctgttcaaggaatggcaggatcctaatagaggcaaagtctctggtggcatgatcaaggagcttctcatatccttcagaagagcaactggccaaaaaccacagcgcatcatcttctatagagatggtgtgagtgaagggcagttttatcaagtgcttctttatgagcttgatgcaatccgaaaagcgtgtgcatcattggagccaaactatcagcctccagtgacattttgtgtggttcaaaaacgtcat

SEQ ID NO: 8351 - DNA, 780 bp, Lactuca sativa
  misc_feature (661)..(661): n is a, c, g, or t
  Predicted polypeptide sequence is orthologous to G1198, G1806, G558
attgctacattcgaaatggagtatgaattgtggattggggaacaaaggaagaaggacgatgatcttcggaaagtgttgttgactcatactagtgatgtcgagcttcgtatgttcgtcgacactggattgaaccattactacgatcttttccgaatgaaggcggacgccgcgaaggccgacgtgttttatttgttgaacgggttgtggagaactccggtagagcggttcttccagtggatcggcggattccggccatctgagctcttatacgtaagcttccgccttccgctttcaatttcaattaaacaaataacattttagggtttgcattggtggcagatactgataccacaaatcgagctaacggatacgcaactggtgaaggcggggggtctccggcaatcatgcgagcaagcggaggaggcactgagtcaaggaatggaaaagcttcaacagacattagctcagagcatcacaatcgacataaccggagccggaagttacaccacacagatgaattgtgcactcgaaaggctcgaagcgcttgaaattttcttgaatcaggcggatcacctccggcaacagactctgcaacaaatgtatcagattttaacacttcgtcaagcagcaaaagcattgcttgcacttggtgaatactttncacgtcttcgtgtactgagttcaatctggtctggtcgtcctcatgatcgtggaactttactttcatgaatcaatctacttttttcgagttttcattagccgccattagctaatctagag

SEQ ID NO: 8352 - DNA, 825 bp, Lactuca sativa
  Predicted polypeptide sequence is orthologous to G1198, G1806, G558
cggcggggtatcgtgaggcctggttagaatctaatattatgggagatggaagcccacacacagatacttccactgaaatggaccctgatgacaacaatcaaagctttgatattgttccatctaatccgtttatggcttctggttctagtgacaaacaaaaagaaaaatttccagaacaaaagacattaaggcgattagctcagaatcgtgaggcagccagaaagagcaggttgaggaaaaaggcatatgtgcaacaattggaaaatagtcgattgaagctaactcaactagagcaagaggtccaacgagctcgaaagcagggtgttgtgatttctaattcaagtgatcaaacgcaaccaaatgggtcattggcatttgtagcagaatattctcggtggttggaagagcaaagcaaacacataagtgagctaaggacagctgtcacttcacatagaagtgacaatgagcttcgttctttagtggaaaatgccacctcacatttcaatggtatttttaggctcaaaagaactgcagcaaaagccgatgtttttcatatcatttatggaatgtggacatcgcctgcagaacgttgttttctatggattggtggcttccgttcttccgaattactcaagctacttgtgagtcacttagagccactaacagaacaacaattggcaagcattgatcatttacaacaaacatcacttcaagcagaagaagctctatcacaaggaatggatgcattgcagcaatctctagcccaaacattggctagtgatgcacccgttgtgccagctggatcttcgggtatggctaactaca

SEQ ID NO: 8353 - DNA, 668 bp, Lactuca sativa
  Predicted polypeptide sequence is orthologous to G1246
tatgcattggataatctaccggtgtaataagagaggagttgtactttgtgcttaaagtgttggacgttgtgcagtttctggtgtacataggttgacttatatccaaatcaccggctatcaactgccaagataacaagatcttgaaattccggttgcttttttatatatatatatatttaatatatattgctgttgtgaatatgattgctgctgctgctgatgatgatgatgatgatgatgatgatagagctcgagagcacgatatgcaaaggcatagacgtgtggaaatttttgactgctttaggtagcctacaaaagacccgaaaaagcaagcaatttcctaggattgtgaatctgaagatttactataattctctttaattagtctttggaataataatacgtagttttgtgcttgtttttaaggtttttaacgtaaatcttatttgttaggatatatggtcgtagtgtgcatagtaattgagtattattgcttaatgaaagatcaaacatgttttatatgttttcatcgttgaaatcgatgaagtgaacgattcaatattctaaatgagagtaccgattgaatcttgtgaatgggggaaagtgaagatttcatctttttccatgtaaccaacatttgtttgaaaaaaaatcatgttttccaaaaa

SEQ ID NO: 8354 - DNA, 916 bp, Lactuca sativa
  Predicted polypeptide sequence is orthologous to G1272
tttattttgggctcttctcctccttgttgcctctgcgtggccggaccacgccttctcgtgtgcacatccatatttctcaacatgggttctcccgtgagtttcagcatccacaactgcatccagagaaaggaaatggtgatgcattgtccaccatctctccactctgtcgccatgaagtatgttgttcccatgaacgcagagcctgcacaataagaaggtgatgagggtgcccatggagaggcgtgttctggccaccagaggcaacaaagatcaactgttgacccaccatttcaaagtccacgtctctaatgttgatggacacttcttccaacacatgccgcgcttatttatgaggatggacgcccaatagatgggaaaggcattggaagaaaagtgcttgatagagtccacgaaacatatggttctgaattagcaggaaaggagtttgcttatgatggtgaaaaaagtttgtttactgttggagctcttccaaggaacaaacttgaattcactgttgttcttgaaaatgtcacttcaaaccgtaacaatggaaatgcaagccctggaagccctgacaatgacaagaagagaatcaggcgttcgtatcaaccaaagactttcaaagtggagctgagttttgcagccaaaatcccaatgcaggcaattgcacaggctctcagaggacaggaatctgaaaactccatggaagccttgagggtgcttgatatcatcttaagacaacatgcagctaaacaaggctgtctacttgttcgccaatcttttttccacaacgatgtgaagatttttgctgatgtcggaggtggcgttctcggatgcagaggattccattccagtttccgcacatccccaggtggtctatccctcaacattgatgtgtctactaccatgatcatcc

SEQ ID NO: 8355 - DNA, 730 bp, Lactuca sativa
  Predicted polypeptide sequence is orthologous to G1274, G1275
gcggggatccaaatgaattattatgatcatcaaatgtctaaagcctacagttacagatcagtagactcacctgacatggactatgatgttccaaaccagcaaacttatgagtttgttgagagctttctcagctttgatgattggataactgaagataaagcatccactgttcctgagtatcaagatcatactcctgtttacccttctgccaccattgaagatggtggtctgtcgatcggaagtagcagcagcaacagccatcttcatgatggaagtagaagcagggccacaggatttgggcaggctcaaaatggcaaaaaagagaaagtcgccttcaaaacaaaatcccaagttgagatcctagatgacggttttaagtggaggaaatatggcaaaaagatggttaaaaacagtccaaacccaaggaattattatcgttgttcagcagcaggatgttcggtgaaaaagagagttgaaagggatgtagaggatgcacgatatgtaatcacaacctacgagggtattcacaaccaccaacgcccttctaactactgatagcttgtactacgatttgttaatgtatgctaaagaatagtagtttttctaagcttactccatcactagcttattgaaaagaaagttgtagttcggttacttattttcttcaaccgaccaaggttatgaatcgttttagaatataattgtttttaactgctatgaagcagtcttt

SEQ ID NO: 8356 - DNA, 330 bp, Lactuca sativa
  Predicted polypeptide sequence is orthologous to G1335
ggggaagaggaggaggaggaggaggaagaggaggcggaagagggcggggtgatgctgtatcatcaagaggaggaggaggagggcgttatggtggtggcaggggcaatggctttcgttaaaagatgatcacaccacaatgatggtttgaccagcttctttttttacaatgatggtttgagttgtgattgatttttgtgttgctaatcttgtttaacatcttttatgtctttatcctagagagtcatggatgtcgcgcaagtgatatctatctcttgagtgtattctagcttccatgtttcaatttatgagatgcatgtgttttttttatac

SEQ ID NO: 8357 - DNA, 340 bp, Lactuca sativa
  Predicted polypeptide sequence is orthologous to G1335
aggaggtggtgggggcggcggcggccgtggtttctctagatctggtggaggcggcggtggctttaggtctggtggcggtggtggtaactgctaccattgtggagaacctggacactttgctagagaatgcccgaccaatgcttgatcaataaactaacaaaagtgtatcctcgacattactatcggcttaagatttttgaggtacatttggttaattagttcttagcttttcttttttcttgttaattgaacgatacattggaagtcacattctagatcttgtgtcttaatcctatgaatatatttggagggctggtccttaatctcagttttgttcgtg

SEQ ID NO: 8358 - DNA, 625 bp, Lactuca sativa
  Predicted polypeptide sequence is orthologous to G1335
aagcacacgcggtggtggtggcggaggcggccgtggaggtggtggtggtggtgatcgttatggaggaggaggttataatggaggtggccgtggaggaggccgcggtggtggtggatatggaggcggtggaggttacggaggaggtggaggtagttatggtggcggaggcggttatggaggcggaggtggaggtgggaacgcatgtttcaagtgtggcgagtctggacacatggctagggattgctttcagagcggtggaggtggaggtggcggttgctacaactgtggtgaagatgggcattttgctcgtgaatgtcccaacgccaacaaccgttgatctgccagaggatgaatggtaaatgtgtattcccacatttactttttatctcctctgtatcttgtttactcttttgctgtctatgttgaagaagaatcaatggggtgatccaaatgttttgatatcacttttttagttgcttcatcttgatgatgatcatctttaaatctagggtttcggatatggtgtcttactaaatatatatattgatacaaaagttaggttttttagtctgtgttaatgggaatccaaagatggttgaatggaatgatatctattttctcttta

SEQ ID NO: 8359 - DNA, 554 bp, Lactuca sativa
  Predicted polypeptide sequence is orthologous to G1335
ttgtgttggtacccgggaattccgactgatggcctctgtgcggggacgtggttggtggttggatactggaggtggaggcggcgaggaacgcatgttttatgtgcggcgaggctggacatatggctagggattgtgatcagaacggtggaggcggaggtggtggtggctacggtggtggaccgtggaggatacggcggaggtcgtggtggcggaggttacagtggcgggggtcgcggaggcggaggtggtggcggttgttacaactgtggagaagatggtcactttgctcgtgaatgtccgactgctattaaccgttgatctgaaatctgaatggaactggtatattacatctgtgttttctaccattaatgttgcttcttatttttctgtttttttttgggttttttgtgatttctaatttctatgtttaagaatcccttgttgaaccatttggcaaatgtttttaggtctcttatatgatagattgttccgtttttggtcctccacctccgtatccaccaccaccaagcttcgcggccgactcggtccaggcg

SEQ ID NO: 8360 - DNA, 730 bp, Lactuca sativa
  Predicted polypeptide sequence is orthologous to G1335
gatcccaagtttctagagagagactagggtttgctctcttgattttgggggttttcgatttctagggtttgtgagtttctcttcaattcaaaaatggacgttgacggcgctaggaaatcaggaaccgtcaaatggttcaacgatactaagggatttgggttcatcactcctgaagatggcggcgaggagctttttgttcaccagtcgtccatcagaactgagggattccgcagccttggtgacggtgagaccgtggagtacgtgattgagaacggatctgatggccgtactaaagctgctgatgttactggtcccaatgaaggtcctgtccaggggagtacccgtggtggtggtggtggtggaggccgtggaggcggcggtggtgatcgttatggaggcggcggtggtgatcgttatggaggcggtggtggtgggtacaacggtggtagccgtggaggacgtggaggtggaggttatggaggtggcggaggtcgcggaggtggtggcggtggcggcggcggctgctacaactgtggtgaagatggacacttcgccagagaatgccctacatctaacaaccgttgatctgctaccatggatgatggaggataaagggtaaatgtgtttcttcacatttgctttgcatccatacatcattctatttacttttttgctttttctgtgttgatgaatccatgggtgacccatagtttaatatgccttgcttttg

SEQ ID NO: 8361 - DNA, 740 bp, Lactuca sativa
  Predicted polypeptide sequence is orthologous to G1361
attcggccattatggccgcttgacgggggcgaaacaaggtggcacaaaacaggaaagactaggccagtcttaatttcgggttcagttgaagggtacaaaaagatactcgtgctttatacaaattatggagggggaaagaaaccagagaaaacgaattgggtgatgcaccaataccaccttggtaacaatgaggaagagaaagatggtgagatagttctctcaaaagtgttctatcaaacacaaccaaggaattgtgcgtcgaacctcaaggagtccacgttacttgatgagaaaactgaaagaaaccctaacgttaggaacatgagcttcattgaaaactatagcatttcacctttcataccatatgacattaatcgaaggcaactcagtagggaaattccttctcacgtcatccctagttttgttctacaagatgatacatcaccttttattcatctaccaagtggatcaagcaaagaataagatattataggtaaaaaaaaaaaagatatattgattctttcctagtatccgaaaggttaacttttgaaattctcataaggacctcatttattttgggggttcaaatttcaagttcagaagaatgtgtaaattttactacatgagttataatattgtagtcattttggattacgagagagacaataatatggttcccttaataatagggtttatataactttggttttacgagtttatataatttaaattaatattgg

SEQ ID NO: 8362 - DNA, 641 bp, Lactuca sativa
  Predicted polypeptide sequence is orthologous to G1364, G481, G482, G485
tactcgtttccgcagctctcaaattctccaccactttcgcctgcaccctcagcatccccggagctccggcagtctctgtctcttctagagccggagatcttcttcgcgccaaattaattcgaataattcaacggatatggcggactcggataacgaatctggaggacacaacgcgggcggtgatttgtcggcgagagagcaagacaggtttcttccgattgctaacgtgagtcggatcatgaagaaggcgctgccggcgaacgcaaagatctccaaggatgcgaaggagacggtgcaggagtgcgtgtcggagttcatcagctttataaccggcgaggcttcggataagtgccaaagggagaagaggaagacgattaacggtgacgatttgctatgggcgatgacgacgttagggtttgaggagtacgttgagcctctgaaggtgtacttagcgaagtacaggggattggaacgggagaagacgacgatgggaacgccaggggagaaggacggttcatctggaggaggtgttgatgctgcagtaggcggcggaagtactgccggagagttaatccggtggatataacgggatgtacggagggacaggatatcatcaaatgtataatttcgggtcagtatca

SEQ ID NO: 8363 - DNA, 764 bp, Lactuca sativa
  Predicted polypeptide sequence is orthologous to G137, G145
gaagagggagagtagaactgaagagaatagagaacaaaattaaccggcaggttacttttgctaagagaagaaatggacttctcaagaaagcctatgaactctcagttctctgtgatgctgaggttgctctcatcatcttctctaatcgtggaaagctttatgaattctgtagcagttctagcatggtgaaaacactggagaagtaccacagctgtagttatggatcattgaaagccacccaaccagaaaatgagagccagtataactaccatgaatatctgaggctaaaggcaagagtggaagttctgcaacggtcacaaagaaatcttctcggagaagatttgaccccattaaacaccaaggagctggagcaacttgagcaccaactggagatgtctttgaggaagatcagatcaacgaagactcaatgcatgttggatcagcttgctgaactccaaagaaaggagcaagttcttgctgaaacaaataaagccttaaggaaaaagttggaaaaaaatgctcaggaatttccagttaggcaaatgtgggaaggtggagcacaaaccattccgtataatccccttcctacacactctgacgatttcttccagcctcttggattgaactccaccatgcacaccagtttcagtggattaagatataaccctattggctccgatgagatgaacgttgctggtgtcaatggaaacaatccaaatgggttgtttccaggatggatgctgtagtagaagaattgcatcacc

SEQ ID NO: 8364 - DNA, 846 bp, Lactuca sativa
  Predicted polypeptide sequence is orthologous to G1382
cggggaccattttccgcctggatgaccaacattctcctcactctcactcctccaccaccgccacctccaatgtcgatgttaccggtcatcgcagacagggaggaggagatgttttcggactcagatccgccggtgccggtggtggtgctaaatacaagctaatgtcaccagctaaactccctatctcaaggtctaactccatcaacgtccctcctggtctcagccctacctccttccttgaatcgcctgtcctcctgactaacatgaaggccgaaccttctcctaccacaggttctttctttaattcctcactgatgcaaaggtcaatcaccactgctgcattctctttagatgcaaattgttcttcaagaaagcccttggatgatagtaactctggtttctttgagtttaaaccacacacccaaattacatcagttccacaaagttcttctgcaggatatcaggtttctacaggttcaaatcttcaaagaggagaaccaagtgggcaatatcaaaaccaaagtgagcctcaatcatacgcatctgcatcttcatctgcttacatgtctcatgaggaaacaaacggattggggaagcataaagatgcgggacccacgatccaagttgacaggtcatcagatgatggatacaattggagaaaatacggacagaaagttgtgaaaggaagtgaacatccaagaagctattacaaatgtacacatccaaattgtgaagtgaaaaagatttttgaaagatcttatactggacaaataactgagattgtgtataaagggacacatgatcatcctaaaccccaacctagtcgccgatttagtgctggtgctc

SEQ ID NO: 8365 - DNA, 554 bp, Lactuca sativa
  Predicted polypeptide sequence is orthologous to G1419, G43
gagatcagggatcctagcaagaaagggactagggtttggcttgggacttacgacaccgccatagatgcagcaaaagcgtatgataaagcagcgtttaagcttcgaggcaacaaagccttattgaatttcccgctcgaaattggaaattcagaggaagcggcggaaacggagacgagggtggtgacgagtaatagtcgtaaaagagctgccggaaagtctgagttggaagtgagaggaagtcggaaagaagtgaaagtagaaccagacacggcgaagtacggtggtgataaggctgatgctgcggttgggtccttaacatttgaaaaggtcccattattatcatcatcttatcctgccatggacttcacgtccggttgtatgatcaggagtaatggccctaaaagcgttgccggacagtctgtggtggaagtgagaggaagtcggaaagatgtgaaagtagaaccagagacggcggagtgcgacggtgataaggcggatgcagcggttgggtcgaccatatcgccgacaaactggacgccggacgataacagtat

SEQ ID NO: 8366 - DNA, 246 bp, Lactuca sativa
  Predicted polypeptide sequence is orthologous to G145
cccactttacaaatcggaaatgggtatcaaacggattcactaacggcaggagcaggagcagggccaagtatgaataattacatgcaaggatggttgccatgttaaaaagaataacatatataataattaattatggtatgggtttgtgggcataaaaaagatcccatgcatgtgtgcttagttaactgctatatattgtaagttatttggaacaaatttatgtcaacagaattaagatcagaaaaa

SEQ ID NO: 8367 - DNA, 412 bp, Lactuca sativa
  Predicted polypeptide sequence is orthologous to G1451
aggtgagggtagatgtttggtgtgtgtgtgttttgtaggtttataaatcggggtgtgtagggaggtcattggacatgagccgattcaacagctaccatgagctgcgtgaggaattgggtgaaatgtttgggatcgagggtttgcttgaagaccctcaaagatcaggctggcagcttgtattcgttgacagggagaatgatgttcttctccttggagacgacccttgggaggcatttgtaaatagtgtctggtatatcaagatactatctcctgaggatgtgcaacaactcgggaagcaagaagtggaatctttaggaggaggccaaaactcgggtgaaagaatccacagagaccatctgtctctttcgggacttcctccatcgatggggtccgggtcacttgatttttgacc

SEQ ID NO: 8368 - DNA, 734 bp, Lactuca sativa
  misc_feature (103)..(105): n is a, c, g, or t
  misc_feature (269)..(271): n is a, c, g, or t
  misc_feature (438)..(440): n is a, c, g, or t
  misc_feature (517)..(517): n is a, c, g, or t
  misc_feature (611)..(614): n is a, c, g, or t
  Predicted polypeptide sequence is orthologous to G1451
tcgttattattcggttcttgatcgatggagcactctcgacccggaaacggaggtaaagaaaccgcggtttgtgaaaggtttgtgttttgggcgagacccgtannnggtgggccgagttgctcgacttggtgaagaagagattgtgaagctccagatacaagtaacgggtcaaccgcgacccgtttcgcgggccaacccgtggaagtcaacaaggaagcagagcgagggatgttaagaagttgtgaagtttcatcgtgtgaaaacgggcnnnaaaggtttccgtttgaatccgagaagtttgactgagaagttgacccgaattgacccattgtgaatgggttttggggttgaagttgggggagaagtgacacgtgttggttttcaggaatgaaagcgggttgactcattgacccggttggaatcggttggtgttggaannntagaagtgatgggtttgactgtttgaccgaatcaatactcctcatttcttggagggcggccgccgccatggcttggntagatatccgtggtggtttgcataccgagcatgccaatgccaccaccaccgccgccatcaaaccgtggctgcaaccacggcgaacccccgagtnnnntaaagttgagagattgaccaagatcaccgccaccaccaccgccaccaccaccacgaagccacattatcggcgagtatcaatggccactcttctttcatcctctctcgtcttctcaatctc

SEQ ID NO: 8369 - DNA, 923 bp, Lactuca sativa
  Predicted polypeptide sequence is orthologous to G1451
cttctgatccatttttcctccattatcacttccacttctctctactctactctctgcttcaggtcgactatggtcggtcggatcgggatccaatatccaccccctatataaccccttccatgctccactctctctcctttcttttcactatttttttcaactttttcgatagcgatcggggacaaaagttcactcatggcgatgtttcagaacaaccactggttttctgagctcggttagttagggttttgctttttagctatgggaggggggatttttagctttggaataatgcatgtgaaggttaggtgttttagactttggaggaagcgattgagctgataattaaaaggagtgaatgttgattcagcagtttttaggggtttaggattcgacgatcgttaagccccgagaagctgctgcactgaggattcgtttagctcatgcttatgaaattagttaattaatagtaatacacatatttatataataaggtaagatttagataaaataatatgaagctttcaacatcagggtctggtcagcagcctcaagaaggagaaaagaaaagcttgaattcggagctatggcatgcttgtgcaggcccgcttgtttccctaccgacagtaggctcccgtgtaatttatttccctcagggtcatagtgaacaggttgctgcaactacaaataaagaaatcgattctcacattcccaactacccaagccttcctcctcaattgatctgccaactccacaatgtcacaatgcatgcagatgttgagacagatgaagtgtatgctcaaatgacattgcagccattgacaccccaagagcagaaggatacatttcttcccctgtgagtgggtattccagtagacaacaactaattacttctgcaagacattaacagctagtgacacaag

SEQ ID NO: 8370 - DNA, 717 bp, Lactuca sativa
  misc_feature (705)..(705): n is a, c, g, or t
  Predicted polypeptide sequence is orthologous to G1451
ggcgggcaggatcttctgagctgctgcatgcgacgacaggagcacaaattgacccatcaaaccctaatcgtacgtttgtcaaggtatacaaatcaggttcggtggggaggtcactggacatcagccggtttcacagctacccagagctgaaggaggaactggaacagatgttcaatgttgaggggctgcttcaagaccctcaaagatcaggctggcagcttgtattcgttgacagggagaatgatgttcttctccttggagacggaccctgggaggcatttgtaaatagtgtgtggtatatcaagatactttctcctgaagacgtgttgaaacttgggaagcaagagttggagtccttcactcaaaactcaggaggagaaagaattgggaatgatgggcatgggcatggacatggggggagagagctttctggattgcctccttccatgggttcgcatgatttttgagaaaaaaacccaaacccaaaaccaagactttgtatttgtcgtcttctatttgatgcgctctctctactctactctactctactttatgtttatgaagattgacactcctatttatttattttctaggtcggttgttattagttttgtgtatcctggttggttatttagtaaaatgtttagacaagacaagactctactattattgtgattccaaggaaactttatcaaatcatcaatncatcatcaatgt

SEQ ID NO: 8371 - DNA, 898 bp, Lactuca sativa
  Predicted polypeptide sequence is orthologous to G1451
cattcggccgggggcagaattctcattggagatctgtaaaggttggatgggatgaatcaactgcaggtgagaggcagccacgtgtctcattatgggaaattgaaccactaactacttttcccatgtatccatcactttttccacttcgcctaaaacgcccctggtatcccggagcttcatcttttcaagatagtagagatgatggggttaatgggatgacatggctgagaggggaaccaggggaacaaggattgaattctctaaacttccaatctgttggcatgtttccatggatgcaacaaagggtagatccgtcttttcttcaaagtaatctgaatcagcaataccaagctgcattagctgcaggtttacagaatcttggaagtggagatgctttgaagcaacaaatactccaattccaacaacaacagcaacagcaacaacaacaaatccagtatagtccttcaggcacttctaatccacttttccaacaatcacaacaactaatccctcaacaattcgtccatggtcaaacccaaatccaacaagtcaacactcaaccagaagaacacccacaaccacaacaacaacaacagagttcgtatccggaatcttacttgcttcaacaccatgagaggccacaatcccatgcttttatggacccgaataccaaatttgcccctccttcaatgcaaaacatgttgggttctttaataacatctgaaggaagtgggaatcttttgagtttttctagggcggggcccactttgactgagcagcatccatcgaaccagaaccaaaaccaacagtcttgggtttcgaggtttgctcagtcacaaccgaatttgtcgtcttcttcacctgctccatcattgtcatatcaagagaagaatgttga

SEQ ID NO: 8372 - DNA, 937 bp, Lactuca sativa
  misc_feature (821)..(821): n is a, c, g, or t
  misc_feature (845)..(845): n is a, c, g, or t
  misc_feature (871)..(871): n is a, c, g, or t
  Predicted polypeptide sequence is orthologous to G1480
gcggggaagaactggacatggctgcgaccctttgtgattcctgcaaacaacgtcggcagctttgttctgtagagcagactccgccttcctctgtataccatgcgacggcaaggtccacgcggcgaacaagctcgcgtctcgccacgcgcgtgtgtggatgtgtgatgtttgtgagcgagctccggcgagcttcacctgtaaggcggacgctgccaccctctgtgttacctgtgaccgcgaaatccactcagcaaaccccctcgcccgccgtcacgagcggtttccggtggtgccattttatgatcctgcaactgccgtgtcgaaggtaggtggtggaggtgataatgataatgataacaacgaccaccatttcctattggattttgatgttaacgtcgccggaactgaagctgaagaagcggaagctgcttcgtggcttatcccagatccaaatataaacaaaatcgttgatggatctgaggatgataataaatcggagtacttgtttaacgagatcgatccataccttgatatagatctgaaaacgccggatcaaaaggctaatcagatcattcgcagatacaattccccaaccgatggagttgttccggtgcaaaacaagatcgaaaatcgccattaccagatgccaccacatgcacatgcttcttctccagatgtagtggagggattacctgcatatgacgtcgattacaccggatctaagcctttcatgtacaacttcacctctcaatccgtcagccaaagcgtatcatcatcttcactggaaatcgaagtaggcgtcgtaccggaccacaacgcanacgcaaccatggcggatgtatcanacaaccaccaccacccatcattaccnggagtatatccgactcctgtgtcgggtttcgatcgtgaagcccaggttttaagatacaagaaaaga

SEQ ID NO: 8373 - DNA, 883 bp, Lactuca sativa
  misc_feature (851)..(851): n is a, c, g, or t
  Predicted polypeptide sequence is orthologous to G1480
ctccggcttcctgttgatcaatgcaataaaagattccacagagagcaaaactgttcaacacttcaactaccaaaattcgaagaacatatatatcatgaggatgcagttggaaaccggtggtggcctcaagtgttttccggcgggctggaacgcgccggcgaagccgtgtgattcgtgtaagaccgccgtggcgttgctgttctgccgtaaggacaccgtgttcttgtgtcttgcgtgtgatgtgaagatgcatggcgacgtatgacacgaacgtgtgtggatgtgtgaggtgtgtgaacaggcgccggcgagtgtgacgtgtaaagcggacgccgccgcgctatgtgtgacgtgcgacagagatatacattcggctaatccgctttctcgccgacatgaccgggttccggtggttccgttttatgattgtgctgatatcctgatgaagtcctccgcctgtaacttcctcgaacttagctccgggaacgggaatgatgatatgaacagttctgtaacaaacgacgacgatattaattggggaattccggcggatacaatcaatatcgatgttaaatttcctagcgacgatagttctccggtggatatcaaatcaatcgaaatgttatttccggaatccgatcacctccttgatttcgatttccctgttccaacggacacaaaattccacagccacttccataatcatgattcagtgaacgacagtgtagttccgttccacgtgtcgccgccggcgaagcattttccaccgccaccggaaaatcaaaatcgatacgagattgatttcaccagatctaatatcaattcccttcacaaaaacagttatctctctncatcgctcagccatagtgtaaacatctaatcc

SEQ ID NO: 8374 - DNA, 852 bp, Lactuca sativa
  misc_feature (809)..(809): n is a, c, g, or t
  Predicted polypeptide sequence is orthologous to G15
gcgggcagatacgttgctcacttgagaagagaagcagcggtttctctaggggagcttcaatttatagaggagtaacaagacaccatcaacatggcagatggcaagctcggattggtcgtgtggcagggaacaaagatctttacctaggcacatttagcactcaggaggacgctgcggaggcttatgatgttgctgctatcaaatttcgtggtgtaaatgcggttacaaactttgatgtgtcaaggtataatgtggaaaggatcatggagagcaatacccttctatctggggaactagcaaggcgaactaaagcacgagagcccatgaccgaggttgtggctaacgaagctcataatggtgaacacaaaaccctctcgaatgatgtcaccagtgatggtagcatgttggaatggaaaacggaagtatatgagcaaaacagtggtggtggagttgagggagatgagtcgtcgactatcaagaacaatggggactccggtgaagaatgcatgaaaaggaacaagaatcttccgatggttcttgggatgccgccggcgatgaatacatggatcccgactgtagctgcgacaacgacccaactgaggtctcatatgccgatttttgctgcatgggcagatgcgtagttgacgatggagacgagaaagaagtcttaggtcctgtaggatgtgacgaacccctaacaagctgacatggcgatgaactacggtgtttgtgttattttacttgctttatgtatgtgttagttttggttctttttgtgttttgggaaaatgcatggaatgataatttgnggactatgtaggatttttgtagacgatgggggtttgaactttc

SEQ ID NO: 8375 - DNA, 859 bp, Lactuca sativa
  misc_feature (793)..(793): n is a, c, g, or t
  Predicted polypeptide sequence is orthologous to G154, G1797
tatctttcttgaacaaaatcttgttgtaagagttgatagttttagctaaggattgcacctttttcgatctttttctattatggtacttgtgaaaaccttgtcttgattcaagaattgatatgggtatttgaggttggtgttttgttgatggatcttgatcgcatataaagattcatggttccatcaaacaaacctgtattttctgtaacttgaacatgcgaccataccactttcaaccacattaagaagacttgacatttgattggttatcagttctgaccttttttataacttcttttttgaatagagtgaaaccttaaattttttggaagatggtgagagggaagactcaaatgcggaggattgaaaatgctacaagtagacaagtgaccttctccaaaagaagaaatggtttgttgaagaaagcgtttgaactttctgtgctttgtgatgctgaggttgctttgatcatcttctctccaagaggcaaactttatgaatttgcaagctcaagcatgcaggagacaattgaacgatatagaagtcacgtaaaagatgttcaaacagaaaattcttcgagtatagaagatgttcagcatttgaagcatgaaacagctactatggcaaagaaggtagaactcctagaagttgcaaaaaggaaacttttgggagaagggttaggatcaagcaccattgaagagatagttcagattgagcaacagctggagaggagcgtacgcattgttcgagcaagaaagatgcaagtctacaatgaacagattgagcaactacnagcaaaggagaaactgctagcagctgaaaatgcatcacttactgagaagtgcttaatccaaacaga

SEQ ID NO: 8376 - DNA, 815 bp, Lactuca sativa
  misc_feature (734)..(734): n is a, c, g, or t
  Predicted polypeptide sequence is orthologous to G157, G1759, G1842, G1843, G1844
gcgggggattttgtgagagagccggtgatcagaagttagaacttagggttagaagattgattcatccatcggccgggagagagaaaatggggcggaggaaactcgaaattaagcggatccaagataagagtagcaggttagtgacattttcaaagcggagaacaggattatttaagaaagcacgacacctgtccgtgatctgtgatgttgatgtcgccgcttttgtaatctccgatagcggcaagctctatgagttctgcagcggtggctataatagtaacagtgtggagcttatcctttccaggtatcaggcagaagagagaaccacccaagaaggagcttttgaagatatggcatttaacaagtccacaagattccgaacatgcaaagagcttctaaagtcagtgagaagggttgacgaacaaccaaatgaggtctctgtgagtgacatgacaaagttagaggaggaacttcatgctgctcttttgcatacaagatctaaaaagactcaattgatggtggagcgtatgtcgacctttcatgaacaggtaaggaaattaactgaggaaaaggaagaactgaaacagcagttacaggtggcatcagcaaagaagaaccagaaagatgatgttgatgacgatggtggtgaaggtcttgaccactctgcaaatagccatagttattaccagaccaatctatatccaccacaaccacttttaacactccctctcttncaggagtagatgatgttatgttatattaatcaactaattcaaggaatatatagatcgatgatgtctttagaaagccacgtg

SEQ ID NO: 8377 - DNA, 732 bp, Lactuca sativa
  Predicted polypeptide sequence is orthologous to G1646, G715
gagagaaagagagggggagagagaaccgtcgcaatggagaacaccaccaccacctccgccgccaaccaccgaccctccgccgctaccgcaacgccaccgcaaccctccccattcccaccaccacaacaaccctatcaacacctcctccaacagcaacaccaacagctacaaatgttctggaattaccaacgccaagaaatcgaacaagttaatgatttcaagaaccaccagctccctcttgcacgcataaagaatcatgaaagccgatgaagatgtacggatgatctctgcggaagcaccgatcctgtttgcgaaagcatgtgagcttttcatcctcgaactcacaatccgttcatggctccacgccgaagagaacaaacgcagaaccctacagaaaaacgacatcgccgccgcaatcacgcgaaccgacattttcgatttcctcgtcgacattgtgccgcgcgatgagattaaggatgatgtttccgccgccggtactgggttgggagggattgtgggcaccgccggtggtcttccatattattaccctccgatggggcagcctgcaccgccgcctccaggtgtcacgatgggacgaccggctatggatcctaccggaatgtatggtcctccgtcgcaagcatggcagtctgtgtggcagaccaccgatgatgggtcatatggaagcggagggagtgctggacaaggggcatcgacggccaaggggacgct

SEQ ID NO: 8378 - DNA, 748 bp, Lactuca sativa
  Predicted polypeptide sequence is orthologous to G1777
agcaccatgcacgtacactacttatacattatcgttgggatgttgagaagatatttgcagtgcttgtagagaagggaaaagatcgtttatttaaagaggctggcttacctatgcttcactctcatgaccttgatccttcagtgtctacttgtacaacaatgtgtgatatatgcatggaggacttgccatctagtgagcagacaaaaatggattgtggccactgcttttgtaacaattgttggacagagcatttcattgtaaaaataaacgagggacagagtaaacgtatccgatgcatggcccacaaatgctatgcaatatgtgacgaatccataatccggaatctagttggcaaaaggcatccggatttggtagaaaaattcgatcggtttcttctcgagtcatatatcgaggacaataagatggtgaaatggtgtccaagcactcctcattgtgggaatgcaatccgtgttgaagaagatgagttttgtgaagtggaatgttcatgtgggaatcaattctgtttcagttgcttatgtgaagcccattccccttgctcatgtgcaatgtgggcactctggactaaaaaatgtaaggatgaatcagaagcagttaattggattacagttcatacaaaaccatgtccaaagtgtcacaaaccagttgagaaaaacggtggctgcaatttagttagctgcatctgtggacaagccttttgctggctatgtggtggtgcacggggcgcgat

SEQ ID NO: 8379 - DNA, 895 bp, Lactuca sativa
  Predicted polypeptide sequence is orthologous to G1808
gcgggggtcttaatccgccttccactcatcgtttcttccctttcctcctcctaccttcctccaccgtctaaaacgcttttccgatcatgttgtcttctgttttccccaccgacggcgaccatattccgtccgacgactttcttggaactgggtttaccccttgggacactgacactcatgaaagtccctttctttatccacctcaagagcctgtcttttcgttttccggctccgacgactccacgccaaaaaccaacagctccaactccggctccgacgagggagacgctgaccggaatcctattgaagtcaccctgattgatgaacgtaagaggagacgcatgatatcaaaccgggagtctgcacggagatctcgcatgagaaaacaaaagcacttggagaacctgaggaaccaggtgaaccggcataagactgtgaaccgagaaataatgaaccggttacggtttgtaagccatcatgcacaagttataaggcaagaaaacgagaggctccgatcggaatcagtgatgctccggcaaaaactatgggacatgcgtcaagtactgctcgtccggcagcttcagaaccagttattatcgtctgcatggccatgcaataataacgtgacaaccatcaatgaacaaaacccacaatcgttaattacataaagctttatatatatatttcatatgaaattaaatcgtaactaagtgcatgagaacaatagcaactcaccctatatatatatttgtaaaggaatcgatcaagtagttggaggaaggtaattatcaagtaatggtaattttaagtcgttatttttgtcttggttttcgtttcttttttagttggtttttggaaaatgaaggttttggtagaacggatggttgtttttgtc

SEQ ID NO: 8380 - DNA, 718 bp, Lactuca sativa
  Predicted polypeptide sequence is orthologous to G19
gttgctatcaagaacaaaactatttcaaagcacaaaaaaatctttaacgaagaaaaatcacaacctatcgagaagaagccaaaagcgaggaagaacaagtacagagggatcaggcagcggccatggggaaaatgggcggcggagatccgagacccacagcagggtgtccgagtctggctcggtacattcaacaccgctgaagaagctgcgcaagcctacgatgaagcagccaaacgtatcagaggtggtaaggccaagctcaactttccattaccaccggcgaagaagctgcgcactgagtcgactcagtcaaccgtccatgtaccaccatcaccacgaccccctacattactgagttacgaccagttccaaaaacaatcttactactcgaacagtgtggctgatgagcacgaattcaaggaacagatctcgaaccttgagacgttcttgggtcttgatcatgagttgactcagtttggtggactcggtggtgagtcagcaggtgatgtttggacgttggatgacttcccggttatcatctgagttgtttccgaataaactgagttgagtgagtgagaacccagtgagttgagtttaattagttcctatataaaacgtaagactcgtgttaatggggtggctggtggtaaggttgacgaaataagttgtgtcgccggcggcctacgcttgcggcacacaccatatccatatatggggg

SEQ ID NO: 8381 - DNA, 709 bp, Lactuca sativa
  Predicted polypeptide sequence is orthologous to G1950
ggccgacagaaatggagattgatccacaatatccagaacctgaagcagacaaaactgaaatcattaatgacgacgatctcttcagagccgccgacaacggcgacgtttcatttttcaaatccctctctcagccgcagctgttccgttgtctcgcgcttcgcaacgaagacggacgatcgctacttcatgtcgccgtttcttcagcccgcaccgaggtggtgaagatacttgcagcttttgatcactcaatcagtggcattaacagtgctgatgaagaaggttgggcaccacttcattctgcatcaagcagtggaaatgttgagatcgtcaagattttgctggatagaggagctgatgtaaacttgaaaaacaatggaggtcgcactgctcttcactatgctgcaagcaagggttggttaaaagtagctgaaattcttctttcaaatggcgcaaagatcaattcaaaagacaaggtagggtgcaccccattacaccgggctgcaagtacagggaagtcagagttatgtgagcttttgattgaagaaggtgcagatattgatgctgttgatagagcaggacaaactcctattatgagtgcagttatatgttataacaaagagatagctcttttactcatcagacatggtgcagatgttgatgttgaagataaggaaggatacactgttcttggtagcgcatcagatgaatt

SEQ ID NO: 8382 - DNA, 613 bp, Lactuca sativa
  Predicted polypeptide sequence is orthologous to G1950
ggttgttaataagctctttttatcttgcgaataattcttaaaggaatctaaatcatcaaaaggaaccgaaagagacttcatgctagcttttgctccatgaccgattaacagcatcgccacctgaacatgccctccctccaccgccctatgaagcggcgtgtacccactaccatccaccacatccacccgaccaccatgattcagcaataccttcaccccttcaaaacaacccttaaaagccgttttatgcaacgccgtccacccattctgatcccttccgttcaccttcgcaccttctgctaaacaattcttcattccattcacatctccttttcttgctgatcgatgtaaaacatctcccaaatgtaacatatcgtaaagatctgtatgctcgttttcaactgcaagatcgaatgcagtctttccttctttagttaccgcatatttcacataactgatacagtttagccggaattcaaccgcttctgaatgaccttccatagaacagcaatggagggcagtccagccgttgtgatcggctaaatcggggtcgcttcctagagtaatcaagaactcaagtactttcatatagccatgacatgcagcaacatga

SEQ ID NO: 8383 - DNA, 303 bp, Lactuca sativa
  Predicted polypeptide sequence is orthologous to G1990
cacccattgttgaggtaatccgagcttactccatactctaaaaaacatttataaaactgacccaagaagaagaaagaagaagaagatttggatcatctactctacttgaattgaagtaggttttttcatgttcttcttcgtgttctctctcgtatgtaaagtgttgattttttttttctttgtaatttattacatgttggatgctatgcatttgtaaaaaactcaaggacagttggcgtgttttgattcgtcggtgtcacgtaaataaaattcaacaggaatattttttctgttttttagtac

SEQ ID NO: 8384 - DNA, 934 bp, Lactuca sativa
  misc_feature (872)..(872): n is a, c, g, or t
  Predicted polypeptide sequence is orthologous to G2
cttggcggggattcgcatttcatcatcaaatggctagatagaaattataagactcgaagaaggacgttgtttcagcgttgcaagtgttttggttattgggtattgactttgaaaaagagaagtaatgtgggatctaaacgggtctcccgatcggagaaggagagacgaagacgaaggtgaggggtgttcttcagcgccggtggtaggggaggaggaatataataatatcaagggtaaaagggttggaggatccgtgtctaattccagctcatcgatcatagttgtcgatcaggacgacgggtccgacgtcgatgaggattccgacgccggtggtttacagaaactcacaaccaccggcgatagcaggttattcgggttctctatggccgacaactcatcctgggactacaatccgccggtcactcatcagttcttccctttggacgactctgaagttgggtctaccaccttcgtcggagcaggtagagagacgacgtcgttgcccactacttaccctacgtctaactggtttggggttaaattctcccacccgtcatcggagccttcatgtttcagtggtggtgttgccggtgggaacaatggattttccgggaaggtcaccgatgttcctcagccactcaagaaaagccgccgtggaccccggtctagaagttctcaataccgtggtgtcaccttttaccggcgaaccggccgatgggaatcacacatatgggattgtgggaaacaggtgtatcttggtggatttgatacagcacatgcagctgcacgtgcttatgatagggcagcccatcagtttcggggtgtggaggctgacataaacttcattcttcaagattatgaagacgacctanaacagacgagcaatttaacaaaggagagtttgtgcatgtacttcgaagacaaagtactggtt

SEQ ID NO: 8385 - DNA, 751 bp, Lactuca sativa
  misc_feature (661)..(661): n is a, c, g, or t
  Predicted polypeptide sequence is orthologous to G2057
gctgctagtctcgagcatcaaactgataagtttcaaagaaagtggacgtgtggtggagtatgaaggtgagtacgctgcttgccatccggagttgtcgttgtttctgagacaggggcactcaactccttatctgcgacctgtgatctatatcatcattgactatctgttattctgcaagtctctgaggggaacccttgtatccttgaacacgccatcttttcgggctatggagtcgacccggccggcctacgctactccggagtcaccgtctagtctccgccccaccctatctttccatcaccatcattctcatggccagtttcacctccggatcacgtgggttttccgggtttcgtattccagcacgaattcaaggtgaagaggaggaacacgacggcatctccgataagccgtcctctgcatcctccgattctcgccattgaatcatcttcatcctccataatccctctcaaacaggaaaatttacgtcaatcaatgtacttcaaagcaaagagaggaggggagaagcttcaatggctgctacacagtgggaaaaagaaaccgaatccattcacaggttcttcagtcatcactggtgtttttacgatttagctttcatgtttgaatagagctctttgtttagctctaaaccctgttttanattatctggatttaatgtttttagaccatgtatgtgactgtgccaattgccttcttttgctatataattatcaaaaatactctgctaaaa

SEQ ID NO: 8386 - DNA, 956 bp, Lactuca sativa
  Predicted polypeptide sequence is orthologous to G2144
gcggggatcttcattattgtgtactttgatggagaaacatgaagaaatgggggttgaatcgtttcaattcggcgaagatgatattcagagcctcatgtcggtggtgccaccgcctgagcccggcaattctttcacggctctccttgaactcccaccgaaccaggctgtcaagctcttacactcccccgaagaaaccacaccccccgctattttccccccttcggtgtttccggccatggaaaccgacaattcactggagacgacgagctcaattctcccaaattcgagccctaattactgcaatttggtgaaacaagaaccgattgattctgattctctgcataattcatcacctatacagtcagatccgattatcccgaaattaacgaagcgcaaggagcgagagaagaaggtaaaaccatcggtgaagaagatcaaaaacgtcgcaaatgagaccgacagtgagaagcttccgtacgttcatgtccgtgctcggcgaggtcaagcaacagatagccatagcttagctgaacgagcaagaagagagaagattaatgctaggatgaagctccttcaagagctggttcctggatgcaacaagatttcaggtacggcgatggtgcttgacgagatcatcaatcatgtacaaaccctgcaacgccaagtggagttcttatcaatgagactggctgcagtgcacccttgtatcgatatcaacctagacaacatcttctctgcagagagtgggtcacttatggactgtagttttgctggcatggtttcactagatggacaaatgaatggaaacagccacaaccaccaccaccaccaccagcagttatggcagcagcagcagcctgatgggatgccactccaggaactgtggggtgggaaagacctccactgcaccctaatttcttgacaccgatgactcccttttaggtatgactcatctg

SEQ ID NO: 8387 - DNA, 714 bp, Lactuca sativa
  misc_feature (617)..(617): n is a, c, g, or t
  Predicted polypeptide sequence is orthologous to G2226
ggctggaaattcttaaaatcccatctcaattcaacaattccaaccacaatccgcttcaaagttaagcaacgaaatggggctctcgccatactcaaacccatcggatgcaggagtgttgtgcgtaattctggttaacacagctatgtcgatatcaatcatgaaggaaatagtttgttcgattcttcatgtggtggggttacgtgtagcgtcatcaccgtcatcatccaatcaaggctcgccggaagcttctgagcgccggggaagtccgtcggagacgtacatggaggagttcagaagccggacgccgtcgctccgttacatctccctccgtcgtcccaccaaacaagaatgctccgtttgcttaacggagtttaaaccagattcagagataaataagctttcgtgtgggcatgtttttcataaatcctgccttgaaaaatggctaaaatgctggaacattacttgccctctctgtagaaaccacatgatgatttctaaagaaatggaagaaaacaacacttgcccgatgtgaagaattgaaatcaaaacttacactttttgtagatatcatcaattgtgtaaggtttccggtggtttattcatctgagaaactgatnaactttggttatttttttctcgtttatcgagttttctttgacgaaacagatatattctgtttctttcatcatttatgccacaatattgaatgatcat

SEQ ID NO: 8388 - DNA, 598 bp, Lactuca sativa
  Predicted polypeptide sequence is orthologous to G2251
gcggggatttgataactccactgtttctcttttctcaatcaaatcaaaaaccttcaaaaacatgggagcactttctcgattcatagctcatgtctacacccttttcttagtattcttcactgtcctcttcctggagctcgtaatcttggttcgctcagtcgccggaagtattggttacacgacggcagccgacgaccacccaatgaccaccgcccagtacctcaaattgattgacgaaaaaaacccagcgagtcggtacaaaaccgccggattagaacgtaaagagtgttcggtttgcctttctgtattcgacgacggcgatgaaatcaggagattgaaatgcaagcacacgtttcacaagggttgcgttgataagtggctggagcaagatagagccacatgtccgatttgccggagtttggtgttgccggaggcgatcgtggttaaatacagtcaacgacatcagattcctctgcatcgccgccgcagggagttttacggtggtagcgatgaggagctcatactcttgttgacttctttacatggtaattatatgcgtagattcatgtaattagtttgtatttctaactttagtgat

SEQ ID NO: 8389 - DNA, 739 bp, Lactuca sativa
  Predicted polypeptide sequence is orthologous to G227, G242
gctataaccgtgggagacggcggcattagctgcatcgggattgccgttggcgtatcgctcgtttcgactccgggaagtgaaagactcaacgacgttagagggtcgttcgctggctgtggagtcggggaacgcggtgacaacgatgttggaatttcgatctgctgagggacgctggcgcagggccgagaaacagggcggaatgacatcgccggcggactggaatcgctgatatcggatcccgttgggctacccgggttgaagaaaagacctgaaacggcaaccgctgagccggcactgacagagcgtttcaacgatggttgttgaatcgcgaagtcattaaactcttcgttcgtcatcgacgaacatttccgtttcaaagtcgagttccagtggtttttaatggcgttatcggttcgaccggataaaagccgggcaatcgtagcccatttgttaccaaaccgggcatgtgcccgaaggatcgtctcatcctcctccggagtaaaagcacggtgttccacctgcggcgacagctggttacaccaccgcagccgacaagatttccctgatctaccagggatagatttgctgataagcgaccaatttctcgggccatgcttctcgacagttgctgaagcaactcatcttcatcggggctccatggacctttgattccggccatatctttcttcgaattgtttcgcataaatgcaaaaatctgttgattttcagtgagaattca

SEQ ID NO: 8390 - DNA, 933 bp, Lactuca sativa
  Predicted polypeptide sequence is orthologous to G227, G242
cgggactttctttcgttcatattcaaaaattctatctcataagtcataataagttcctgaaatcagtcggttttgattttgattctaaaatgtttatgggttgtaatactccgaagaaggatatggatcggatcaaaggtccatggagtcctgaagaggacgagttgcttcaacagcttgttgagaaacatggtgcgagaaattggtcgttaattgggaaatctatacctggtagatctgggaaatcgtgtaggttacggtggtgtaaccagctgtcgccgcaggtggaacaccgtgcgtttacgccggaggaagacgagacgattcttcgtgctcatgctcggtttgggaacaagtgggcgacgattgctcggttgttgtcaggtcggactgataacgccattaaaaaccattggaactcgacgttgaagaggaagtgttcttcgatgacgaatgaagagtttagtgagtttgctattcaacagccttcgttgaaaagatctgttagtgctggttcggcggtggctgtttctggtcgttatttgaatcccggtagtccgtctggatctgacgtcagtgattccagcgttccggcgatttcgtcgtcgcacgtctaccggccagtcgctagaacaggagcggttgttgctccgcaaatcgaagtagcaacgtcttctcctccgcctccgcctccgccgcttcaaacgaaagatcctccgactttattaagtctctcgcttcctggagtcgaaaatgaagagtctacagctgctccgacgccgatgcagttaatgccgccatcgccggtagcaagtcctttaccacctccgcctcccacctcgccagttcctatccatgctatgccgttgcggcaggtcccagtcgatcgttacaaaaacataaacctaaaccacgcagacctcatgtcatcga

SEQ ID NO: 8391 - DNA, 881 bp, Lactuca sativa
  Predicted polypeptide sequence is orthologous to G227, G242
cggggacttcatttttcccataaatctttcatggatcccactacaaaacatgttgatcgtataaagggaccatggagcagcgaagaagacgagttattatgtaagttagtaaatcaacaaggagcacgtagctggacatcgattagcaagtcgattccagggagatctggtaaatcatgtcgtctccggtggtgtaaccagctgtcgccggaggtagaacatcggccgttcacggtagaggatgatgaggttatcatgaaggcgcatggtcagttcgggaacaaatgggctacgatcgctaggttgctcaacggacgtacggataacgccgttaaaaaccactggaattcgacgttgaagcgcaagtatgcggcggcggacggcggagatggaggtgagagaaatccgcggatgatgaagatgacggagagagatgtcaatgcgaagatggttgcggttgcggttacgattacgaactctggtagtttatccggatcagatgtgtgcgatccagataataatattccggcaccgtacgccggagaaacatgtataacgtcaccgggatttcgacagaaggttgaaatggatcctccgacggcgttaactctggcgttacctggaacaggttcatattcgtatgagatctgtgatgaagtgaagaagaagatcaatgcgacatcgtttagcaatgagattctttcagtgatgcaggagatggtacgtaatgaagtgaggaaatacatggagtgtgaagaagggttgatgcaagtgtgaaacaaaagtgatgaattttgttaattaaaaaaaactaatagtgaatatatagagcttgttgttcgattcaaattattcttgagttaacatgaagagaacgagtt

SEQ ID NO: 8392 - DNA, 735 bp, Lactuca sativa
  Predicted polypeptide sequence is orthologous to G2394
ggaacgattgatcttcacaacttcgccgcaaatccctccgattctttgctagtttaatcgcatactcactggttagtctttcctctttgttcgcgtatgattcttcccataaaatcagctcaaatacgcaagaagttgatgttttgcactactagggtttttcaattgtgagttctgatgacaccagttgtttcattgatccgttgtttacttacttggacgttttctctgaatacgtattagaaagatcagaattccgaagctaggttttgcgtgttgattagggtttacattaggagaatgttcatctgaaaatttctctgctaagttgtagttggtagatgggcgtttgtgtgttgggactacattgtaaagttgaaacaaagaaggaacaagacgtaatggagcgagcagaaaccagggaggacaatgggcatgtgattgatataacaactgaaccttcttcttcctctacctcaacacaagatagacaagtgaacaggtcaaacgcacagcagaatgaaaacctcccttcaaccagtgtaagcgatcctgtttttcagcattctttctctactaccaatgtgacaaatccaagaaatacaccatttgctaggagggcaaatgggacaaatggtcgtcgtaggagttcattgaattctggatattggatatgttttgaaatggttataacaatgagccaaataatagcagccattgtggttctgtccatgt

SEQ ID NO: 8393 - DNA, 915 bp, Lactuca sativa
  Predicted polypeptide sequence is orthologous to G2394
cggggacgatttcctgtatcctaacaaaattgatgcgatattgaagatttcgatgatggataagtatagttttagttcgatttttctagcttcgttgctgaatatgattaaattgatggcttaaaatcgaagccgtgatgtttgttcagctgaattcaagttgcgtgtgtctgtgttttaccctttcatgaaatttatcatcgaaggagaaggtataacattctatccagcttacatattgcaggaatcgtgaaggagactaaagcatctgttcttgataacgccaattatgcgattgtttcctccctaactttcaccaaactagaatggctgtaactgtaacccccgaagaacagaacatagaccatgcaacagacagtttccccttgctcatcgagagccgagtacaccatgaaaatgaacatataatcgatttggaaagaggtgatgatgatgatgatgatgatgcttcttcctcatcaaacgcatcaactaattctctttctcatggcttatcaaacagccctagagcttccacttctcaactgattcgatcatcatccagtggttcaacttcaaatggagttggaaggagaggagaagggtttgggaggcgaagatggagcccattcgacacactgctatggatttcaatcgaattagtgttcactttggggcaaatcattgcatccattgttgtcttatgtatatcacaaaaggagaacccacagactccattgtttgcttggattgtggggtatgcagctggatgttttgcaagtcttccatttttatactggcgatatctccatagaaatcaatctactgaaccagggtcaagtcaagctagacaaccaccttctgaagctaaccatacaccagaaacaaattcttatatcacaatctcctttgctc

SEQ ID NO: 8394 - DNA, 950 bp, Lactuca sativa
  Predicted polypeptide sequence is orthologous to G2550
ggagaatttatttctgctgctttggttctgtcttcgtctttgctccacttcacaggtattaccgcccacttctaaagggattatccaccagccattgaaatcagagatggctacttattatccaagttcctatctttcgacccaacaacaagcttgattctaatcaagaatcgccttgtcctccaatcgatataatgtaccagaatcataatatcaacagatgcctctttcttggagcttttgactactaatccgcagtcaaacccccaaaatctttcaagagttgaaaatcatcaaaacttgcaatatcaagaattgtccctcagtcttggaatgcaaataacttcttccatggatttgccttcgttccaatacaattacttgaatccccatcttcaagattctagtggccatggctctcgaagcaataaaatggagaacattgactatttgtcattcgatagggctgtgaacaatcaaattccatctggggttgtggcaagaatttatagttcaagatatctgaaaccatcacaggagttgcttgaagaagtagcgaatcttcatgaagctataaagcaattaaagatgaacaaacgtaataattttcagaagattggcgttgataggtacgatgaaaatggttcaagaattgactttcaatcagttcctcttgagtcagccaccagttcctctggcgagctttcggcttctgagaaacaggaccttcagaacaagattgtgaaactcttttcgttattagatgaggtagataggaaatacagagaatactgtcaacaattacgaatcgttgagggatcattagatatggtggctggttgtggagctgcaagatcatacaccgcgcttgctaaatcaacatatcgcgacactttcgttgtttgcgtgatggaattaacgaccaaattcaggtgatccgtcaaaagctc

SEQ ID NO: 8395 - DNA, 720 bp, Lactuca sativa
  misc_feature (678)..(678): n is a, c, g, or t
  Predicted polypeptide sequence is orthologous to G259
atggggtttgtggtttggcagccggcggagttcgccagagacttgcttccgacactgttcaaacacagcaacttctctagcttcattcgccaactcaatacttacggttttcgtaaaacttcaacaacccgttgggaattctgcaacgaaaggtttcacaaaggtcgcaaagaacaactctgtcaaatccgaagaaggaaatcatggataaacaagcctcggccaatcgcccaattaaccctgaaagaatcagatgaagatcaaagatcttcatccagtaattctttatcctcagggtacaacattctcgtggatgaaaatcataagctcaagaaggaaaataaagttttgggcttggaacttgtgagcataaaaaagaagtgcaaggagctcattgatttggttggtatgtatactagtagctcaagctcaaagaaagaagaggaggaagatgaaaggccaaagttgtttggggtgagattggaggtgcatggtgataaggagagaaagaggaaggggattgaagaggttggtgaaagtgcaagaagaattttactttcggtaaatgtaaacaaatagatatatagccacgtctttgatagaaagttgtaaagaaccgtcatgttaagatatgctatacgtctaaggtgtatgctatgttgtgcttgtcaaattcanaatttggaaacatgatcaagatttatgtttcatcgaaaaaaa

SEQ ID NO: 8396 - DNA, 759 bp, Lactuca sativa
  Predicted polypeptide sequence is orthologous to G268
cggccattatggcctgtatttcccgaatgatatatacaaagcagagtataaatattgggaaagaaataacattaagttatgctaatgtttttcgttggaggactttgaatgtacgaaatgtgatggatatgagggcaagatatggaggatttgcagcagcattgcatgatcatggggttgattgttgggttatgaatgttgttcctgttagtgatacaaatactttgcctgttatctatgatcgtgggcttgtaggtgttgtgcatgactggtgtgagccttttgacacataccctagaacatacgacatattgaatgctgctgggctcttctccatagagcaaaaaaggtgtagtatgtctagcataatgcttgagatgaatcgaatcttaaggccaaatggacatgtgtatattcgggatgttaattctgtgatttataaacttgaagaaatagcaaaggcgatgggatggatgacacatgtgtttgacaatggtgagggtcccaatgctggggtcaagcttttgacatgtgaaaaacgccttctataacacaaacagacacttctctcgtattcatattccttaaaagtatataccagatagctgctgcaacagttgtagccttaaaccttaaattgatcgttggaaaactcgagtaggaagtttgttgatgaaggaaaaaataattctaataaataggtagatttacttgtattctttatatggataaacgttgaattgaatatattaattgatt

SEQ ID NO: 8397 - DNA, 726 bp, Lactuca sativa
  Predicted polypeptide sequence is orthologous to G268
cgactcgagtttacttgagagtaaggttaacgaaagtttgggggagagtgttgtagaaagcgatcagaattgggaaaaaattgagaaatttagggtttgtgatcagggtaaaagagagtatataccttgtttggataatgtagatgtggtttctaggttaaattcaactgaaaagggcgagaagtatgaaagacattgcccagcaaaaggaaacgaattggattgtctggtgcccaatcccaaagggtacaaagaccacattccatggccaaaaagtcgagatgaggtatggtatgataatgtacctcatacacgtctggttgaagataaaggaggacaaaactggatatcaagaaacaaagacaagttcatatttccaggaggtggaacacagttcgtacatggcgcaaatctgtacttggatcaaatctctaagatggttcctgatattgcatttggtcaacatgttcgagttgcattgaatgttggttgtggtgtagcaagttttggtgcttttttacttgatcgaaatgtgactactctatctatagcaccaaaagatgttcatgagaatcagattcaatttgccctagagcgtggtgttcctgccatggtggcagtatttgcaacacacagattgttatatccaagccaagcatttgatttaatacattgctcaagatgtagaataaactggactcgtgatgatggaattttgcttctgga

SEQ ID NO: 8398 - DNA, 918 bp, Lactuca sativa
  Predicted polypeptide sequence is orthologous to G268
cggggaatctagatgcgatcttcttaatgttgatgcacccagcggattcattcgccattcttcgtcttcctggcactacacagagagctacgcagcgggatcaaaatcacatattcacagacacctatacatacattcaggcgtcgtttaaggcacttcattgaccattgacacagaaatatatatacatatattatacagaaggagagagagagagagagaaagagagggaaagcgacttcaacacttcactgaattgatggcacagtcgaagctctagattatgttgaccaaaaagcgttcatcatacgcatagatctttgagcttttagtctacgtttacatgtattaaactcacaggtaggggaggggcttagatctgaggataatgcttacaaagatgaagggatttggttcgttaaaatcgccaatttttgtgaaagctgctggatttgccttcgtcgcgctagcttttttctacttaggtaagcattggtccgatgatacttatcagcaattgatctttttcagttcgaactccaacccaaatgcaaaaatcccttcgatttcaatttcaccaaactataacaaaagctttgatatcaagtctttaatcaacgacacaaaagaggtagaaacagtagcagatcatacgttacctgcaattccaccacaaccattgctttctccgccgcctccgcctccgcctgcggtgcagaggctaggtgtagtggatgagaatggggtgatgagggatgagtttgaggtaggggagtatgatcccgatgtggtagagaaccgtaataacgaaacgaaagcggtggaagatgataatgggactgttagggttctaaaatttgagacttgtccggtgagtatgagggagtatataccatgtttggacaatgaggatgcgat

SEQ ID NO: 8399 - DNA, 864 bp, Lactuca sativa
  misc_feature (681)..(681): n is a, c, g, or t
  Predicted polypeptide sequence is orthologous to G2719
gacgtcccccaaaacactttgcctcgcaactcatttcacctgttcgtcaatcttcccctgtcacacactccagcagttgaaaccagtcaacttcgctgcgaatggacaaagatcaagatcaagaccaagacgccgccaaaattgaggatttcacagcaccccaagacgatggcgcccacataactaccgctgccactgaaaaccatgacgccgatgactctgacccagttactgtcggagatggagttggggccagcggtgctagtggcggtggtggtcgcgccggcaagaggaccggcgatagagtgaagggtccttggtcgcctgaagaggacgccatactgagtcgattagtgagcaatttcggtgcgaggaattggagtttgattgcccgaggaattcccggcagatcggggaaatcatgtcgtttgaggtggtgtaatcagcttgatcctgctgtcaagcgcaaaccctttactgatgaagaagaccgaattatactctcggctcacgcaattcacggaaacaaatgggcatcaattgcaagactcttaccaggaagaaccgacaacgcaataaaaaaccattggaattcaaccctaagaagacgaggtcacgaactcggtaaattcaacatcgggtcgggtaacaccattgaagacccgagcttagaaagatcanaagcatcatcagaagaaaccttatcatgtggggacatcaattccttcaaaccccacgaaggacccgacatcacaagtgaccctaacaatgaccaaactacccttttccgtccgaaaccccgcgtaagcgcgttcaacgtttacaactcacaaaccggttctgaaacatacgggcccaaactgt

SEQ ID NO: 8400 - DNA, 751 bp, Lactuca sativa
  Predicted polypeptide sequence is orthologous to G274
tattgagaccgggtgggtattgggttctttctgggcctccaattaattggaaagttaatttcaagtcatggcaaagaccaaaagaagaattggaaaaggaacaaaggaatattgaggaaatggctaaacttctttgttgggagaagaaatatgagaaaggtgaaactgcaatttggaggaaaagagtcaatcaaggatattgtcaagaacgagactctcgtgttactttgtgtcaatccacaaatcccgatgatgtttggtacaaggaaatggaagcttgtgtgactccttacatggaaacaaacaacacagatgaagtttctggtggcgaattaaaaccgtttccagaacgacttaatgacatccctccaagaatcagtagtggctccattgatggagtctccattcagtcattccaagaagacaataaattgtggcaaaaacatcttaatgcttacaagagagtgaataagattattgactcggggcgatatcgtaatatcatggatatgaatgcagggtttggaagctttgctgctgctcttgagtctccaaagtcttgggtcataaatgtgatgccgactgttgctaaaagggatactcttggtgtggtttttgaacgtggattgattggaatctatcatgattggtgtgaagccttctcaacatacccaagaacatacgaccttatccatgcaaatggtcttttcaccttgtacaaagacaagtgtagttatgaagacattctttt

SEQ ID NO: 8401 - DNA, 945 bp, Lactuca sativa
  Predicted polypeptide sequence is orthologous to G274
ccatttctttatttctctcagatttgctttcgcattgtaatccactgatcctacaagctactttgccagattttttttgctcgctcccaatcgtcttcctccgtatatcaggcggagatctccgccattctgatctaattttcgcaacacccacctcgtaataatcaaaacaacaccctgttaatcatcagactcttatgctcggagcttcttctacgtgagcttagtttctcaaagattctgtttgtctcctgatgcgattggctgcatcatggcaacaaaagggaattcaggagaaaacagggctagaagttccataaccatattcatagttgttggtttatgttgtttcttctacctattgggagcatggcaaaggagtggatacggaaaaggagacagcatagctttagagatgaccaaaactggtgcagattgcagcattctcccaaatctaaactttgaaacacaccacagtggcgattctgtaattgttgataacccacaaaccaaagtcaaagaatataaaccatgcagtcctaaatataccgattataccccttgtcatgaccaaaaacgagccatgacatttcctagacatgatatgatttatagagaacgacattgtccccctcaagaacaaaagttgaagtgtctgattccagctccaaaaggctatgtgacaccattttcatggcctaaaagtcgtgattatgttccttttgcaaatgcaccttataaagcattgactgttgagaaggctattcaaaattggattcagtatgagggcaatgtgtttaggtttccaggtggtgggacccagtttcctcaaggggcagatgcgtacattgatcaacttgcttctgtaatcccaattgataatggaactgtgaggactgctttggatactggttgtggggttgcaagttggggggcatacctttg

SEQ ID NO: 8402 - DNA, 910 bp, Lactuca sativa
  misc_feature (867)..(867): n is a, c, g, or t
  Predicted polypeptide sequence is orthologous to G2754
cggggatgaaacctttcctgccactctccattgtcatcggacttctccaccgctcctcttcacgcttcctgcagagatccaaggttttgactgcgagatggtgcctaaaaacgaagtcatggaagaaccagtagcagattctccgacttcggtgcttgaagacgaggatgtctgcaaggataaatctgctgtgaagatggaagatgtactattaggtgaggcaaaaaatggggacgcagctctcatctcagctgtaatggcagaagaggaagtaaaacttgaacaacaaaggaatcaggaagaagaaagtgtggcaaaggaacctcctaccttgaatgacacacagtttactaaactggatgagcttcttactcaaactcagctttactctgaatttttactggaaaaaatggacgatataactaaaaatggggtggctgaagatgttcaagaagtagtaaggggcgaagaagaaaggccgtggtgctaaaagaaaatctgcctcaaattacaacacaaggaaggccaaaacagctgtagcagccatgcttacacgatctaatgaaggtaccccttttgatgacaccaatattagtaaagaagagagagctgcaatagagcaggctgagcttgttcctttgttgactggtggaaagttgaaaccttatcaagtcaaaggtgtgaaatggatgatctcattgtggcaaaatggtcttaatggtattcttgctgaccaaatgggacttgggaaaacaatacaaactattggttttcttgcacatttaaaagggaatggcttagatgggccctacttggttattgcccctttgtctactttgtcaaattgggcaaatgagattgcaaggnttgtcccatctatgaatgcaatcatctaccatggagatagatc

SEQ ID NO: 8403 - DNA, 852 bp, Lactuca sativa
  Predicted polypeptide sequence is orthologous to G2779
cggggaaatgattttttccatgtgcttatgttttaatgtagaaaccgattgttttcagaacaaaaccaaaaacatttcaaattcaacaatcatgatgaagcaataaatggatggttttagtgatgatagttgagtagtagacatgatgcatgggatgcacaataaacacttgataaagcgtgcaagtattgtcgggtttgtatgcgggttataatctgggttatgggtgtatccatggagtgtatgatagcttcattttatttaattctttttatagtttattttagcacatttcattcacattttagttaatttccatgcatattttcctttttgttattttatgaccatttttgggtactttctagtttcttgagcattattgtagattttctgggagactagtggagcgggactctttggaggcgattgggcttgaagggaaatggggatttcgtacttgatggctgtggaggtgattcagggagtaggcttgtcgactgcttgaaggcgcggaagtgttgaactttaaatttgaaagggcgcgggagaattcttgagtgtgcaagatcgatgtctaggagtttgcggaagttttgagtgatgtggagagacaaattgggctctaattgaagaaatattgaagaaaaatgggctagaagctgattggattcgaactgggccaatggattagctgtgggggcccaagacttgaagaagcccataaattccgtcacaatcacgcggcccgcgtaagattccctatggcccacgtggatttctgacaagggcaatttcgagattttacttgaagctctatattggaaggttggtgtgcctcttcagccttat

SEQ ID NO: 8404 - DNA, 860 bp, Lactuca sativa
  Predicted polypeptide sequence is orthologous to G280
gcggggacactttgtactgtgcttcttcgaagctgacatctcctttctctcttctctgtacaatctcctgcacttccttccaatggccgccgcaaaacatacccaatccccatcactgccaccatattcagagatgattttcgctgcaattgattcgctgaaagtcaaggaaggtgcaagcgaatcctcgatttcagactacatcgaatcaacctgtgataatttgccagatgaacacgccaatatactgactgataacttgaacaaattggttgaaagcggcgagctagtggtgttgaatgacaactacatgcgaccggagcccaccgaaactccgaagcgcggccgtggtcgcccaccgaaggccaaggacccttctgtttcagaggctgtgactcaggcggagcctgggtccgaagttaagaggggaagaggacgacccaagaaagatcctaacgcgccatcttcagccaagaaagttaaggttggatctacctcgccgccgtcgtccaaaaccggccggccaagaggtcggccacgcaaggtgcagccggagttgacaagcgttgaagccaattaacctttaacttgatgcaaagaagagaacagatgttgcagactgatttccaaatcagaaatttctatgtttagagtaatgtacaattctcactgtatgatgtacaaggaactataactagcattctctggatttagaagttttatctctgcaaatttcaattacctaacaaaaagcctttttataaagggtttcttattagtttaaggtgtttttaatgtctttagggtttcttgtaatataacttctatgttaaatgcatttgtgtgttgtattttgccta

SEQ ID NO: 8405 - DNA, 820 bp, Lactuca sativa
  Predicted polypeptide sequence is orthologous to G2802
cgcgggggtgctcgcacacggtggcttccaccatttcttttccccaatcatattactccaccatatcttctctaaaccgatttgtgtcccctctaacgtctcacccctgatacttcaaaccaccatcgatttatccactttagttcaacagggaagcaacaagaaccaagaacgcattctggcgttgttggtgttggtggtgcgacgacgtgggttgctggtggcggtgacgggaggcgttgtggtcttcaggtgtcgcaaattgattgcttggtggcagttatgttccaccgctatgagttccgatcaatttagtccaggtaacgtcgctcgccaccatggtccaagccaccgtcgttctccaccaccgattatccctgcaggaacacatggtgtgcgaatatagcttcatcgcctgatttccttcttatattccttcactgatcgagccttgattgcttcgtcgatgactacaacccagaaatcagtttcgttatgttctatgcctttgttaatggcaagagttgcgtccgatgttcctcgaaaatcagaagaaaaaattcagatgcatatccccatatgctcgaaaagaaataaattcagattcatatccccatatgctcgaaaatcaaaggcatacattcatatcgtcgaaaacaagaaggtaatattgaattgtggaaattgaaatatgttctacttttgtgattgttatgtagtatctcattattctctactgatactgtaaaatccagtggaattgtatacagataccaatttgttggcatgaaatcctgatgatatcatcgttctttttaca

SEQ ID NO: 8406 - DNA, 666 bp, Lactuca sativa
  Predicted polypeptide sequence is orthologous to G2989, G2990
gaggtggacatcgtgaagaaagaaaaggaagccaaggggaagattgtatagatcgattcggtggcggtgcctcctccgacggaagatgatgtggatgaattttttgctattctgcgacggatgcgagaggcggtgaaatacttcgagaaaggtaacggtgggaataaattatcggatccatcacgagaacctgatgatggtttagcttctgtgaacaaaggaacgaacgttgcactcttggatctgaatactgttcctgacgagagagaatagcatcttctacggtggcgcgtggggtttgtctttgttaactgcgctcgtggcgcgtcttaggttaagccttgctgcctggcatcgttggctatcttgcgctcatgtaactcacctggtcgggtcatccggctgggttttgacccagaatgttaaaaaatatgaaatattttggtttctttgctaatttttctacacatggctgatgtatgtgtaatttgattgaaaaaaaaggtacccatcaacgggcccggaaggcaaattattttgctttggaagatgataattgaacgatgattatagctgagtctttatgtatgtatttttatatttgaaatggtacaacgagatagcaaggaaaagatgatcggagcttcttttctttcttccgatgtc

SEQ ID NO: 8407 - DNA, 671 bp, Lactuca sativa
  Predicted polypeptide sequence is orthologous to G2993
aggtatatgtacagcagctgcgggaggtggttgattatgtgtcaaaggtatttgagaagtagtctcgccttctacctctctccggtggaaactccggtggcattcacaggcagcacattttaatgcttctggcgtgccatcttctccgctaggcataaactctccacacccatcgagaacatgagcgcccatattggcagcatggttccttaagcatccacgataccggaccaccaccactgcaaccggcgctatagaggttgttgaaggtggtggtgctagtggtagtggctgcgagggagcttgagagaccagtccagaaagatttggatccggatccgagtttgaattccttccgggtgtttctgcagcttccggttgttctttatgtaacctgaatccgcgatactggtctccctgatgaagatgatttggggtttcatttcttttggtgtttgaggtagaagatgattcttgagtggattgaggtggaatatgataattaatggagtttctctctctagtttccattaggtttgacatgtgaacacatgatccctcaccctaaacaccaattcaagtatttaaaatttcgcaaatcctgctggaaatctggaacttgaggatcaaggaatatagagattaaacagtgtctcctaccacccaccctg

SEQ ID NO: 8408 - DNA, 876 bp, Lactuca sativa
  Predicted polypeptide sequence is orthologous to G3
tctatcgaatcggaggagaggtcatgtagatcactgtcgtctccgattgaatcagggatattaagacgtgtcgatgggccacggaggtagaaaacgtcggtgtcgtaggcacgaccggcgtcgacgggggaggagtaagaaccaaaccaaatacgagaacgtttatcgagttctcgaatctcggtgacccacttcccccacttcctcatcctgattcctctgtagtagggtttgtttgtttcaattgactgaatctcctttctcttagatgttgaacagccgccgtctgcctctatgtgtggcggttgtgattgtcgtatggttcatcttctgttgctgttcctgtaactggccggcgtaggtgccgccgttttgaagccttttctgttcttccccagtatgttgattgtggtgactgtacctgggtttgtgagttctgtggtgcttttttctggtatgtcgagagggccgttaatctatctacatctgcacatctgaggtataatcattgttgtaggggtgggagtgtagttcttccttatccttctaggtttcccccttattttgttgccctatatggctggaaacgggagagcttccacagtaccaccacacttctcttgccattgccgatgacaaacacaaagccttggttgccgttggaaccttgactttgcactaaacagacttctacaataacgaaaaaagagaaagaagaagccaaataaggatgaaataaagtttcctggcgtgaagagatcaaatttagagatgttaaactcccactaaacttggtcgatgttcccaagggacctgttgtccagatttttttaaagatccgcaagttacttaccccttgctgcccacattaaacga

SEQ ID NO: 8409 - DNA, 467 bp, Lactuca sativa
  Predicted polypeptide sequence is orthologous to G3060
agctattattggaaaaagcggagtcaactctaagcaaattagtcggttgactggagctaaattgtcaataagagatcatgaatcggatccgaatttgagaaatattgaattggaagggacttttgatcagattaaacatgcgagtcaaatggtgcgtgagttgattgtgaatataagttcggcttctggaccactgccgccacaaaagggatttggaaaggcggcgggtggtggtggtggtggtggtccggcggggaattttaagacaaagctttgtgagaattttgctaaagggacttgtacttttggggagaggtgtcattttgctcatggtgctgaagaattgcgtagttctggagcttgattttgagggttattttttttagttttggagtatctgagatgttgattgttgaggacagttgtgagtttgttggtactaggtttttttttgtttcagattttta

SEQ ID NO: 8410 - DNA, 845 bp, Lactuca sativa
  Predicted polypeptide sequence is orthologous to G3074
gcgggggacctttacggatctgtgaaatttctggatatcgtaactcgaatctgatccaaactacgaaccagatctgcaacgccgatagttctccgccactgtgattcttagagatcagatctcgtctggcgcgctcttttgttgatttctctcttgagttaattcttcaaattgtgtttgttggtgtatcaacgccatgaagaagaagctcgatacgcgtttccctgctgctcggatcaaaaagataatgcaagcggatgaagatgttggaaaaatcgccatggctgttccagttttacaaaagctttggaattgtttctgcaagatctttgtgatagaacatatgatataactctacgcagaggtgcaaaaactgttaactcactgcatttaaagcactgtgtacaaagctacaatgtatttgattttctgagggaagttgtgagcaaggtccctgactatggccattctgatgctgctgctggtggtgctgttggttctggtgatgatcgtaccatggtaaagaggaagaaagctgctgctggtgaaacaaatgaaagtgatgaagagttgaaaagaaacaggatgaatgaagcagggcaaacgggcagcaatggtagggggagagggcggggcagaggaaggggcaggggccggggcagaagctcagcagatagagaggctccccaaacagatattgaactcgaatcctgcacgccattgattccatcaaccaccaccaccgccgccactgccgccgctgctgccaccaccgcgatcagtgatggtggtcgggactttgatttgaatgccgggggttgatgagaatatggagaaagcatccg

SEQ ID NO: 8411 - DNA, 733 bp, Lactuca sativa
  Predicted polypeptide sequence is orthologous to G309
gcgccgtcgagaaggtcttatcggcggtgaaggagatgaagccggagattttaacagtggtggagcaagaagctaatcataacggaccggtgttcttggaacgattcaccgagtctttacattactattccaccctttttgactcgcttgaaagcagtggcaacggcggcggagtggtggaaggtggtggtattccggcggcgagtaaccaagataagattatgtcggaggtgtatcttggtaaacagatctgtaacgtggttgcgtgtgaaggaccagaccgagttgaaaggcaccagacgttgagtcaatggaagactcggtttgaatcgggtgggtttgaagcggttcatctgggttccaacgcctacaaacaagctagtatgttgttagctctgttcgccggcggcgatggctacagggtggaggaaaacaacggttgtttgatgttgggttggcatacacggccgctgatcacgacatcggcgtggaagctccggtgaactcgactgggtcaactcggtgaataatacctaacgagttggttcaaactcagtgccagcctggaaaaacagaaatcgcgagttgctgagttggagaactgaaactcaataggtggggggcacttgcccacatctgggtattttgttattttaattaccaaagaaattttttttttatgcctatcttttattttctattttaaattgggagttggtgggttaaattggaa

SEQ ID NO: 8412 - DNA, 728 bp, Lactuca sativa
  misc_feature (655)..(655): n is a, c, g, or t
  Predicted polypeptide sequence is orthologous to G309
gggaattcggccttatggccgctagtcgggggaagaagaggggttgaagttgaagttgaggttgaggttgaggttgtgttgtgttgtccgcctgttggttcatcgattatcgcgcccacccctcacgagcgtttcttcatctctctctctcatctccacaccacttgtatttgctgtaccatttttatacttccacctatcatctttctctctctgataatcactcgcactatcatcgcttcccccaatcacaaatgctcagattcttccacccattcacagattgttaacccataccccttttcccgatccccaatcggtggatttaagttctacagaaaagactctgaagaagaaaaaagaaaaaaaagatgaaacgagaatacccacagcaggattacaccttctttaatggcggcagttccacttccgcttccgcctccaccgccgccgcctctggttctgggttttcagatgtcaccgggaaatcgaagatgtgggatgaggttgaagagcaagacgccggcgttgatgagctgttggcggtgcttgggtacaaagttaagtcgtctgatatggctgatgttgcgcaaaagatcgagcatctggagggtgttttggggaacgatgatgggttgtctcagcttgcttctgnatctgttcattataacccttcagatctatcttcgtggctttgatcaatgatttgtgagctgaaccccacaaat

SEQ ID NO: 8413 - DNA, 849 bp, Lactuca sativa
  Predicted polypeptide sequence is orthologous to G309
cgcggggatctacttttaccgaaccccaatcctccattcgatttcatccaagtttctttaaccaattgatatacagatcttttcatcagtctacgaatttaatcagccatgaagagggatcgtgagcgtgagcgtaagaaggaagcaaagccatcgtcgtcgtcttcaatggcggttggaattggaaaggccaaagatttgcatcagtcgttgccggattccggcggaatggatgagcttctggaagtgttgggttacaaggtgaggtcaacggatatggcggatgtagccaagaagcttgagcagcttgaaatggtgatgggtgaagatgggattttgcaactgtctgatactgttcattacaacccttctgatctatctggttgggttcagagcatgctctccgagctcaacaccaacagttctgataattcgtcttccaccaacttcggtatcgttctccccggcgaatcctcctccaccaccatgattgatttctccaacaacaaacaaattgatacccaacaaaccggtggtaagatgtacgacgatgatccatatgatttgcgtgcgattgcaggtggtgctatttacgggacaaccgcagaggagtctccggtgtctagaaacggaattaaacgaatgaaagcggcagctcctggatctgaagctgttgacgtaccgccggaatcgccgaaaccggtggttctcgtcgattctcaggaggttgggatacgattagttcacacgttgatggcctgcgcggaggcggtgcagcaggacaacctgaactagccgacgctcttgtcaaacacgtgggtctcctggcggcgtcacaggctggcgcca

SEQ ID NO: 8414 - DNA, 958 bp, Lactuca sativa
  misc_feature (776)..(776): n is a, c, g, or t
  Predicted polypeptide sequence is orthologous to G326
catttgtcgtttccaaatcctccaagatttttataaccctttatcgttttcatcacaaattcaatcttcatcatcaataccctaaaagcttcagagatcagattatgtcttgtgtctgtgatttctgtaatcagagatcggcggtgttgtactgtaaagccgattcggctaagctttgtttgttctgcgacaacgccgtacactctgcaaatgctttatctctcaagcacttccgttctcagatctgtgacaactgcggatctgatgccgtttccgtcgcctgttcaactgataatcttctcctctgcacctcttgtgatcacgatttccatggagactcctccgtttcctcttatcacagtcgtgtgcctgttgaagagttctccggttgcccttcccctcttcagctggcctcgatttggggatttaatctgaaatcttctggttctaacggcaattcgtgtgaaagtaagtattccactacgaattttcaagatttagcaacgatacatgagaaaactccttgttatgatgaggttccgagcgttgactggaaatctagaggttcgggttgcggagttcataataaagttttgtataagcagctggtggagcttgcgaaagaaagatttgacggagatggagctgaattggggcctcaaacaccgagtggatgtggtccgagggatatttcagaaggttttgagtatgaggaacaagacgataaggatctgttgcatcagcaaactccattaacgtatttgcttatgccgccncagaatcccgcgaattcaaaagcgaataatgggggtatcactgaatttagtaacatgtggagctatagccctaaacgccaaaccagtcagatatgggattttaatctagggagatcaagatcttctgaggcaggaggtgataatcttggctttgcaataaacaattgtactgaccttggtga

SEQ ID NO: 8415 - DNA, 890 bp, Lactuca sativa
  Predicted polypeptide sequence is orthologous to G4
cgggctgacccgacctttgcggaagatgagtttgtaaagaaccctagcaaatgctactcgaagcccatacgatctgagatctttgatgttgaagatgagtttgaggctgcttttcaaggatttaaggacgaaatcgaagccgaagttgtggagcattttgttagcccttcaaatttgtctgtctccaaaggctctggctcaaaacctgtgaagtccgataatgaacctgagaaatcaagttcaaggaaaaggaaaaaccagtacagagggatccgtcaacgcccatggggcaaatgggcggcagagatccgtgacccgaggaaaggcgttcgtgtgtggcttggaacttttaatactgctgaagaagccgctagggcttatgatgaagaggcaagaaggatccgagggaagaaggcaaaggttaacttcccattagaagagaaaccagaagttaaccctattgctgctgctactactatggggattaaacccaaactatttactccatctgagagtgcagctgctgtctttcacttcaattctgatcaggggagcaactcttttggttgttctgactttggttggggggagcattgtgtaatgactcctgatattacatctgttttctcagaggttgatgatgtgaatcctgctaaaaaacctgaaaaggttgatgagtcgctctttcagatgccctgttttgaagggaactgggatgctttcctgaatggagatgcagctcaagatgatggaaatgcagtggatctttggagctttaatgatcttcctgtcattatggatggatctttctaatcaactatgtatttgttggcgaatggataaagcatgcttaagcctttgaatggtgtatcagttgcagagtatatagc

SEQ ID NO: 8416 - DNA, 882 bp, Lactuca sativa
  misc_feature (708)..(708): n is a, c, g, or t
  Predicted polypeptide sequence is orthologous to G4
gatgcctttgatattgacgatgagttcgaggctgattttcagggatttaaggatcaggttgaaatcgatcaggataacaagccttttgctttctccgcctccaaagattccgctcctgctcgtgggtcaagatctgtgaaatctgatgatcaggttgagagatctggttccaggaaaaggaagaaccagtacagaggaatccgtcagcggccatggggaaaatgggccgccgagatacgtgatccaaggaaaggcgtccgtgtatggcttggaacctttaataccgctgaagaagctgcgagggcttacgacgccgaggccagacgcatccgtggtgataaagcaaaagtcaacttcccggagaaagcttctccggcgaagcccaaatcccggaaacctgtttacaaacttggatctgtggaagagaaaccagaagctaatcctatgccggcggcgaaaccatttattccgtcggaaactgccgccttttacttcagttccgatcagggtagcaactcgtttgattgttccgatttcccatggggggagaactgtgtaagaactcccgagatcacatctgtgctttctgaagtcgatgaagctatctttatggaagatcctaatccagtgaagaagccgaaaacagagtctgtgaatttggtctcagattgtgagaataccgatgacctgttctttgagatgccatgngatgcttcttccgtcgacgctttcctcaacggcgattcaacaactcaggattgtgaaaccgtcatggatctatggagcttcgacgatctccctgtcatgatgaacggaggattctaattaaaactccaaaaaagtttcatttcatgtgtctgtaaataaggctttacatgtcag

SEQ ID NO: 8417 - DNA, 737 bp, Lactuca sativa
  Predicted polypeptide sequence is orthologous to G409
ttcattgttcttcttctcttaaccctgttgattccttcttcgcctcccgatcgtctcctttccagggttctcgatcaatggttagctttgaagatagagggaatggatccggtgggcaattttttcagtcatttgatcatgaagacaatggagatgatgaatacgatgaatactttcagcagcctgagaagaaaagacggctcacggttgaccaagtacggttcttggagaaaagttttgaattagataacaaactggagccagaccgaaagattcagctagccaaagaactcggtttgcagcccaggcaggttgccatctggtttcaaaaccgacgtgcacgttggaagactaaacaactagagaaagactacgacgatttgcaggaaagctacaataaactcaaagccaactatgagaatcttcttaaagagaaggaaaaactaaaatccaaggtcggtgaattaagtgataagctgatgattcaagagaaaggaacctcggatgcatcgagtactaaaagcccgtgtgagccacaactgtgtgaactggtacttgaggaagatttatcgaagaacatgaacccgacatgcgggcccgaaggagatttaaacgtggtgtttgaaagaggcgattcatcttatgtatttgaacaagaacaaagtgacgggtcgttggatgaagaaatgataactttgggaagatgtttctaccatcaatggacggttacacattgc

SEQ ID NO: 8418 - DNA, 759 bp, Lactuca sativa
  Predicted polypeptide sequence is orthologous to G450
tcggccttatggcctgtagccgggtggaggaggcagtggctgtgaggcggagaccttaaaggtcaccggaaaacgtggctacgcagagactgttgatcttatgctcaatctacaaccaaatgaccagtcctcatcttcaactaatctaaatgatatgaagttgcagaactctaagaacaacaaagatttgatcaagccaccagccaaggcacaggtggtaggatggccaccagtgcgaaactatcgcaaaaacgtgatggctcagaagagcaataatgaggaaactgagaaggtggtggcagccaccaccggtagtaacaaccatgcggcctttgtgaaggtttcaatggatggagcaccgtatcttcgcaaggtggaccttaaattgtatgagagttatcaacaattatcagatgctttagccaagatgtttagctccttcaccatgggagagtatggatcccaaggaatgattgatttcatgaatgagagcaagttgatggatctccttaacagttctgaatatgttccaagctatgaagataaagatggtgattggatgcttgttggtgacgtcccatgggcaatgtttgttgattcttgtaagcgacttcgaatcatgaagggatcagatgcaattggacttgccccaagagcaatggaaaaatgcaagaacaggtgttaaagacaagtatgaagcaaaccctaatcttgattcagttcatgacaacttcaaatcatcaaagtacatggatggat

SEQ ID NO: 8419 - DNA, 883 bp, Lactuca sativa
  Predicted polypeptide sequence is orthologous to G450
cttggcggggaaacaatttaatcaatttcaattcctttccttctcaaacaaccaacttttttcaaaacagttgtatcacagaagattcaatttcaccaaacaccatgtcatcggaaacatccatgtccaacatcacgacggagccacctactaccgccgccgtcttcggtagccttacgttcaatgatacagagctgacgttaggtttaccaggtgaatctcggaattcgggagtcaaacgaaggttttccgatattattgatctgaaattgggcggagctgatcaatccgactctgaatgctccgtcgttacgaaatctcctccggcgaaggaacaaatagtaggatggccaccagttagatcttacaggaagaacatgacgatgaagagtgattacagatatgtaaaggtggcggttgatggagcaccatatttgagaaagctagatctcaaattgtacacaagctatcaacaacttctgttcgcttttcaagatctcttctcctgcttcacaatcagaaatgtattaaacgagatgaagctgatggaccctgataatggtatcgaatacgttccaacatatgaagataaagatggagattggatgttggttggtgatgttccatggaatatgtttgttgaatcatgcaagcgaataagattaatgaagaactcggagtcgttgagttgaacaagcgttgatggaagaaatagttcatagaaagattgtttttttttttttgagaataggaaaatagttgattaaataggaatattgtagaagtaaataagatccacatgatgtgtgtgtacaaaatgtttgctgagtttgtgcagaaactgacatttataaagccaggtttttagggttttgtaaaaaaa

SEQ ID NO: 8420 - DNA, 912 bp, Lactuca sativa
  misc_feature (733)..(733): n is a, c, g, or t
  misc_feature (783)..(783): n is a, c, g, or t
  Predicted polypeptide sequence is orthologous to G450
aacaattttctctctcttttatctcacaccaattagaaacaaagccattcgacaacacaatcaccaataattagtgctgaacaagtcttgtttgagccatgatgaacctaaaggagactgagctctgccttggcttacctggtggcggcggtggaggcagtggtggcaacgaggcggagatgttgaaaaccactggaaaacgaggcttctctgaaaccattgatcttaagcttaatcttcaaccaaatgagtcattgtcatctaacgacaacacctccactacaactcatgtcaaaccaccaaccaaagcacaagtggtaggctggccaccagtgaggaactaccggaaaaatataatggctcaaaagagcaacacagatgaaccggagaaggtggctgccaccactgcaactttcgtgaaagtttcaatggatggtgcaccatatcttcgaaaggttgacctaaagatgtacacaagctaccaagaactagccgatgctttggccaaaatgtttagttccttcaccatgggaaattatgggagacaaggaatgatagacttcatgaacgaaagcaagttgatggatctgctgaacagttcagaatatgttcccagttacgaagataaggatggtgattggatgcttgtcggcgatgttccatggcagatgtttgtggcttcatgcaaaaggctccgaataatgaaaggatcggatgcgattgggcttgcacncagagcaatggagaaatgcaagagcaggtgctaaaaacagatcttatttncagatcttcattattgtgtttgaatttctttttttgggttttcatttgtttaaagtttgatagtatatagacttcataaaaaaatgtgacatttgtaatccacaataaagcaggagtttgtttgtgcgg

SEQ ID NO: 8421 - DNA, 892 bp, Lactuca sativa
  misc_feature (734)..(734): n is a, c, g, or t
  Predicted polypeptide sequence is orthologous to G450
gcgagatagaggagagatgacgtcgttcgaggagacggagttacggctagggttgcccggcggcggcggaggaaataagaccagtgaagttggagatacagcggtgcattgcaacggaaagagaagttacgatgagacaatcatggatttgaagctgaaactgtcatcagatgatcaggaaaccaagaatgatcaagagaagaatcttttcgaagccacaggcggaggcgatggtaattgctcagttaacccaccagcgaaggcacaagtggtgggttggccaccggtgagatcttaccggaaaaacatgctatcaatccaaaaaaacataagcctccgcggccatgaagagtttaccggcggttgtggtggggtagcgtttgtgaaggtgagtatggatggagctccttaccttcgtaaagtggatctgaaaatgtacaaaagctatcaagatctctccgatgctttgggcaacatgttcagttccttcactattggtaactgtggatcgcatgggttgaaggatttcatgaacgagagcaaattaatggatcttttgaacagctctgactacgttccaacttatgaggacaaagacggggattggatgctcgttggtgatgttccttgggagatgttcgttgattcatgcaagcgtttgcgtataatgaaagggaaggaagctatcgggcttgcaccaaaagctatggagaagtgcaagaaccgcagctaanagccgcaaacgggattaactacaatctttgtgtggcatttgggatcaagaatactctatgtggattgaacaaacatttgggttaatttgtgtatgtatttattatatatttttacatcaaaattatttcaagatctggagttttctattggtgattat

SEQ ID NO: 8422 - DNA, 764 bp, Lactuca sativa
  Predicted polypeptide sequence is orthologous to G451
aaccaccgatgattgcacggaatccaaaggcagttctcaacacaaagaatccgatatcgaaacttcacctgcagccaagtaagttcaatagccatcaatcatacttctaattgattttaaacatatttatattgttatattgtgattctaattaatgggtttaatgaaaattgcagatcgcaagtggtcggatggccaccggtgagaaactaccggaggaacaactttcaggcgaaaaagatggagacggaaagtgggatgtatgtgaaagtaagcatggatggagcaccttatcttcgaaagattgacttgaaggtttataaaggttattcagagcttcttaaagctttggagaacatgtttaaactcaccattggtgcttattctgaaagagatggatacaaaggatctgagtttgcacctacttatgaagataaagatggcgattggatgcttgttggtgatgttccatgggagtaagtccctatttctttctttttttttcaacctttttatccattaaatagtatgttgttaaatgatatttgaaggaagtcaagaacattagagatttattaaaaaaggttagaaattaaagggaaaacatttttttgttacttcttattttatgttgttctttttatgttaattagaaaaacattcatatatagtttacgagattaagtaacattaagttaaacaaattggtattataagttagtattaagttacatgtcacataattgggttagaagagtgagcta

SEQ ID NO: 8423 - DNA, 868 bp, Lactuca sativa
  Predicted polypeptide sequence is orthologous to G489, G714
cgtcttactccttcctttttcgatcagttcgctgtcccacttccaaccctagctgatccatctctctcatacttcgctacgaattaaatatcagacaagagaattttctctgaatttcgtccactggattagctttttttagggtttgatccgagtagcttgaagcaactaaatagaacacgaggtattccgaaaatggatcaacaaggccacgggcaggcccaagggatgaacacagtgaacacctctgcccaaatgccctacaccatgcccccatacccacctccaaaccaaatgatgggcattgtcccccctgcccccgggcagccctcccaaacctcgggtctcccttccccccctgcccaacttgcccaacaacaactcgcctaccaacacatcgatgaacttattaaacaacaactccaccaacaactccaaaacttttgggcaaatcaataccaagaaatcgaacaaacaaccgatttcaaaaaccactctcttcctttagcccgaatcaagaaaatcatgaaagcagatgaagatgttcgcatgatatctgcagaagcacctgtgatttttgcacgtgcttgtgagatgttcattcttgagttgactttaaggtcatggaatcatactgaagagaataaaaggaggacacttcagaagaatgatattgctgctgctattacacgaactgatatttttgactttttggttgatattgttccacgtgaggatttgaaagatgaggtgattgcttccacgattcctagaggtgggccacttccggttggggggcccactgagggtctaccgtattactatatgccgccaccacaggttggtggttcagggatgtatatgggga

SEQ ID NO: 8424 - DNA, 928 bp, Lactuca sativa
  misc_feature (798)..(798): n is a, c, g, or t
  Predicted polypeptide sequence is orthologous to G562
cggcgggggagtggagtgttgctttcttcctcccttgttttagtgagagaaagttctagagagagaaaatgcagcagtgaatttgttcgaacttagctgagtgagcaagagcaagtatctgtagaaaggatttcccatatcttcattgatacagttttaggtgctttcccatggggatcagtgaagaggcacaagattgtaagcctgaaaaatcttcttcacctccaccacagcaacaacagacgagtgttcatgtatatccagattgggcagccatgcaggcatattatggccctagaatggctgtgccaccatactacaatcctgctgttgcatctggtcatgcccctcccccttatatgtggggtcctccacagcatatgatgccaccctatgctgctttctatccacatggaggtgtttatgcacatcctgcagttcatcttgcaaatagtcctctgaacattgattcacctgccaagtcatcagggggttctgatagaggcttgatgaagaaattaaaaggatttgatgggttggcaatgtcaataggcaatccatcaaatggtgaaggtggaaacaatgatgggaactcacacagtggggagactgaaggaacaagtgaaggaagtgatgggaatacaactgagcgaggtaaaaatggtgggaaaagaagcagtgaagggtcgcttattctttctgaagttgagaaggctgagccacaaagagcagatggagcttccagtaaaatgatgacaggtgtcgggattctttctcccaatcctgtctccgcattanatctcaagaattttccgaatacagctgctgacatcactttcaccatttgtacattgatgccaatgaagcactttttcagaatgaccgagaactaaaagggaaaagagaagcagtctacccgagatctgct

SEQ ID NO: 8425 - DNA, 736 bp, Lactuca sativa
  misc_feature (10)..(10): n is a, c, g, or t
  Predicted polypeptide sequence is orthologous to G598
ggagaaactntgggaaacaaccagccacagatcatcaaatctctccataggcagcacggaaaccgaaaactttaccaccatgagtagggagtttaacgccttggtacttgcaggaaacgacatagatgttaatgaacacaacgagccaattagtaacttgcagaggatcagggaggaagaaattctggtggaaaacaatcctttagcgattgttgcggataataatccaagggtggcttctccggcaagacttggtaacggtggcggcggcgctggtggtggtgggatgagtttgataagtagtagcagtgggggtacccatggcgatgtgtcttctgtgcaacgggtgaagaaagaggaggtggaatctaagatatcggcatggcagaacgccaaaattgcgaagatcaacaaccgtttcaagcgggatgatgcgatcatcactggttgggagagcgaacaggttcagaagtccacttcgtggatgaagaaaatcgagagaaaattggaggaaaaacgagcaaaagcaatggagaagatgcaaaacgatgtagcaaaagctagaaggaaagcagaggaaaaacgagcaaccgcagaggccaagagaggaaccaaagtggccagggttttggaaatagccaacttgatgagagctgttggacgaggtcctacaaaacgatctttcttttagcttcttatataagaaaatgtgtaaaaagatagaaagggaaaaaaa

SEQ ID NO: 8426 - DNA, 754 bp, Lactuca sativa
  Predicted polypeptide sequence is orthologous to G635
gaatctagagtgatgaaaatgatgaatcgattatctgaaattgggcccacaatagtcatgggtaaaaatgaacaactacacacatctggtcatgcctatcgtgaagaattggaagaagtgctgaggattgtgaaaccacaacattttttacctattcatggggaactcttattcctcaaagaacatgaattgcttggaaaatccactgggattcatcacactgctgtcataaagaatggagaaatgcttggggtttctcatttgaggaacagaagagttttgtctaatggtttcatagccctaggaaaagaaaatttacagttgatgtacagtgatggtgacaaagcatttggtacatctgctgatctttgtgtagatgaaaggatgaaaattgcaacagatggaataataattgtcagcattgaaatcatgcgtcctcaatcaaccgaaaatactgcattattgaaagaaacaattaaaggaaaaataagaataactacacgttgcttatggaatgacaatgggaagcttctagatgctcttcatagtgctgcacatgcagccctatccagctgtccaataaaaagccccttacctcatatggaaagaactgtttctgaagttttaaggaaaatggtaagaaaatatagtggaaaaaggcctgaagtcatcacacatgctattgaaaatcctattgctgttattgctgatgaaattagtgaaaaagtatctggtgtgaatgtgaatgtgaaag

SEQ ID NO: 8427 - DNA, 938 bp, Lactuca sativa
  Predicted polypeptide sequence is orthologous to G653
gcggggagcttgcaagccatctcttccccgcattggttgatatatatatataaatatcacacagttccccaaaaaaacccatttctttccgctgcgtctatccttctcagacattccctacaatttgacctctgaaaacagaaggattttgacttcgatcgacaaatccaactcaaatttcaacaaaactatctgaatttatcacaggtgttggttcagattgaattgaattgaaaagggtataaaggtttcacatctgattggttgttgacagtagggaggtagaggaaaagatcgagatcagatccataggggaaaagggcaattatgtcttttaccggaacacagcaaaaatgcaaggcttgtgggaagactgtttacccagtggagcttttgtctgctgatggtattgattatcacaaatcttgcttcaagtgtagccattgcaaaggtacccttaagttgagcaattactcatcaatggaaggtgtgctctactgcaagcctcactttgagcagctcttcaaggagagtggaaatttcaacaaaaacttccaatcacctgcaaaggcggctgagaagttatctccaatgctgacaaagtcaccaagcaaagctgctggcatgttttcggggactcaagagaaatgtgctacttgtggcaaaactgcttatcctctcgagaaggtaacagtggagaatgaatcataccacaagtcttgtttcaagtgctcccatggaggctgttctttatctccatcaaactatgcagcattggaggggattttgtattgcaagcatcatttctcacagctcttcaaggagaaggggagctacaatcatctcatcaagtctgcatccattaagcgagcatcagcagcatcagcagcagcagcaacagcagctgcagcttctatcccagaagtttgaagtttgaa

SEQ ID NO: 8428 - DNA, 915 bp, Lactuca sativa
  Predicted polypeptide sequence is orthologous to G720
cttcggcggggggattccttctatatttacttcattcgacgaatcaagtagtttataaatgagaaaattaatgatgatttgagagatctgatgatataaacgatgccagacagctatggtttgcactgcaaatgatttattagggtggaaagattttccgaagggtcttagagtcttgctccttgatgaagatatcgattctgcaaatgtaataaaatcaaaacttgaagaaatggattatgttgtttctgctttctatagtgagaatgatgcattgtcggcgatttcagacaaatctaaaggcttccatgtagctatagtagaggtgagagcaggtaacgaagatggaaggtttaagtttcttgaaagggcgaaagatttgcctacaatcatgacttcagatgtgaattgcatcagtaccatgatgaagtgcatagcacttggtgcagtcgagttccttgagaaaccattgtccgaagataaactccgaaacatatggcaacatgtggctcacaaggcgttcaatgcaggagctaaggatgaaaatgaactgttgaaatccgaggaagctttgattcgtttggaaaaagtaggtataaagcaagaaatcattcaaaataaagaacataatgaggaggtatcggttgaaagcgataaatatcatgctccatcgaccccacagttgaagcaaggaatgaggcatgttgataatgaagatcaaacgaatctctcaactgagaaagagtgtgtagaacatgatggtgagtccaaattcgtcgaaattacttgtgatgatcatttagtcgttgataatgttatggagacaaacttctcaaagagtttggaagagggaatcaacaagcccttccagtaatgaatgttgccccgatccaaaagatggtaagaagcaaaatg

SEQ ID NO: 8429 - DNA, 708 bp, Lactuca sativa
  Predicted polypeptide sequence is orthologous to G730
tgttggacccgggattcggactgatggcccgaatgcgggccgtttaaattctatccttctcaagatatagtttgtttccttcggaatctctatgttctccatgcaaccaagcctcccttgaagaattgctccatagaccatactgacaatctttctcttgatgaacactagaccttcctccatgttccgttgataactgatctgtcggccttgggttacgaatatcaaacatgatatcgtccagaattatccccagatgacccattctcgtaaatatcagattgccctgaagacacaggagctcgatcagtctgtctttactgttcggtacatctgcaagtgagatttaacatgtgacaaagctaaatctttcacatccattaactcaagaactgacttgggtgttgctctttcatggccgcctaaaagctcaacagcatggacaaagcgagcatgaagggtagtcgtccagcgcatcctcggagccctcatactgcgtttggaggggaacctcgatgataaaaatcttgatcggacaatattgataatattattgctatgaattatagaactggtggtcgtataattagtgcaagaatctaacgaaggctggttcttatgatgcggattgcgcattatcgcgaaattgggaggggtattctggtaatcaactcgaattcctcttataggactccagaaacctaattt

SEQ ID NO: 8430 - DNA, 987 bp, Lactuca sativa
  Predicted polypeptide sequence is orthologous to G730
gcggggcttccgtttcatctctccctatcaaaaaaaaaccctctttcttttctcactacattttcccttccttcctattctgcaaaaccaatcctactcctactttatactctctcagtccagaataccatgcaaagattaatgcaatcataagtcactcaaccagcatataatcagaactacatcccctttcactgacacccactctttatccatcgaaatgtttctgagctcaaatttttctccaatgacaaataacgaagctacaactttcccagatctatccttacagatcagtcctccatttgcagcggatgagtataacatgacaggttgtatcatcaaaaggccaccctccacctcaagcagcagcagcgatttaagccaagaaaacaccttcaaccatcaccactaccaacagcttatagcagcagatatggatggttttgttaaccatggtttgcagtttgatcagcagcagcctcagctgaccttggggcctgagatgggagctttgaatgattgtcatcccaaccaccattatcatccgcgtggaccacgtcaaatctactcctacgatttcaagagaagctcgaggatggttaacagtgtcagaaggggcgctagagctcctcgtatgagatggacctcgtccttacacgcccacttcatacatgccgttcagctccttggtggtcatgaaagagcaaccccaaaatcagtgcaagagttgatgaatgtgaaggatctaaccctagctcatgtgaagagtcacttgcagatgtacaggacagtgaagagcactgacagaggaggagcagttgcactgacagatactcaagtaattaatcccagggctccaatctcatttgttgaagtagagggagatatatcaccatctactacactgcatatatctcaaaggagatcctttgaatcgtctttggaaacgaatgatttgagtttacacatgaaaaaaaatgtatc

SEQ ID NO: 8431 - DNA, 556 bp, Lactuca sativa
  Predicted polypeptide sequence is orthologous to G869
gaacctgtggagcggaaggattcggcggatcaaaccggaaagaagaaattaaccggagttcgattgcgaaagtggggtaaatgggcggctgagatccgtgatccatttagcagaaaaagaatttggttgggtacatataacaccgcggaagaagcatcgaaagcgtatacgaccaagaagcaggagtttcaagcaagattgtcggcttctgccccaattcgacccaaatccgatggcgaatcgtcgacacaggtttctcaggaggcagatcattactctacggagggggaggagaaggagacgcgtttgtcgggtcgggtcgttccggatcacgccccaattgcgaaatcgaaagtggttcattggaagaagtgggatagatggggtgccaatgttcataacccggtaatcaattcaaacatccagtctgatgatacatgtgatgctgaagaagaggcttcaaatacactccaatcgatgaagatgggtttgaggccgggttacatggccccattcggatcagaaagtggctcatctcgtaaatcctcaaagaccg

SEQ ID NO: 8432 - DNA, 712 bp, Lactuca sativa
  Predicted polypeptide sequence is orthologous to G869
agagagagaaaggagaagaagagctgggttttatgtcggcaggttcattgaatctgattggggctccattgaagctctgtatttcttttgcgttgttcatctgttcttatctctgctgtttcacccagcagagtcttcttctctgtgttccgactgtttcgatgcgtttgaggccaaaaaggacttgttctggagtcgagtgtttcggtggttttcacataaataggttgtttgatcttttcttgttcttgagagggcctttgacataaaccctaaatcaattttggtttattttccggcttttatttttgttttgaaagttttgtttagttttgggtatgttttgaggctgcaaaagccgccggagttttgaaaacgataacacaaccgccgatgaatcaagagaagaagtcgagaaacagagcgaagataatggaaccaaacaaactcatgcggaagatccgggttatctgttgcgacccggatttgaccgattcatcagatgacgatgagcccaacaaaaaaccctttgggtcaaagcggattgtccgagaaataaagattccggtcggcgacggtggcttttccggtggctgtacgacggtgatgacagcgactaaagaacaggagactgaaagttcatgtcaagatagcaacaacggtgagaaaagttgtgggaagagaaaaagagtttcgaccaaaacccccggtc

SEQ ID NO: 8433 - DNA, 947 bp, Lactuca sativa
  misc_feature (856)..(856): n is a, c, g, or t
  Predicted polypeptide sequence is orthologous to G881
gcggggtcatcagttgacaattaattcttcagaccagcaataatggtggcgtcatcatttgccatagacctcaatcttttccccttccacaaaaccgatgacacaccaattagagaagttcacaccgatgatgattatgatgacgatgatgatgatggggaggaagaagacgattgttcgtttggaaaagaggttgatgatcatatgatcagcggggatcatttaagcaggataaacaacgaaaacaagaagctaaaggagatgcttaagatcgtatgggagaactacaactctcttcaaacgcatgtcaagaaactaatgcaagaaaaacaagtacctgaatcgaatccaaagaaaagaaagctggatgagacagttcaacaaagcttgtggaagagacagaattggaacttggaatcaccaaggaatactggggttcaaagagtttatataccaacagatccgtctgataaaagcctggtagtcaaggatggatatcaatggaggaaatatggacaaaaggtgactagagacaacccatctcctagagcttattataagtgctcttcttcaccaacatgcccagtcaagaagaaggtgcaaagaagtgtggatgatcctggtgtagtagttgcgacctatgaaggtgagcacaaccacagacgcacaaaggaagaggctgcgtatgccctagccaatgaacataagatttcaagtagtgaaagaaggtcaaactccccaagatttgatgaggttttggtggaaaaaatggctacttttttaggaaaagatcctgatttcactgcagaacttgctgctgccatttcctccaagattttggaagtcgatttgttcntagcatgctaatcgattcgtattcatctcttttgtatatgatatgtggtttgaacaagaacacaaagagttttataacgggtatttgatcg

SEQ ID NO: 8434 - DNA, 700 bp, Lactuca sativa
  Predicted polypeptide sequence is orthologous to G896
agctacatcgataagatgcgccatatgtcaagccatcacccaccttaacgatcctcgtgtcggagctccgcggcctcataccggtggttatccgggaccttctccatcctcttatgctcctcatcaaccctcgccttacaaccacgctccgccagggcctccgccgtctgcacatggcaggaagaaggcggtgatcgtaggcatatcgtataaattctcgaggcatgaacttaaaggatgcattaatgatgctaactgcatgaaatatcttctgattaataagtttaaatttcctgaagcttctattataatgcttaccgaggaacaaacagacccttacaaaattccaacaaaacaaaacatgaggatggcacttttctggttagttcaaggatgtcaaccaggcgactcacttgtttttcattattctggtcatggttcacgacaaaggaactacaatggtgacgaggttgatggatatgatgaaaccttatgccctctggattttgagacacagggtatgattgttgatgatgaaatcaatgcaagtattgttaaacctcttccatttggggttaaacttcatgcaattattgatgcttgccatagtggcactgtattggatcttccattcctttgcagaatgaacaggagtgggcaatatgtatgggaagatcatcgacctcggtcaggtatatat

SEQ ID NO: 8435 - DNA, 734 bp, Lactuca sativa
  Predicted polypeptide sequence is orthologous to G896
gatgcaaattctcgtaacaaacaaatatggaaactcaacaactctgcaaagggtgctacaattacgtgacagtagcacctgggagacgttgtcccatctgcaatacaatcgccaagcccaacaaaagaactagtcaacgtattgtccctgggatactccagtttatcgatggctatgccaacacacgttcaaacagcaactactacaatagcgtccatggacagcttccacaaccaccagcatatggaggttattacgctccaccggtgtatggttctggtacctacagcccacagccaccgccatcaatctacagtggaggttataataaccctccaccacagtctccggctgtgtatggttacggttatggccaccccgaaccgcagacgtggtctcctttgatgcataacaactacctccaacaatcaccggaggttcatgagaagaagaaggcggtgctgtgtggcgtgacctacaaaggtcacccgaagtcactggctgccagtataaataacgtcaagagcatgcatcaattattgctgaaattgggtttcccaaatggttccatccgcatcctcacagaagaagaaccagaccccaccaggacaccaacaagacgcaacatattgatggcaatggagtggctcacaacagattgctgttccggggattcattggtattctattatgcaggacatggctctcatgtgcctgataccatggagatgaaa

SEQ ID NO: 8436 - DNA, 907 bp, Lactuca sativa
  Predicted polypeptide sequence is orthologous to G896
gccttcccgtcgcatttgagctattccccgccgtcggtatatggtaggaagaaggcggtgatcgtcggcgtatcgtataagaacactagtcacgagcttaaaggatgccttaatgatgctaaatacatgaaataccttctgattaagacatttcagtttcccgaatcttctattcgtatgctcaccgaagaagaaacagagtctaacaggatcccaacagcacgtaacataaggactgcactctcttggctaatcgaaggatgtcaaccaggagactctctcgtctttcacttttccggccacggttcacggcagaggaacctcaacggcgacgagcttgatgggtatgacgaaaccttgtgccccttggattttgaaacagcaggtatgatcattgacgacgaaatcaacgcaacaatcgtcagacctcttcctctgggagccaaacttcatgcaatcatcgattcttgccatagtgggactgttctagatctcccattcctctgcagaatgaacagttctgggcattacgaatgggaggatcatcgtcctacagcaccaggcatatataagggtagtaatggaggcgaagtcatttcgatcagcggatgtgacgatgatcaaacatctgctgatacatcggcgttatcaaaaatcacatcaacaggagcaatgacgttctgttttatagaagctatagaacatggaaacgcgtctacttatggaagcttgttaagttcaatgcgtaacaccatccgtaatgcatcaagagggtttggttctgcgaattctgtgcatgatatgctttcaagtaatcgtgggttcactcaggaaacacaattgacttcatgtgagcctttcgatgtgtatgcaaaaccattctccttctgatcttcatatatgatga

SEQ ID NO: 8437 - DNA, 723 bp, Lactuca sativa
  misc_feature (613)..(613): n is a, c, g, or t
  Predicted polypeptide sequence is orthologous to G927
tcgaataatgttgcctttaaacttgagcaatgatgatgaaccggtttttgtgaatgcaaagcaatatcatggaataataagacgtagaagatcacgtgctaaggcagaaatggcaaataaagttttgaaaaatcgtaagccatatatgcaccactcacgtcatctccatgcaatgcgtcgaccaagaggaaacgggggtcgtttcttgaacaccaaaaaggaaaacaactgcaaagatgaaaataccgatcaagaaaaagacaaaaaccttttaaagtctcctaattatacaattttcatgtccaatcatcacaacttcacttctcatcgtgaaccaaataacatgttctcaacgggagacgttaaaagtcttccgattggaaacctttcggtggtctctttttcagaaatgatgtccgggaacacagctcccagacatagttttggcatgcatggcaaatgggttgcagcgactggtggtggtgatggtcgctgcaattttacagtctaatgtcagagatgaggtcctgatgtgttgtatgtatatcagcatatcgggacctcatatctttacaaccagatgaaatatttgaaatatttatctggttgtctntggcaactcatccttggcttattgtgttgaggttgtctctaacctttctcacgttgcatttcatagtgtgcaatgttttgagagttgtatgagatggtcatagccttaat

SEQ ID NO: 8438 - DNA, 275 bp, Lactuca sativa
  Predicted polypeptide sequence is orthologous to G929
ggccttatggcctctgtgcgggagtatgggcgagagcatatactgatataatacaagaattgagtgtttttgtttatgaatgattctttgtggatttttgcaaacatggtaattgtgtggtatgtaatatggtttttgtagactataaagttttttttgactccctggttgtgggacgggagcatacaaagataggaaaataagttatgtaatggagtacatacactcttattatgattcgtttagccgaaaattttggaaataggttgtccaac

SEQ ID NO: 8439 - DNA, 894 bp, Lactuca sativa
  misc_feature (846)..(847): n is a, c, g, or t
  Predicted polypeptide sequence is orthologous to G938
cggggaaactacagaataccccttttctttctctctcatctataaactttggaaaggggtttccaggagaaaaaaagaaatcaaacccaccattcagattggctgagaatctggagatgcatatgtttgatgaaatgggattttgcgaggaacttaacgttttctgtgctcaaaatgcgcaaggagagattagttctcttccaactgaaaccgggacgatggtggatgacgatttcaccgatgaagaaatcgaagttgatgagctagaaagacgaatgtggagagataaaatgaaacttaaaaagctcaaagaatcatgcaacactaaagaaaacatggatacagcaaaacaacgccagtcccaagagcaggcgaggaggaagaagatgtccagagctcaagatgggatattaaaatacatgttgaagatgatggaagtctgcaaagctcaaggtttcgtttacgggattataccagaaaaaggaaagccagtgagtggcgcatccgataacctccgtgaatggtggaaagataaagtccgattcgacaggaacgggccggcagccgccgccaagtttcaagcagataactcgatcgccggcgagaacgagaagacgagttcaattgggtcgacaccacactcattacaggaacttcaggacacaactctcggctccttgctatcggctctcatgcagcattgcgacccgccgcagcgacggtttccgttggaaaaaggtgtaccgccgccatggtggccgaccggaaacgaagactggtggccggagttgggtttacagaaggaccaaccgggcccgccgccttacaagaagcctcacgatttannaaaagcgtggaaagtcggcgttttgacggcggttatcaagcatatgt

SEQ ID NO: 8440 - DNA, 942 bp, Lactuca sativa
  misc_feature (845)..(845): n is a, c, g, or t
  Predicted polypeptide sequence is orthologous to G993
catcatatttctctctccataattcataaaacctcattcatcctcctgtttctctctctttcaagaagactaattagtaatggatggaagttcaactgatgatcaaagcacaacaacagagacaacttcaacagttgcagcacctgtgactacgcctccactgatcggcagcggcggcagcatggttgtcgacatggaaggtggtttggaagccgagtcaaggaagctgccttcgtcaaggttcaaaggggtagtccctcagccaaacggccgttggggagctcagatttacgagaaacaccaacgcgtgtggcttgggacctttaacgaagaacatgaagctgctaaagcctatgatacagccgttcagcgcttccgtggtcgcgatgctgtcaccaacttcaagccgcttccagccgacacagaagaagccgggttagaagccagtttcttgaattcccattcaaaagctgagatcgtcgatatgttgaggaaacacacatacaatgatgagctacaacaaagcaaaagaagctgcaacttaaacaaaaccccttgtacaaacgggtttagatcgggtcaacagttggtcaacgcccgggaacaactctttgagaagacagtcaccccaagcgacgtcggaaaacttaaccgattagtgataccaaagcagcacgctgagaaacacttcccgttgcaaagcgaaagcacttccaaaggtgttcttttacatttcgaagacatcgggatgaaagtatggagatttcgttactcatactggaatagtagtcagagctacgttttgaccaaagggtggagccgattcgtgaaggaaaagaacttanaagccggtgacattgtgagctttcaagatccacgggttcagacaagcaactttacatcgactggaagacaaaaaacgggtcgggtagctccaatatt

SEQ ID NO: 8441 - DNA, 579 bp, Populus tremula x Populus tremuloides
  misc_feature (502)..(502): n is a, c, g, or t
  Predicted polypeptide sequence is orthologous to G1033
cgctcctccctcaactcccttcacattctcacacgtaaaatatcctccccccttctctcctcctctttctctctctttcaaaccctatctcagctcacctaccggattcgcaatgaaaggaggtagatcgaagtcagatactaagaccaccaaactcttctgtgaacaagaagccaaccaaaggaggaggagctgcagcagcccggaaatcaggaaaggcagctaaggatccaaacaagcccaagaggcctgccagtgcattcttcgtcttcatggaggagttcagagagcagtacaagagggaacaccctaaaaacaaatccgttgcagctgttggaaaagctggaggagataaatggaagtcatgtcagaggctgagaaagccccctttgttgccaaagcggacagaggaaggttgatatgagagagatgaagcttacaccaggagcaggctgagggccccaggaagagaggatctgagagtcatgtcagggtcatgtgncgtgagtgtgagaggattgggaggagtgcgcgcggtggttgggcgggatgctcgtcttgtttgccttttggctttgt

SEQ ID NO: 8442 - DNA, 374 bp, Populus tremula x Populus tremuloides
  Predicted polypeptide sequence is orthologous to G1033
ttactagtcactacctatttgtcatgctctttcaaaccctatctgagctcacctaccggattcgcaatgaaaggaggtagatcgaagtcagatactaagaccaccaagctctctgtgaacaagaagccaaccaaaggaggaggagctgcagcatgcccggaaatcaggaaaggcagctaaaggatccaaacaagcccaagaggcctgccagtgcattcttgcgtgcttcatggtaggagttcagtagagcagtactaagcagggtaacacccgtagaaaacaaattccggtgtgcagcctgtgtggcaaagagcctgggagggagattacaattggaagtccactgtccagagggctgaggaaagccccctttg

SEQ ID NO: 8443 - DNA, 620 bp, Populus tremula x Populus tremuloides
  Predicted polypeptide sequence is orthologous to G1033
aactctcttcctattctcatacccaatattctctctctaccactcttcctctctctttcaaaccctaaccccacacaccggtttctcaatgaaaggaggtagatcaaagtcagataccaagagcgctaagctctccgtgaacaggaaaccaaccaaatttttatcagcagcagcaaagatttcaggaaaggcagctaaggatttatttagcctaagaggcctgctagcgcatttttcgtcttcatggaggagtttagagagcagtacaagaaggaacaccctaaaaacaaatcagttgctgctgttggaaaagctggaggagataaatggaagtcactgtcagcggctgagaaagcgccctatgttgccaaggctgataaaaggaaagtcgagtatgagaagaagatgaaagcctacaacaaggagcaggctgaagggcccaaggaagaagaggaatccgagaagtcggtgtcggaagtcaatgatgaagatgaagatgatgaggagggcagtgcagaggaggatgacgacgacgagtaggatttggacatggggaatagcatagtcatgtaggtcgtgacagtgtctggacattgtatgttaatggcggagtattggca

SEQ ID NO: 8444 - DNA, 694 bp, Populus tremula x Populus tremuloides
  Predicted polypeptide sequence is orthologous to G1140
ggtgtttgttttactttcggtaacaggaagcttttgattcctctgatcagacctaactcaagccagctcccaataagtataatggctagagagaagatcaagatcaagaagattgacaacgtgactgcaagacaagtgaccttctccaagaagaggcgaggacttttcaagaaagctgaagagctttctgttctttgtgatgctgaggttgctgtcatcatcttctctgctaccggcaagctctttgagtattccagctccagcatgaaggatgtgcttgcaaggtataatctgcactccaataacctcgacaaaataaatcagccgtctcttgagttgcagctagaaaacagcaatcacatgcgattgagcaaggaagtttccgagaagagtcatcaactaaggcggatgagaggtgaagatcttcaaggactaaatatagaggaactgcagcaattggaaaaggcgcttgaagtaggacttagccgtgtgcttgaatccaagggagaacgaattatgaatgagatatccacccttgaaaggaagggagtacagcttttggaagagaataagcaactaaaacagaagatcgcaaccatttgcaagggaaaaagacccgcccttgttgatttagacacagcagttcaggaagaaaggatgtcatcggagtctacaaccaatgtttgcagctgca

SEQ ID NO: 8445 - DNA, 323 bp, Populus tremula x Populus tremuloides
  Predicted polypeptide sequence is orthologous to G1146
ttttttttttttttttaaaagtcttagaattacaagacattcaatgtcatacaaattttgaagaaagcgataaaaagcagcagttttaaacacgtaatttaaataatacacacccaacgctgacacaaccagcttgatattgtatgtaagggtaagcagaggcctcccatagatttaaacaatccaaaagtggggatgtctcgaatcctaacagtagaacataacccgcttgacattctccttcaaggcaggcaggggcctcacagcagcattagcagcaggtccgcgtgtggctcgaccacctgctcctccacctcctcgcc

SEQ ID NO: 8446 - DNA, 613 bp, Populus tremula x Populus tremuloides
  Predicted polypeptide sequence is orthologous to G1146
ggtatcatgatacaggcagggagaaagatgtcttcctcaagttgggcagtggaacatgatgaataagaaaatggttaatggaggcagagtcaataattggatctgcatcaatttttcaaggaatgtccaggacagtgtggcccgaggattttgctatgagcttgcacagatgtgccacatttctggcatggactttgctcttgagccattacttcctcctgttggtgctcgtcctgagcaagtagaaagggttttgaaaactcggtaccatgatgcaatgacaaaactccagccacatagcaaggaacttgacttgctcattgtgattctcccagataacaatggttctctttacggtgatttgaagcgtatttgcgagacagatcttgggcttgtttctcagtgctgcttgacaaagcatgtattcaaaatgagcaagcaatatctggccaatgtggctctgaagataaatgtgaaggttggaggaaggaatactgttcttgttgatgcattatctagacgtattcctctagtcagtgaccggcccactattatttttggtgctgacgttactcatcctcgtcctggggaagactcaagcccatccattgca

SEQ ID NO: 8447 - DNA, 826 bp, Populus tremula x Populus tremuloides
  Predicted polypeptide sequence is orthologous to G1146
gaatatgatgaacaagaaaatggtcaatgggggaagagtgaataattggatctgcgtcaatttttcacgaaatgtgcaagacagtgtggcccgaggattttgctatgaacttgcacaaatgtgtcaaatttctggcatggactttgctcttgagccattgctggctcctgtcagtggtcgccctgagcatgtagaaagggttttgaaaaatcgataccatgaagccatgaccaagctccggccccatagcaaggaacttgacttgcttgttgtgattctccctgacaacaatggttctctttatggtgatttgaagcgtatttgtgagacagatcttgggcttgtttctcagtgctgtttgacaaagcatgtgttcaaaatgagcaagcaatatctcgctaatgtggctttgaagataaatgtgaaggttggaggaaggaatacagtacttgtggatgcaatatctagacgtatccctctagtcagtgaccgacctactattatttttggtgctgatgttactcatcctcatccgggggaggactcaagcccatctattgcagccgttgtggcttcgcaagattggccagaggttaccaaatatgctggcctggtttgtgctcaagctcatcgacaagagcttatccaagatttatataaaacatggcaggatcctgtacgagggacagtgtctggtggcatgatcaaggaacttctcatatccttccgtagggcaaccggacagaagccacagcgaataatattctacagagatggtgtcagtgaaggacagttttatcaagttttgttgtacgaactcgatgct

SEQ ID NO: 8448 - DNA, 557 bp, Populus tremula x Populus tremuloides
  Predicted polypeptide sequence is orthologous to G1198, G1806, G558
catcctataggatgcggaaacccacagacgttgttatgtggataggtggctttcctatctgaactcctaacttttggaataactggacctctaactgacaacactatgggcatttacaacttgcaacaatcttctcagcaggcagaagatgctctctcacaagggatggaagcgctgcagcaatcactggcagaaaccttggctaatggcaaccctggctcatcaggttcgtctgcgaatgtggcaaactatatgggtcaaatggccatggccatgggaaagctaggaactctagagggattccttcgtcaggctgataatccgaggcagcaaacactagaacaaatgcaccgtatatcgacaactcggcaatcagcccgtgctcttctagctatacatgactatttctctaggctacgagcccttagttctctctggttggcccgaccacaggaatgagtagcagtatgttgcccctcaacaaaattaacatgaatatttaccacctcaccaccctcctacttggccttcagttctcattatgccattgggtggga

SEQ ID NO: 8449 - DNA, 710 bp, Populus tremula x Populus tremuloides
  Predicted polypeptide sequence is orthologous to G1198, G1806, G558
ttttttttttttttttttttttttaaatcaactcaaaatgaaagtttctcaactttcaaaatcatttcgagattgtcaagtacaaggacagcatattctaaacttgccattacaactgtggataaaatgaaaacaggaagacgatcatcaggctacaaataattaacattgatgcatactgtacttgaaggactcaaattctatgctctaagatgattagtatgaaagaaagagcagtaccatgatacatctgagactacaacaagaggaatgcagaaaagagaagctattttgagcactagaaacaagaagcactgctggatgtggaatgagcctttgtgatttttgtgcagaactcgagttcagatgcaaagcagattcactctctcggtcgcgcaagccagagggaactaagagctcgtaaacgggagaagtaatcgtgtattgcgaggagagcacgagcagactgacgggtggttaatattcggtgcatttgctgtaatgtttgctgcctcaaattgtcagcctggcgaataaatccctcgagggtgcctagttttcccatggccatggccatctgacccatgtaatttgccacgtttccagatgaacctgaggagccaagaggtccgctggacaatgtctcagcaagggactgctgcaatgcctccatcccttgagataatgcatcttctgcctgttgggaggac

SEQ ID NO: 8450 - DNA, 475 bp, Populus tremula x Populus tremuloides
  Predicted polypeptide sequence is orthologous to G1198, G1806, G558
gacggtaagacaggtggcgcggtgttttgtggtgatcggagagtattatgggaggctacgggcacttagttccctgtgggcatgtcgtcctagagagacaatgatgagtgaagaaaactcatgccaaaccaccactgatcttcaaatggtgcacccttcacagaatcatttcgccaacttttaatataaaaaaaacatgggatagcgatacaaaagagccagacagcttgccttcctcggtgactgagaacctgtattgcgacaaatgttatgggctgttagaattcggataagcactttagtagtgaagataggatcgttttcttttcttttctttctcctctgccttcttcattatctttatatcatcaatcactatgttatcttgtaaatgcaaatcaattttatatgcatgaggagctttctcgcttgctttaaaaaaaaaaaaaaaggggaaaaaaaaaaaagggggggg

SEQ ID NO: 8451 - DNA, 574 bp, Populus tremula x Populus tremuloides
  Predicted polypeptide sequence is orthologous to G1272
taattgaggcttgcaagtttctttatgagaggtggtccccaacgtttgcggtaattgtagctcagaaaaaaccaccacactaaatttttccaacctggatctcctgataatgtcccacctggtacgatcattgacaacaaagtctgccatccaagaaacaatgacttctatctctgtgctcatgctgggatgattgggactacaaggcctactcactaccatgttttgttagacgaggttagtttttcagcagatgatctgcaggaacttgtgcattccctctcatatgtatgccaaagaagcacgactgccatctctgtagttgcaccaatctgctatgcccacctggcagctactcaaatgggccagtttatgaagtttgaagacacgtccgagacttcctcaagccatggcggggtgacatctgcaggagctgttcctgtcccacagttgccgaggctgcaggagaaagtttgcaattccatgttcttttgttgagcatgctagccttttactctgtatgtaaataaaactagatggacagcaggtgtttggggtttctgaatttggtgca

SEQ ID NO: 8452 - DNA, 869 bp, Populus tremula x Populus tremuloides
  Predicted polypeptide sequence is orthologous to G1274, G1275
gactgaacattcggttgattgctttggtgatcagagaattatgatctgattttttttatactaagatgtccagtcctaagtttagcacacaggaggatacacccgagcaaagtgactacgctcacgaccagctgtccaattttgagctctcagagttcttgaccttcgatgaatggatagcgctagaagatgctccgtcgtccatagcttccagttatgcctgcaacccggtttatagagcacgtgtcgttggcgagtcaggtggaagtagcagccctcgtgaagagctaagtggtggagagggtgaagaagggcgagagaagaaggaagccaaagaaagggttgctttcaaaacaaaatcagagatcgaaatactagatgatgggtacaagtggaggaaatatgggaaaaagatggtgaagaatagtccaaacccgaggaattactacaggtgctcggttgaaggttgccctgtgaagaagagagtagaaagagacagggatgatccaagatatgtaataacaacctacgagggcattcactctcaccagagcttttcctagttctcaggcgaagttgcactggctcatggtttcagatcctcgggcacgcttgatattgatgaacttgttaaggataacgtattgcatcgatcttggtttcactttgctgcaatctttaagagttggaaagctcatggacgacttgcaagaatatcagacaaagtcagctttgccagctttttgactagctataatataggaccttgagtggttttttggtactaattagtcgggatcccctcaatatatgcaatattaattgtgtctgatacaatttcagctgtaattaattatggttcttataaa

SEQ ID NO: 8453 - DNA, 467 bp, Populus tremula x Populus tremuloides
  Predicted polypeptide sequence is orthologous to G1341
tcaggttcagctatgagaagcgtaaccagctggtgtaccgcctgcatcccaggccgtaagcagaaagaaaccaagactgaagaatcggagaaatctttaagaaaaaaatcttcccgcgacgaatctagtggtcctggtgaccaagctcatgaaggcagcagccatcaaggaaccacccatgccgccagtagtgctgatactggtggcgcagctgttgtcgttatgactgcaacccatatgtctgacatggaaggtagttctcatgatggcggcggcggcgacggaggtggcggtgacggttaatcattaagcagtccccgtttgattgtgttcgtgattctttttattgatatcgtaatggttttttctcttggattattatatatcactgctgcttgcttctttactttccttgtttcaagttattgctctaagatgttgaaagccatggttgtgatgtgcgcgat

SEQ ID NO: 8454 - DNA, 538 bp, Populus tremula x Populus tremuloides
  Predicted polypeptide sequence is orthologous to G1341
catcggccgttagacagatccaccacgtcatcgctgtgcaccacctgctccagcttggtcctgtgatgctccaccactcagatgcttttgcaccaccaccgccttggccaagaccctttggtcatcaaccaccccctcatcaccaccatgacacctccacctcctggaccccctggtcctcccccaccaccattctttgatccctacaggccaccacctcctccttactagcaagtactaaaattctatacacttcagcctgcatacgtatattatacaacctagtaaccttccgtcctcttatcttgcctatgtgcaagctagatgtgtaaagtattggatttggatgtgctagaggttgtttgccgcacaggggaaaagaacaggaagccatccatccactattcatggatcaagaaagagaggtgtgtgtacacacacacacatatagaatggtttttcaagtgtgtacttgttagtattattatcttcttttatacaatgtacttttatgactgatatgcttttatgatcaata

SEQ ID NO: 8455 - DNA, 603 bp, Populus tremula x Populus tremuloides
  Predicted polypeptide sequence is orthologous to G1364, G481, G482, G485
ttttttttttttttttttgattggaatcggcttggattttgggattttacaaaataatcttagaatcaggctctacatcagttattaatcttgtaactcaagaaactgatagggcttatgctggttctattatcatcgcttgagttaaaagaactactggcaagagaatgggtgggtggtccaagctcatcatatttattaggaagctaatgcagcagcatagcaaactagttggtaagctatgatttgatcaatacaagtccttgtgacttgattaggtcgacttttccacgcttagtttaattctctggggcggtcgttggcccttgaattaccttgatgatgaaacccgccagcaccgtacacgtgtccttgatggtgatgacccatcatcatcatcccgccatacatcccttggcccccaccaccattaaaccctccacctccaccgccggtggaattagccccgcctccacctcccgcagcaccactcccaccagacccacctccaggaccttccttctcccctgctggtcttcccatggaactcttctctccttccatctccctatacttctgcaagtaaatcttcaggggctccac

SEQ ID NO: 8456 - DNA, 362 bp, Populus tremula x Populus tremuloides
  Predicted polypeptide sequence is orthologous to G137
caatgtttgcaaattcagaaaagtgttgatgcataatttgtaatttccagaaaccattatataaaatgatggggatccctccctctctcatccttgtaaagcttaataactttttacatgcagttgtccagcttctctcttgtatacaatcttttacatgcatcgatccaccttcttcactaagctgtggtggggtaaccctcggtttctcttgatatttgtgaaagttgtaaccttttgcaattgttggtttgcaggaaagttcggcataagaacctttttcatgttgttttacatggtcataccttggaatgtgattgggacatatgatctcgtaaaaaaaaaaaaaaaaaaaaaaaaaa

SEQ ID NO: 8457 - DNA, 561 bp, Populus tremula x Populus tremuloides
  Predicted polypeptide sequence is orthologous to G1382
gaaacacaatcatgatgtacctacagctaggacaaacagtcatgacatggcgggaccatcagctgtgaatggaccctcaaggatcagaccagatgaaaatgagacaataagccttgatcttggggtcgggatcagttctacaactgaaaaccagtccggcgatcagcaacaagctttccgtgcggaacttatcaaacatgaaaaccaagcaagtggttctagtttcagagtagttcatgcaaccccaattacggcttactacggtgttttaaatggtggcatgaatcagtatggatctaggcaaattccaggtgaaagccgtagcattgaaattccaccttatccatatccgcagaacatgggaagattattaacgggtccataagtttgtccgagttttaaatttgtttcccgcatgcttgccttacagctggtaaatggcaaaaggacaaacaacaataattcgtctcttcttgttctccggggacaggacaaaatgaccgctatggaataaacctgttgcaaacgctactggaatggttccacctaataggtaatcca

SEQ ID NO: 8458 - DNA, 707 bp, Populus tremula x Populus tremuloides
  Predicted polypeptide sequence is orthologous to G1389
tcttttaaataatttacaacattataatttatttattaaaaacttcataacttgtctaaaatattatctatctaacaagaaacaagacttcaaaattaaaaataagtcaacctttgatttggttgattttacataacaagatgataatatcatagctaagtggcataacatggggagttttcttaaaccaatccttcgactaattgagatcatcaggtgagaatttttgcatgatcttgatttcccattggctgaacacccgaatcaaaaaagcttcccactgcagccttgtagaaaatctcattgaaccatgacggggatgatgaagcagatgatatggtggcgaaggtatcgttctatcgctttcaacttcggactgctggttgtcaatctcatgatccgacgatcctgacccttcaaatgaagtctcgtggtagtcaatgtcatgatccgaccatcctgacccttcaaatgaagtctcgtagtagtcgatgtcatgatccccctctgaaccttcaaaagactcgtggttgtaaatttcatgattcaccgcttctttgcgccgtccaaatgaatcccattgatcaaacatcgtgacatatgtgacatgtttgtctatcacatggatcccacatcgtaccacttcactgttttcggacctcaatatcacatgtgagttccaatccatcatctccacagtatttttc

SEQ ID NO: 8459 - DNA, 765 bp, Populus tremula x Populus tremuloides
  Predicted polypeptide sequence is orthologous to G1419, G43
ccggggaaggaaatcaaaccttcacttctctcccattctttgaattcaatttccagttttgcagcttcagctctttgtttctgatcttcaatttcaatcctcctccaataagtaccccagaaagcaaaagaaaattagaagagaaattaacccctcttatcaattatggcatcttttgatgaagcttcagctttggaactcattagggagcacctcttgactgactttgcttccatggacagcttaatcaccaatcttgatgatctttgcagtacttccagctcctgtattactgctgactacatcaagactgaatcaacagaattcgatccctttgatcaatcagagcagccacaacccaagctgcagagtcaatctagcatcgaacccaagcctcaagcctcaccaaagtctccaagcactctaagccagagaaaaccatccatgatcaagaacatcgcaatccctccaccagcaaccttgaacatgaccccaaaagcagtacagccggtggtgaacaaggcagatgtttcaagtgaacaagaaaggcattacaggggcgttaggcgtaggccatggggcaaatatgcagctgagatccgtgaccctaacaaaaagggagctcgtgtatggcttggaacatttgatacagccattgaagctgcaaaagcttatgacagtgctgctttcaggctacgtggaagtaaagcaatcttgaatttccctcttgaagctggaaagtctaattctcagcaacctgaacaa

SEQ ID NO: 8460 - DNA, 824 bp, Populus tremula x Populus tremuloides
  Predicted polypeptide sequence is orthologous to G1421, G1750, G440
atttgtcactagctacttatataatccctccaactctggagatccaattaagcttagtataaagtagcttccttcagtttttttcctccaagaaaccaataagaatcttcatcgttgatcaaccaaataaattaagctagctagaccctacctgagctggccagtacatggttctgccgctatgtcttgacccacttcttaattgaatacaaaaaccaacccttggtaccacccaccatgcatcttctattccccaatgaattacaacccatgtttacctccaacgccaccatgtccgttcaaccaaaagtcaaatttactgaacatgtattcatcactagtaagctcatcgagaaccagcagctgcatccttcttcaagaacccgccaaagacttgttagaatcatccataccgaccctgatgccactgattcctccagcgatgaagaagagggagaacaagagaggaagtttgtcaagagagtgaagagacaagtgagtgaaataagcttgttagagcaagaaacaacagcaccagcagctccttcttccacaacttcaaatgatgatcaagaaccaagaagaaagagaccttcttcaagattaccagtacctgacgtatctcttcagaaaaagttcaggggtgtccgtcagagaccctggggaaagtggtccgccgagatccgtgacccgactcgacggaaacgggtctggctcggcacttttgacactgcagaggaagctgctacggtatatgatcgagctgactgtaactaaaagacccgacgccgttacaacttcctactaactccgtatacggataa

SEQ ID NO: 8461 - DNA, 396 bp, Populus tremula x Populus tremuloides
  Predicted polypeptide sequence is orthologous to G1478
atcattttgagagagatctgaaaatgtgaggggtatcatcaggagagagataaccaatgcggttcttgtggcggagaggtggtttcatctaaggcaacctcaagattggtttgctgtgagctgtgtggatcaagggcatcattatattgtcaagcagatgatgcacttttatgtcaaaaatgtgacaaatgggtgcatggagcaaatttcctagctcaaaggcatgttagatgcatgctatgcaacacatgccaaaatcttacacaaagatatctcataggagcttcaactgaggtgttgcttccaactatcgtgagttggagagaaagaaggcagcgcaattctaatcttgaaaagaagagctctggatcacttaaaatgccctttttgtttctt

SEQ ID NO: 8462 - DNA, 811 bp, Populus tremula x Populus tremuloides
  Predicted polypeptide sequence is orthologous to G1480
gggtggataactctctcttgcgggattttggagaatcaagaaacaccccccctaaaaaaaaagaaggttttcgcgttttcctatttatttgatcagaaactgggagagaaaaaacatgggaactgaagtcgagagcttaaagaacttaaccggaggatggagtgttgcggctaaacgttgtgactcgtgcaaaaccgcggctgcagctgcgttttgcagggccgactctgcttttttgtgtctgaattgtgataacaagattcaccatagccaggtgaatagcaaaatcatgtcccggcatgagcgggtgtggatgtgtgaggtctgcgagcaagcaccagctgcggttacttgcaaagctgacgcagctattctctgtgtcacctgtgacgctgacatccactctgctaaccctcttgctcgccgtcatgaacgagtcccaatcgaccccttttataactctgctgaatcaattgttaagacttccacggcgtttaatattctaatacctggagaaaatggtgtgtctggatctgatcagaacgatgatggtgtttcgtggctgttacagagtaatcacacaacacatgaccataattcaaagctccgaatcgagaatcctgttgtgaagactggagacatgtttttctctgaaattgatccgtttcttgaattcgagtatcagaattccattgatgcgagctatgagcagattcatggtggtgctgatagcgttgtgcctgtgcaaaccaaaccagctccgcttccggcgatcaatcatgaaagttgctttgacattgatttctgtaga

SEQ ID NO: 8463 - DNA, 766 bp, Populus tremula x Populus tremuloides
  misc_feature (698)..(698): n is a, c, g, or t
  Predicted polypeptide sequence is orthologous to G1480
ggataaaactacgcttcaacctaaagaaccccatcgagacagaacacaactcaacagaagcttcaagccttgaaactcgtagccttcatcttccttaatggcatcaaagctttgtgactcatgcaaatcagcaacagcaacgttgttttgtcgagctgactcagctttcctctgcgtcagttgcgactccaaaatccacgcggccaacaagcttgcttctcgccacgcgcgtgtctgggtctgtgaagtctgtgaacaagccccagctcatgtcacctgcaaggctgacgctgccgctctatgtgtcacctgtgaccgtgacatccactcggcgaaccctcttgcccaacgccacgaacgtgtcccagtcactcccttctttgactcttcctctgctgcgcacggcggtggagctgccgttaacttcttggagtatcgttaccttgatgacgtgaatggtggggatgatgttagtagggaggaggcagaggcggagtcgtggctgttaccgaaccctggtggggggagtactaaaggggtggatagtttggatctgaatacgggtcagtatgtgtttggggcggaaatgcacccgtatttggatttggatcggtatgtggatcagaaagtggaagtgcaagagcagaacagttcaggtactactgatggggtggtgcctgtgcaaagcaacaaattanggtttcaagctcctggtttggttaatgacaattgctgctttgagttggatttctctgctggatctaaa

SEQ ID NO: 8464 - DNA, 783 bp, Populus tremula x Populus tremuloides
  Predicted polypeptide sequence is orthologous to G1480
ggacgaaggcacaacactacagaagagaagcttaaagccttcgtactcctcctcctcatcttcttcctcaatggcttcaaagctctgtgactcatgcaagtcagcaacagcaacgttgttttgtcgagctgactcagcttttctatgcatcagctgcgactctaaaatccacgcggcaaacaagcttgcctctcgccacgcgcgtgtcccggtctgcgaagtctgtgaacaagccccagcccatttcacctgcaaggcagacgcagctgctctctgtgttacctgtgaccgtgacatccactcggcaaaccctctcgctagtcggcacgagcgtgtccctatcactccctttttcgactcatcctccactgtgcacggcggtggggcagctgtgaacttgttggaggatcggtactttgatgaagtggatggtggtcgtggtgatgttagcagggaggaggcagaggcggagtcgtggctgttgcctaacccgggtggggggactactaagggggtggatagtatggatctgaataccggtcagtatgtgtttggttcggaaatggatccgtatttggatttggatccgtatgtggatccaaaagtggaagtgcaagagcagaacagttcagggactactgatgggggtggtgcctgtgcaacgtaacaaactaggatttcaagctcctgcgttggtcaatgataattgctgctatgagttggatttctctactggatctaagtcttttggtggtggctatggctataactccttgagccaca

SEQ ID NO: 8465 - DNA, 470 bp, Populus tremula x Populus tremuloides
  Predicted polypeptide sequence is orthologous to G1506
ttctaggaagaggacctgtgtcaatcggccaaagccatctccagttgagaagcttacaaaagatttatacactattttgcatgagcagcagtcgtcatgcttctctggctcttcagaagaggatttgctttttgacaacgaaactccaatggtttctgttgagataggacatggaagtgttctcattagacatccaagctcaatagctcgagatgaggaatccgaagctagctccctttctgtcgagaacaaacaatactcgacaaatgaggcctattcccatcctgtgatccttcctgtacataatgaaaataagagtgtcagtatggcatatcctattactgtaaaaactaagaacctcagcggacaaggaatgcagcaagagcaacttaatagggacaagtctccacatgaaaaagtacacatcctgggaagtcataattcaccactttgcagtgttgatttgaatg

SEQ ID NO: 8466 - DNA, 753 bp, Populus tremula x Populus tremuloides
  misc_feature (694)..(694): n is a, c, g, or t
  Predicted polypeptide sequence is orthologous to G154, G1797
gccggggagacaaaacggggagagggaaagtggagctaataagaatagagaattcagctagtaggcaagtaaccttctcaaagagaagaaatgggcttctaaagaaagctttcgagctttcaattctctgcgaagctgaagtttccctcattattttctctccaactggcaagttttaccagttttcaagtcatgacatggagaggagcgttgctcggtaccggagtgaagtcggcctgcctggaacaaatgaccaacgctctagatccttggagttttggagatgtgagattgaagagttaaggagaacaataaataaaacagaagcacaacttaggcactttattggagaagatatagcaccgctggggttgaaagagttgaagcaactggagcgacagttaaagacaggggttgaacgtatccgctgtaagaagaaacgagccatctcagagcacatcaaattgttgaagagcgagcaaagagcccttcaagaggagaatgctcgtcttcagaaaagattgcaagagctgcctgatgccaatgtaagctcgaggattccggaaccaaatgcatgcaatgcttttcatcagcaaaggatttttcttgatggatctcaccattaaacaggcggtgaatggtcctttacaagaagctataatcttcaaaaatgaacctcaagtgtggtggttgnggttcgtggtgacaataaattgcctctctttatttgcataaagctttggaggctgatga

SEQ ID NO: 8467 - DNA, 739 bp, Populus tremula x Populus tremuloides
  Predicted polypeptide sequence is orthologous to G154, G1797
gggctttttacatatgtattattccctcttttcttatttgggaggcgtctgtgttttttcctgaatttaccaaaagaagaaagagatcagggtttgtgtgatcctttcaattctccgtattgggtctcttgagatttgaaagttcacaagcaatattttccttgtcttcctgcttcttaactgttgcccataaaggtataataatggtgagagggaagactcagatgaagagaatagagaatgcaacaagcaggcaagtgaccttttcaaagagaaggaacggactgcttaaaaaggcctttgagttatcagttctttgcgatgctgaagttgcactcattcttttctccactagagggaagctctatgagttttccagctctagtattaatagaacaatagaacggtatcagaagagagccaaggacgtaggaatcagcggcaagatggttcaagacaatatacagcctgtgaaggaagatgcatttactctggccaagaagatcgagcttcttgaagtctctaaaaggaagttcttaggagagggattggaaacatgttccactgatgatttacaacagttggagaaccagttggagcgaagcttaacaagaattagggcaagaaagaaccagttatttagggagcggattgagaagctaaaaggcgaggagaaaatcctgttggaagaaacacgaggttacgggagaagtgtgggatgcaacaacttgacctctca

SEQ ID NO: 8468 - DNA, 811 bp, Populus tremula x Populus tremuloides
  Predicted polypeptide sequence is orthologous to G154, G1797
ttttttttttttttttttaagtctaatgatacgtcaaatatatacccaaattacagtatttaagtacccctgtttacagttgatctcaatcaataatgggtagcttttttaacagacagcatatatatttctcttaaaataatactattgccttaattattgcttgcgcagttgcaatatagcattagcaagagtctaagaatatgaaaaagtttggcctcacagtacgatgggcattcaccgctagtttcttggtgggatgcgctttgttcttgtttctggtggtccaatgaaacaattccgtctccacatccgaaattgaactgctttctctctgctcttcacggggtaaaatcatctctctgttcccatgagactgggccatgactggtgcaccacactcgtcagacagtcttgcattttcagctgccagtagcttctccttttgttttagtagctcaatctgttctttgaaaacctgattctttctcgcacggatgggtgcttacactcctctctaactgttgttcgatctgttgtagttcttcaatagtgcatgatcccaaacattctcccagtagctttcgtttcgaaacttcaagaagctctatcttctttatcatgcttgctgcttcttcctttattgcagcatggttctgttcaacaggctgcttggttggggttgttttcttttcacgtgccttcgataccgttcaagggtctcctggcatactgggagctttgcaaattcattagagctttcctctaggagagaagacaataggggcaaccctcagcatcacaaagaact

SEQ ID NO: 8469 - DNA, 681 bp, Populus tremula x Populus tremuloides
  misc_feature (566)..(566): n is a, c, g, or t
  Predicted polypeptide sequence is orthologous to G1638
ggggtgagtaatcatgggtatgaagggttgaagcaattttatagtcctggaggtaagaggggcacagcgactcggccttctgagcaggaaaggaagaaaggtgtgccgtggactgaggaggagcacaggcagtttcttttgggtcttcaaaagtatggtaagggggattggagaaatatctcccgcaattatgtgactactaggacgccaactcaggtggctagccatgcacaaaagtattttattaggcaaagtactggagggaaggacaagaggagatctagtatccatgatatcacaactgtcaatcttccagatgccagatctccatcaccagaaaacggaaagccatcatctccagatcattcaaccataaccatgcaatctcaggcaccaccaataacgactggcatggttaaagggctatttgactggaaaccccaaaatgaaggaacagccacagttttcaatccagcaaatggcaatttgttgatggcacctttctgtgggatatcctcatatggatccaagctgcaggagcaaaatctgcttggaggaacacttcncaggatatcagttcggtccttacaatttgatttttcagatgcaatcaatgcagcatcactaaggtcatagatgaagtggagcatttggggctctgaaggcattgatattgctata

SEQ ID NO: 8470 - DNA, 803 bp, Populus tremula x Populus tremuloides
  Predicted polypeptide sequence is orthologous to G1638
gttcaatgattcagatttgaatgcaagatccagcatatgctacgtgatcgttctgcaagagtctaataaatatggactaacttgagcccccaatgacatattcacaataatacatgatagagaattgacaaagttatccaacatactgaatagcatatagaatatcaataccttcagaaccctaaatgctccacttcatctatgaccttattgacgctgcattgattgcatctggaaaatgaaattgtatggaccaaactgatatcctggaagtgttcctccaagcagattttgctcctgcagcttggatccatatgaggatatcccacaaaaaggtgtcgtcaacaaattgtcatttgctggattataaactgtggctattccttcattttgttgtttccagtcatataaacctttgaccgtgccagccgtttttggttgtgcctgagattgcatggttgtggttgaatgatctggagatgatagccttttgttttctggtgatggagatttggcatctggaagattgacagtagtgatatcatggatactagatcttctcttatccttccctccagtactttgcctaataaaatacttttgagcatggctagccacctgagtcggcgtcctagtagtcacataattgcgggagatatttctccaatcccctttaccatacttttgaagacccaaaagaaactgcctgtgctcctcctcagtccatggcactcctttcttcctttcctgctcggaaggccgagtcgccgtgcccctcttgcctccaggactataaaattgtt

SEQ ID NO: 8471 - DNA, 680 bp, Populus tremula x Populus tremuloides
  Predicted polypeptide sequence is orthologous to G1646, G715
ttttttttttttttttttcaaatcagtaacaaatagataataaattaagcgactgaacatcagatataattaggcaagtcagcagcaaatgtagagctgctatacaatgaagttaataagttttaagaagtctctaacagctaaggacagctttcttgaacaatagccaacaagtagacttggagatcatatgcactcaaattccaagtaaattagtcaaggtacatatttgccttctgtcatgccactaatcactgcatctgagaagcttaaccttgtccatcaaggttcccttgtccaccactcccataagaaccatcctcagcggcagctgtctgccaaacagattgccatgcctgagaaggtggctgaacataaaccccagtggcaggatccacagctggcctcccaatcatcatccctccagcggcagcggcaggctgtcccatcggagggtaataataaggtaccccactagccgtagcgccgacaattccaccaagaccagcagcttcctctttgatctcatctctaggtacaatatcaaccaagaaatcaaaaatgtcagttctggtaatagcagcagcaatgtcattcttctgtagagtccttctcttgttttcctcagcatgaagccaagaacgaattgtcagttctaaaatgaagagctccatgcttta

SEQ ID NO: 8472 - DNA, 462 bp, Populus tremula x Populus tremuloides
  misc_feature (36)..(36): n is a, c, g, or t
  misc_feature (42)..(42): n is a, c, g, or t
  Predicted polypeptide sequence is orthologous to G1660
atgggatgatgcccagaagtggatagcaagccccanttgganccggcctaaaacagggcatgctcaggtgcaaggtggacaaggaccacggaagacgggtaatgttctgagtcggcaatcttctaacaaagattgttgtagaagttccagaacaaaaggtggttacatttgaagaaccagatacaaaacgggttgatactagtcaggctaagaaggaaacttgtctgcagaaacttcaaagttgggaggctgattcatacccaatagttgattcctacggcaagcctgtgcttatgaatgagaattctgttgggcaatcagcaatcagtctcagcaggcatgattcatctttggccattcacagtgcaactacatttattccgcctccttcaactgctaggtctgtgtcatgagagatatgggtccggaatgctcctatgctagtcaagagccttctaggcc

SEQ ID NO: 8473 - DNA, 768 bp, Populus tremula x Populus tremuloides
  Predicted polypeptide sequence is orthologous to G1660
tttttttttttttttaaaaaataataaaaaattattaacatgtattttaacacaaaaaattatttaaaaaacaacatcaaccacactattaaacaagctaattttcaaagactggcttttatgtacaaagggcacagggtagtaaagtaaatggtaggttaggaccaaaaaatccgagaaggaagactagttcatttgagtaatatgtttcaggtttcaccaacaccaacaccaaccacaaaaggttaacgaggaaggaacacgaccagttctacgaatgtactctgcctgtttgtcagttttcgcagcctgcctgttactcttggcttctgctgttgctcgcttctcttcagccttgtgccttgctgctgctagtttgttcataagcctatcttgggcctgcccccttatcctttcaacctccacctcaatttttctcatctcagcttcagtttttgctttttgatgattctcccatgcatgaattttcatctcttcacgtttaaacctggccatatatttggccttctccgcctcctcccatgctgctgcacgtgtttcaatcacaattttactctgttgatcagctgctataattttctgtgaagtggatgcgtccttgtcctcctcctccttgctagcccaggctgcaatgttcattttacctagctgcgtccctagaaccattatttctctcttggttttcagttttaactccttttcagacaatcccttgtttggatctaaacggtcattgggaggatttgt

SEQ ID NO: 8474 - DNA, 602 bp, Populus tremula x Populus tremuloides
  Predicted polypeptide sequence is orthologous to G1666
ctcagtctccgtcaagtcctccggtgacaaggcggcgcaaggtcgacgtgctggctggttggtctctcctatagataatgaatcatagagctctctaagctgctgactcctttgcaaggaggcttcttcagtcgtaacctccattggttgcactgtttttctagtcttgattggcccattgtaatacccatctccccacactaagatcctgaacaacagcacgcagttctcaataacacaaacttataaattcattgagattgacattataattctccaaaattaacccagattgtatttgatacatgtgaacatggtggaatatttcgaagttttacttatcaatctatcatcatacataaaacatataaaggatgcattatttctggaagaaaaatattacccttgttgtggacacatttgccaaaagagactgtatgtccattgaaccgattgcactgcagcctgtaacatagtctgcaagcggctactaggcggggtagccattcttgcaactgtatattgatcaccaccagagagatacctcttctccttctaatactccagctcctgctctctactctaacaaaatcagtcgaata

SEQ ID NO: 8475 - DNA, 389 bp, Populus tremula x Populus tremuloides
  Predicted polypeptide sequence is orthologous to G1765
attggtgtaatcaaatgaagaaatcgactgtgatatcaaggaaccactaatttcttaaagctagttcatgtatatactggttgtatcaaatgttcagtcctaggaagtcagatgtccaataaggattctctcttgtgttttttcttggtctatgggaagaggaaaacaacactaaacataaattatagctgaatattgactaaaacagtaaagaaaattgaagttgacagagaaatctctaaaatctgaaattgattgataggatttaaaacattgactagtaaaaatatccccagtagacaatcatactagttaagactctagtcctatttcttgtaggaaaatgttctctcatttagaagatccacaaaaaaaaaaaaaaaaaaaaa

SEQ ID NO: 8476 - DNA, 467 bp, Populus tremula x Populus tremuloides
  Predicted polypeptide sequence is orthologous to G1789
atagcatttaatctcttcataggcttcagggttctagccaatatggacttcaaagcaaaacaaactgttcgaaaatgccttggccatctatggtcaagaatctcctgatcgctggcagaatcttgccagtgctgttggaaaaacagtggaggaagtgaagaagcattacgagatacttgttgaagacgtccagcagattgaagctggcgaaatccctctgcccaactacactaaaagatctggagctagcaacaaaagctgccattgcattgatggtcaagcacaaagggtgaagaatcttaatctcaactgaaggatacatgaactaagctagctatagaataaagatccattgcgctacaaatgacaataggcagaagtagcagcagcagtgttattagctagcaccgaaaatgggattacgatctccctttgtgttatctgtataattactttctcgtcaaaca

SEQ ID NO: 8477 - DNA, 674 bp, Populus tremula x Populus tremuloides
  Predicted polypeptide sequence is orthologous to G1863, G2334
taaatggagcagctttattagtgtaccaggagaacgtctatcaaagccaagctgcaaaaactgctacccttgattcactacagccacccacactactccccgtttctcaaatcacctgtctgagttttttatttccgcaattaaaactttgtgcttgcaaatgcagcagacgttacacagcacattaatgcagaaaacccacaaaaatttagctcaagtatgtgttaatctttggccaggaccacctttggctttcttttgtgacttcttagtgtcctctcagttatcttgtggagaacgacaacttgtggagaagtcagatgaggccattggaatggatatcgacagctgcgttgtagagaatgaggtctggttggaactatcattctccaggccaggccaggcgtctcggttttttggccactcatcaaggaagggtcgaagagactgcccgtcctgtttgacagattccctggtggtgaaatcactactgaaaaatgaatgctggggatgattgttttgcaacatcgagttttcagttgatttctctgtggtgaatgatgagactctggattgcatcaaaaaccatgcattgcccagctgtgagtctatctgaagacccttgttgcttcctgaggcttcagacaagaagctatgctccccaccttcaggct

SEQ ID NO: 8478 - DNA, 179 bp, Populus tremula x Populus tremuloides
  Predicted polypeptide sequence is orthologous to G1884
tttttttttttttttttttttttttttagggaataagaagattttttaatacaacaatcaaaacgtggttcccgttgtaccccaagttccaagttccaagttccaagttccgagttctgagttccgtctgttccgagtttcaccagagtctatggttacagctcttaactcttctatta

SEQ ID NO: 8479 - DNA, 594 bp, Populus tremula x Populus tremuloides
  Predicted polypeptide sequence is orthologous to G189
tggtgagggttccagcaatcagtttgaagatgtctgatattccacctgatgactactcatggagaaagtacggtcaaaagcccattaaagggtctccacatccaagaggttactacaagtgcagcagtgtaagaggatgtccagctcgtaagcatgtggagagagctctagatgatccatcaatgctagtagttacctatgaaggagagcacaaccacaccatctcagttgcagagacatccaatctcatcttagaatccctgcttaactagatcatccctaccaacaagaagccaacgaaagaagtgccaacaaacatagctgtgggaaccaatcagatgatcaactcggcttttttctcaaaggagattagtgggtcagttcatttgttcatttgcctgtaaattatgggattcttgcagccctccttttcccccactcttgaacagctttgaacccatccgatgattatttaaaatctgaaagaggaagggatcaagatggtggatttggtatattagatttcaatcgatgtaaaagaaatcgaggtagtggggggggttctattctctctgaatttttatttttttaaaa

SEQ ID NO: 8480 - DNA, 644 bp, Populus tremula x Populus tremuloides
  Predicted polypeptide sequence is orthologous to G19
atccttcaacttaaaaatccttcttaaattcttttcaactgttcttcgtcataaaccctcgtctactttacttccctatcaacagacctcttgtagttttattgtttagctaatttaagaaatatgtgtggcggtgcttttttatccgaaatcatccctcgtaaccgcggccgccgcgaagcagcttcacagttctggccaaactcatgcttcgataaactcggtccctttgagtcctgtctgagccaagctagcaatcaggaggagtcgtttactctcaaacgaccccaaccccaacccgcttcaggggatcatgagcaagtggagaagcccaatgccaagaggcagaggaagaatctatacagaggtataaggcaacgaccttggggtaaatgggcagctgagattcgtgacccaagaaaaggagtccgtgtttggctcggtaccttcaatactgttgaggaagcagctcgagcctacgacagagaggctcgcataatccgcggcaagaaagccaaagtcaattttcctaacgaagatgaacattactcctctcaaaattcaaataccaagcctcctatgtaccaaacccccacttgtcatttctcaaaagggtatgattttgggtacggttctggaatgaa

SEQ ID NO: 8481 - DNA, 834 bp, Populus tremula x Populus tremuloides
  Predicted polypeptide sequence is orthologous to G19
gacaccatttcttccttctctttctctaaagaactggacagacaaaaacatgtgtggaggtgccatcatttccgatttcgtacccgttaaacgtggccggaaaccgaccactgaggatctctggtctgaacttgactccttatctgattttcttggacttgatcatcgttctatgaacaatattaataatggtagcaaaaaagaaaacctatcaaatctcaagctcgctcaaaagccacgccagcccaaccaagtgataacagagagagttgagaagccaagccaagcaacagagcaagaagccggtaaaacgaaggttcagagaaccagaaagaatgtgtacagaggaataaggcaaaggccatggggtaaatgggcagctgaaataagagacccacacaaaggtgttagagtttggctgggcacttacaacacagctgatgaagccgctaaagcttatgatgaagccgccaagcgcatccgtggtgataaagccaagctcaacttcccccctcagccaccaccaacgtccgaggcggcgccgccaccaacctcggaggcggcaccaccacctgccaagaagcgttgcatcttgggtcctgaaacggctgctatggctagttttgagcaaatcttgaactcggagccgtttcatggactggaaccgaatcagacggcggcccagctgacttgtgacggaggtggaagtggtgattataattgtgaccctgtggacccttggatgcttgatgatcttatcaacgtcagcttaattattagtaatataattaattaactcctaatctggctagtgatgcatgcatgtccactgct

SEQ ID NO: 8482 - DNA, 379 bp, Populus tremula x Populus tremuloides
  Predicted polypeptide sequence is orthologous to G1957
gcgcccttttttttttttttttttttttaaacccaaaagttaaacaagtattcaaaagagtaacttatctatggtcatagcttacacaaatctaaaacagctgatttggatagttcttgcaaaccccacataactgtgcatcaccaaataaaacatttaatcctaaaaaatactgcaacatgatgatacaggactgaaaaaacataatccaagagcatgctatccttcattctacaatgagatgggcttaagagagagggatagagagattcctacatgctaaatggtaactaaaccaaacaagggttccagcctttatcgcttggatgatctcttatcatcctccccaccgtcaccatcatccgagtcatctttatcc

SEQ ID NO: 8483 - DNA, 652 bp, Populus tremula x Populus tremuloides
  Predicted polypeptide sequence is orthologous to G2
gcttaacctttgtacaagtgacaatgatggacatggaagagatgggtatggagagactgaaacgactcagcttcttagcaaaatccacattcaatctccagcatcactcaagtccagtgaaatgccaagatatgagcagttcaggagatcactcggagatagtcagatgcatccttttcttcccccacagtttaactcaccaaattatcaagtgagcttccatataattaaagctcgtgcaaacaaaaaaagtacaggtctttttactagttgaattgttgtgtttcaattcttctttagactcagcatccaagcagcagcaatggaggccgaattggaagtgatctttctctctctccatctgagcttcattatcaccatcattatcagcaatggcaagcaggtcctccccggtttgcaaatgctgcagcatcatcaggattccaacagcagattaggactccacaaaactggctgcagaacaatgggttcaactctctcatgagaccttcttaacccatacataaagtagccgttccatcttcctcgctatgcaatctcaatcctcaccttgtttgctagctgggtaaacatgtaaagagcaaggcttttaactacgaggcaggttgtttttctatccactgtccaccca

SEQ ID NO: 8484 - DNA, 800 bp, Populus tremula x Populus tremuloides
  Predicted polypeptide sequence is orthologous to G2007
gacaggtagcaatatttgacgagacttactttgtttatttatttgtgtaagcttagctacagtcagctagctagctactccgtgcactatgggaaggcaaccttgctgtgacaaactcggggtcaagaaaggtccatggacagctgaagaggataaaaaactcattaacttcattctcaccaatggccaatgttgttggagagctgtccctaagctcgcaggactccgacgatgcggcaagagttgccggcttcgttggactaattatcttcgccctgacttgaagagagggcttcttacagaagcagaagaacagctggttattgatctccatgctcgtcttggcaataggtggtccaagattgctgctagattgccaggaaggacagacaatgagattaagaaccactggaacactcatataaagaagaagcttctgaagaggggaatcgatcctgttacacatgaacccttacacaaagaagccaagcccgaggaaagctcatcatctcctgctgatcttttgccagaatccagcaacaacaatgatatgcaagaaaacgatggtatcgttattaattcggatgataattcaagatcaccgactgaaaattcttgcagtaccgaggattcgctcttgttagatagtatttgcaatgatgaaatgttactgaatagcttgtggatggatgagcctccgctagctgatgcatcatggaacaaaattattcctccggccgcagaaaatactaacaatgacatgggttatccatcatgggaggataactacaccgggttat

SEQ ID NO: 8485 - DNA, 605 bp, Populus tremula x Populus tremuloides
  Predicted polypeptide sequence is orthologous to G2057
ttttttttttttttttttttagagttgagccggaagagcccacttaataaataaataagcttattttaaaatgcctggagaatctatcaaacatatttggagaaaaaaatgttttttccaaccagatgttttttttttataggccaaagcattcaactgaaatcactggaatctctgctcctttctttttctgtttgaccatcattctccctgattgattccatagtagtaaccttgaacatgcatgagcagcagcatgttcagctctatcttcaattctgagaatttggagaagaagaggatggtctatctggtacaacattttgctcatccccgccatgaattcgggttggaatgctaaaacctgacaatccatcagatacaaacctgcttccaaaaatcaaagattgatgaagttcctgtgttctatgatggtctgtggatgccatatgaagatcattccatgaacgaatggaatgcggaaaactggactgaaggggccccctctgggaaaatgctgaggcttgggctagcattgcttggtgtggtgtcagaagcggggggctaaatgtaaatcccccagcaactctattctccgcatttgt

SEQ ID NO: 8486 - DNA, 757 bp, Populus tremula x Populus tremuloides
  Predicted polypeptide sequence is orthologous to G2057
gccgagccagatctgaggctctcgctccaatcatttcaagaaccaattcttttgcaacatcaagcacaccatcatggccatcaagctcaaaatgaacatcaagtgttgttctctggaaccactgctcattatctcggcctagatggctcttctagtgggtggtctgagcagcaccacgcaccagaaatcaaccgtttccaaagaaatctggtggcttggaatgcagctggcggcggcggcggtggaggtggaggattcttcttcaacacaccactaccaccgctacagacgatgtcgccatcgccacctatacagccggttttcggcccaaaccagtttttttcacagaggggaccccttcagtccagtaacacgccttcagttcgtgcttggatagacccagcaatcactcctgatcatcatgaacagcaacaaattccacaaatgtatcatcagcaaactgcaatatcaggcattggattcactgcctcaggtggtgagttctatgggtttcgagttccagcacgaattcaaggcgaagatgaggagcacgacggcattcacaacaagccgtcctctgcttcctctgattctcgccattgatcgagcaaaaacgtcaaaaatttcacctttaccaggacttgttcatagtttaagagagactaatacggtgctaagaagacatttcaaagactggcctggtgacttgaaaatgaatcaatggcaaataccgtgggaagagagagagatctgagtg

SEQ ID NO: 8487 - DNA, 713 bp, Populus tremula x Populus tremuloides
  Predicted polypeptide sequence is orthologous to G2085
tttttttttttttttttttttttaaggacaagataacttcatatattgatgatggcactataatatctgtacattctacaggacatgcaggaattaattgctataaaaccctcaacatgaattgatgccgattacagtagccattcttgaaatacaactcaaaaactcggtcaatgatctgttattaaggctgtatcaccaccattggcgtaagtaacaggattgttatgtgtatcgatagcagggacagagtctgattcgttggcttctgtttcacccagatcaattggagccacagaatgctccagggctttcttggagtgatctctcaaagttcctctatttgcccaaaaaagcccacaggcattgcaaagagaccttggaccagatggaccacgccgcatcattggagtggattttgaattagtgccacaatgtgtacacgaggtttcatgttggctatcatcttgtgctgaatcctgaccaccatcccagccatatcctccctcagacttcttggcagaggtgaattgacctttattccgctgcatcctgagtgcaacctcctgacggacaccatatctaacttcttataaagcatcgctctttctctctgcggaacctactaatgagctgtcgtgaggtagacacgggtggactcatacacccttgatttgagagcattcacacaagagtatcaatctccatatata

SEQ ID NO: 8488 - DNA, 754 bp, Populus tremula x Populus tremuloides
  Predicted polypeptide sequence is orthologous to G211
ttatggccggggtatttgatgttgttgcaaagcctcctcatttatgagtgaattgaggaacgaaaacacatcgtcggtgccggaattgatatcttgatcggcttctccaataccaagcctttgatcgcctctcaaatccatcccagaagtaccatcataattcagcaaacttgtatagccatgacttgcaataaaatggtctgcatgatactgatcatccaggtgggcattaatgttgttttgaaaatactcattctctctgttgattatgcgaggactgccactagtagcttcttccaaaccagaagaaacaacattcttaataggttcttttaggcgtgcttggtgcagattcgcctccggcaaagaaggttttgattgatcaaaagattgaggattgagaggcttatgggttcttggatcaattccttggcttatcagcttcttactcaggtgcgtgttccagtaattctttatttcattatctgtacgccctggaattctcccagctatcaatgaccacctaaagaaacaacccattgaccaaatcaacacaagtagctagtccaagctaagatcgatctagctaaaatttgttcaaagtaaagtgatatacatttcctttctagctcaaatcttcaacgaagaagaaggtgaaatttaagaacacagatcgtttacaagattcaagcacatgatcattcattgtgaaccagattcatgcaggtttcgagctaaactagctataaactaa

SEQ ID NO: 8489 - DNA, 406 bp, Populus tremula x Populus tremuloides
  Predicted polypeptide sequence is orthologous to G2116
ggacggttgcaggggcttgatatcagtaacaaaggatcaaatattgttaagtcagaaggcccctcgctttctgcaagtgaaagtagcaccacattttgatgtaaactggctgctgactagctgacttgtccatggtgtgcctgtgtggtagattgtttatagactgacatccagtcacttagagaaggtttcttttttgatttcattattcattccattaatgatgtggggtcaattcctaattattaattcatagggttctccagaaagggaagcaccctggttttgctgcaatttgtaagggtcctttgtttaacatgggattttgtggtgatatagaacttaatggaatgtaaggtcattccaattggatgtcaagataaaaaaaaaaaaaaaaaacaccccc

SEQ ID NO: 8490 - DNA, 710 bp, Populus tremula x Populus tremuloides
  misc_feature (523)..(523): n is a, c, g, or t
  Predicted polypeptide sequence is orthologous to G2226
gggcagccatcttcatctccatcttctatgaaacaatcccatatgacatgtataaaagttttgataatcccatgaatatgtcatgtttctaggctgctagcatgttcttgatgcttatatatttctttgcatagagaccaagacaggaacttcaaagcttccctagtgtcactgttgtcggctccttttacaggattttgctattcatcacttcatcatagtcaaaaaccctgtttatatgccccaagatcaagcaaagaaggaaacatccggttttctccatttgcttcaactgtgatttatacaagcatccctccattggtttccataacttccatttgagcacactgtgaatcaagaatcttttgttagcttgagctttgcggaatcactggaaaaaaaaaaaaaaaaacaagtcccacgaaacttcaatgggtctatcaagtctgccagctccatctgaaggagtactatgtgtgcttttagtaaacactgccttgtcaatttccattgtcaaaggaantagtccgttcaatccttcatattgttggtatccgtttgtcaccatctgcttccctcccatcgtcagataatgctgaagacaccagagagtcgtttgaatttcgtttaagtcccccagagaattacatcgaggagttccgaagcaggatgccgtcaatccgattcaacacggtgtgcagctgtaaaca

SEQ ID NO: 8491 - DNA, 392 bp, Populus tremula x Populus tremuloides
  Predicted polypeptide sequence is orthologous to G225, G682
tgttcatcacaagtttctttcaacttaattatggctgacttggatcactcctctagtgatgacaactctgttgattctagagaggaaaccagccaagattccaagcttgaattctcagaagatgaggaaactcttatcaccaggatgtacaatctggttggtgagaggtggccattaattgctgggaggattccaggaagaacagcagaagaaattgagaagtactggacttcaagatactctacgagtcagtaaatcagggttgtccaagatgattgccctaactgatgtactagagtagcaaaattttgggtggttttgtagcgttcttctaagagcctgcaatatgggtgggtttaggttgtgatcaagatatttgtacaatggttgct

SEQ ID NO: 8492 - DNA, 524 bp, Populus tremula x Populus tremuloides
  Predicted polypeptide sequence is orthologous to G225, G682
ggatgtcccttcaatttcaacacagttaccctccatagactcgaaagattttttttttttcgctcttaattatggctgactcggatcactcctctagtgatgatctctctgttgattctagagataccagccaagattccaagcttgaattctcagaagacgaggaaactcttattactaggatgtacaatctggttggtgagaggtggactttaattgctgggaggattcctggaagaacagcagaggaaattgagaagtactggacttcaagatactctacaagtcagtaaattagggatctaagtccaagatcctgtctgatgtcctagagttggcaaaattttggctggtttgtaacaaaatctggttctacttaggaactgcaatatgggggtttagctgtgatcaaaatatcagtacaatggtttttcaatgcggtaatggtagttaattaatgtttgggaccttagattgtaagatgaaatctgcttgttaatatggtaaattgagaaatttttaca

SEQ ID NO: 8493 - DNA, 647 bp, Populus tremula x Populus tremuloides
  Predicted polypeptide sequence is orthologous to G225, G682
aatataaaaaaagaaaacgtgccatgctttgctattaatatatcggtactccaatcccttcaatactatcccagaagctttacttctattgttttctcactaaattcctattggcaactttgcaatcttcgaagtatttcctccttttcgctatggctgactctgaacattcttcttctgatgaaacttttgcgtattcgagaggtactgtactgttgacactcacttttgtggtctcttcttctttacctacacagcttgttggtaaaaatattaacggtattttgtcccttctaagttttgttaccttttgctgcttatacttgaagtgtttgttcacgacaagggcgggtgtttctttgttggactatttgttcaatactatgtttgggttcattgattttgggatgttttgttcagaggaaacaagtcaggaaacaagtcaggaatcaaggcttgaattctctgaggatgaggagacacttataattaggatgtttaatctagttggagagaggtttgtctgttgctcttttgtttctctatttcaatgactttgttagccttcagattcaaaatatttaacctaaagttttaataatttgatcaggtggtctctgattgctggaaggattcctggaagaaca

SEQ ID NO: 8494 - DNA, 737 bp, Populus tremula x Populus tremuloides
  Predicted polypeptide sequence is orthologous to G225, G682
ggagcaccatccttatttgttttgtgttgttttttttttttaatataaaaaaagaaaacgtgccatgctttgctattaatatatcggtactccaatcccttcaatactatcccagaagctttacttctattgttttctcactaaattcctattggcaactttgcaatcttcgaagtatttcctccttttcgctatggctgactctgaacattcttcttctgatgaaacttttgcgtattcgagagaggaaacaagtcaggaaacaagtcaggaatcaaggcttgaattctctgaggatgaggagacacttataattaggatgtttaatctagttggagagaggtggtctctgattgctggaaggattcctggaagaacagctgaggaaatagagaagtactggaacactagatactctacaagtgaatgaagctgtaaaagcacaagttatgctttctttacctctgctagagcaagttctgggtctgtcattcataagcagaagatgatgggttaagttgattctagctgttctgtagctatgctgtgtttcatgcaactgttgtctttgattgctgaaggaactgcaatctttttcttttttttactgcctctatgttctttcttgtgcatcggtaagtcttgatgtaccaaatcttgttacaagaagtggcttgattcattggccatttcttgattttcagataagacttcactcctcctcaaaaaaaaaaaaa

SEQ ID NO: 8495 - DNA, 672 bp, Populus tremula x Populus tremuloides
  Predicted polypeptide sequence is orthologous to G2343
gtcaaactctgctggggtttgtcgcagtttcctttattctttcctctgatctgtttccaacacgaaacaagcttgcatgaatacttatgcagttataatgttttcatttcctcacattttcacaatctcacctctggaagctaaaagggggtagaaatgaaagaaaagaaatatataaaaaggaaaaaagaaaactgtcttcaaaagcctggaccattctgaaagctctatatatcataaatatcttatagagatgaagggaaagaagagagtgtagcagctcccatgctagatgaatttggtgcaatttcttctccaccaagtactgattcttcaacattatcccaaaaaagaaagttcgagcattgctgtgattcaacccattcaatattcaactcttgcctttgtaagcactccaatgacatctccccttcttcgttcatgctacaggattgcatttcaataggcatcatgttgtcaatcaatggaggcaagtaatttgtgtccattccaatactaaaagttgcttgcgggggcagtgctgcttgaacttgatggtgctggtttgaattccatgtttccatgttcaagcttgccgaatcagggaaaacctctccgcgaacactactatccgccattccatcaagcgaggtgctcgtgtcaaacataaat

SEQ ID NO: 8496 - DNA, 447 bp, Populus tremula x Populus tremuloides
  Predicted polypeptide sequence is orthologous to G2457
ttttttttttttttttttaatatatcagatcatatagatattgacgaaatgaaaatagcttccataaagttcttacatcaagtgaagtaaacaatagcataaacagttggtcacaaatacaatattagagaaacatagattcatatatatatatccttaattaagacacgctgaagtcaaggattcttaattcacttcaaagagcatggagtttcatggaggtctggttttgaaaaatcaaaaccatgatcaattgttcagcagtgcagaccttgactttagatgcttctcactgccatcatccaccttagtttggttgttagtccccaacatcaattcaaaatgaatatgagggaagtgtgcccaatttttggcagcagtgctgaaagcttctctgtgactgatatcaggattattggccttgatcctctgaatttcctcttttat

SEQ ID NO: 8497 - DNA, 631 bp, Populus tremula x Populus tremuloides
  Predicted polypeptide sequence is orthologous to G2457
gcaacaacaatcaacttttaatctctttttttacatttttacatcttagacatccaaaatggcacctaagaaagcagctcctggtggcaagaagaaaggttccgcctacaatgacttcatgaaagaagaattggcaaaactcaagagcgactcccgccctcataaggaaaagttcaagcacgtcgcttccttgtgggccaagagcccaaagaaccccaagaaccacaaataaacgatcaaatgaacgaagaaggagaacaatttttgagggtccacagcgatatggcttcgatctgacaatcttgtccctctcttgtgagtgacgggacaaggttttgttttttttaaagtcatctctcactgttgttgtaccaaatttctttcatttccattctccctcattcttccttcttcatttatctcgtcttggtttcgcgttccttgcctttttcctttttctctctctcatcttcttttacgatcaatattgattcttgattctaagaaatctagtccaagtttcattttgctctacttagtgtagttttactaatcttcaagatgaagctgtacacgtcgagcaataatcattggtttcttgtcaaaaaaaaaaaaaaaaaaaaaaaaaaaa

SEQ ID NO: 8498 - DNA, 488 bp, Populus tremula x Populus tremuloides
  Predicted polypeptide sequence is orthologous to G2535, G961
caaatcgagctacggctgctgggttttggaaagccactggccgtgataagatcatctatagtgggtttaaaagaattggattgagaaagactcttgtgttttacagaggaagagctccacatggacagaaatccgattggatcatgcatgaatacaggcttgatgacaccaccaacgacactaatgtctcaaatcctataggagaggcaatccctgaagaagggtgggtggtttgccgggtatttagaaagaagaactatcaaaaaacccttgagagtcccaaaagctcatcaagcttattggaggctcatcagattcttggttcaggaaatgatggagttcttgatcaaatacttctctatatgggaaagacttgcaagatggagaatgaaacatatagcaacatgaatatctccaacaacaacagtagtttaaggtttcctctcagacaatagcatcagtgatgggctccatgaaagattcatgca

SEQ ID NO: 8499 - DNA, 813 bp, Populus tremula x Populus tremuloides
  Predicted polypeptide sequence is orthologous to G255, G664
atgggaaggtctccttgctgtgaaaaagcccatacaaacaagggtgcgtggaccaaggaggaagacgatcgccttgttgcttacattagagctcatggtgaaggttgctggcgttcacttcctaaagccgctggccttcttagatgtggcaagagttgcagacttcgctggatcaactacttacgacctgaccttaaacgtggcaatttcaccgaagcagaagatgagctcattatcaaactccatagcctccttggaaacagtagatggtcactcatagctggaagattaccagggagaacagataatgagataaagaattattggaacacacatataagaaggaagcttttgaacagaggcatagatcccgcaactcataggccactcaacgaaccggtacaggaagccacaacgacaatatctttcaccacaaccactacttcagttgaagaagagtctcggggttctataattaaagaggaaattaaagagaagttaattagcgcaactgctttcgtatgcacagaagcgaaaacccaagttcaagaaaggtgtccagacttgaatctcgaacttggaattagccttccttcccaaaaccagcctgatcatcaccagccattcaagaccggaggaagtagaagtctttgttttgcttgcagtttggggctacaaaacagcaaggattgcagctgcaatgttattgtgagcactgttgggagcagtggcagcactagcacaaagaatggctatgacttcttgggcatgaaaagtggtgttttggattatagaagtttagagatgaaataa

SEQ ID NO: 8500 - DNA, 641 bp, Populus tremula x Populus tremuloides
  Predicted polypeptide sequence is orthologous to G259
ggttccaaccatttctttcttcttgaaaagagagagaaaagagaaaggaaaggaccttgcatttctcatgaactgtggagtcgtcttgctgggtttttattgttggggttgggagttcttaacagcccttcttctcttctctgcctcttctccttagaaatcttgtaatatcatccaataatctccttttctctttgttttttttttcatttctcctttttctttgaataaattcatggcaaatgacaagggtttattaaattatgttagaaaatcaaccccgccaccttttttattaaaaacctacatgttagtggaggatctggcgaccgatgatgtgatatcatggaacggggaggggaccggatttgtggtgtggcaaccggcaaagttctctcgtgatctcctaccaacactcttcaagcatagcaatttctctagctttgtccggcaactcaatacttatgtatgtattaaagtttatactaccctttaattttttggttcttgattctgcatggtatatattttatctattcaatattcttaattgtttttggtttagttgacttagttcttaattaaaaattcgaatcgatcatcttcttggttttatttttttctccttcttgaatcttttt

SEQ ID NO: 8501 - DNA, 677 bp, Populus tremula x Populus tremuloides
  Predicted polypeptide sequence is orthologous to G2604
gaaggcattgctggaatgggagaaagggctgtggtttgtgtgtcgaagactctgtaagtttgtaggaaattggaaaagaaagctacaacttttctgagatattgcaatgccagttcctcttgcaccttatccaacaccgccggccccatatgctccgaccccccctcctcctcctcctccttcagcagccaatggtgcacagagccagcttgtgtgttctggatgtcgaaacctgttgctctatccagtcggagcaacctctgtatgctgtgctgtttgcaatgcagtcacggctgtgccacctcctggcacggaaatggcacagctggtttgtggaggttgccacaccttactcatgtacatccgtggagcaaccagtgtgcagtgttcatgttgtcacacagtcaatctagccttggaggcaaatcaagtggcacatgtcaattgcgggaactgcgggatgctgctgatgtaccaatatggagcacggtctgtgaagtgtgctgtttgcaattttgtgacaccaattggggtctcaacaagcgccactgaagagaagttcaaagcctgaatagttacacagctgtgctaagttggtcattacagattctacaagtatgtttatgcatattacaatatctcctccgacgatagcatctccaggtgaagcagaggaa

SEQ ID NO: 8502 - DNA, 888 bp, Populus tremula x Populus tremuloides
  Predicted polypeptide sequence is orthologous to G261
gtttaataactgtatggttactactgttaacaaggaggcaaagctacacaggagtctgcgactctgtaaccatgcaagctataatacaacttaatattgacaagggaaacgtgatatgaaacaagagatcacaaatataatgcaacctcattgaaccaatcattcctaatttattacatgtgtgtccctgaggcatcagaagttgagaaaattatcaaccaaagtcaagttctttcagcaggagtaagatgccccatctgctctgtaagattatttacattcctcatatcccaccaaaattttctgggatcaccaggttttatttcattttttctaccatcagaatcctttctttcagattgaacttcctgtgtgtcagttgaaccaggattctcagttaaaaaccgttcccagaatacatcgttgactccagttgccacggcgggagcagtcccagcaggttgttctttcggtgaaacaggctctggcacaacagctatagaaggttcagaattcatgtcaataccaggtgttttagggcgaaaatcaaaaatgagttgtgcacaagatatagctggactctctgcaccacttgtagactcatccatctctatcgttttagtgttatgactgtgggtttgaacaacatcatttaccatattctcccagagtgtcaggggatgtttccaactgctcaaactgctccatgtttaacagggcaaaagaattaccatctgcattttctctaaacagagcttgggaagtcaccgtctgattatcctcattactactggcttcaatgtgtagacaaccaattctcggcagccttctctttctatcatgaccttccaactgcggcattagatttaaggcaggacctggcttagg

SEQ ID NO: 8503 - DNA, 714 bp, Populus tremula x Populus tremuloides
  Predicted polypeptide sequence is orthologous to G2632
tacggccggggagaacaacgtgcaaaagcagaggttgacaagaagctgataaaagctagaaagccatatcttcatgaatctcggcaccggcatgctatgagaagggaaaggagttctggaggacgttttgcgaagaaaaccggtgatgatggttcaaagaacacatccgaaggcaagctcaatggttctggtccggtccatgcatctcagtcacggagttcatcaggttcagaactcttgccctctgactctgttgaaacttggaattcctctgatggtcaaaaggaagcaagagagtcccaagtgcatgacacttttgaagctcatgactatgtgaatagaggtggccactataaaaaacacagtggcttgcaatcctctgcatacggctcgtacgtgggtgacaatgaggatggagaccgttcaggtgaaaatgaggacggagactgtccaggccagcaactggggaaccaggccaaacgaaggttttttggccctcagtgaacccagcatgttaagtggatgccaaggtggagggtccaattcacgcgggtagcgaaacttgaatcctctctcttatcaggcaaccacgcacttggcaatgtatattgccaggcggcaaatcattcttggctttttctttttcttgcttgtggcttgaacagggtgaaggagatgatgaatccttggggtggctttcttttgtctgccaac

SEQ ID NO: 8504 - DNA, 353 bp, Populus tremula x Populus tremuloides
  Predicted polypeptide sequence is orthologous to G2639, G2640
tttttcagctgggaaattgccttagttatctagcacatgcttatgttgtggaagtggttctagcactggaacccagttcgaagacaattgtgaagagcactaaattttcttctcttgaatgcatcttgctgtcctgatgcagctgcactctcctgtaggcatctatctgggcagtgaattctatttttcttggcaacgctagtttgaactctaacagtaaattatttctgttctgcaaggctgttatactataaccttggaacattgcagttatactgtaaccttgagatgttttcgtgtcctacaattgttcatccttcacatgtgaaaaaaaaaaaaaaaaaaaaaaaaaa

SEQ ID NO: 8505 - DNA, 600 bp, Populus tremula x Populus tremuloides
  Predicted polypeptide sequence is orthologous to G2655
gcaagtacttggtgcctgcaaaaaaatgaaggaaaactctgatggtgataatcagcaacatgtttcttcactgcctttctctgagttctttacatttccacagtactcaacaagctcaattcatttcgaaaactctgttggcaagaatgaaaagttgcataagactcaatctactatagctgacatagaagtgaccatggtagagagtcatgccaacctcaaaataagatcgaagaggcgaccgaaacagctcttgaaggttgtttctgggctgcatagcatgcgcctcactgttcttcacctaaacgtcacaacggttgatcaaattgtgctttattctctaagtgtcaaggtagaagatgattgcaagctgacttcagtggatgagattgctacagcagtgtatcagatgctaggtaggattcaagaagagtgtgtgatgaattgttagaaagtttactattaattttcctttgtggttggccctctacacaccatatgagggcaatttctgcatttttaggcagtctctgaaaggctcatcgcaactaatgtctctcccattttattcctagtgtagcttcttctggttggtctaat

SEQ ID NO: 8506 - DNA, 790 bp, Populus tremula x Populus tremuloides
  Predicted polypeptide sequence is orthologous to G274
tttttttttttttttttttataacaaaccattaaattacattaatccaaagatgtgaatgtcattaatgaatctaggtggaactctcttgatgctctttaaagcaaaagatgtgataatcacactgcaaaatcactttttaaacatggtaacagcatgtttaaaagccaagaaagattttttattaatcgagaaaataatgatgcaattggtaggtgaagctaacttatctacattctataactatatcaaatgaagaacgtaaatcggtaaactaacaattctgcagaaactgcattccttagctggctggctggctggaagctagatgacccatctgcagtaatctgtaggatctgactaggaaaggttgagctcttcctgttacaatcacctccctgatataatccaaaaacacttgttcactgtgatgaagtgctattgttttcgcctgcaacccagtattgtttgacggtgaacaacactttttctgacagaagcggtccgtcctcatgatccaccattttcgctttccatctcattcctcccacaattctcctcaccttgataagcacatcaactttatcacggaatatgactgctccttcaggccttaaaatgcgatccatctctagaagaatgtcttccatattgcacttgtctttatacaagctgaaaacaccatttgcatgaataagatcgtatgtccttgggtaagtggagaatgcttcacaccaatcatgatatatgccaatcaagccacgctcatatataacacccaaagtgtcttt

SEQ ID NO: 8507 - DNA, 678 bp, Populus tremula x Populus tremuloides
  Predicted polypeptide sequence is orthologous to G274
ggaggatttgctgctgctcttgagtctccaaaattgtgggttatgaatgtggtgccaaccatagctgagaaaagtactctgggtgtgatatatgggagaggattgattggaatctatcatgactggtgtgaagctttctccacatacccaaggacttatgaccttatccatgccagtggagttttcagtttgtacagggacaagtgtgacatggaggacattcttctggagatggatcggattttgcgaccagaaggtgcagttatattccgtgatgaagttgatgttcttgttaaggtgaggaagatggtaggaggaatgaaatgggatactaaaatggtagaccatgaagatggccccctagttcctgagaagattttggttgctgtcaagcagtattgggttggaaactcaacctccgctcagtgaatgatgaatggcaattggtgaaaccttctctcgtctttagctggcaatgcttcgttgtacaagacatgacatgtatggatatgtttaagcatgggtttttgattccttggggagtacggcggagcataggagggggggggttctacacgatttaaccgtataatgttttactagccattaatagcccatgctgtattctagtggtaatttatggatgcctccgaacctgtaaggtttttgacatcaata

SEQ ID NO: 8508 - DNA, 780 bp, Populus tremula x Populus tremuloides
  Predicted polypeptide sequence is orthologous to G274
agttttggtatccatgatttataatattattttttagggtaaaatggatccatggtccttcaagttccagagaattgtggtatttgctcctctaattcaactttaatcacaccatcctttgttggtgctaagctacagtgctgcaacctcggacaacaatgaacccagagattctttgacatttaaagtcttggcaaaatggaataaactgaatattgtctgtggttgaccaagaaatataatcttcgatggtgaaggacattcttcttgtcatcagtattgcattcgtgaagcttgatactttaactgatcaagccactaagttgtgcacatgctccacatcaacaacaacagattaataacttaaatcagaattcttcagttcagcaatttaatcacttgcttggcattgtaattgctggcataattttgccctgaaaacaatgactaccggattatggatcgcttgatgtgctgtttcccgtgccaccgacccagtactgtttaaccaccaccagtatcttctcaggtacaaggggaccatcctcatgatccatcatttttgtatcccatctcattcctccagcaattttcttaaccttgttcatacatcaacctcatctcggaagatcacgatcccttcaggacgcaaaatgcggtccatttcgagaaggatgtcttccagagtacacttgttctggtacaaactaaatacaccattggcatggataaagtcatatgtccttgggtatgttgagaccccctccaccagtcatgata

SEQ ID NO: 8509 - DNA, 564 bp, Populus tremula x Populus tremuloides
  Predicted polypeptide sequence is orthologous to G274
ctgttcagaactgggttcaatttcagggtgatgtattcaaatttcctggaggagggaccatgttccctcaaggtgcagatgcatacattgatgaacttgcatcggtgatccctatagcagatggctctgtcagaactgcactagatactggttgtggggtagccagctggggagcatacctgatgaaaagaaatgtgttggccatgtcatttgcaccacgagacaatcatgaagcgcaggtacaatttgcattggagcggggagtacctgctgttattggggttctaggttcaatacatcttccatacccatcgagagcctttgatatggcccagtgctctcgatgtctaattccatgggccgcaaatgatggaatgttcttgatggaagttgaccgtgtcctcagacctggtggatactggatcctttctggcccgccaatcaattggaagacctactaccagacatggaaacggtcaaaggctgatctccaagctgagcaagaagcgattgaagagctggctgaaaggtctttgctgggagaagaagtatgagaagggagat

SEQ ID NO: 8510 - DNA, 572 bp, Populus tremula x Populus tremuloides
  Predicted polypeptide sequence is orthologous to G2790
ggtcctgtgctctccttacctgcaaaatctacctgaagcagagagattggagtaaaggagccaataaagaatctgagcagcagggggctgtgtcttgtcccagtggactgcaccgttcacctggcaagcagcaacggtgctgatttctggtcacctgctactactgaaaaaaaccatccaccattctcatcaagtaaacagtgaatctattgtaatagttaattctctgcctaattttgagagccaggtagctcaaggtgggaaagggtccaaaagatcaaacggacatggtagtaaaaataccaaaggactcgtgcatggtggagaagatccaagcgtcgggtgcaagggggttctctgcctattttttatgtaaaccaggtgagacttttgggaaggtactggaaggtggagaagggaagaaggaggatgcttctctccttgttttggggtggcagcctctttggcatagctagctttctaacatggatcgcacctgtaaatgttcccggcattactgatgtcagtgccatttttggtaagaagggttggttgcaagtctaattgtttct

SEQ ID NO: 8511 - DNA, 619 bp, Populus tremula x Populus tremuloides
  Predicted polypeptide sequence is orthologous to G2898
ggaacagaaccctgaaaagaaacgaagaaaatggcaaagaaagcttcaaaatccaagaaatgtcactcttcttcttcttcttccttagcttcctcgacctcttctaaaagagtttctaaagagggaaaaatggtgttgaggataaggtccaatgagatcacaaagaggtctacacggcaacagagagtggttaggagtgagaacgagaggagaccaaagtcgaagaccaagaaaaataagaaattcgatgctaaaaagcccaagaaacctccaactgctttcttttacttcttagaggatttccgcaaggaattccaagagcagaacccagatgtcaagtcaatgcgtgaggttggcaaggcatgtggagaaaagtggaaaacaatgacctatgaggaaaaggttaaatattatgatatagccacagaaaagagagcggagtttgatagagtcatgtcagaatatatttaagagaaaggaaagccggtgaagatgaagaccctgagggatgcctctgagtttgatgagtagagttcaaggtgctgctgtttgaaaacccgttgtttcactaggaatacatgagggaagaaatgtatatctactttcaaaccactttctt

SEQ ID NO: 8512 - DNA, 1640 bp, Populus tremula x Populus tremuloides
  Predicted polypeptide sequence is orthologous to G2982
caaatccaaacaacacgcgtctctcttctgttgctttatcatcaacctaacccaaaccgccactcctcttctcttgtataactgaccgttcccgtcactctcccttttccttttcgtttattaattcggtataatttcccatcttttatatcttaatggtcgctggtggggcccacctggaagatggagacaggcacccttcgtcggcctccagaagaggaggaggaggaggagccaccacgggctcctgggtgtctggccaatcggtgtcaactagcggcagcgtggggtctccatccagcaggagcgagcatgccatggccactcccgctagtgacagcactttcttaaggttgaaccatctcgacattcacgccgatgatgccgccactcaagatgccgccgctaataagaagaaaaagagaggtcaacgggctgttggagctgataagagtggtagaggacttcgtcaatttagcatcaaagtttgtgaaaaggtggaatccaaaggaacaactacttacaacgaggtagcagatgaacttgtcgcagagtttgctgacccaagcaatagtgtttccaccccagatcagcaacaatatgacgagaaaaacatacggcggagggtatatgatgctctgaatgtactcatggcattagatattatatctaaggataaaaaggaaatacagtggaaaggtcttccccgaacaagcctaagtgatattgaagaattgaaggttgagcgtcttggattgagaaatagattcgaaaagaaagctgcctatttgcaagaactggaggaacaatttgtaggtcttcagaacctgatacagcgaaatgaacaactgtacagctcaggaaatgctcctagtggtggtgtgtcgttgccttttattctggtgcagacacgccctcatgcaactgttgaagtggagatatcagaagatatgcagctggttcactttgattttaatagcactcccttcgagctccatgacgataattacgttctcaaggcaatgaaattttgtgagagacctcagagcgatggtatggcacccaatccacctgctgatggaggtgaaggttctagcatgtccagcatgtatcaaccacaaatccttgcttccccaagtacaaacaccccagttaggcatcctacttcgccgcctcttcctggaatcataaaagcacgtgttaagaatgagcattgagtcatgcacgatcatctgaaccatgggcaatcatgtcagctgtgtctgtatattgtgtaaagtagtttgctgtagatggtgcctccctataattatccccgttcacagtttgcccttgttaggaggaactgagatgacaagcagatcggcccttatgctttgagacttccatggaaacacttggttctatctggttctcagctttagatccattattcgcttctgtaactgtttaaccattttttttccagttattttttcccattgtagcaaaaattaagtttagattgtattaggctacataggattgtccagccttactcagaatgatagaatgaattaattcaattcttcaagaatttggtgttataaaaaaaaaaaaaaaaaaaaaaaaaaaaaaaaaaaaaaaaaaaaaaaaaaaaa

SEQ ID NO: 8513 - DNA, 684 bp, Populus tremula x Populus tremuloides
  Predicted polypeptide sequence is orthologous to G2983
agacaatgcctttcttctttctcgaaacaaagaaagaaactaaagaaagaaaagcacgtcaaggcagatcatcacaatgaaattaacaaagttgaatgggatttatttatttctttctttacaaccccttcatctgccttccgggtgcaatgggaaaagctcgagagttctatctcccttctctctacatgacctgctgtcctctaattccaagcactcaaaggcccagctcctacactttcttttgtacggactatcctcctctctctccacctttccctgtgcaaaaataagagtattaaatataaactaagcacaaaacattcaaagcttcgtttatcagcgtgaataaattaaaaattaagtctttatggttgctgagacataccctagtatccaaagatataatggtaacgggagatggggttctcggactatggcttaaaccaaggctgttcctcttctgtttttgcctctcgcgggctttgtgattttggaaccagtaaaaaacattcttcccttcaatcttgccgtatctgcttagttgtgcagggatatcttctatttgttgcccattaggagttctcattcctcccctaaacaacatctctagtatacctatctgctcttgcgtgggggtcacaacgtgtccctcccggatgcgtctccccctatatgcatccg

SEQ ID NO: 8514 - DNA, 568 bp, Populus tremula x Populus tremuloides
  Predicted polypeptide sequence is orthologous to G3032
ggctgccccatttcttggtttcctcatccgatagtggtggtggttgaagcggcgacccctctgtgacagtggacgatgagggtggctgatgagattcggctcctgtagctttaggagctgataatgctgggactggtacttcatgttgctgtgcctgttgaggtgagcttgtcattttgaccgactagaactgaatggaaggtagatgtggcaagagcaaaaactatcggtgcgatattgaagaaagcagatttttttttgatggattgaagaaagtagatgaatcaaccttctagattgaaagcgtccttagcctgttagccagatgactattccgaggaggactatctaggtgaacaggtggcaatgccaaaaaactttttggcctactgaaattatcaggagaagaatcgaaaaggtttctagctagacaccattaataaatttaacagcctggctgtttttgtttatgatgtaatatctagagtgaataaaaattaggattttaaaattctaaggttatagctgagatttttgagaaatatagataaaactctagcgtaaaaaa

SEQ ID NO: 8515 - DNA, 770 bp, Populus tremula x Populus tremuloides
  Predicted polypeptide sequence is orthologous to G3060
ggctctctgggtttctctctcattcctatcctcttctactttttctctatatttctctttccttcgtagctttccgagcgagttggattagtggtagtttagttagtgaattgctggatctgaaaattacttaagagaatggaatttagcggcggtcaccggaagagaaccagaaacgacgctgcttttaatggcaatggtggccacaaaaagaacagacaagaaatggagtccttttcaactggtataggaagcaaatcgaagccatgcacaaagtttttcagtacttctggatgtccatttggtgagggatgccatttcttgcatcatgttcccggtggcttcaaggctgtgtcccagatgcttaatgttggtggcagcccagctcttccaccagcatccagaaatcaaggtgtcccaaccctttcttatcaagatcgctcttctcctccatctgtgaagtcccgtttgtgcaataaatacaacacagttgaaggttgcaagtttggtgataaatgccactttgcccatggtgagtgggagcttgggaaggcttctgctgctccatcatatgaggatcctcgtgccatggggccaattccaggcaggatgagcaggcacatggagcatccacaccaaggtcatggtgctgcagccagctttgggtcctctgcaactactaagatcagtattgatgcatcacttgccggagccatcattggaaaaaatggtgttaactcgaagcatatttgtcgtgttactggagccaa

SEQ ID NO: 8516 - DNA, 815 bp, Populus tremula x Populus tremuloides
  Predicted polypeptide sequence is orthologous to G3060
atttttcatttatttccctttgaagtccctctctcccccgcccgctctctcctcctcctccacttcaaaccctaactttcctcttatccctccctctctctctttaggtttttttttcccctccactcttctcctctcaagtttctctcttcttcgtagctagttagctagcggaggaggagccgaagcagcagcagaggttactgagttttggatctgaaattacttataaagagaatggaattcggaggtggtcaccgcaagagaggcagagtcgacgctgcttttaatggcaatggcggccacaaaaagaccagacaagtacttctggttgcccatttggcgaggggtgccacttcttgcattatgttcctggtggctataaagctgtgtcccaaatgcttccagctcttccaccagcctctagaaatcaaggtgccccacccccttcttttccagatcgctcttctcctccatctgtgaagtcccgtttgtgcaataaatacaacacagttgagggttgcaagttcggtgataaatgccattttgcccatggtgagtgggagcttgggaaggcttctgctgcttcatatgatgatcctcgcgccatggggcaaatgcagggcagggccgctgctccatatgatgatcctcgtgccatggggccaatgcagggcaggatgagtcggcacatggagcatccacaccaaggtcatggtgctgcagcaagctttgggtcatccgctactactaagatcatatttgatgcttcacttgctggagccatcattggggaaaaatggtgttaactctaa

SEQ ID NO: 8517 - DNA, 656 bp, Populus tremula x Populus tremuloides
  Predicted polypeptide sequence is orthologous to G3074
gatgagatgatgataaaaatcagacggtattcccactgcatttatactatgattacacaactcagctactcctgacactgttgtccctgcaagcttcctcaacatacaaccaactcctgaatctgaagcatgaggaagtcgcctggatggtcccttgaagacattgaaaagatggatatcaatcccgtgtcaactggctaacttaaatacaagaatggatgaggaggaggaagattactatgaacaagactgcagttactagctagtgttttgttctgctggacatggcttctcacatcctataggttttacgtccttgcatgaaaatatgaatctgaaggtagacgattattgaagctcatcagtcctgactagggagcttacggttaagtggtagtcatcattacagactatgcagaaattggtaggattctgtgtcttcttcagcatatattttctacagcatttgctgagtgtagattactcattaactcccctaggcatttagatatcagtctcgttgaaccgttcttgtatttgaagatgcaacacgctaactattacttcttgatggcatagaaaggctcatacgataactggggaaaaaaaagaaaaagaaagcttcaaaatgctttaaatgctttggagaagaagtg

SEQ ID NO: 8518 - DNA, 257 bp, Populus tremula x Populus tremuloides
  Predicted polypeptide sequence is orthologous to G326
aacgttacaaggagaagaagaaaacccgaagatatgataagcacatacggtatgaatcaagaaaagcgagagctgataccaggaagcgagtgaagggtcgatttgtgaagacaactgaagttcctgactgttgaattcatgcttagttagaggtccttgatatcactgtaaatattctttacgttcgtctcgtagagaatgtataatttagtggtgcttgtctccgcatcaggaaaaaaaaaaaaaaaaaaaaaaaa

SEQ ID NO: 8519 - DNA, 672 bp, Populus tremula x Populus tremuloides
  Predicted polypeptide sequence is orthologous to G328
ttttttttttttttttttacaaaatagtagcagctttactgcatttagtgaaactactaagggcatcatatctcattgatcaagaccaattagatttagaaacataagagtatgatcagtactagatcattagtaataactaatacaatcctcatctaaggagatttttcttcttcttcttcttccttctctctggattcagaatgatgggacaatgccatatcctgtttccgccattagtgtggaggagaacatttggtcatcttcgacttctgcatcttttctctttgcaaatcggccttttatccggggtctggtctctgcataggccttccttgaggcatacctgattgtcttctcaaacttccttgtcttctttttctctctgtatctcaggactcttgcctccctatccattggactaagttgaggtggcatctggatagcagtgctggagaaaagttcgagtgtcccttttggagttctatgttgcgagattgagatctcgctcactgttgattctggcaccactccaacatccatggatgacatggatacactttgactgatcgaaccattgtagctgtaagcagcttttgagggctcatactccaatcccaactgaaaattgtgatactgccgttgctgttgatgatcctttccttctccata

SEQ ID NO: 8520 - DNA, 743 bp, Populus tremula x Populus tremuloides
  misc_feature (680)..(680): n is a, c, g, or t
  Predicted polypeptide sequence is orthologous to G351
tccctcctccctgtctctctcaatacctttcttcctctccttggaaatcttgttcgtttgtacccctcgttgcccactcacacaagaaaaactcagtatcaagaatccaaatcatggctcttgaagctctgaactctcctacaacagccgctcctttaaattatgaagaaacatggattaagaggaaacgctctaagagacctcgtagtgagtccccttcgaccgaggaagaatacctcgctttttgccttatcatgcttgctcgtggcggctccactgccgcaaccgccaaaaaaaccgcttccgcctcccctgcaccaccccaaccaccaactttggatctttcttacaagtgtacggtttgcaacaaggctttctcttcttaccaggctctcggcgggcacaaagccagtcacaggaaatcctcctccgagtcaaccgtcgccacagccgctgaaaacccatcagcctccaccacaactaacacaaccaccacgaccaccaatggtaggactcatgagtgttctatctgccacaagactttccttactggacaggccttaggcggacacaaacgttgtcactatgagggcacaattggaggcaacaacagcagcagtgctagcgctgcaatcaccacctcagacggtggtgctgttggaggcggtggcgtgagccanagtaagagtcaaagaagcggtggtggatttgactttgacctgaacttgcctgctttgcctgaa

SEQ ID NO: 8521 - DNA, 644 bp, Populus tremula x Populus tremuloides
  Predicted polypeptide sequence is orthologous to G351
cccctgcgcgggagagccatgggtaaagcgcaagcgctctaagcgtccacgactcgaccaccagcctactgaagaagaatatctcgctctctgtcttatcatgctagctcgaggctccaccaatctccaattctccacttcaggtcaccagaagtccctcaccccatcaacagtattcacatcttcagagctaaaaaatagttacaagtgttccgtatgcaacaaggagtttccttcataccaagccctaggcggtcacaaggcaagtcacagaaaactcgctggaggcggcgaagaccaaactacttccagtacaactacttctgtcataacagcaacaaaaaccgtatctaacggaagcggtaaggctcacgagtgctccatctgccacaagactcttcccaccggacaggccttggggggtcacaagaggtgtcactatgaaggcatcataggaggcggcgaaaagagtggtgtcacttcaacttctgaaagtgctggatctactaacactcgcactcatagccacaacgaatttgacctcaatgttcctgccttgccagagttcccttcatttttctctgtatctggtgaagatgaagttatgagccctctaccggcagcgaaaaagcttcgtatttcga

SEQ ID NO: 8522 - DNA, 576 bp, Populus tremula x Populus tremuloides
  Predicted polypeptide sequence is orthologous to G354
gtttacatgcaaaacatgtaacaggagtttctcttcatttcaagcgttaggaggccaccgtgcaagtcacaagaaaccaaagcttgcgggatcaactgggaacttgttaatgaagttgcccagttcgcctccaaagccaaagaatcaccggtgctccatttgcgggcttgaatttcctatcgggcaagcgctcggaggtcatatgaggaggcatagggctgataatattgatgctaccagtaacagtggtgataatgaactggcattgacttatccacctttcttaccggccgtcccagttttgaagaaatcgaatagcagcaagagagtcctgtgcttggatttgagcttggcactgcctatggaccagaatgagtcggagttgcaattaaggaaggccagcactcaacctgtgttgaaatgttttatctaggctttaattcttaatagattttttattttttttattttttttgttcatatacgccttctagctagtacgactacgtagtcgggattatttactaatcagattcattcagttcttttccaaaaaaaaaaaaaaaaaaaaaaaaa

SEQ ID NO: 8523 - DNA, 693 bp, Populus tremula x Populus tremuloides
  Predicted polypeptide sequence is orthologous to G354
gattccatcttctaagcaaatccaacatcctctccacatttgaaaccaaagaataacaaaacccttactgttcatattcttataccatgaagagaggtctgcatgagagagagattgatagcataaccatggctaattgcttgatgtttctatctaaaggaagggaatcatattcttttccttcatttgatcataccatgagcaatctttctcctgctcgtgtttttgagtgcaaaacatgcaataggcaattcccgtcgtttcaagccctaggcggtcaccgtgcaagtcacaagaagccacggttgatgggaggagaagggagcttcgagactcaatcgccagcaaagcctaaaacgcacgagtgctctatttgcgggctagagtttgctattggacaagctttgggtggtcacatgaggagacatagagctgccttgaatgatcaaaaccaggtggatcctctgaaccctcctatcactgatgatcaaaaagcagttcctgtcgtgaagagatctaatagcaggagggttttgtgtttggatttgaatttgactccttatgagaatgatatggagctgtttaagctcggaacgacagctcctatggtcaattgtttcttttagatcttacgtgtactctcatgaaactatctatagcctaggtttttcccctttcctttcgttcttcctg

SEQ ID NO: 8524 - DNA, 523 bp, Populus tremula x Populus tremuloides
  Predicted polypeptide sequence is orthologous to G363
ggaaaggtatgccagcctggcatcgttgcctctacatggatcctcattccgatccctaaggatagaggcacattcttcagtgcaccagaactttgcaccaccagtaaggtcgctagaaataagcagcagtgcaagatttgatcaaggttatgcaggtctgccggtattcatggaggatgatgaggcagagttgttatggccaggtagttttcgacaggtagctgtggcagacgatgctcatcaaagttttgtagtcgccggaagttcaaacatgatttttttgggggcaactccaccagtgaacttagatgattctgcgccagatctcacactaaaactttgagaacattggttgcagtatttatgctccgatattatctcttgtatagcaagttgtgcaatggaccatggctgaacttttatattccctgctaagaatttgtatgtcagtgtataagagcttcacggagattattctggagcttcttcgtttgttatatctatgtgattgatccttttaatt

SEQ ID NO: 8525 - DNA, 730 bp, Populus tremula x Populus tremuloides
  misc_feature (613)..(613): n is a, c, g, or t
  Predicted polypeptide sequence is orthologous to G4
ggggtacgtgtctggttgggaacattcaataccgcagaagaagctgctagagcatatgattctgaggcacgtagaattcgtggcaagaaagcgaaggtgaacttccctgatgaagctccatgtgcttcagcaaggcatccaattaaggaaaactcacagaaacgacttacaaaggcaaatataagccaggattttagttacttgagcaacccagaaacggattataataatatgggctttgtggaagagaaaccacaagtgagccagtttggaataatgaattctatcccggtcaatggagattctggggtgacgcccttaactccttctgacaatgcttctatgtatttcaattctgacaaggggagcaactcatttgattgtgactttgggtggggagaacaaggcgctgaaatcttgtccgttcttgcagcaactccagaagttgatgaatccgtctttgtggcttttgacaatcagttgatgaaccttcaggtgccagatcttgtggtaactgggaggcttctcttgatagcttccttaatggagacacaactcaggatggcacaaacgcattggacttgtggagtttcgaagacttcccctccatggnttgggggagtttattgagccacttttttctgtgcttgctaggttttgtaaataataaggctacatgttagaatggttgtttatctgagatgggaatggagtgcaacacagatgaaca

SEQ ID NO: 8526 - DNA, 812 bp, Populus tremula x Populus tremuloides
  Predicted polypeptide sequence is orthologous to G4
gactcccgaaccccaaaaatattttcacagaagaaaaggaaaatcacaatttgaccactctctctcaaaaaaatctcatttacacccctgtgaagcaaaccaccagcatcatcaacctcaagcagcagcatgtgtggcggtgctatcatctctgacttcatacctccgaccaccaccgctcgatcttctcggcggttggcggagggattcgaatggcttggtacgaagaaacccttcaacaacaagaagtactcgaagccagttgttactaatcttgacgatgatttcgaggctgacttccaagagtttaaggatgagtctgatgtcgatgagaattatgatgtttttgttgatgccgagcctttttctttctctgctcctgcttctgcccctgctaagaaacgttctgcacctgttaaatctgctgaattcagtgggcaagctgaaaagtcagcaaagaggaagagaaagaatcagtatagaggaatccggcagcgcccatggggaaaatgggctgctgagattcgtgaccccaggaaaggggtgcgtgtctggctgggaacattcaatactgcagaggaagctgcaagggcgtatgatgccgaggcgcgtagaattcgtggcaagaaagctaaggtgaactttcctgatgaagctccacttgcttcatcaaagcagtcaattaaggaaaactacggaaaccactcccaaagacaaattcaagccagtcattcagttacttgagcaacccagaactgaattataataatatgggctttgtggaagagaaaccaatggttaatcagtttgga

SEQ ID NO: 8527 - DNA, 842 bp, Populus tremula x Populus tremuloides
  Predicted polypeptide sequence is orthologous to G4
actagttctctcattctctcttagaggaaaagtgaaaatcaccatctaaccactctctctcaaaaatcttttcaattacacccccgtgaagcaacccaccggtataatcaccatcaatcaacatgtgtggcggtgctatcatctcaggcttcatcgctccgacaaccaccgctcgatcttctcggcggttgacctcgggctttgagtggcttgagccgaagaaacccttcaacaacaagcacttgaagccagttgttgctgatcccgaagatgattttgagggctgattttcaagagtttaaggacgagtctgatgtcgacgagggattatgatgtctttgctgatgccaagccttttactttctctgccagtgcttctgaacctgctaaaaaacgtgggctccctcgtggttctactgctgttaaatctgctggattcagtggacttgctgaaaaatcagcaaagaggaagagaaagaaccagtttagaggaattaggcagcgtccatggggaaaatgggctgctgagattcgtgatcccaggaaaggggtacgtgtctggttgggaacattcaatactgcagaagaagctgctagagcatatgattctgaggcacgtagaattcgtggcaagaaagcgaaggtgaacttccctgatgaagctccatgtgcttcagcaaggcatccattaaggaaaactcacagaacgacttacaaggcaaatataagccaggattttagttacttgagcacccaaaacggattataatatatgggcttgtggagagaaccacagtgagccagtttggaataatgaatctatccggtcatggagatctggg

SEQ ID NO: 8528 - DNA, 849 bp, Populus tremula x Populus tremuloides
  Predicted polypeptide sequence is orthologous to G428
ggcttctctagtcccagcaaattcaaacttaagagtcattaataatggaactccaactccaaaaacatagaaaaactacaaattaagaacaaaacgctaagaaaacaaagatagaaggccaagctgcctgtgccttcttccttctgctaatatggacggaacgtacggtctgcactcaacggtggcggactactcagacaaggcgttgatgtcgccggaggatttgattttacaatcggagtaccagagcttgctgtcttcagaaactcttcggctgcggattccgattcttggatccgaagagttgctttcagaggcggcttcgatcagaacagaagaagatatgtccgctttgatcaaagccaaaattgcctcgcatccttgctatcctcgtttactcgaggcttatatcgattgccagaaggtaggggtgcctccggggatagcgtgtttcttggatgaaatccggcgagaaaacgaccttttcaagcaaggcgctgtctccacgtactggggagctgatcccgagctagacgagttcatggaaacctactgtgatttgttggtgaagtataaatctgatcttgaaaggcctttagatgaagcaacaaccttcttgaacaagattgaaatgcagcttcgtaatctctgcaccggtgcctccatcagaagcctctctgatgaaggtgcgccatcatcagatgaggagtaagtggaggggagttggatatgcatgaagctcaaccagtggtgaagaccgagagcttaaagataacttctccgcaggtttggaagtatattggtcgctgaactggagtctccaaagaaaaaagaaaggaagctcccgaa

SEQ ID NO: 8529 - DNA, 692 bp, Populus tremula x Populus tremuloides
  misc_feature (247)..(247): n is a, c, g, or t
  Predicted polypeptide sequence is orthologous to G450
actactattcctcaacctttattacatgtgcataccataaacctctctacatcaagataattagtagcaagaaattaacaccaacaagaagaaaagagagagagagagaggggataagagaggtgcgtagtggtactacttattttcaagtatcggagcttttgtttttttgtttgtgaaggatgactagcataatgggagcagaacctgaaaagtatagcatgattaacttcgaagagactgaatntacgtctagggttacctggaggaattggtaacggaaatgatggtgaggttgcaaagagtaatggaaagagagggttttctgagactgttgatttgaagctcaacctctctacaaaggaatcagcaaagggaggcgacgaggagaaagtcatgaaggagaaaaccgttgctcctccggcctcgactgatcctgcaaagccaccggccaaggcacaagttgtgggttggccacccattagatcattccgcaagaatgtcatggctgtacagaagaacagcaatgacaacggtgaaaaatccggtagcagtggcaccggtgtggcttttgttaaggttagcatggacggtgctccgtatttacgaaaagtggacttgaaattatacaagagctaccaagaactctctgacgctctaggcaagatgttcagctccttcaccattggtaa

SEQ ID NO: 8530 - DNA, 1313 bp, Populus tremula x Populus tremuloides
  Predicted polypeptide sequence is orthologous to G450
gcaagaaattattagcatcgtcaacacgaagaaaaggagcatagagagagagagagagatagagagagagagagagaagaagaagagggtttgttgctcatttttaaggactggaggttttgtgaaggatcgatgaccagcataatgggagcagaaccagctggcacctacagcatgatgaattttgaagagactgaactacgcctagggttacctggaggtgttagtaacggaaatgattctgaggctgcaaagagtaatgggaagagagggttttcagagacggttgacttgaagcttaacctttcaactaaagaaactggaaaggatggatcagatcaggagaaagtagtgatgaaggagaaaactgttgctcctcgccctaatgatcctgcaaagccaccgtccaaggcacaagttgtgggttggccacccatcagatcattccgtaagaatgtcatggccgtccagaagaacagcaacgacgagggtgaaaaggccagtagcagcggcgctactggtgcagctttcgttaaggttagcatggacggtgccccatacttacgaaaagtggacttgaaactatacaagagctaccgagaactctctgatgctctaggcaaaatgttcagctccttcaccatcggtaactgtggctcgcaaggaacgaaagatttcatgaatgaaagcaaattgatagatcttttgaacagttctgagtatgtgccaacttatgaagacaaggatggagattggatgcttgtaggagatgttccatggggaatgtttgttgattcatgcaagcgcttgaggatcatgaaagggtctgaggccattggactcgccccaagagctgtggagaagtgcaagaacagaagttgaagtgcttttttccaaggttaatatgatggtcagctgatcccaactgtccacaaagaaaaggaaacatgcaggctcatcgagctttgaagcctggaagtctctgcaccatgatttttcttttttctttttacatatatgtagtaagtccaagtataagaggaaatatatttgaagggatttgttaattatagctagctaggggcatgaagtaacaatagaagaagaagatgtgttcgtaaaacttctttttattctgtatgatcatgtgtaatgtttattgtcttgcttaataatgaccatcattattgtttctagctggctaggttgtcgagagcgtgttctgtcactctccctccatttctgtaatggtggcatgatgagattctctgcatgatatatacgaaatctttggatcaaaaaaaaaaaaaaaa

SEQ ID NO: 8531 - DNA, 1178 bp, Populus tremula x Populus tremuloides
  Predicted polypeptide sequence is orthologous to G450
gagggagtgatcagtttctcagaggaaattattgaggtaaaacgtaatctcatcatggaagtagagaagggaacaaagatgcggtttgaggagacagagctaaggctagggttaccagggaatggtggagggggtactgaaggaggagagttcgcaaggaagagaggattctctgagaccgtggacttgaagctcaatctttcttccaaggaggggggtattgatccaaatcatgagaagactcgaagggagaagaaccttctggccactgatccagcaaaacctccagctaaggcacaggttgtgggttggcctccagtcagatctttccgaaagaacatgttagctgtccaaaaaagcagcaccgatcaggagagtactaacaaggttcctgggggcaacgcaacctttgtgaaggttagcatggatggcgcaccttacctccgtaaagtggacttgaacatgtacaagacctaccacgagctctctgatgccttgggcaaaatgttcagttccttcaccataggcaactgtggatcccatggaatgaaagatttcctgaatgaaagcaagctcatagatcttcttaatggcaccgactatgttccaagttatgaagataaggacggtgactggatgctcgtcggtgatgtcccatgggacatgtttgttgaatcatgcaagcggctgcgaataatgaaaggaacggaggcgactggacttggtaatgagtatacagcataaaaataaaaccaaaatgattcttctcgtttacctcctaatacaagttttgttttgccttttctcatttcatcagcaccgagagccatggagaaatgcaagagcagaagcttcaagtagtgagcaccacagcctgctccttcgatctcgagggtcgcatgcagggaccaaaaattaagatggtaaaagcgcactggatggattgagcaggctcttcgtgagggtgtttctgcattaatattaattgtacgtggtttgttatataatgttaattttgtgagatgctacttgatccttaatatttatcatggacaagaacgataataactcctaaatatgttccaaaagactccgttatatgtatcttgtttgttcagttgaatggcttgcttaattattcattattatagctaaaaaaaaaaaaaaaaaaaaaaaaa

SEQ ID NO: 8532 - DNA, 1206 bp, Populus tremula x Populus tremuloides
  Predicted polypeptide sequence is orthologous to G450
gggggaagcccaacttatattattgaggtctctctctctctctctctagcttgcttgcaaaacatagaagaggacacaagaaataagaaacaaagaaacgagcaaaagctagctatcaacaacaccaaaagcaacaagcaataatacaaaacatatcagatcttccactaaaaccattcattggcgcgcgcgtggcagagagaaatggcaacagctaccgtgttaggtaccgagagggcagatttgaactacaaagcgactgagctgtgtctaggattgcctggtgctgttggtgtcaaaaatgaagttgagacacctaataaggctaccgggaaaagagggtttgctgagactgttgatttgaagctcaatcttcaggctaaagaaggtgtcatggatctgaatgagaatatcaacaatattgcttcagaggacaagaaccaccttccttctgccaccatcaaggaccctgctaagccaccagccaaggcacaagttgtaggttggccaccagttagatcttacaggaagaacgttttggctcagaagaacgccagtgaggaaggtttcggggcacaagttgaaggttggccaccagttagatcttacaggaagaacgttttggttcagaagaacgccagtgaggaaggtgagaaggcaagcactggcggatgcagtgcagcttttgtgaaggtttgcatggatggtgcaccctatcttcgcaaggtggacttgaagatgtacaagagctaccaagaattgtctgatgccttggccaaaatgttcagttccctcaccatgggtaattatggagcccagggaatgatagactttatgaatgaaagcaagctgatggatctactcaacagttccgagtatgtgccatcctatgaagacaaggatggcgattggatgcttgtgggtgatgttccatgggagatgtttgttgattcatgcaagcgcccgcgcataatgaaaggatctgaagctgttggacttgcaccaagagcaatggagaaatgcaagagcagaacctgaatcttatgtactcaatgtattcaggttccctgctggattccctctttttagccttgcatccatgtatgaagactagcaggcaaggcacttgcgcaacatggatggatcagtagtggtgtttctttggatgtgtctttactcttctttttttattattattattgctgc

SEQ ID NO: 8533 - DNA, 799 bp, Populus tremula x Populus tremuloides
  misc_feature (729)..(729): n is a, c, g, or t
  misc_feature (763)..(763): n is a, c, g, or t
  Predicted polypeptide sequence is orthologous to G451
caccacacaggaaatacagaagttaagttcgctgccactttagaagagaaacgtcaaacttcatttcattcaagatcgttgaacaaagaaacgaaaagtatggaatttgagagagatcttaatcttgatgcaacagagcttaggttaggcctccccggcactgccacaagacagtcagagaagcaaacacctaactcaaatcttgccaagagcaacaaaagatcattgcctgacatgaatgaagatcctgcaggatcatcaagggaaaattctagcactgtgtcatcaaatgaagaaaaaagccatgaccaagaaactgctcctccacccatcaaggcacaagtggtagggtggccaccaatcagatcttacaggaaaaactgtctacaagcaaagaaacaagaggctgaagctgctggactttacgtgaaagttagcatggatggtgctccttatctcagaaagattgatttgaaggtttacaaaggatatccagaactcctcaaggccttggaagagatgttcaaatccaaagttggtgagtattcggagagggaagggtataatggatcagaacatgtaccaacatatgaagacaaagatggagattggatgttggttggagatgttccatgggatatgttcatcaattcatgtaagaggctgagaatcatgaaagagtcagaagctagaggtttgggttgtgctgtgtaaagcctcacacatgcnattcaggcccctacaaaagatgaagaagagatcngaaagagttgactttagcctggttcttcgagaagaa

SEQ ID NO: 8534 - DNA, 799 bp, Populus tremula x Populus tremuloides
  Predicted polypeptide sequence is orthologous to G468
tttggcttcacacttccaaaatgggcagaggagctacctctagttcttcatcttcttttgaaagcagcaactacccatctgtatcaaccaagtcctctctctctcagctaaagaaggaccttagcacagatctcaggcttggacttagcatctcagcctctcaacaggagaacccttctacaccaagtgatcagcagctttctgactggccaccaatcaagccattaaatctaagcaaggcattagagtcggaggaaaatgagtgcagtagtgccaccttcttcgtcaaggtttacatggaaggtattccgattggaaggaagctcaacctcttagcccatgatggttaccatgacttaatacagactcttgaccaaatgttcaacactagcattctctggcctgaaatggatattgaacattctgggcaatgtcatgtgttgacatatgaagacaaggagggggattggttgattgttggggatgttccctgggagatgttcttaccttctgtgcggagattgaagatcactagggcagacagcctatgatcttggttcatgatgctgatcactagggcagactgcccctatatgattttggttcatgatgcttatgcggtctccttttctccttgacacatatataatatggcgagtcgaaaataaataggtagtggatagctaggtaaactctatatcaagtgttgagaatcacgtatgcacatgtacatccttgggataaatgatagaacaacagttgtcttttgattgtaaaaaaaaaaaaaaaaaaaaaaaaa

SEQ ID NO: 8535 - DNA, 712 bp, Populus tremula x Populus tremuloides
  Predicted polypeptide sequence is orthologous to G468
atggtcagaggagctgcctctagctcttcatcatctttcgaaagcagcagctacccatctgtctccggcgagtcttctttccctcagggaaagagggaccttagcacagatctaaggcttggacttggcatatcaacctctcgacaggacaacccttctacaccaagtgagcagctattggattggccgccgatcaagccgtctccggggaaggcagtaacatcagaagaaaacgagtacagtagttccaccctattcgtcaaggtgtacatggaaggcattcaaattggaaggaaactgaacctattagcccacgatggttaccatgacttgatacagactcttgaccaaatgttcaacactagcattctctggcctgaaatggatgttgaacattccgggaaatgccatgtgctgacatacgaagaccaagagggcgattggttgattgttggggatgttccatgggaggtgttcttaccttctgtgcggagattgaagatcaccagggcagacagcctatgatttggttcatgattcatatgcagtctcctcttctccctagacatgcacttgtatatggtgaatcgaaaataaataggtagtggacagcaacgtaactccatatgaatatgttgaggatgatagaacaaaagttggtcttttgttgtaaattaaggattttcagagttcatcaaaaaaaaaaaaaaaa

SEQ ID NO: 8536 - DNA, 542 bp, Populus tremula x Populus tremuloides
  Predicted polypeptide sequence is orthologous to G519
tcgggcagccaaagacagctgggatcaagaaagctttggtgttttacgcaggaaaagctcccaagggagagaaaaccaactggattatgcacgagtatcgcctagccgaggtggaccgctccgttcgcaagaagaacagcttaaggctggacgattgggtactctgtcgcatacacaacaagaaaggcacaattgagaagcaaggacagcatcttagcgtcaggaaagcgaattcgacagagattgccgaggaggatgagaagaagtcggtggttatgctgccgccaccaccagctccgtcctcggcgacaggaacgatgaatgattacgtgtatttcgacacgtcagattctgtgccgaggctgcacacagattcgagctgctcagagcatgtggtgtcgccagaattcacgtgcgaggtgcagagtaatccttataattacttggattccaccatggatattccgttcgcgtcccaatttcaggggaatcatcagatgtcgccgcttcaggacatgttcatgtatctgcagaaccgtttt

SEQ ID NO: 8537 - DNA, 607 bp, Populus tremula x Populus tremuloides
  Predicted polypeptide sequence is orthologous to G559
gcccgaggacagcttagaattttgaatcacaaatcgccatcaaaggcccatgattgcatcaaggttctacataaactataacatattaaatgcttaaactataaactcaatcttcaaggaaactagaatatagaacccgcctaaatgaggtatgaatgtaatgtatctaaaagactggagataaaaggtaaatgtcctatgtgataactaggatgtaaacaacagtagacagaacattctgtagctggtctgatgatcatgctattctcagtcctttgatgaggaggaattatcctcagatgaattatctttctggattgaagaagccattgatcctctcatttgcaaatccccaccttgctgctgctgctgctgttgaagttgttgctgttgaagctgatgcagctggagctgctgctgctgctgcttctgagaatgaatttggagttgttgaaactgttgtgcagctaaaaaagtatgcattgcttgattattgggatataattgctggcctcctccaaaagatgcatagtttggcacttgaccagtcagtaccttcagatgctgaatttcttctttcagtgcgtcattcaaggcatcttgcaag

SEQ ID NO: 8538 - DNA, 771 bp, Populus tremula x Populus tremuloides
  Predicted polypeptide sequence is orthologous to G562
tgcagagtctgtgaagctagtgacaggttttctaatctaagttgcttccttcttcgtgtaaaattgaatacagagtgagcattatttcaagtctccggagttcacagcttgttatctgtgaggataaggagatttatgatctgagaattggaaggtgagagagttaaagcagtttttgcgaatcatctccaaattaagtaaggatttttattttttttggtgttttaccatgggaaacaatgaagagggaaagtcttctgcgtctgataaatcttctcctgcccaacaagatcagaccagcattcatgtgtatcctgattgggcagctattcaggcatattatggatcccgagtggctctcccaccatattacaactcgggtgtggcatctggccatgcccctcatccttatatgtggggcccaccgcagcctatgatggctacttatggggcaccatatgcagcaatctattcacatggaggagtgtatgcacatccggcggctgttccgattggatcccatccgcatggtcccggggttctgtcatctcctgcagctaatacccctttgagtgcagaaacacctacaaaatcttcaggaaatactgatcagggtttactgaacaagttgaaagggtttgatgggcttgcaatgtcaataggcaatggtgatgctgagagtgcatagggtgggagtaggctacctcacagcatggagacagaaggttccactgatggaagtgatgggaatacagctaggggaaaaaaagg

SEQ ID NO: 8539 - DNA, 345 bp, Populus tremula x Populus tremuloides
  Predicted polypeptide sequence is orthologous to G568
tacttgtgattaatcatattttctcattgcttctttacaagaaatacaatcaagggattgtggattttggaactgccaatcggagaagaaaatgtctgaaaattttggtgcaaactgcattctgattgtttttcccttttattttaactaaatgtgcatgaatatccattctggtgtaacggttgatatggtgcaacattgagtggtgaaggaatcccagctattggcataagaaatcttattagatcagtcatttcctgtatcttatttctatattggaaaactttggtgattccatctcaaaagtgatttgaatacataataaagggaaagcagaaattgcat

SEQ ID NO: 8540 - DNA, 415 bp, Populus tremula x Populus tremuloides
  Predicted polypeptide sequence is orthologous to G580
ataaaaaaatattaatttaatatacatttaaaaatatatatatttaaaaacaattcctttgatttttggagtgtcagtcatccgagccattgaaaaatactttttccattgctggaccgtcattttttaggtccagccaggttggcagccacctagcatctgggaagcacagcccaatagtgttgtcctccagtccagataataaccatacattcgatttcttgcctgattcttctccgccgaaagaacctccttcggccagtaaaaccattattcacgggggggggttcaaactgaaagacaaaagttcttccacggaaaatttgaactacaaagaattgtaagagaacctatattataaaggcatataaatgatagcctattacaacttctataaacttgtccttcgattatt

SEQ ID NO: 8541 - DNA, 689 bp, Populus tremula x Populus tremuloides
  Predicted polypeptide sequence is orthologous to G591, G793
caattgtttttgtcaacagaagcttcttacatcactttagaagacaacctcctaacatctatttcaacttgaatacaaatttcttcgaatacatgatccacatacccatcaatcccttttggaaaggccctacattcccactatgcaaagggagaagaaaagagagttctcgccactaatattctggtcattttccactaaccccgccacctcaaatatttagaatagggtcacattcatagagcttcagaaatttcttgccttgacttgaccattgctgtgtaacatcaagtgcccgtgatttaatatcttccttggcacggaaatgactcgtttgacgggaaaggaaaagagaagaacagtttccctgacttgattattttctgtttctcggtaaggtcgactagtagtggaggttgaaacctgaatccagtgtcgatgtagaaatgggaaaccagacgcccgctggaatgatcgatgtgtacgcgcgcaaagcttgcacgttcttggttaggtttaattatgagtgggggttcgattcgggcttgaccggtgtcggagcattaggtgggcgtgctcggaagattgctgatgcaagtgatacaggcatgatgcagagcgccttggactgaaggagctgcacggcagctccaacatcttcttccatcaacttagctacttcttgttca

SEQ ID NO: 8542 - DNA, 603 bp, Populus tremula x Populus tremuloides
  Predicted polypeptide sequence is orthologous to G653
aatactagtagaatccacatatttgcaattgaaattcctccgcaagtaattttacatttgtgggaatttgaaacccatctatcaatcaaacacaacaaacatgcccattatagctgggcagaaaggaagagagagaaaaaacaaggcagaaccaagttttgcatactccttccaatggaaatcggagggcatgaaaggaaaacacaatgaaaagtagataaagccacgcaaataaaatatcaaatggagatatttaagcctctggcacagaagccgctgcacgcttcattgttgcggacttgatgaggtggttgtagctgcccttttccttgaaaagttgggagaagtgatgcttgcaatacaatacgccctcaagtgctgcataatttgatggtgttatagcacagccaccgtgcgagcacttgaaacatgatttgtgataggcttggctttaactgtaccttctcgagcggataagcagttttaccacaagtagcgcacttttcttgtgtccctgaaacatgctacagcttgctagtgaccttgtagtcaggattaacttctagctacttgcggtactgaagtctgtgagtccgtctctga

SEQ ID NO: 8543 - DNA, 828 bp, Populus tremula x Populus tremuloides
  Predicted polypeptide sequence is orthologous to G748
agaaggattttgttacaaccagaatctctcttctgtcgagttatctcacacacttacataaatatataaacatctaagataccatgtacatgaaaaacttaggaaacagatatcatctaagatgaataaggaaaaactacaggtcttaaagtggcagggaagtgcatggtcctgtcaggtggctatgctattctagagagtcaaaatagggacacgcaattctgggttttcttctctgcaggaattctgtcaataaggtggccttctggtggtgtaagtgccaaccttctagtgtaaaagggaacacaaattcgttgagatttagaggctacagcactctgatgaaaaactccatttcattgcattactgttatagcagaaagtgtacaactttgctgatctctcatcaagtgttctcatggaaattgagagaccgggaaaacgcagcacggttcgcttgcaacactggagttgttcctgccatgtaatttctgtcttcgttttttgattgaaagcccttgaagagacctcctccattaatagaactggatttctcattcgtgatcccgagtgtcgcccatatagagctctttgcagcttcactaggatcatcaatcctcaaggtctttggaaccaaaacacccgtttctgatttggtgcccgttccctggagggcctcttctaagcagggtggattaaggatgtggccatccctttgaatgtttcccccagtggaaaagtacgactggagctttgggtactgtggtttaaaacccggccataatggccgatttccccggttaccaacaccatgggcgcgccttttcc

SEQ ID NO: 8544 - DNA, 253 bp, Populus tremula x Populus tremuloides
  Predicted polypeptide sequence is orthologous to G811
ggggagggaacttgatgatgccatttctattatgaaacaaaaagacatattccagtttaacaaaaccttctatgaaaattttttttaattgggggaaacaaaaaaactttgtaattatttccctttcaccatccttttttttgataaaatgcttaaattcaccggaatatcttatgtgaagggtttctagctttggcaaactctgagcgagggacggggtgaaaataaatgtcattttgtcaaaaaaatccaa

SEQ ID NO: 8545 - DNA, 474 bp, Populus tremula x Populus tremuloides
  Predicted polypeptide sequence is orthologous to G865
tgcacaaatcctttctagcaatgatgccaatttcccgtactacacttcaaacctctttaatcagcaaccttttgctccccatttttcatcaagctttttatcacaacaacaacaacaacaacaagatctattgagattctcgtcaaggttcgacagcccctctagctctgatcaacaggaacatgggaaggactccagtaatcctagcgagtaatatgttaattagcatcattcctttgaagcagtaatgccattagatgtcgagaagttcataattgatcaagaccttccaagtatttttgttgtgttttggaagctcttctctttcagttccctttttgtttcaatgcatggggtagacaccctaatatatattagtcaccccaagaatcacctatcagttggcaatttgcatgcatggtctgtactctttggagagataactatatatatatatatatatgagaaattttg

SEQ ID NO: 8546 - DNA, 629 bp, Populus tremula x Populus tremuloides
  misc_feature (507)..(507): n is a, c, g, or t
  Predicted polypeptide sequence is orthologous to G921
gggccgggtgtatagatatacttagagctagcttcttcaagagagagattcataactaattcatcaatggactcatcatgggtgaacacttctcttgatctcaacatcaatcccttcaagcatgtcaatgaaatcactcaagttcagaaaataaaaaaattcgagggatattctacctgggttgaacagaaattacaggttaaaaatgaggatggtgttcgtgttcttgttgaagagttgactcggataagtagtgagaacaagaagttgacagagatgcttggtgttgtatgcgataactatatgggtttgcaaaaacatctagctgatttggtgagcaagaattctgtaaaagaactcggtacaccaatatcatcacggaagagaagggccgagagtgaagattatagcatcgtgattaatggaatcagtggaggaaatgcagagagcagttctgttgatgaagagtcaagtaaaaggccaaaggagagtctgaaatcaaagatntcaaggacttattttaggactagtgaatccgattcaagcttggttgtgaaggatggatatcaatggagaaaatatggccaaaaggtgaccagagacaatccttctcctagggcttacttcaa

SEQ ID NO: 8547 - DNA, 590 bp, Populus tremula x Populus tremuloides
  misc_feature (547)..(547): n is a, c, g, or t
  misc_feature (563)..(563): n is a, c, g, or t
  Predicted polypeptide sequence is orthologous to G927
atacggccgggggctccccctctccgtttgctttctttttgtttgttgcttgagattttacagaaatggctcttaacaaatggtgtttctttgcttctgtatgagacctaagttgttgcttgcttctactactgagaattagtttgaactactgttgggataaagacgattaacgcaatcacaaaggtcattgcagagggaatttaacgacaatgaaaatgaaagaatatgaaggaattgtccataatccaagcgggcagttgtcagcggtgccatggtggactgcacttgggtcacaagctgttactggtgaatcgtgtggcctcttgagggctttacctgtagaacagcttgccattggaggtgaagctgcgactaagcaggccaggatgagtactgaccgaaggctagataaagggaatattactcaattcactatatttccaggtgactggaaaacttctggtgatgaacagagaaatcttcaggcagccatttcattgcaaacagctctgccagagtatcgtgctcattttgacctgggatntggtcagcctgtgatntgcacaaagtatcctcttgtggatcaa

SEQ ID NO: 8548 - DNA, 295 bp, Populus tremula x Populus tremuloides
  Predicted polypeptide sequence is orthologous to G927
aaagtttccgaactaatccctcattgaagcagataaagcggggagtcaaggatcaaaagctgaaaggttagataaaatagaaaatgtgccagttgctttagctttttcagaatgcgactataatcgcatgagattggttttgttccttgttgatcgaacatgaacgaagagaagatctaaatttatacatttttttaagaaggaaaaatgatttgatggtcaggatcttgcagcgaaatatcgctgctcctgttatcattactttttattggtagaaaaaaaaaaaaaaaaaaaa

SEQ ID NO: 8549 - DNA, 687 bp, Populus tremula x Populus tremuloides
  Predicted polypeptide sequence is orthologous to G938
gatccggagggagtgcatctttggtcattaatgattccagtgagtatgatgttgaaggagctgaagatgagccaaactttgatgtgcaagagtgcaaaccggagactctcagctattctaatctagggatggaaagaatgggtgaaaggctacctcttcgacaacaaccttatccaatcaagggagaagttatcaccagcacggattttattagaaagagaaagccatccagtgatataaacatgatggtggatcagaagatctacacatgcgaggctgttcaatgtgctcatagtcaaatccgattgggtttccccgacagggcttctagggacaatcatcaactaaattgtccatacagaagcacttcattggagtttagagggtcaaattttcatgttaatgaagtcaagcctgtcatctatcctcaaccatctgcactgtccatgacaactgcgccattggtgaacccagcaccctcttccttcaatctatcaggagtccctgaagatgggcaaaagatgatcagtgagcttatgtcaatctatgacactaatattcaaggcaacaagaacacaaatcgtggtaacaatttggtcacagaaggtcacaatgttttccagccaaaaatccaacaccagcaggacaaccacttgcggagtcaaagcaatatgatcaacggaaata

SEQ ID NO: 8550 - DNA, 600 bp, Populus tremula x Populus tremuloides
  Predicted polypeptide sequence is orthologous to G938
tcataaccccagaaaggtagaagagagaaactttgttaatttcttcaatggtcgcagcagctcttacgaatccacaactcattaacttggagcttagctgtggctgcctcttcctgcatcatatactctgaattgcaaagaataagaataggtgagcatctaagcgatagctgtgcacggagattgatatcgcaagagaggtgaagccaatcttaactgagcttagtcatccatccatttctttaaaccgagctgactctggtgtgtgctgaaatgggaatctttgaagaaatgggattttgcaacaatctggactttttctcggctcctcctggagaaatggatgtggttccggaacgcgaaccagaggcaacaatcgaggaggattacagcgatgaagagatggatgtggacgagctggagaggaggatgtggagagacagaatgttgcttaggcgacttaaagagcagagtaagaatacggaagttgttgataatgcaaaacagcgtcagtcccaggagcaagcacgaaggaagaagatgtcacgagcacaagatggtatcctgaaatatatgctgaaaatgatggaagtttgcaaa

SEQ ID NO: 8551 - DNA, 574 bp, Populus tremula x Populus tremuloides
  Predicted polypeptide sequence is orthologous to G993
cagatcttcagcaaagtgttgacagatgatgatgttcgttttcggttctcgttcccagctcattgcttgcagcatttagattttgctggaaataattctgttgatttgcatgttaaagatagctgtggtgagcttcgagttattcgttgcctgaagagagatggagattatgacaagcctgtgctttctaagggctggcgtcaatttgttaaatattatgaactgagagttggtgacatggttgttcttcatcgtgaggatgaccagaacctggggtcacagttcaggattgaagctaagaggagtatccagctgtttggtgaggaggattggggtgaagtgccaagagctaactagctattatatatttgcaggatgttcggccatatccagatatatatagaagaatgaatttatgtatgtgtttatgtttgagtgtttgtagtgatcataatcaatgttatctgcgtcagtctaattaaataaatatgttgctgttcttagtttcttgaatatgtattacgtgcatgtaattctcagcaataatggatttaattaattatatgtgatcaga

SEQ ID NO: 8552 - DNA, 481 bp, Lotus corniculatus
  misc_feature (164)..(164): n is a, c, g, or t
  Predicted polypeptide sequence is orthologous to G1006, G22, G28
aaaatcccaaaatttggtggaccagtggatggcatgtggctcaaaggagcaggaagtggcatacacacatctcagataattacaaatgggattgaacaaacacaacaatactactactagcaactctaaaaatttctcatagtgtatttacacgaccccacatngcatccttgtcagcattaactgaccaataactgctcgccaggtgtaacctgtgccacttgacttcccacttgccccgttttcaatcccacctgggcagtcaccaccaccttcttcctcttcgccggcgacccactctccgacgaagaagagcaactctccgacgaagaccgcttcgaagccactctaaccgggtcgggttcaccggagtttacccggagcggaaaatttagcatcgccctcgagcccctcatcctgtacgcagctcgatcgtaagccaacgcggcatcctcggcggtctcaaacgttccgagccaga

SEQ ID NO: 8553 - DNA, 572 bp, Lotus corniculatus
  Predicted polypeptide sequence is orthologous to G1006, G22, G28
ttttatccaagttcatgaacctgcactcctataaatatcactcttccctctttgtttttgaagtttcaaaattcatttcaacacctgctttcaaaaataaaaaaaaataaaaaaccttactcaactcttttctttctctccaaacacagcacaagacacgaaaacattacggccacaacatgcacggagaaagtacctacgattccgatttggccatcttagaatccattcgccgccacttgcttggagaatccgatatatgcatattcggagccccgatttctaattcgggtaacccgccggtttacgttcggagctccagtttcagcaaactgtacccgtgtctgactgacaattggggcgagcttccactcaaggaagacgattcagaggatatgatgctctacggcgtgcttcgcgacgccgtcaacgaggggtgggtcccatctctcgattcatcgggttttcttcccgtcaaatctgaaccggagcttttcccggcagtgcagagcccaccggagcgggttgttccggctccggtgattcctaaggaggaagtcatgccggcggct

SEQ ID NO: 8554 - DNA, 554 bp, Lotus corniculatus
  Predicted polypeptide sequence is orthologous to G1006, G22, G28
taacacatttacaacccaaaagaacaccaccactaccatcaccaatttcataatccagatcaagatatatatagctgctaccatgtcttgtgatttttcgtcattggaatccattcaaaactttctgcttcttgagcttgaacacgataattcccacgtagattggaatgcatccaacaatgaaacctgctattcaccctcttacaatcaatttccaatccccaatttccagtcaagtggatcatcacaggctgtcactaacttagatagtgttgttggtcccgtgaagaaatcaccagggtgcaaaaagggttcctctgcagcagcgcgtgaatccaacgcgccacctgtatggaagcgttacaggggcgtgagacgcagaccatgggggaagtttgcaggggagataagagatccaaagaagaacggtgctagggtttggctcggaacctatgagactgaagaggaagcagctctagcttatgataaagctgctttcaagatgcgtggtaaaggccaaactcaattttccccacctcattggttctgactcg

SEQ ID NO: 8555 - DNA, 428 bp, Lotus corniculatus
  Predicted polypeptide sequence is orthologous to G1006, G28
catttgttttctttaattcctaattaaggcttttgattgtgtctttcccttttgattgtgccactcccactagagtcaccatcccaatccatctctcaatttcttggtgcattatttttgtaacagcttccaatttccaaaatttgttggatggttgagtgttcatctctcagaataagataattacataagcaagttgcattccacgtcagccttcaattcaccaataactgttctccacgtgtgcactttgcaacttgactcctccacttgttctgtttttaatcccacttgagcagtcaccacaggcaccgttggccccaccaccttcttcctccgcttcgccgtcaaaccactctccgacgatgacgatgacgaacaagaagaagaagaagacaatgaccgcttcgacggcacacgaaccgggt

SEQ ID NO: 8556 - DNA, 455 bp, Lotus corniculatus
  Predicted polypeptide sequence is orthologous to G1006, G22, G28
tctctcacaaatatcccaaatcttcactattccactctcttattagacaaacacagaaatcaggagctccagtttcaaaaacaccgccacaacatgtacgaacagagtaattatgagtccgattgggcccttgtagactcccttcgccgccacttcctgtgtgagtccgaacaaagattcggagccccgacatcagttccgggtaacgcccgggtttactctcggagctccagtttcagcagcttgtatccgtgtctgagtgaagattggggcgagctccctctcaaggaagatgattccgaagacatggtgctctacggcgtgctacgcgacgccgttaacgtcgggtgggtcccgtccctccatgccgggtgcgggtcacctgaaagtttctcgtcgggtttggtgatcaagccggagccggacgtcatgccggtgagagagagcttcccggc

SEQ ID NO: 8557 - DNA, 460 bp, Lotus corniculatus
  Predicted polypeptide sequence is orthologous to G1033
gttgaaggtcttctcctctttccttcatctttcagaagacggtcttggtaagggaactgagaacatgacaaagggaaagaaagctggaaagacttcaaaggaagtattgaaaccagttgatgaccgaaaggtaggaaagcgaaaggcggctgttaaacccgataagggtactgcagggaaggcaaagaaggccaagaaagatcccaacaaaccaaaaagaccgcccagcgctttctttgtgttccttgaggatttcagaaagacttttaaggctgaaaatcctaatgtaaagggtgtatccgctgtagggaaagctggaggagaaaaatggaaatccttgactaaggctgagaaagctccatatgaagctaaggctgcaaaaaggaaagctgagtatgaaaaacttattaatgcttataataataaacaggcaagtacagcggatgatgtagacgaggaa

SEQ ID NO: 8558 - DNA, 534 bp, Lotus corniculatus
  Predicted polypeptide sequence is orthologous to G1033
acacaccactcgctctttctctctctctcttcctctctctcccaaaccctaaccccaaaccctatttcgcttccgtcatgaaaggtggaaagtccagaaccgaatctaatagagctgagcctaagctcgctgtgaataagaaggctggtggcgccaccaagccggccaggggtgccaaggggaaggcagccaaggaccctaacaagccaaagaggcctcccagtgctttcttcgttttcatggaggattttaggaaaattttcaacaaggagaatcctgagaacaaggctgtgtctgctgtgggcaaagctgctggagctaaatggaagtcaatgcctgaggctgagaaagctccctatgtggcgaaagcagagaagcgaaaggctgattatgagaagaccatgaaagcctataacaagaagcaggctgaaggtccggctgctgcagatgaagaagagtctgagaagtcagtgtctgaggtgaatgatcaggatgaagacgatgatgacagcgacgaggatgatgatgacgagt

SEQ ID NO: 8559 - DNA, 566 bp, Lotus corniculatus
  Predicted polypeptide sequence is orthologous to G1033
aacaaaccctcgctctctctctctctctaacaaaccctcgctctctctctctcctcgccgcaccgtcaccatgccgaaggccgcttccgactccaaacccgctgacagccggttgaagcgcaagggcgctggaactggaaggaagcagacgaagaaggctgcgaaggatcctaacaagcctaagaggccttccagcgctttctttgtttacatgtctgagttcagaacgcagttcaagaaggataatcctaacaacaagtccgttgctgctgttggcaaagctgctggtagcaagtggaaatccatgactgatgctgagaaggctccctacgttgctagggcagagaaggcgaaggaggagtatgagaagactctccgtgcctacaacaatggattggctgagagcaaaggctctgctgaggaagaaggttctgacaagtcaaagtccgaagtcaatgatgatgatgaggacgatgatgaagatgacgagtgaaatcatgtagcaaatgaaggagcttaagggtgtaactggatgcaataattttcataggctcgcttcaatttta

SEQ ID NO: 8560 - DNA, 509 bp, Lotus corniculatus
  misc_feature (50)..(50): n is a, c, g, or t
  misc_feature (329)..(329): n is a, c, g, or t
  Predicted polypeptide sequence is orthologous to G1062
aaaaaaacaatttattccaaaacttaaaaacaaagttaacagcataagtntgctttttcataatcaagatgagaaaaatatcagagctaactcctcaacctacagatttagctaacctatttgatcttggcctggacgggtaggccattacaaagggcaacaagaagcaatgcatttacaaacagcaagctacagcaactacagttagtgccgctataagggtagagcatttatcaagcacttcaatcacaccatacccgggtagccagctgaatcaagaagcactgctttgatttgctcagggaggacatcctggccttctgtgcatngctcagctctgaacacatctaaagcaaagccattaaagcagctaataacagcctgctgaacatccaatccgaggttgtccaacgccttcatagtagaaagcaaaagacctggtctgcgggtacaaaacatatgaatgttgacagctctcccttcccttaacctaacttccaccttcacag

SEQ ID NO: 8561 - DNA, 554 bp, Lotus corniculatus
  Predicted polypeptide sequence is orthologous to G1067, G2156
gctttaatttgtctccttcatctctctcttgctttgcttcttcttcttcttctcttcagctctctttctactcccttttctttatctgcactctccttctgtctgtttatcaattccttttccatcaacacaacttttttttatattcactccactcaccacttctcttaaaataaaccataaacacaaaagcaagggttttttaaaacatagtttgctctactattttttactaatatcaatattttttttcctttttttatgaataaaaattgtatatctctctcttcgtttgatatgtccatggctggtttggatttaggcacaccatcatcatcacacttccttcaaaacctccacagagaagatcacttcaaccttcagcagcagcaacagcaacaaccacaggaatcggaggaagaacccaaccacaactccgacccgttttcagctgaagatggaccacgctccggcgacttggttggccgtcgaccacgcggccggccaccggggtcgaagaacaagcagaagccgccggttatcataactcggga

SEQ ID NO: 8562 - DNA, 458 bp, Lotus corniculatus
  misc_feature (379)..(379): n is a, c, g, or t
  Predicted polypeptide sequence is orthologous to G1076
aacacaaagggcaaacgttttacaatgttcctaaaaagagttcttacaacattcctagcaaaagaagacgaacttcagtaacaatcagtacttcttcacaaacaattcaaaggaaagaaggaaattcaccagaaaattaatatatatatatatatatatatatatatatatatatatatatatatagatgttaagattcaactactcacctttgtgccccgaagatcaactcaataagattgccttccaccggagtttccagcccaaccatcaactggtaattgaggcatgtttaggggtaaattgaagaacggaagccctgaagatgggtcagggaaagagttattaactcctccaccaccaccactgccactaccgncaccagcagatgattgaccttgttgcatctgaagagattcatcttcctccaagggcaacctctcatacgcaacattagt

SEQ ID NO: 8563 - DNA, 460 bp, Lotus corniculatus
  Predicted polypeptide sequence is orthologous to G1136
aggcagaggagggagaagcttaaccagagattctacgcgcttcgcgcggtggttccgaacgtgtcgaagatggacaaagcttcactgctaggagacgctatatcctacatcacggagctgaagaccaagcttcagagttcagaatcggataaaactgggttgcagaagcaatttgatgcgatgaagaaggagctggagaaaaccagtgaacagtcttcttctccaactccacctccacctaacaagaacaagtccttctcctcatcctcctcctcttccaatcagattctagtggaggacattgacgtgaagatcattgggtgggatgcaatgataagggtccaatgcagcaagaagaaccacccggccgcgattttgatggcggcgttgatggagctggaccttgaggtgaaccatgctagtgtgtcagtggtgaatgataccatgatccagcaagcaa

SEQ ID NO: 8564 - DNA, 494 bp, Lotus corniculatus
  Predicted polypeptide sequence is orthologous to G1140
cgaaaagaagggagagaagattatgaatgagatcaatggtctccaaataaagggaaagcaattgatggaggagaacgaacggctaaagcgtcacgtggctggcatgattagcacaggcttaatgcatggagatactgagtcagaattgttagttatggaagaaggtcattcttcagagtctgttactaacgtttgtaactccactactgggcctcccttagaggatgatagctcagacacgtcgctcaaactggggcttccatactaaggctgaaggaaaagtgtgtggagttaaacttacagggcaagatgaacaaatattaatgtgaatggtctttagtggattaattggtggtatagtacttctatattagtaatgacttttggaggtacgcgagatatgtcattgagaaattgataagatgtaattatttcccaactaatgttctaattcgcattataattaaccaggacaatgtggtatccttcctttt

SEQ ID NO: 8565 - DNA, 544 bp, Lotus corniculatus
  misc_feature (237)..(237): n is a, c, g, or t
  Predicted polypeptide sequence is orthologous to G1146
ggcccccctcgagttttttttttttttttttaaacgtgaatgttggctaattatatgcaaaactaatgagatgaaacttcccctcattgaaaaatgaagtgggaaatttctatgttagaaagatcttcaggcaaaattttctacaatgaagactgatagaacattctttacaatgccaacttttacaatatctataaaacctaatacttctaggaactctaaactaagttggtgatnggtttccaaggttcttcaaaagctaagtcttgtaatttttaatttccaactataagtgattcttcaacatttcaccatgaaaccaaacctacgtgaatctatcacaggaaacctgaccgctatgcatgaaccgcgactaatgtacatgctaatctgaagtgagcactgcattcaatgattgttccagttttctactatttgatgctctatcatctaccaattccaagtctaacagtaaaacatcactctcttcacattttctttcaaggctggcaatggcttaacaccacactctccagctactcgt

SEQ ID NO: 8566 - DNA, 567 bp, Lotus corniculatus
  Predicted polypeptide sequence is orthologous to G1146
acagttcaaccaaatatgtctcaaaaaaaatgttcaaccactaacatgagaaggcaagccaacaaaagcaagtaacaagttcatccacgaacataatcacacgaagtttttaacaaaagtcaaacaccaatgacatcagtacttcaaacaaccatatgctatcctaacagtagaacatcaccctcttgacgttctccttaagtgcaggtaatggcctcactgcagcgttggcaccaggtgcccgagtagttcgtccacccattccgcgaccagcagcagcactggtcatggagccactgtcagaagtttcaggctccatatagaaccttgctcggaaggctgcgagatgggcatagtatgctggaggcacaatagatacagatcgtgtgcaccttgcataggtgtagcacaggttgtgggtaaggctttgtaaaccatcagcagtgaagttgttctcgtcccacaggacgtggtaatgcgcaggacggcttgtgccctggattccagcatgggaacaaagataaaaatcgaactccgttggatggcagatcttggagtccaccacag

SEQ ID NO: 8567 - DNA, 495 bp, Lotus corniculatus
  misc_feature (49)..(49): n is a, c, g, or t
  misc_feature (201)..(201): n is a, c, g, or t
  Predicted polypeptide sequence is orthologous to G1146
tctttcacggcgcattcctttaatcagtgacaggcctacaattattttnggggcagatgtcactcatccacatcctggggaggattctagtccatcaatagcagctgttgtggcttctcaagattatcctgaaatcaccaagtatgctggtttggtttgtgcccaagcacatcggcaggagctcattcaagatcttttcanaacaatggcaagatccagtcagaggaacattaactggtggaatgatcaaggaacttcttatatctttccggagggctacaggacaaaagccgcagcgcatcatattttacagggatggtgtaagtgaagggcagttttatcaagttttattgtttgagcttgatgctatccgaaaggcttgtgcatctctggagcccaactaccagcctcctgtaacttttgttgtggttcagaagcggcaccacacgaggctgtttggcagtaaccatcatgacaagagttctgttgaccgga

SEQ ID NO: 8568 - DNA, 603 bp, Lotus corniculatus
  Predicted polypeptide sequence is orthologous to G1146
atgaaggaaattaacatttcatgcagatttttatacaaaaaatattgattgatagcactttgtttacaatgcctgattcgatttcatcttggccgactagagggttagcatctctaaagtctacacctatggtttgtctcccatgttctaggatcctaaactaggcctctaaaagtacaatgagaaaccttgctgctatgcttcaaagccactaatatacaagctacagggttgaggggaaaggaaggtgcattgcatgattgtgttttgcagcatttcactgtttgatgcacatgtcccccatcggccattgccaaacggccagacaatcttaacaataaaacatcactctcttcacattttctttcaaggctggcaatggcttcacaccacactctccagctgctcttgttaccttggaaccatgtccagtacctgtggagccattctcctgcagctcttccggtcccgcatagaaacgagctcgaaatgcggccaagtgtgcataatatgctggaggaacaacagagacagagcgtgtacacctcgcatatgtataacagagattgtttgtcaaagactgaatcccatcagcagtgaaat

SEQ ID NO: 8569 - DNA, 604 bp, Lotus corniculatus
  Predicted polypeptide sequence is orthologous to G1146
ctcatccagatgcaggcacaggccgcggccgtggccgtgcacgggcgccaccttctcaacaacctccatcatcgtcctctcattctcccgctcctgtcatcggcgctccgatttctccagcgcctgttgtttccgcgccgatttccgcgccatcgcccccgccgccttctccggttccggtcgacgctctgagttccgaggtcgagcagaaactcgcattgcgaccggcagcgccgtcgtcgacgaaggctattaggttcccggaccggccagggttcggtcgattagggaagaagatacaagtccgagcgaatcactttcagttgcaagtcgctgaacgcgatcttcaccattacgatgttgctatcactcctgagattacttcgaagaaggtgaccagagaggtggtgagtcagttgataaagatgtacaaggagtcggtgttggggaatcgcttaccggtttttgatggacggaagaatctcttcacggcgggtccgttgccgttttcatcgaaggaatttgtggtgaagttggaagatgataggccgaaagcctcgtcctcttctggttctaaaaaagagaaacgggagcggcaatttaa

SEQ ID NO: 8570 - DNA, 604 bp, Lotus corniculatus
  misc_feature (586)..(586): n is a, c, g, or t
  Predicted polypeptide sequence is orthologous to G1146
atttagtcaatatatcattatatctgatttaagcaggagcaccattcacctttagcattgcaaaatccgtctctctacatcgtcaacttaaattaaagccatatatagtagctgctagcataataatgaacacccaaccaaacaaagaaacggccatgtcgaagagagaaaattgcggttggtatatatgttcaataggcagctattctataattcctaattagttaatgttatgtccaacttcagcagtagaacataacatctttcacattatccttgatggcaggcaattctatctcaacattgctcctggttgcaccaccagcacccgcactagcagaacccatttccgattcgccttcgatatagctgcgagctcgaaaagcagctaagtgtgcataatatgccggaggaactatggaaactgatcgagtgcaccttgcatacgtgtagcataatttattggccagcccctgtagctcatcagctgtaaagttattctcatcatacagaacatgataatgggtaggtctgctagttccttgaattccagcgtgactgttgagataaaaatcacactcgcttnagtggcaatcgaagtgtc

SEQ ID NO: 8571 - DNA, 414 bp, Lotus corniculatus
  Predicted polypeptide sequence is orthologous to G1146
agcgacctcctacctttccaacactcagcacctcccgctctttcccacaagcccaccttccgagcctatcttcgctcttctcaccccggtgacgcccgccccaccctcccttcaagatgaagaccattttcaacggcgactgcccgtgcggggagaaggacgagtccgagtgcagcgggtgtgaaaaggttcgttcgacgtgtgcacggtggccgagagagttggagagggatggtggcgatgtctccaccgcggtcgcggctgtggccacgagcagtgcgcgtagaggagtacgggctaagaaaccacctacctggcacggacactgacaagctggggggtctccgtgccgctgtgtctttacacttcctcgtggacggatggcgaatgggcttgcctgtttccgacttgggt

SEQ ID NO: 8572 - DNA, 579 bp, Lotus corniculatus
  Predicted polypeptide sequence is orthologous to G1150
agaaggcaaagttatatttcaagaatagatatttcaagtctgcaataaaatgtctttaacatccattaaatttcatcaaccaaccatgatcctcctatggaattacataactttcagtaacagatatttcacttcatgtggatatggttgacaatgatggcacaggaacccctttattcgcctcacatttgcttatctgtgatggacggttgcattatttcacgtggtggccctagcttgtctgaggaagcagggttcattgcaattataggatatgaaaagctggcttgattgctggtcttggccttccttatccaagagaacaatcaatggcaacgtctcaggcactggcaacatgatgggagtttggatcttgcctcacccccatcttttcttgcttccaccttccacatgattgaggcttgattatgagtatgtggggtttgccatctaaggaaacatccagaggctgaataatacaatcattagacacaggattagtgcaaatacaaatttcaaagggataagttatgaaagagaagtgtgtggcgggttccaaactcctatctagcaagtact

SEQ ID NO: 8573 - DNA, 481 bp, Lotus corniculatus
  Predicted polypeptide sequence is orthologous to G1198, G1806, G558
cactcacaaagttatgattctatttcagatagggggaaaactctagcaagtgaaccaaacattcaaatttatcacatccaaactacttggaatgaaataaacacaaagcccttcaactactcttacaagggacaacattatgggtaataaacaagatacaatactctggtcaacaattcagtttctagattatgtgactagatgaacactgatatcagtaacctgaaaagtacaacacagtaaaattaaacctatgataacaaagtattcctggtgccagatccatgaaaatgaacttgacatgctatttatcactcatcaatctctggggcgggcaagccagagggagctaagagcacgcagcctagaaaagtagtcattgatggcaaggagtgcgcgggccgatgggcgagtggtcaatattcggtgaatttgttgcagcgtctgctggcgcaaatggtcagcctgccgaataaacccc

SEQ ID NO: 8574 - DNA, 515 bp, Lotus corniculatus
  Predicted polypeptide sequence is orthologous to G1198, G1806, G558
gcaaccacaaaccattaagcaggaaaagatacaaaaagagaggaaaatctccctcaaataagctgatttctgaaatacaattaccagctgtaacctaaatacaaacactattctacattttccccttcacctctatctatcaaacacctacacaatcaaattattgagactattttcaaagcaagggaaagcttaaataaaaatgttgcaccacaccagcatcaggtggagagaagagtaatcacattatctaatgtttacagcacagctaggcttctagaggaattcattgccaaaggacaccagcttccaattaactgatttaatgcagaagattcaatcctcatgttgaatgtgatctggcttgaaaaaacttcatgaatggagccttgataaacttcactcccgtggcctggccagccagagagaactcagggctcgcagccgggagaaataatcacttattgcgagaagggctcgagcggattgtctagttgttaatatcctaagcattt

SEQ ID NO: 8575 - DNA, 344 bp, Lotus corniculatus
  Predicted polypeptide sequence is orthologous to G1198, G1806, G558
actaagtttcaaaagcagatgttattatatgcattttacaagaccaactttaatttcacacaggctcatacagtttctaaatacttcattttgcaacaatctaatatacaacatgcgtccaaaattaatttatttacaaactcctatggatgaaataaacgaagcagccatattcacaacttctccaaaacgcaagactgcaggaaaaatttgatgctcaaggccagagaaactacatcacatcgcgttcataatcacaagtttttgttcttgtaatcttgtgtgactaagcaggttcacggggtcgattcgaccatagtgagcttaaagccctcaggcgttgg

SEQ ID NO: 8576 - DNA, 568 bp, Lotus corniculatus
  Predicted polypeptide sequence is orthologous to G1198, G1806, G558
ctggttttcatttcagttaccagttataggaaaaccatgagttccacttgtaacaagttgagacagagaggcaggactcttgcaaacaaaccaatgaatgaggttaatgcacaaggagaaatcttcaaaattaagggtaatacaacttttgtgatgaactatgcacgttggctggaagaacataacaagcttatttctgagatacagagtggtttaaatgatcataaacaccttattggtgatgacaagctgctgtttcttaaagacagaatcatgaagcattattttgaactgtttgagatgaaaacaagtgctacaaatgtagaattcttcaagtatggcgatttgtggcggactggaggaggctttcgcccttctgaacttcttcaggttattctacctagacttcaacattcttggaccgaggaacaactttctgatatttctaatcttggatatacatgtcaacaagctgaagaagcccttgcacaaggcatggaaaaactccaggaaacccttgataaagccacagaagcaggtgacaaaggatttcaggtgacatgtgtct

SEQ ID NO: 8577 - DNA, 574 bp, Lotus corniculatus
  misc_feature (33)..(33): n is a, c, g, or t
  misc_feature (45)..(45): n is a, c, g, or t
  Predicted polypeptide sequence is orthologous to G1272
aatagaaaaaaattagatgaaacatcaacaccntgatattatagntgtaaaacacagggttcacttgcaaaatatagtagtgtatccaaacatagctaaaattccataatccatgttcatagatacttagcctaccacaaaacagaaaggctcacttagcctaccacaaaacagaggctccaaacacatgagaaggcttgtgataaaagcctcccaatattcaagccctacggctaataagataaggtcttcaacataggttaacacagaaaagctagttaggaacttagttatatgtacagcattcttgtctaaggcgcttataggcctcaaacaaagaacatagagttgcaaacattatcctgcaatttgggcagttgagggacaggaacagctccagcagcactcagtccaccatggcttgatgatgtctcagatttgtcctcgaatttcatgaactggcccaactgggttgcagccaagtgggcatagcatataggagcaacaacagaaattgcagtggtgctcctctgatacacatatgatagactgtgtacaagctcctgcagttcat

SEQ ID NO: 8578 - DNA, 590 bp, Lotus corniculatus
  misc_feature (202)..(202): n is a, c, g, or t
  misc_feature (578)..(578): n is a, c, g, or t
  Predicted polypeptide sequence is orthologous to G1272
gtactctctctgcgttctcttcttcggacatggatccaaatgaacatgaaaatggaaatgggaatgggaatgggaatgaggatttgatgcctccgccaccaccacccccattgtcccagctgatgtggaaccggtcaaggttgacctccttgacctaccccctgagccggtgaagaaaaaactacctacccggcttcccatngccaggaaaggtttgggttccaaagggaccaagctgccccttctcacaaatcactttaaagtaactgttgctaacagtgatggacatttcttccagtacagtgtggctctttcttacgaggatgggcgccctgtagaaggaaagggggttgggcgaaaagtgattgacaaggtgcaggagacatatggttctgagttgaatgggaaagactttgcctatgatggggagaagactttgtttaccattggttctcttgctcggaacaagcttgagtttacagttgttctagaggatgttatatctaacagaaacaatggaaactggagccctgatggtgctagtacaaatgatagtgacaagaagagaatgagacggncttatcattcca

SEQ ID NO: 8579 - DNA, 596 bp, Lotus corniculatus
  Predicted polypeptide sequence is orthologous to G1272
atatcatcgaaaagccgcaggcaaaccatcttaaatattaacattcgataggtccaagacatgtgcaaaatggcctgtggcatgagcaaaagctatggcaacaagttcaacaaaccaaaataaacaacctagggccaacaaggtccagtttagatacatgaccaaactagagttccaaacagttttataaacaggcctcaacagaaaggaagcagagaagcctcaacagaaaaacatagaactgctgacgctatcctgcaacttaggcaactgagggacgacaggagcaacaccagcagcagtaagccccccatggctcgaagacgtatcagacttgtcctcgaacttcataaactgcccaatctgtgttgcagcaagatgagcatagcagattggagcaaccacagaaatggcagtggtgctcctctgataaacataagacagagaatggaccagctcttgcagctcatcaggagaaaaaccaatatcatcaagcagaacatggtagtgagtgggtctgcttgtaccaatcattccagcatgtgcgcacatatagaagtcattatttcgaggatggacaattttattatcaataa

SEQ ID NO: 8580 - DNA, 536 bp, Lotus corniculatus
  misc_feature (502)..(502): n is a, c, g, or t
  Predicted polypeptide sequence is orthologous to G1272
gatgacatagattaccatttttcattatcatcatcttcaaaaacaaggttatggccagttcacttttctgatatttcagatttcatatctcgatagcatatcacaatacacatgtgtaaatgacgcgcaggtattgaacaagatactgaaatagtggaatgcaaagaaatggttccaaggagttaaaaaagatcaaatactgtcaagatgctaacagaagaacatagaatgggccacagcttggtgaagcctgggtagttgggggacaggaatgggaccagcagatgtaagacttccagggctggaagaagtctcagagaactcatcaaacttcatgaatggtcccatctgagccgctgccaggggtgcatagcatatgggggcaacaacagatatggcagtggtgctccttggatacacataagatagtgagtgtacaagttcttgcaaatcatctgctgtaaatccaatttcatcatgtaatacatgataatgagttggncgacttgtcccaatcgccccagcatgagcacaca

SEQ ID NO: 8581 - DNA, 550 bp, Lotus corniculatus
  Predicted polypeptide sequence is orthologous to G1272
cccgcttcatttctaggaagatggattcgtttgaacctgatggtaatgggaaggaggagagtttgccgttgccgccaccgcctccggttctcccttctgatgtggtacctctaaaagcagaggaggtgcttcctgctgctccacctcctgaaccggtgaagaagaaaacacctgcgcgtcttccgatagctagacgtggtctgggaactaaagggacgaaaataccgcttctgaccaaccacttcaaagttacttgcaccaacaatgatggacacttcttccattacagtgtgaattttacctatgaagacgggcgccctgtagaaggtaagggtgtagggaggaagataatggacaaggtgcaagagacttatcagtctgacttaaatggcaaggactttgcgtatgatggggagaagagtctgttcactattggctcccttcctagaaacaagcttgagtatgaagtggtgctggaggatgtgacatcaaacagaaacaatggcaattgtagccctccaaacggtcatggggaggacaatgagactga

SEQ ID NO: 8582 - DNA, 417 bp, Lotus corniculatus
  Predicted polypeptide sequence is orthologous to G1335
caggttcaatgaccagaagggtttcggattcatcacccctgacgatggcggtgacgatctcttcgttcaccaatcggagatcaaatccgagggtttccgatgcctcggtgaaggagaggacgtcgagttcatcgttgcttccgatcccgatggccgcgccaaggctattgaggtgactggccctaacggccaagctgtgcaaggaactcgccgcggaggcggtgctggtggcggtggacgcggaggaggcggttatggtggaggcggatatggcggaggcggttacggtgggggaggacgcggaggtggcggatatggaggaggaggcggatacggtggaagcggtggttatggtggtggcggtggatacggtggcggtggacgaggaggtggtcgcggaggcggcggtggtggtgc

SEQ ID NO: 8583 - DNA, 535 bp, Lotus corniculatus
  Predicted polypeptide sequence is orthologous to G137, G145
gataaaaaatactcaatgatattaatattataaatttcttaagagggtcataccaaggccaaaggtttagcagtttcaagtcagctgtttttataccaaataaaaaaaaaaaataacaatagaagcaaagtagcatttacacatggcaaccttaagcacatggcttggttctttggtagggtgtatgcttggatatagccagataaacaagcttggctcaaagcatccatccaggaataaacccattcactggttgagcttgagttgttgcagccatctgatctgaagccacaccatggtacctatagtcagaaccaatctgcaatgtggggttgcattccaatggctggaagaagccctgagagtgagcatttggtgaaccaccatactgcatgcttggatcaccagcttgatcccatgatagcctgtagtgatttcttgaattgatatcatccagcttcactgacaaggatctgtttgcttctaccaacatctgctccttattttgaagatcagacaactggtccagcatgaa

SEQ ID NO: 8584 - DNA, 806 bp, Lotus corniculatus
  Predicted polypeptide sequence is orthologous to G137, G145
ggtgagaaagagagagaagaaaagaagaagaagaagaagagagagatggggagaggaagagtggagctgaagagaattgagaacaagatcaacaggcaagtgaccttcgctaaacgcaggaacggactattgaagaaagcttatgaactttccgttctttgcgatgcggaggttgctctcatcatcttctccaatagaggaaaactgtacgagttttgcagcagttcaagcatgctgaaaacgctagaaaggtaccagaaatgtaactatggtgcgccggaagctaatgtgtctacacgggaagccttggagttaagcagccaacaggaatacttgaagctgaaagcacgttatgaagccctacaacgctcccagaggaaccttatgggggaagatctaggccctctaaacagcaaagagctggagtcacttgagaggcagctagattcatccttgaagcaaataagatctacaaggacccaattcatgctggatcagctctctgatcttcaacgtaaggaacacatgctaagcgaggctaacaggtctctcagacaaaggcagctggaagggtaccaactaaactcactgcaactgaatcccggtgttgaagacatgggatatggccgccatccagctcaaactcatggtgatgccttctatcattcaatagaatgtgagccgaccttacaaattggttaccagcctgatccagtgtcagtggtgacggcaggcccgagcatgaataataattacatggcaggatggctgccatagcggctggggaagctattgtgatgtttccg

SEQ ID NO: 8585 - DNA, 413 bp, Lotus corniculatus
  Predicted polypeptide sequence is orthologous to G1382
atataattatacaattacaaacaacaattacatataaagtcaacccggagctgcttcactcctacacagcagctcataaatagtgatatagacatgaaagaactatctgcattttcttacagaaaatgagctttttttttcacctttgaagctatacccgccaaaaagaagaaaccagagcgctactcataaatatttatttttattttttgtagttagttaacaatttcttggacccattagtaatcttcccatgttctgtgagcaaggatatgaggaatggtttaaagatggaccatcactcctattttctctagaaccataggaacttgagctattatttagaacaccatagtatcctggagctgggctagtatgaacaaacttgaaattggaagtgctagggtgagtat

SEQ ID NO: 8586 - DNA, 563 bp, Lotus corniculatus
  Predicted polypeptide sequence is orthologous to G1384
ggagtgataagctcatcaagaatattattgatgatatctgaagagagaaatagacagctaaatacaaaaggataatattacaaactagtactttaaatggaatgaatataacctagagatactggttcaagctgtatatgtttttttttgtcaaggaagcggtatatgtttgattccatctaaacaaagcatgaaaaaaaaaacccactggtgtgctcaccccacccgccacgagcatggaaatgatcacaactcgaacatgattgtctgagggatacatgtgttagaccaagaaaattgacatgaatatcagccagagccagagggagaggagctatggacagaatactgtgctggcagctgagtagaataaaccgaaggaactgaaacttcttgcagagaactcacagaagaagcaaacatagaagaatatgatgatgatgatgatgaggaagattgaagatgatgagaagccatggttgatgacacatttgcctgatcatataaactcataggagaatagtcataaaagttgcttgaattggaaccactggaaccctgaa

SEQ ID NO: 8587 - DNA, 532 bp, Lotus corniculatus
  misc_feature (248)..(248): n is a, c, g, or t
  misc_feature (288)..(288): n is a, c, g, or t
  Predicted polypeptide sequence is orthologous to G140, G146
ggctaggatatgatagaaagtatattgaaaaacacataaaacatatggtatttggtacaaatgtttctttcactagtgcatagttggaagaattttactaaaggaaattctaaagacactcatttaaacttggggcatgtactggctctccagtatagacaccacttgaaactattcagatagattataagatggagaagatggtggcagaatttcatgaggctttccagtttatcatcatacaagtnggagagcagatgggtcttgacatgacgaatactaatgatnggggacattcacagggaagaaattccggtcatatgatggtgaaggtatagacacgcatggatttccctgtagcaaactctgttcttgtggctgtgctctctcatgttgagctatcttagctcgtaacaaattattatggtttggcagctcaatttcccgcttttgcatgaactcaatatctccaaacaaagtttcgtgctttctagatctaactctgcttaggcctttttccaatctactctca

SEQ ID NO: 8588 - DNA, 672 bp, Lotus corniculatus
  Predicted polypeptide sequence is orthologous to G140, G146
atggggagggggaagattgagatcaagaggattgagaacacaactaatcgccaggtgacattctgcaagagaagaaacgggcttctgaagaaagcttatgagctatcagtgctgtgtgatgctgaagttgccctcattgtcttctccagccgtggccgcctctatgaatattcaaacaacaacatcaggtcaactatagagaggtacaaaaaggcttgttcagatcattcaagtacgagcactaccacagaaattaatgctcagtactatcaacaagaatctgccaagctgcgacaacaaattcagatgctgcaaaattcaaacaggcacttaatgggtgatgccttaagcaccctgacggtgaaggagcttaagcaacttgagaacaggcttgaaaggggaatcactagaattagatccaagaaacatgagatgctactagctgaaattgaatacttccagaaaagggagattgaactggaaaatgaaaatctttgccttcggactaagataactgatgttgagaggattcagcaagtaaacatggtttctggacaagagctgaatgccattcaggcattagcttctcgtaactttttcaatccacccatgattgaagatggaacttcctaccctcagcagcctgataagaagatccttcatcttgggtaa

SEQ ID NO: 8589 - DNA, 687 bp, Lotus corniculatus
  Predicted polypeptide sequence is orthologous to G140, G146
ggaagaggaaagatggagatcaagcggatcgagaacaccacaaataggcaagtcaccttctgcaagcgccgcaacggtttgctgaagaaagcttatgagctatctgttctgtgtgatgctgaagttgctctcattgtctcctcaagccgtggccgcttgtatgagtatgccaacaacagtgttagaggaaccattgataggtacaagaaagcatgtgctgcttcatcaaacacagaatctgtttctgaagctaatacacagttttaccagcaagaagcatccaaattgagaagacagattcgagatattcagaatctaaataggcatatccttggtgaagctcttggcaatctgagtctcaaggaactgaagaacctcgagggtagattggagaaaggtttaagcagagttagatctagaaagcatgagacattgtttgctgatgtggagttcatgaaaaaacgggaaattgagctgcaaaaccataacaattatctgcgagctaagatagctgaacatgagagagctcagcaacagcaacagcaacagcagcagcagcaacagaatttgatgttgagcgagtcattaccttcacaatcttatgatcggaatctctttcctgcaaatctgcttggttctgataatcaatattcgcgtcaagaccagactgctctccaactagtctaa

SEQ ID NO: 8590 - DNA, 810 bp, Lotus corniculatus
  Predicted polypeptide sequence is orthologous to G140, G146
ggaagagggaaaatggagatcaagcggattgagaacacaaccaatcgccaagtaaccttctgcaaacgcagaaatgggttgcttaagaaggcatatgagttatctgtgctttgtgatgcagaagtggctctcatagtcttctcaaaccgtggccgcctctatgaatatgcaaataacagtgtcaaagcatctattgagaggtacaagaaagcatgttcagattcttctggaggtggatccacttctggggctaatgctcagttttaccagcaagaagctgccaaactgcgtgtccaaatcagtaacctgcagaatcacaacaggcaaatgctgggtgaggctttgagcaacatgaatgccagggatctcaaaaaccttgagacaaaattagaaaaaggaattagcagaattcgatccaagaagaacgagatgctatttgcagaaatcgagtatatgcagaaaagggagatagacttgcataatagcaatcagcttcttagagcaaagatagcagaaagtgatgagaggaagaaccataactttaacatgttgcctggaaccacaaactttgaatctctgcagcaatctcagcaaccctttgattctcgcggttccttccaagtgactggattacaacccaataacaatcagtgtgcaaggcaagaccagatctcacttcaatttgtttgatgtgtttgtgcttaagaaggcaaacacttgtgtaatttggcatctagtatatgaaagcagctgccttataaaggaaatataatcagagctatgtggaggggatttattaggtgttgccct

SEQ ID NO: 8591 - DNA, 744 bp, Lotus corniculatus
  Predicted polypeptide sequence is orthologous to G140, G146
ggaagagggaagatggagatcaagaggattgagaacaccaccaatcgccaagtcactttctgcaagcgcagaaatggccttcttaagaaagcttatgagctatctgtgctttgtgatgcagaggttgctttgattgtcttctctagccgcggtcgcctctatgaatatgctaataacagtgtcaaagcaacaattgataggtacaagaaagcatgttcagattcatctggggctggatctgcttctgaggctaatgcacagttttatcagcaagaggcagacaaactgcgtgtgcaaattagtaacctgcagaataacaacaggcaaatgatgagtgagtctttgggctctatgaatgccaaggaactcaaaaacctggagactaagttagaaaaaggaattagtaggattcgttccaaaaagaatgagctactatttgctgaaattgagtacatgcagaaaagggagatagacttgcacaataacaaccagcttcttcgggcaaagatagctgaaagtgagaggaaccaccctaacttgagcattttggctgggagcacctcaaactatgagtctatgcaatctcagcagcagcaacagcagcagcaattcgactctcgcggctacttccaagtcactggattacaacccactacacatactcagtattcgcgccaagaccagatctcattacaacccagtagtcagtatgcacgccaagaccacatgtcccttcaattagtg

SEQ ID NO: 8592 - DNA, 297 bp, Lotus corniculatus
  misc_feature (37)..(37): n is a, c, g, or t
  Predicted polypeptide sequence is orthologous to G1419
cccaaacaaggtataatttatttagattcaatctatntggacaaaatcatgtatgctacactacctggagtcgtgtggtggtagttgtttacttcattccttaaccaccatacctcatcccttaacaaaatatatgtttctcacaagaaaccaaaagttacaacaatatgtaaccctcagacaaaaccttttcttttctacataaaagaaagacataaaggatgaaaaataaagccctacaattttagcaaaatccatgtgtggcatcgctataattctcagcgggtgggatagcaa

SEQ ID NO: 8593 - DNA, 479 bp, Lotus corniculatus
  Predicted polypeptide sequence is orthologous to G1419, G43
gacattgtcaacttttattttacaattaattaacaggatcctcatgaagagcaaagagtcaaagatagagaaaaataaacaaatactaatttaatttgataaacaaaattacaatttgcaatttcacacaaccattagctgcggaaatcccaaagctgggtggggagataacggcgacaaaggcgccaccgtgaaattgtcccagaacccagtccagctagacggcgttaacgacgtttcctttatcctattaatatccgattccaccgtgaataaacccttcacatcaccggagctagacggtggcgttaacagagtatcccttatacggttaataatctccgattccaccgtcttttgcctcttcaccgcttcctccgcctcctcctcacgactgtgcttccggtcaacgacaccggcttcaagcgggaagttgagaaccgccttcgagccgcgaaaggtaaacgcggctcggtcgt

SEQ ID NO: 8594 - DNA, 585 bp, Lotus corniculatus
  Predicted polypeptide sequence is orthologous to G1419, G43
tgggtacgggcccccctcgagagagaactagtctcgagttttttttttttttttttcttgcaaaaacgtagtgaatgaattaaataaacttgtgaaatgtacatacatgatgatgctcatctcttaatcaaggatgcaacaaaagtcaaaccaaaaaaacatagtcctagatgagtaatttcacaccatcattaactgtgaatgaaaagccggaaggggagataacggcgacaacggcggcaccgtgaaaatccccttcacatcactgtcccataccccggtccaaatagacggcgtcaacggcgtctccttaacttccgattccgtggttttctcccttttcaccaccgccttaacttccaccacctcctcttcacggcggcgtttcctgtcactctctccgtcgccggaggcagcggcggcggcgacatcaagaggaaagttcagtatggctttcgacccgcgaagcttgaacgcagcccggtcataagccttagcagcttcgatggcggtgtcgaaagtcccgagccacaccctcgaaccacgcttgttcgggtcgcgaatctcagcggcgaacttccccca

SEQ ID NO: 8595 - DNA, 570 bp, Lotus corniculatus
  misc_feature (534)..(534): n is a, c, g, or t
  Predicted polypeptide sequence is orthologous to G1421, G1750
tttttttttttttttacaaaaaacaaaaagtctcatccattcattccttaaaccataatagtcactactacttgagtacaccaagtaccacaaacaaaaagagattagtaattaaactgattacagtcattatactaatttgctgtcgatacaaaatttgccggtaaagaggcaacacaacgacaagccataatatccatccatccattcttgttaactgctaataaacccatcaaatcaaatcaaagaacaagaagcggatctgaaacaaacaaatcatcaatatcttggaaaaagtcacggttgctattcatcgtagtagtattattccaactattgaatccgaattccaaatcctcaaacaaatttgtactcgagctgcagcaaccaccatcatcttcgaaaaacatgcttctttctggcaacacatcattgaagctgttgtttccgtacaaaacatcttgaaactggacgtcaaattgcatcacatcatttggaattggaaacagtgattcagattcttccatcttctcntgtgttggcaatgcaatcttttcagtactcaaattc

SEQ ID NO: 8596 - DNA, 519 bp, Lotus corniculatus
  Predicted polypeptide sequence is orthologous to G1451
acagaaacaaggtaacctattataatttaaatttacagtcattggctgttgatctatatagaccttggcagaatcactaccatgtcaaccattgatgtgtgtataagaatgttgggccaatccatacataaacgtcataaagattctgccaccataatggtccaactaaaattacttagaagcacaaagtcctagtaatgaaaagaacccatgggtgccacgccatttctcgaacttctcaactctggtcgactcgcataatcatcacaagagttgccatggttagaaagttggtgaccaggggaagaagtagaagtagcaacacttctgcccatttctggcacttctagtggagatagtatcttgatgtacgagacattgttcacaaactcctgccagggatcatcaccaagaagaagaatgtcattctccctgtcaacaaatacaagctgccagcctgatctcagagtcatagggtcctccagttggccttcagggccaaaaatgcgagcgagctca

SEQ ID NO: 8597 - DNA, 547 bp, Lotus corniculatus
  Predicted polypeptide sequence is orthologous to G1451
ttttatatcaagatagaatggaatgggaatgattttttgtctctgataatacatataaccttcacacatcgattgcctacggattaagtatcgtatatatggtcgctagcacatggacaagatgccatatagttacagtattagttatgaatggtggtcctagcatgaaaaacaggaaaacaaagacaaaagacgaaaagagtaggctttaaactacatttaggaagcacttctcaccatggacaagggattgagaagaagcaagggcaatataatgagatggaagaaatgtagactatgaaacagtcacatctttctcagtagtctacagaccctacagtggtcatcccagagcctaaatgtctcgggtcctgacggttcatgtaatcatcacagacgccattagagagccttgggttgggaactgagttcacaagctcgagaccggtgtaccccattggctgcattgcctggggcgaaagtatctggatgcaccatacactatttacgaattccggccagtggccatcaccgaggagaagaacgt

SEQ ID NO: 8598 - DNA, 563 bp, Lotus corniculatus
  Predicted polypeptide sequence is orthologous to G148
cccttttttttttcaaatacgatcaatatgttcaattaaatacagtaagaaaaagtagtatctatgtgtatccagttacaggaaacactatataatcaagtctgcagcttcccgtggtggtcacaaagatacattaattttatatgctgaaacacaaatctaattaaaaagcatatagacaatgaggcaattaataagtcatatatttaatttattaatgactaagtgatcaaatcaaagcatccatccgtgcatgaagtttgtctcacaagtcatgctgttctttggaatactagatgattcagcttgaacatattgatggtaccctatttgcagaaagggttctggttggcaatccattgggttggattgagcaggatgaaagggaaagttgctggttccagcagctgaagtagaggaccacaagttttccataactttgggattatatccctctgattcaagcttgagtttaagttgcttattgaggtctcctaaatgacgttcccttgtgcgaagctcttccatttgttcaatcatgatttctgtcttcctttgcctag

SEQ ID NO: 8599 - DNA, 480 bp, Lotus corniculatus
  Predicted polypeptide sequence is orthologous to G1480
tcattcacgtcaaacgcaatgactaattccctcaccgcacgcggatgctcacagtaaatgagcgacgactttcattctcatgggcgaggatcgaactccagacatataaacgtacacaaccgctttcattcagcatgtgggaacgacgccgtatccagagaaagggtcctcctccgtgagaagattcacattcacatcggagcggtacgcgaaccttcctttgagtcctgggcctagtttccgcataagctttcctcgaagcgtagcgaatggtcttctcgaaccttcgattcttcctcttctctctgtacctcaaaaccctagcttccctatccgccgacgagaatggcaccgcctccaccgccggcgccggcgttccatagcaacagtacgaaatctccgacatcgcgttcccatccggcacaacaccaacctccatcgacggcgacgacagagcgtggtagtgcgatttagcgttgt

SEQ ID NO: 8600 - DNA, 439 bp, Lotus corniculatus
  Predicted polypeptide sequence is orthologous to G1480
taggactagatatgatttataaatatgattggtgaataaacaaaccatacttagcattccagatttagatacagcagccatagccataagaggaagtgcaatgctaccacagaaaccaacaacattcattcaagcaacttacatttggcacaactgtagactgcaatagaacatgaatctatatacaaaacaaaacagcaaccaaaaagaaagacaaagagagaaagataaggaaacaagaaagaaatttaattacatatacacaaagtggcaagggtggtggtgagtgagtgagtgaatcaagcgagagtggaacaagaccatcatatccagtagcaccaggagcaggaagatcaggattgttattatcatcagagcgtaacgcaaacctggctttgatcctcggtctgctttccgcatacgctttcctcgaagcgta

SEQ ID NO: 8601 - DNA, 512 bp, Lotus corniculatus
  Predicted polypeptide sequence is orthologous to G1510
tgggaattagcgttaataggaggtggcccattatatgctgtttttaaaaccctaaaaactagccagaaaaacgttttaattccatgaaatccgttatttccgtttctggcataacgccgctatggcgttcgcggccgcgatcgcgattatcgcggtggccgctatgtagcggcataacgatggcggtgaagcaaattcccgctacgctatagcgggtagcggccgctatcgccgctatttaacaacactgatgtgtaagttgttaaacggagggggcattacaaacttataccagccaaaattcacaagaaggggaaggtcatggtcctaagtataaccccagctttaggatgtccaaaacagagtcaatggctacactgtgatgaaactgcaaggagaagtggcaaggcccaaatcaagccgaaagccagaaactacgctttacccagacctttggctgcccacatgctgacttagttattcaccctttttgctgcccatagtgggatcct

SEQ ID NO: 8602 - DNA, 379 bp, Lotus corniculatus
  misc_feature (140)..(141): n is a, c, g, or t
  misc_feature (172)..(172): n is a, c, g, or t
  misc_feature (191)..(191): n is a, c, g, or t
  misc_feature (231)..(231): n is a, c, g, or t
  misc_feature (241)..(241): n is a, c, g, or t
  misc_feature (267)..(267): n is a, c, g, or t
  misc_feature (273)..(274): n is a, c, g, or t
  misc_feature (300)..(300): n is a, c, g, or t
  misc_feature (308)..(308): n is a, c, g, or t
  misc_feature (339)..(339): n is a, c, g, or t
  misc_feature (360)..(360): n is a, c, g, or t
  Predicted polypeptide sequence is orthologous to G1535
ggatagcaattaacaatgaacaaattttattaaggaaaatgtccggagggatgcgaacatgccctggagcctggagaacagaatttcaaaggccaggtatttaacgcacaattcagatttacaagtgtttatagttgtcnnatctctaaatttactaccgtgattcctaaanaaaaaccaattataccagntattgactcccaggtgtattctcaacagaactcgattaanaaatcttgtnatcagtgccagatgaagtattatgcnacaccnnagctagattattattcaaaatttacnagtaacangctcctccactaaagaaaaaaactatccaangcaggtttagagaagtgttanctaaatttgggtgattaaa

SEQ ID NO: 8603 - DNA, 537 bp, Lotus corniculatus
  misc_feature (245)..(245): n is a, c, g, or t
  misc_feature (489)..(489): n is a, c, g, or t
  Predicted polypeptide sequence is orthologous to G1535
cacttcactctccttcctcactctgcaccaggtggtctcactctccacgaagctagctagcaaggtcttcaggcacagaagtgaagtgtgtgttttgaagagaaaaaggaaaaaaaaatgtatggggattgccaagtcatgtcagatactctcttctcgtcaccgatccagaaccctaacttcaacttcatctccaccatgccttttcacccttttcctcccatgaaagaagaagattctatgtngggagggaaagaagagatggaaagtggttctgaaagtgaacaagttgaagacaagtccgggaacgagcaagagatcactgaacagcctaagaaaaaacgttatcacaggcacactgctcgccagatccaagaaatggaagctttgttcaaggaatgtccacacccggatgataagcaaaggatgaaactaagccatgatctaggcctaaaaccacgccaggtcaagttctggttccaaaaccgncgaacccagatgaaggcacagcaagatcgatcagataatgtgatactt

SEQ ID NO: 8604 - DNA, 516 bp, Lotus corniculatus
  Predicted polypeptide sequence is orthologous to G1646, G715
ggaataaacggttcattagctgatgatcaaacatgttacacgcatatgcacagaaggatcattgttcaattttaaaattttgtacataaagtagttaaatgatgttgatcatcaagttaacaggttcataatgtcatcccataaaaatttggttaacaaaaccatttctaaattgcaagcaataaaaaattccaagcaacattgcagaagtccagaatcttcatatctcctgacagttcatcgccattattgtcactcagctctgagaaccgtcgagattgggctgcccactggtgccggcggtgccgtaagagccgtcatcggcggcagtctgccaaacagactgccaagcctgtgatggtggctgaacatacaccccagtagcaggatccatcgcagggcggccaatcatcatcccagcaggctgtcccatgggcgggtagtagtacggaacgccgctagcagcggcggcgacgagcgacgcttcctccttgatctcatccctaggaacgatat

SEQ ID NO: 8605 - DNA, 516 bp, Lotus corniculatus
  Predicted polypeptide sequence is orthologous to G1646, G715
aataaaaggttaaaatttcactagcacacagtcgaactatatatgttaatgtctgcattgcatgtaagctatcagctacattttctaatcactagggccttctcagatcccaccatccaatttttcgtccccaagtctgcaactgataactaacaggcatcagtaatcttaatatccatgaagcttcaataacaggtagctaatggtctggagatgattgttgttgctctggcggttggagccacatttgtggtgccatgaagggatcaggctgcatagcatacatattcgggtccatcacaggtttatgcatcatgacacctccaggtccaacttgctgtgcatgttgaggcggcatatagcaataaggaagtccatcaccaggcccagcaacaggcattgctcctccgggcattgttgcaagcacttcatctttcaggtcctcccgaggcacgatgtcaaccaagaaatcaaagatatcagttcttgtgatggctgcagcaatgtcattcttct

SEQ ID NO: 8606 - DNA, 544 bp, Lotus corniculatus
  Predicted polypeptide sequence is orthologous to G1666
ataattacacatactttatgatctaaatcaatttcaattattctccctacatacatccttaattaaccactgcactaattaacaaaaatatcaattaacttaaatcactaaacccctaaagacaatgcagatttctagttagtctctttcagcacaccacgtaccctttcttcttggtactcactggagattttcacatgttgattaccacatccaaaaggttctaattggacgtttctgttattgtgtgtcaagtagtgagacaatattccagattatttcacccctgcacatttcaaactaaaacatttctagtgtgtggtatgatttgattcaatgccctcttcacttccacaatgctaaccttcttcccactcacatattccttcaccttcgccctcaactccgccacaaacacaccattattcaacgaagactgaacaccagtcacctctatcctcatctccctcagcatctgcatcacatccagaagcaaaccttccctgtgtggacactccagctccagcaatgcatcactctcaat

SEQ ID NO: 8607 - DNA, 460 bp, Lotus corniculatus
  misc_feature (91)..(91): n is a, c, g, or t
  Predicted polypeptide sequence is orthologous to G1767
aataaaaatcagtttatagttcttgattcctttttttcattaatcaatacatgcaaagtccaccctgataaccttcaattaatcccatatngtcttacttaccaaactcaaaaaaagaaagaaaaaaaatcaaaatccatcaccacccaaaaacccactcacacacgtgccaaaagaacctcgaacacgtgcgaataactaacttggagagagttggagtcatgctttcttccccttcctccctccttcacgtcgtcaaggcctccatgcactggcccacaccaccgcctgctccttccacgtcaacaatatccctccatcggagcactgtgtcatcgaccacccttccttataccttctcaacaacgccctcacatcatcacaaacctcctcactaaacgccgccgtattcatccccgctccatgcatacgccgcgtccacttcgccgccgtctcctcc

SEQ ID NO: 8608 - DNA, 500 bp, Lotus corniculatus
  Predicted polypeptide sequence is orthologous to G1781
ggatcatcaccaagtttttcattttactgttttagatcaaaacattaaatccatcagcaccctctaaaaaatccagaaatcatcagaacaatagttacgaacaaaaaagacagaatcatctaactacatgtatcttctacagtttgagtttaaacaaaaaagtaagataactagtaaagaaatgaaaagttggtgggttaccaatgactcaatgagcaatgggtaaatttctcaaattgacagataattatttatatcagatgactagggatgcttaaactccttcctccagcttgtgtaatctgagcatcaatatgcatgggagtaaataaattcagctgagtgctttggtccactgtatataagcatgatcatggagacaagaatcctttgatgtgcacagcaccccaaataagtgtatgagaagagcctgtaaagttgtcaatttgagatgatcaatcattgaatcctcaatcttcatcatcagagctggcttcatc

SEQ ID NO: 8609 - DNA, 252 bp, Lotus corniculatus
  Predicted polypeptide sequence is orthologous to G1808
gaattcggcacgagctaatttccaaaaattccgtccctctgtccccatcatgctttccgccattcttccctccgaccctcttctcagcaacccattctccgccttcgccggcggtttcacgccgccgtgggactgccacgattaccccttatccgattacctcaaacccagtactgaacccaaaccggtaacttcaagttccggttctggcggaccgatcctaacccatgagaaacgttaaccggacccgga

SEQ ID NO: 8610 - DNA, 531 bp, Lotus corniculatus
  Predicted polypeptide sequence is orthologous to G1821
ggcagggttgatgagggaacaggaccagtacatgccgatcgcgaacgtgataaggattatgcgaaggactcttccaccgcaggccaaaatctccgacgaggcgaaggagacgattcaagagtgcgtgtcggagttcatcagcttcgttacttccgaagctaatgagcggtgccagaaggagcagaggaagacggtgagcgcagaggacgtgctttgggcgtttgggaagcttggcttcgatgactaccttctccctctcacccttttccttcaccgctaccgtcacactgaaggcggacttgtcatgccaccaccgccaccgctgccgcagccagcgccagggtactactacagggatgatgatgcctctgcttctggctcttcaattgcaccatttgattctctttttcacctaaagcgtgatcctgatgatttgatttgatgtgagaaattagtttaagagaaaaaccaatgcatgcagattcaggtgagagtagtgtttctagctagtacatttgcatgtccctgttg

SEQ ID NO: 8611 - DNA, 513 bp, Lotus corniculatus
  Predicted polypeptide sequence is orthologous to G189
agaacaaatcaacccacttgctttactttacttttttccccactttcagattcaaacccgttaccaaatccaccatcaccttgactttcttttctttccaaccaaaaaaaaaacaacaatttactagtactataatggtaatggattcttcacagtgtttgtttgtttgtttcagcctcgaagacaacgaaaaagataaaggaatccaatccaatattgtaacacaaaccaaacagcctttagctaaaatctaatgatcatcattcatcaacatcaattacctttgaaattgcttgtcacattgattaacatgaacttaagatgattctaaaatgagattagtagcatctgctgcagagagagcgtgattgtgctctccttcataggtcactaccagcatagcagcatcatccagggctcgttctacatgttttcttgctgggcaacctctcacactactgcacttgtaatatccccttggatgaggggatcctttaataggtttctgaccat

SEQ ID NO: 8612 - DNA, 549 bp, Lotus corniculatus
  Predicted polypeptide sequence is orthologous to G19
tacaatcactaaatccaagaaagttggaatattaattaagctcataaggagacaaaacactccacttcctagtaaaccgggtgacggttagtcatgacgacgtcgtcaagcatccacaggtccatgaaatcgctctcccactcagcatcaccaccaggcagaggctcagcctgggcctggatctgggcttgggcctggactggctcattgtcgaggcccaaaaaccactcaatgtcagagatttgcagcttcaggttaggctgatcctcgagcccggtggtgatgatgggtgcggagctgtcagaggacccggtggtggtggtggtgggcccggagctgccggaggagctgtactccggctgctcagggctgaggcagcgttgcttcttggtaggaggcggagccgccacggtgtcagggaaattgagcttggccttgtcaccgcggatgcgcttggcggcttcgtcataggctctggcagcttcttcggcggtggggaaagtgccgagccagacacggacacccttttgtgggtcccttatctcagcg

SEQ ID NO: 8613 - DNA, 518 bp, Lotus corniculatus
  Predicted polypeptide sequence is orthologous to G19
tctctctgtctctgagagtggggaggtgcaatcatctctgatttcatagatgaataccctaaccgtggcggagattaggcactggtgacctctgctatgaccttgatactctctccgacgtcttcacttcttcttccactcaccaaccaccctctttccactttgatgatgtaattccaattccaaacaagcagggggtggcatcatcatgtgaggagaagaagagagtgatgattgaagttgaagaaaaaggaagcgatgagaagagtggagagagtgaggagggtattaggaagggtaaacgggttcggaagaatttgtacagaggaatcagacaaaggccatggggaaagtgggctgctgagatcagagacccacgtaagggtgtgcgtgttgggctcggaaccttcaacaccgccgaagaagctgctcaagcttacgacgatgctgccaagcgcatccgcggagacaaggccaagctcaactttcccgacaagcccgagcccagtgagccggtg

SEQ ID NO: 8614 - DNA, 558 bp, Lotus corniculatus
  Predicted polypeptide sequence is orthologous to G19
cacactcacacaaacacaaacacaaacacaaacaaaaactctcccacagaaatcttcacaaacttttcatcatacttgtctaaacctattcctactaaacctttgatttccttctcttccctcaatcacccaccacctacaacctgagttaagtaaccaacaaccaccatgtgtggcggtgctatcatcgctgacttcatcccccgccgtggaggccgccgcctcaccgcctccgagctctggccaaactcattcggcaagcaaaatgactcacaaatcgaaaaacctcccattgctcatcaacaacaacaacaacaaccatccaccttcaaaagatctcaacctcacatagctgagaaaccaatgaaaagacagaggaaaaacctctacagaggaatccggcaacgtccatggggaaaatgggctgcagaaattcgtgatccgagaaaaggggttcgtgtttggctcggcacattcaacaccgctgaagaagctgctagagcctacgatcgagaagctcggaaaatccgtggcaagaaagctaaggtgaatttcccc

SEQ ID NO: 8615 - DNA, 380 bp, Lotus corniculatus
  Predicted polypeptide sequence is orthologous to G19
cagctcacttttattttctttgttcttccccccattgctctcattatcatcatagcagcgacaagtactattaattttctctctttctctcgacatgtgtggaggtgctatcatctcagacttcattgctgtcaagcgtggccgcaaccttgccccacaggagatatggtctgagcttgatcctttctctgattttgctgcctttgatgctgcttctgctggtgctgctgtttccaccaccccaacttccaaatcctcctcaccacccctcaactttgatgatgtgattcaagtccctgaccaaaaagtggcaggatgtgacaagaaaggtgagaagaagaaaagcgtggtgggttctggtggtgcagggaagaagaacg

SEQ ID NO: 8616 - DNA, 614 bp, Lotus corniculatus
  misc_feature (115)..(115): n is a, c, g, or t
  misc_feature (217)..(217): n is a, c, g, or t
  misc_feature (585)..(585): n is a, c, g, or t
  Predicted polypeptide sequence is orthologous to G1944
ccccctttttttttttttctttttttaataaaaataatgtcataaattatatttatttaaataaactaacaagacattttaaataatccattttatttttaactaaataatcttntgaaaaagtcttcattataagtgcaaatgtttcgaagcgacccattaagcatccgccatggctgtcattgcagaccaattatctcaacggagattagacatnggaatagcagacacaggaacagctgcagtgggtcttgatcttatctcatatggcacaaaactgcctacaatcacctgcacgggagttgcagccaccaacataccagctaatgtaccacctgcaacacgtccatctggacttgcaaaaacaatgctcatgttgccagaacggccaagtgtttccccaccactttcatgtggacagaaatggcctgataatgatagaatcctaaactgtccctcatgggttactgtcctagcagaagaaccaggctggttaagggtgacagttgatatgtgtcccactgcagagagaatgcatatatctcgcggagttggctgagagaataccattatctccctaaaaanattctctccagaattgatggtgatgagat

SEQ ID NO: 8617 - DNA, 518 bp, Lotus corniculatus
  Predicted polypeptide sequence is orthologous to G1944
gcaaatttcaagcagctttggaaaatcccatcagccaacggaaaattttcattgttctggtttggtcaaattggcttgagagtggtaattcaatatatgcatggaagcaagagaaggtatcagttctggggttacagtgataggagcagaagctccatcagcttatcatgtggcaccgaggagtgaagctccgaaccaagttcatgtccctgcaccagcatcagcaggtactgctgcagctattgttggctcaccggtgagtgtagggttggatgttacaattaagaagaaacggggtagaccaaggaaatatggaccagatgggcctgtctccatggcattgtcaccattgccaatctcatcttcagttccgccttctaatgactattcatctgggaaacgagggaagccacgcgggatggaatacaagcagtcgaaaaaaattgggttggatcatcatctaggtgacttgaatgcatgctctgatggtacaagctttatgccgcatatcatcactg

SEQ ID NO: 8618 - DNA, 525 bp, Lotus corniculatus
  Predicted polypeptide sequence is orthologous to G1950
aaaagttctaatcttccatctctaattggtttttaaactggccaacataacataccaataatgcataaataacccctttcaacatactatgtacctttcattacatagagcatatggcatgatctaacaagtcgtaagctctgatggtatacataaacaccaaaaacaagtaaaatctcactttaaaaacagcttctatgatcagggcaaagtacggaggaccactttttttcaacaaaagcaaccttaattggctgtattgtgctctcttggcatcaatgacaattttctaatttcttctggttgtattactcaagcatggccttggcagcatcgattaatattgctctaaactcatctgtagctcgaccgagcactgtgtacccttccttgtcctccacatccacatctgctccatgtcttataagaagaagggcgatctctttgttacggtcaattacagcactcattaaaggagttggaccagctctatctacagcatcaacctctgccccttcttcaatc

SEQ ID NO: 8619 - DNA, 588 bp, Lotus corniculatus
  Predicted polypeptide sequence is orthologous to G1950
gaaagcttggtaatatatcaatggagatggaagtagacagtgagaagaaccagcaagacacagtgatggtgaaagagaaggatctcttcaaagctgctgaagaaggtgacacctcaaccttccaagcatcgtcccctgaaacactctccgaatccctctctctaaggaacgaagacgctcgctcccttctccatgttgccgcttcttccggccactcccaggtggtgaagatattgttgtctgctgatgcatcagctagtgtggtaaatagtgctgatgatgaagggtgggcgccgcttcattctgcggccagcattgggaatttggagatagtggaggctttgttgagcaaaggagctgatgttaatctaaaaaatggcgggggccgaacagctttacactatgccgccagtaaaggtcgggtgaagattgctgaaatactcatctcacatgatgccaagattaatataaaggacaaggttggttgcaccccattgcatcgggcagcgagcactgggaactctgagttgtgtgaacttctgattgaagaaggggcagaggttgatgctgtagatagagctggtcaaa

SEQ ID NO: 8620 - DNA, 496 bp, Lotus corniculatus
  Predicted polypeptide sequence is orthologous to G2
atataaatatttatatattatatgaaagattatttaacttgaatgtgattactggcgggggcagaaaaaattgtacattaggatggtctcttgagtgtgtggaacccatttttctgcagccaaccttgagaagaagagggtcttataatctgcggtgggaatcctgatgatgctgcagcagttgctaaataatgtggaggtccggattgccactgttgtaaatgttgatgatcgctcgatgataaggatagatcacttccaactcgacctccatagctgctgctgggaaaatgaaaatttggagggtgaatatgtgcaaaattgtggaacattggagactctccagaagatctgtaggggacatatctttgcatttcattagaggctgaggaatggaggtgagtttgactcagcatcctcagtgcttcactctccccatgcacttccttgttgcttctatgcaaaggcttcggtagtatactcatgagcttgggct

SEQ ID NO: 8621 - DNA, 389 bp, Lotus corniculatus
  Predicted polypeptide sequence is orthologous to G2071
gattaatacactatacaaactaatatttacattggacagaggttagaaacttacatagcctaataggcttgtcttatcatcatccaacataagagacaacagcatataagcaaatgaaatagtttattatacaagatgcaggtttaattaatgtacaactaaagttcctagttcctatacatataagctatcgccctatctattattgccatgggactgcatttatctcacatctggaatatacactccagtccttaagacataacaatggcttccttggtagagctgtcacttagaaacaaggaccaaccaactcacgttgtcttccactaccaaggacctgtaagtgtcctcctcaagcattgtcttttactatttccccatggctt

SEQ ID NO: 8622 - DNA, 573 bp, Lotus corniculatus
  Predicted polypeptide sequence is orthologous to G2107
gtttttttttttttttttttagaaaataaagtgtgtatatatctatgtgtgttgatttttctaatatccaccctaatcagtatccgtactattgaaaaaacacacaagtacggacactactccctaatttccaccctaatcaacctctttattcctcaaataattaagaaaaaaattaaactaataaactattcttttttttaatgtaataaaataaactaaattgaaaaactccacaatgaaacttcagcatctagaaattccacgtcagcagcaccatactcactcccccagcaatgtgtcggtgacatcagcgccatgtttctcagaaactccggcaccgcctcttcctcttggtccactttcaccgtcaacgccggcaccgtctccgacgactcaccacccttcctcccctcaccggtctccgtctccaccaccggacggaaggcctcagctgcctccacagcagccttccggatacccctagcatccttcgtggccggaaccggcagcctccaagcagagtccgcgaagttgaggcaggctgacctccccctaagcgcaatagccgcc

SEQ ID NO: 8623 - DNA, 410 bp, Lotus corniculatus
  Predicted polypeptide sequence is orthologous to G2107
caaactcaacaccaaatcacaacacaacacaaaccaacccaaaaacacaaacaacaacaacttctagtaactactagctagctaacccttttgtgtacactgttccattcagtctaataacttcaaagaacgaaactagctttttcctcattgacatgtttaccctcaatcaatttcccgaccaggataactctgaggtatttttggcggcaagcaacccgaagaagcgagcagggaggaagaagttcagggagacgcgccacccggtgtaccggggagtgaggtggagagactccggcaagtgggtgtgtgaggtcagggagcctaacaagaagaccaggatttggctagggacgttcccaacgccggagatggcggcgcgtgcgcatgacgtggcggctattgcgctt

SEQ ID NO: 8624 - DNA, 522 bp, Lotus corniculatus
  Predicted polypeptide sequence is orthologous to G2116
agttaactaattacttcttccaaaactgtaaaatgaagtattaaactttttttcaaaataagctaatccaatcataaagttaaatcaaataaaaaattgaatagaaaaacaaaaaaaatcaataccttcaggtctcactcatgtcagtctatgaacaattcgttaaacagggtggtgacatgttggtcaatcaaatttgcatcaaaagggattgtcaattttattaacagaaacggagcgaccatcaggcatcagaacatgagaaaccctgtgacctatgtccagcccctgaaactggccgatagaatcacttgacaacatttccgacatatcatatggagtggataggtcaaacataggctgatgatggggagtagatacatcagatgagagtgaatgcaaatgtgacatttgcatagcctgaagttcgctccgcccatgttgtggttgatgtaaggaaaacggagcttgtgaatatgaaagatgatgcattcccaaagtaaaggagtcagcatgagttac

SEQ ID NO: 8625 - DNA, 475 bp, Lotus corniculatus
  Predicted polypeptide sequence is orthologous to G2144
ccaataatctaagtagcatgcaatgaacaaagcaactcactccaataataattcagtaacagtctgttctatgattttacaatcttgaatcaatcatctcgtcgattgaatgacccctatagttagtatacataatgatacttgtattatataagaatagcttaccgattcttcttcctcttttctagccatagaaaatccaggtttccaactgagcctgataaatagaagacatggaaaccctgctgaatagcattagcatagataccgctcaagatcactgctaactgcgaatactatacttgatatatacactactaggctattagctactgatacggcaacttctgcacgctttcatagctccatcttcaattggtttgagtgcagagatgctgaatttgctgacgagtcataactcaaaagtgaggtttccggagtcatgaaattatggttgtcttcctccctcgcccaa

SEQ ID NO: 8626 - DNA, 382 bp, Lotus corniculatus
  Predicted polypeptide sequence is orthologous to G2226
tgaagtaaacattttatttatctcatggttaacatgttgacaatactgttcaccagaagtacacaaaataatgcttcagatggtgctggaagacttgagagacctattcggataagggaagccaacttgcatatagaaaaaggctggcatcaatggaagctcaaaactaccctaagtgaacaacaaatggcacttaattcaagaagaagcaaaaatcatggagggactcaagcatagtggctatgcttattaataagaggggtagaacaaagtatgaaaactctatgggttcttctaaatattggaccagtatacacaataaaaaaaaaagattagaactctaaattacccacagaagaaaactctaagcccaaacgaaaag

SEQ ID NO: 8627 - DNA, 430 bp, Lotus corniculatus
  Predicted polypeptide sequence is orthologous to G2226
ttcaaaccccacttcgtaagatactaagaagagactaacagagtttccaatactttgttcttcctctctgattgatcaagcatagcatctctgctttttgtgtctctatttccatgattttcagtgctgcttgaatcaaaggcaatttgttgttcattttttagcttcaacaggtgccaaacaatttatatcagtaatttggcatccttaaaggatcctcaccattgaccaaaatgggtctctcaagtctcccagcaccatctgaaggagtgttatgtgtgcttcttgtgaacactgtgatgtccatttccatattcaaaggcattgtcagaacaattctacacattgttggtatccatctttcttcaccagatgcctcccaaaacccacctgaatcatttgaagtccatctcagcccctctgagagtta

SEQ ID NO: 8628 - DNA, 520 bp, Lotus corniculatus
  Predicted polypeptide sequence is orthologous to G2239
gcgtgaaaatgatagcctcccaccgctgggtggttcctgttttatataacttgggtttcggtccaaacgaaccatgggttgcccggcccattagatatacaaagtgatcagcccaagtgtcttatacattgacgcgcccgtgtcagaccaggtccaaataaattttgctaccgtaacaccttatcatacaaaatgtacaaattttgaagtggaaaaacaaaatctcgttcagagaatttagaaaaaaaatacaacgaattattgagatcgctcaaacaatagttaaaccggaggagggcgggcggaatcactggctcccagcggcatgatagggcgcggccgaggacgacgcttcatcgtcgctattccgcgtcctcggccgcggggatctaatcgacaatgccctcatcaagaacgagggagcctttgagaaaacccaccggtccgatttagacccctggtccaaccgcctcgaagccttccccctactgctaccattgccgccggtccggtaacccac

SEQ ID NO: 8629 - DNA, 516 bp, Lotus corniculatus
  Predicted polypeptide sequence is orthologous to G2239
ctctcttttcctcttcattttttcttcatcaattacaacacaatggaaagaaaatctcaaacactctcccttctcctcctcctaatctcgccgtcgatccccctcgccgccgcacagtccccaaacacaaaccaaaccgtagaccccgatttcaaagaattcaacccttcgtttgctataatcatcgtcatactcgtcgctgctctcttcctcatgggcttcttctccatctacatccgtcagtgcgccgattcaaaccccaacagcgtcctccccatcacccacgcgcgctcccggagggtggcgcgtggcctcgaccaaaccgtcatcgacacgttccctgtcctggaatactccgaggtcaaagcacacaagatcggaaagcacgcgctcgagtgcgccgtttgcttgagcgaattcgaagacgctgaaacgctgcgtttgatcccaaagtgcgaccatgttttccacaccgagtgcatcgacgagtggctggtttctcacaccacctgcccc

SEQ ID NO: 8630 - DNA, 549 bp, Lotus corniculatus
  Predicted polypeptide sequence is orthologous to G227, G242
acacccacacttccaaattaaacaccctaacctcacaccaacaacaacaacaacagaaaaaatcatacaagaaaatgtacaacacacctatagcgtgatggctatgacccgaaaggaaatggatcggatcaagggtccatggagcccagaggaagatgaagcgcttcagaaattggtggagaggcacggaccgagaaactggtccttgatcagtaaatcgattccgggccgatctgggaaatcgtgcaggctgcggtggtgcaaccagctctcaccgcaggttgagcaccgcgccttcactccggaggaggatgataccattatcagggcgcacgctcggttcgggaataagtgggccaccatcgctcgcttactttctggccggactgataacgccatcaagaaccactggaactcgacgcttaagcggaagtgctcgtctatcttcgctgcagacgatctcgccgccggtggtggtggtggtgatttctgtcctcagccgctcaagcgatccgctagcgccgggttaccgggaagtcctgcctggtc

SEQ ID NO: 8631 - DNA, 547 bp, Lotus corniculatus
  Predicted polypeptide sequence is orthologous to G227, G242
ctccattcaaatctctagtaacgaaaatggacacaaacaccaacaccaacaccagcatcaccaaaatggatcggatcaagggtccatggagtccggaggaggatgaagctttgcagaggctggtggagaagcacggcccgaggaactggtcgctgatcagcaagtcgattccggggaggtctgggaaatcgtgcaggctgcggtggtgtaatcagttgtcgcctcaggtggagcaccgtgccttcacggcggaggaggatgacaccataatcagagcccatgcccgattcggtaacaagtgggccaccatcgccagactcctctccgggaggactgataacgcgattaagaatcactggaactctaccttgaagcggaagtgcgcttccttcatgatggatgaccacaacgcgccgccgcttaagaggtctgttagcgccggcgccgccacgccggtttccaccgggctctacatgaacccgccgtctccggggagtccctccggatctgatgtcagcgagtccagcgtacccggtgtgtaccccct

SEQ ID NO: 8632 - DNA, 481 bp, Lotus corniculatus
  Predicted polypeptide sequence is orthologous to G227, G242
attacattccttcattcttatcatatcaccgattgagctcactgaaattaatctgagtatggaagcaccgaacagaagctcctctactaccacttcttcatcagactcatgctcttcagattccaatcctaggagtaacaatcctaatagacctgagaggatcaaaggtccatggagcgctgaggaagacaggatcctgacccggctcgtggagcggcatggggcacgaaactggtccctcatcagccgctacattaaggggaggtcagggaaatcctgcaggctgcggtggtgtaaccagctgagccccaccgtggagcaccgtccattctcggtacaagaggatgaaaccatcatcgccgcccatgcacggtttgggaaccggtgggccgccattgcccggttgctgccgggtcggactgataatgccgtgaagaatcactggaactccacgctcaagcggagggtgcccggtggtggt

SEQ ID NO: 8633 - DNA, 377 bp, Lotus corniculatus
  Predicted polypeptide sequence is orthologous to G2371
tcaatgatagattgattgattcattaattagcagtaattataataattaaccaagtcgatacatagttgtaagctgtagacaaaacaattgagaatccaatctccaacatctagtagtagtaggattggtgaggtaccatgtgagggttggaattagaatgagaattagaagagtactgataaaaatggtgattggtatctgtgccctggttcataggcacagtgtcaccattgtaggagcattctggtccagaatcatcatgttcagcttggcattccatgttcactccaaaaagcctaagtaccctgcttgaacttgaactaggacttgaagaactcatgttccccatcgctctcgtcctttgcctctcaccttg

SEQ ID NO: 8634 - DNA, 536 bp, Lotus corniculatus
  Predicted polypeptide sequence is orthologous to G2394
gttgttggtaatgtaacatacagatgagacaaacatagagtacatttaaaatagactccaacataaagggcatgacaaacccacataagcaaaaggaaaataaaatcttgaatctggtagcactgaccatagcccagatatcccaataattacttaacatgacaacaatagcacaacaaaattaacaccttacacaaagctgtgacaaaatcagaccaggtcccagtcattctggtataaatatacaaatactacctatctaacttaacactccttattttcagcctttttaaagtccttgagctgctgattgtttctccactgttaatactaccaatcgatgagaaaacagcggagcgttcatgtggtgaaatatcatctagggatggaacatgtgggctcatttcagaaaggttggcagaactttcacaatttaaatcagacatatcaccatccttggataaaattaagcttctatggagtctgaaccttggccttgtccttaaatgctccaatgatgctaaaatgatcacata

SEQ ID NO: 8635 - DNA, 509 bp, Lotus corniculatus
  misc_feature (507)..(507): n is a, c, g, or t
  Predicted polypeptide sequence is orthologous to G255, G664
gaattcggcacgagctgatttgaaccttgagttaactattagtcctccacgccatcatgagcctgatgaaacaggggagagaaacatctgttttggatgcagtttgggtttgcagaacagtaaggattgcagctgtggaattggtagcactagcagtggggacaacatcaatgcttcttcttcttctgctgcttatgatttcttgggcttgaaacctggtgtttgggattacacaagcttggaaatgaaataaaaatgaggcaatttctcagaaatagctagtgtttggaagataagttaaagaattgagtcacttgattttgaaatcttttagcatgtactgaatgctcctcaccagaattgattctcgcttcagaatcggtggtagaagagtttctagatatgcattttctctccctctttctttcttttcttctctaatttgtatttgtataaataactagttgctgatgcatagcatataaatgtatagtaccagtatagcanaa

SEQ ID NO: 8636 - DNA, 502 bp, Lotus corniculatus
  Predicted polypeptide sequence is orthologous to G2574
gtgtttgaaatcctagaattacatatatatatatatctgagggtatgtgcattgggcttcttattctatacaaggaagagggtatttccctttaggaacatgacctcagtcattgaactaggaactcacaatcacccacttccagtttcagccacagccatggattctaccacttctgctgctctttccatgctatagtcaggttcttacacatctcaacctacaggtcactgtgctgcatctatgggaagtgcttctacaatgttcatgggtctgaatttcagttcttataatcaatcaagagcaacacaggccttcttaccaacccctaccccagattggttcccaacaatcactttagacctgacttaaacaacctctgagtcatggaattcttaagggagaggaggaggtcgatggagaaggacatgcttggaactggtgcatcattgtcaaaagcctcacattcataatcgtctgggacaccccaaggatctcactc

SEQ ID NO: 8637 - DNA, 528 bp, Lotus corniculatus
  misc_feature (363)..(363): n is a, c, g, or t
  misc_feature (386)..(386): n is a, c, g, or t
  Predicted polypeptide sequence is orthologous to G264
cacaaaacttaaacataatttgcatgaaaaagtttcagccctttacaacacaactagttgtcgaggctcataactaagtatattaatcatgggaatttcacataccattagtataactagtacttcaagatagcttgctcaaagtgtgagctgatccatacccttaatgtttctagagattccatgaactgatctcccttcctcttgctcatcgtatgggttggctcgatagttggatatcgcctcttcattgtccgaacagcctggtctttctgtaaggaactgttcccaaaacacatcattcactctatctggagcagctgggctgacttggttgctacttggagttggagcagctaaatnggtaacctcattagctacatttnggtttgaggaaactccaatatcagattctttaccactggcataaaatcttgattcagcaattttgccaatttcttgacaatctatttggggtgatctggctgagtatgagtttctgttggctggtaacggacaagacgctag

SEQ ID NO: 8638 - DNA, 538 bp, Lotus corniculatus
  misc_feature (124)..(124): n is a, c, g, or t
  Predicted polypeptide sequence is orthologous to G2650
taatagaatacaaaaaagatactgtcaatcattatcatctttgaatccacgtaataatccatcaacattaatacattagaatccaaattaataaactaaagatccaaactacaagatgcaaatngttctaatgatcgacaatatttttggccaaattaaaacagcattcaaaccaacaaattccaccatcaaagtgtagcatcatcttcttccaccatcatgccatcatcattttgctaccagacaagcaatcttgaagaaggaaaacttgactccagcccttttagagttaagaagaactattggcagtgtcctgagtgttcaattttcagcaaaattccttgaaaaggttagtctctagttaagactattcctcagccaaaacatcatccaagaagacaaatacctcagtagtggttcatttcttgatttctagttctgtttcttcctccataatgtctctccaaaggcgtagcaaactaaagaaatgactagctataaacacagtgaaacaactactggcatgcaccaacaaata

SEQ ID NO: 8639 - DNA, 508 bp, Lotus corniculatus
  Predicted polypeptide sequence is orthologous to G2650
tagtacaattccaggtaatacatcaaaggcagtacaattatttcatacgatcgggggtaaatattcaacagcacagatcatcatctaattattcctttcaaataaagataatatgcaacagcaattttggaagtacttgaaatcaaaggaagctacttgaagtacttgaaatcaaacgaagccatcttcgcttagttctcttcagaataaacgtacaagggaaaaaggcataatcctgaaacggggcatttttgaagaaaaatacaaaacctcgacaggattttctctcctatggaacatcacaacagctcaaaaaggggcttgttcaccactcctgaagctcttagtaaaataatgaatgagaattatttttaatgaaaaaatatataatatccttcggcaacctggcagcccttccattacaacttttcttccctgattggttcccaaaaaaatcaccaaaagaatatgtaccttaagatattaaatacctatctcaataagatgt

SEQ ID NO: 8640 - DNA, 407 bp, Lotus corniculatus
  Predicted polypeptide sequence is orthologous to G2655
atattaaggtgatttctctactaggattttgatactagctttggcacaggtggtagacaagtagaggttacaagctgataaaggaaaaaaaaatagaggatagaaaggctttaataatatttcttcaaaatttaattcagcagaaactagcagcttcttctggaactgtgcttgataattgattcatagcagctgcaatttcatccacgtggggttcagctcacatccttcctctaccttcacactaacagaagcaagtaccatatcttccacagtagtaacattaagatggagaatgatgaaaccaagactttgcatcccaagaaccatcttcacaagcggcccgggttgcttcttggacagtatcttaatattggcatgaccatccaccaaggtcacctctatgt

SEQ ID NO: 8641 - DNA, 499 bp, Lotus corniculatus
  Predicted polypeptide sequence is orthologous to G268
aaaactatgtcacaaaagaataaatgaattttacaagcaagttaaaccagcactaactaactcttacgatctgatgtcaaggattaaataaacaaatgcttctagacaattatatagaagtgatatctccacatactttcaattctcaagtgtgtatgatgacccttttctggcagggaccaaaaacaagaatgtgagttttatatatcaaccgcgtagtaggtgcttatcacaaaccaagaccctgtaacttgcatgaggaccctcagatgtgtctcgcaccgtcgcttgccagcctatagccttggcaatctcaacaagctcatccattatggcaagagaatcacggatgtacgcacgcccaccaggtctcagtatccggtccatctcgagcataattgatgacacattgcatcttttcttctccacagaaagtaggttggcagcatgcagtaaatcataggttcttggataggtgtcaaatggttcacaccagtca

SEQ ID NO: 8642 - DNA, 532 bp, Lotus corniculatus
  Predicted polypeptide sequence is orthologous to G274
gatcatcaacgtaaatagcaaactctggtaaaatatgttgaatacttatacagtggaccaatggagaggatacaacttaaaattcagaaaaatagaactatttttttcatttggttcaaatcaaaacattaaaataacgaaaagaaactcctgagataaagccagtaagagggtgtttgctcttcattgtgacattataagataattaacttacgccaaaaaatgcgtagcagaaaacctcgagccagctctgttactttctccattaataaattaacgacatatgaaacattttatctgctcctgcaattgtcccctctctgtgccatagctgtgatgaccaattaagccaaaatgtccatgacaaaactatgtgaactctgggaatcgtatacagtacagtagtagtaagttactagcagcctaaggccaaagcctctatttcaacttgttttcagtgtctatagtgttgacgtggaattagtgacccaatactgcttcacagcaattagtaccttctcaggaacaagag

SEQ ID NO: 8643 - DNA, 564 bp, Lotus corniculatus
  Predicted polypeptide sequence is orthologous to G274
caatagctcagaatactttaggtgttgtctttgaaagaggtttgattggcatttatcatgactggtgtgaaggattttctacataccctaggacttatgatcttattcatgctaatgatttgtttagcttgtaccagggcacgtgcaacctggaagacatccttctagagatggatcgcatcctgaggccggaaggagtagtcatcatccgggatgaagttgatgtccttatcaaggtcaagaaaattattggggggatgagatgggataccaaaatggtagatcatgaggatggcccctttgtgcctcggaagatattggttgctgtgaagcagtattgggttggaagtggtaaaaacaccacctccaatgaggaataaaacaggttacaggtagaattgtcttgggtgtgaatctaatggctcaccctgcagtaacaacaatcaatgtttctaaaccgaaagcaaagaacaaatggaaaagggttatgaattaaatgaaaagaggaaagattgttgagcctagtaaaagcaaagattggttctgggagcttattctactatg

SEQ ID NO: 8644 - DNA, 510 bp, Lotus corniculatus
  Predicted polypeptide sequence is orthologous to G2789
gatgcaattaatatcatcaaaccccacaaaaaatccatgaatttatacatccttcttcaattcatcaacaccgagatcaaagaaaggctttaattaagcgtaaactaagttataaaaggaagaaggagaatgaacagtgataaagtgaaaaaaaggacaaaaacaaaacaaaacaaagataataattaactgatctgaaaagcatgaaaacatttggttaaaaaggtgggcgagcactgccattccaataaccctcagatggtaattggcatgaattgagaagattttgaggcactccatggaagagtgaagcattaggatccggcatgagttgttgctgttgtggttgcgattgcggttgttgctgcggggttcccataatccctggtgaccctaatcctccgctacccgtaacggtagctggggtttcctcatcctccaagggcagtctttcataagcagcatttccaaaggaagcagccatgatgaccacaggacctgaggccagca

SEQ ID NO: 8645 - DNA, 589 bp, Lotus corniculatus
  Predicted polypeptide sequence is orthologous to G2791
atagaaaaagatcggatcaaggaatagaaagttgacagagttgcgattaattaattaactcaaagttgaaactagaaatagcatctatcaaagtcaaggcaaatacgacgtcgtcattgtaggtccacccgatgatagtgacgtttcattttcctagactttagaaattccaccaccacgtcattttctgcgtttcttcagcacgcacttcttcacgtccaacaaacaaagcaaaagacatttcaaaaaaaaaaaaaacaaaaaaaacaaagcaaaagtcaaccaacggacgctgcatctttgacaatgctgttcgcggacatgccgggagaagagggcccattatcaccgttggatccaattaccgggctagggttgttgttgatgttgtggcccgcgttcatcaaagggttcctggcgtgacacgtggcggcggagactgcggtggcgagggaaataggcatgaggcagagaccttttccctggaggtactgcatggcggagcccatgtcttcgtccatgagcttggccacctgctgctccgtcacggtgaggctgtcgttggaggatgaagctgtcatcttctggg

SEQ ID NO: 8646 - DNA, 474 bp, Lotus corniculatus
  misc_feature (437)..(437): n is a, c, g, or t
  misc_feature (456)..(456): n is a, c, g, or t
  Predicted polypeptide sequence is orthologous to G280
aatcagctcaagtcatgtcctcttagacaattaaggaaaaaagtaaaaaataaacaaagactctcattctcataaactaagctaccactacataattttacaaagcaaaaattacattgacacaaagaccaaattccctacattgtctaagaccaccacaatcacaaggcacactctatgattcaacgctgacttcagtcaattgaggcttcaccttaggaggcctccccctgggcctcccactagaaacagcagcgcccggagacgccgccgcagccgaccgggcaaccttcttgggccggcctctaggcctgccacttgcaattgacaccaccttgggctttggctcagcattaggatcctttggtggacgacccctgggccttggtggggccaccacagtgtctagaggcagagcagccttgggcttgggtggnctgccacgtcccctcttangtggggcatttgggtcag

SEQ ID NO: 8647 - DNA, 539 bp, Lotus corniculatus
  Predicted polypeptide sequence is orthologous to G2826, G2838, G362
gaattcggcacgagaaatccgcaaccacactagaagagtaaactccaattccaccacgtgcttaaagctcttcggcttcagcgtccatgaagacatggacgacgaagccgcagcgcttgaagacacgccggactcactaccagtcaaggccacttccccatcaggctcctctgactccggcaacggagacgccgccggctccgcctctggcataaacactccctccggcgaccggaaaaaaaagtgccagtactgctgccgagagtttgcaaactcccaagccctcggcggccaccagaacgcgcacaagaaagagcgccagcagctcaagcgcgcgcagctacaagccacgcggaaggccgccgtatccttcgtccggaacccgatcatctccgccttcgcgccgccgccgcacctgctatctccctcgggagctatgatggtgccggcggggacaccgtcgtgggtgtacatgccgccacgtggtggccctcctcccttccacgtgtcggtttcgcacggttgcgttttcccggtcg

SEQ ID NO: 8648 - DNA, 625 bp, Lotus corniculatus
  Predicted polypeptide sequence is orthologous to G2885
aagaataaaaaatagagaatttccttttgttgctatgtgacagatgaatggtacaatgttcatatcaacaaaaattaatgattgactcaaacacagtaagatcataaaaacttgcactaaggaatttaaaaccctcaatacaggccctacccactaataagattagaggtgtcatctccttcctagagatgtcaccatttctgtaaaccaaaaaatagaaaaccctcaatacaaagacttgacaaaagagtatttcctcttttttcttcccttctagtgtattatgtatgacagttaatcttccaagataatttgtctggaaagatctttaccaatgccttcaagcaagcaactatctcctatgctttaattttttgcgtagctttcggctacattttaacacacctcacaagatgctccatatgcagtaactacagaaacgcctccaatatttggacattataaaccgagactgatggggatgtatgtattgttagcaaccatttacatcaaactgcagctacaaacaaggaacgtcagaatgttagatcagtgcatctttattcaccaataaaagaaacatagttgtaaacttataaacccgtcacgcataatacttagcata

SEQ ID NO: 8649 - DNA, 493 bp, Lotus corniculatus
  Predicted polypeptide sequence is orthologous to G2982
attttgatttcaatagcactccttttgagctgcatgatgacaattatgttctcaaggcaatgaaatttcatgagagacctgagaatgataatataacacacaatcctactgatggaggtgaaggttctagcatgtcaggtttgtatcatgcacaggttcctactttagtttcaaacccggcagttaggccacctccctcgtcaccacaactacctggaatattaaaggcaagagttaagaatgagcactgatctgctattgtcatattgtcttgcctctttaggaatgtttgtatattgtgtaaaataatttgcctgcaattgtctgtctttatatttcgccaacatcgccaaagtcaatctctaggttagaagcaaattggtcctcttgcttctctctattcttagggattgattttgacattcattgctaatgctaacccgcatcaagtatttgtcctttcgtagctataatagagaaatttgcttgtatt

SEQ ID NO: 8650 - DNA, 464 bp, Lotus corniculatus
  Predicted polypeptide sequence is orthologous to G2989, G2990
actaatctctcatcatcatcataatctcatccataatataaactaacaattaaaaaccagagagaataaagaagaaaggtaaaaattaaaccactaattaaactaaacgggtaccatccttaatctaatgttctaaacatgttattatcatcatcattttggttcttccccatgaaagatcgatcaagattcaagatgaagatgacccattagcacgaactgttgctccaccatcgttctggaagtgatgatgaatgggatcctcagcaccatggttgcgatttccattgccattgatttcagaggcgctgctaatgttggtgataacagggtcatgattttccttggcaaaaaaactcttagcagaaccagcatggttgatatggtggttgatgttgttgttgttgatttcgttgctaccatctctcttcccaaaagtgttcttgttgttatgcatccaaact

SEQ ID NO: 8651 - DNA, 586 bp, Lotus corniculatus
  Predicted polypeptide sequence is orthologous to G2993
aataagaaccaaattgttatttcttgaggagtcaagataaagatggtgaacatgagagtatcaggtttgaaaacaattgttgtcacaaggtcaaggattttgaactcccaaacatgagaccacaactgctactgcatgtctgcatcaatccaccacgaatccatcgcatgactgtcaccccaatttaaaacattcagagctaacaaggttaatttctgtgaatgtgatcattaatcggtgctgctatttctgctgtgaggattgttaatatcactaagaagttgaaagccatatccaccaccattgatcttcttctcattcccaatctcagaggaagatctactcttgttgttgtgcatccaaaccttgaacacctctctggacacgccaatgccatcacaaaacttctggatcgaaccttcctcctctctctgcattctccaacccaatttctctgagaattccagcatcttccccttctgctcttcactaaacttggtcctgcacctcttcttcttgctcgggttctctgttccaagagctaactgcacgtgcggcggcgccgactttgatatctggctgtgaa

SEQ ID NO: 8652 - DNA, 576 bp, Lotus corniculatus
  misc_feature (554)..(554): n is a, c, g, or t
  Predicted polypeptide sequence is orthologous to G2996
agtgtggaaaaaaattggtgagaaattttattttatatttttgaaaaaaagaaaaagtggagattgatatggagtttgatgagcaagaagagcaagatgaagaaatggggatcccggagtcaccgccgccggtgccggcgagttacgacccgcttttgaactcagcaccgagatccaaaatcgcagaggtttcagcgcctgtaatcgggaggaaaggcggctcgtttaccccgccggtggcagcgggggttgtgaggtacagggaatgccagaagaaccacgccgtcagcttcggcggccacgccgtcgacgggtgctgcgagttcatggctgccggagatgaaggcacgctggaggctgtgatctgcgccgcctgtaactgtcaccggaacttccaccgcaaggagatcgacggcgaaacagtggcctcgtgccagaggcagcagcctccgcctcctccggtgcaccaccaccagtaccacagccaattctccccttactaccaccgtggacctcagcaccatgccgcctccggcggctacctccaccaccanctgacaacatctccgacggcgc

SEQ ID NO: 8653 - DNA, 505 bp, Lotus corniculatus
  Predicted polypeptide sequence is orthologous to G3055
gctagtgctgctgcttcttctgctgggaatggagctaatgtcaagccttctaattggaaaaccaggatttgtaataagtgggagatgactgggtattgtccctttggcaacaaatgccattttgctcatggtgctacagaactgcacagatatggtggtgggcttatggagggagaaagcagagacactgcatccgctattgcggctgacactaaacagggtgtgccttcaaagactcttgctgataatgtggttgcatcagctactcctattgctcactcagatatttatcatattggagtcccatcacagaggccttccattgtgctgcagaggccagggcaaagaactcttcagaagtggaaaggtcccgataaaatcagtagaatatacggtgactggatagatgacatcgaatgaagttattaaccctgtcttcagaacgaggaaaatgagtgatcctcgcttgatgtattaccatggaacaaaatatgccaggatttcg

SEQ ID NO: 8654 - DNA, 576 bp, Lotus corniculatus
  Predicted polypeptide sequence is orthologous to G3060
taaagagagcatcaattaacaaataaaggacagtgcaatgggaaggttcaagtagctaagtaaagaaactcaaaacagcaaaacttagcatcagaagttctgtcagtaccactaagtagcaatgcacaacatattaataataataattatagtcctgactattacgacaatccacctgaataaaagaaagttcccactcctcatttccgcaattcagcaggtccatgtgcaaaatggcatcgttctccaaaagtgcaagttccctttgcaaaattctcacacagctttgtcttgaagttgttgcttccatgatggccatggccgccaggaccaccagcaccaccttggtttgatttaggtggtgcagacatttgcagggtcaacagcaaatccttcaccatgttactagcttccttaatttgatcaaagcttccctcaagttcaatgtttctaagatttggatcagactcgtgctctcgaattgatagtttggctccagtttgacgacaaatctgctttgagttcacaccacccttcccaatgattgctccggccagcgaagcttccacgctgatc

SEQ ID NO: 8655 - DNA, 635 bp, Lotus corniculatus
  Predicted polypeptide sequence is orthologous to G3060
tccaaaacccctttctcagggttacgattagggttagggttttcccaccttcttcgttcactttccttcagatctctctccaattgaagcttctcctgttccgaatcctctgttcgttgctctattatcccgatccggatctatggatttccgcaagaggggaagacccgaacccggtttcaactcaaatggaggaatcaagaaatctaagcaagaattggagtcattatcatctggtgtaggaagcaaatcgaagccatgtaccaagtttttcagcactgctggctgcccatttggtgagagctgccacttcttgcactatgttccgggtggttataatgctgttgctcatatgatgaatctagcaccttcagcacaagcgccacctagaaatgttgctgctccaccaccacctgtgcctaatgggtccacacctgcagtgaaaactcgcatatgcaacaagtttaacactgctgaaggctgcaaatttggtgacaaatgccattttgcccatggtgaatgggaactcggcaagcatattgctccttcatttgatgatcatcgtccgattggacatgccccagcaggtcgtattggtggtcgaatggagcctcctcctggtcctgctacaggct

SEQ ID NO: 8656 - DNA, 679 bp, Lotus corniculatus
  misc_feature (572)..(572): n is a, c, g, or t
  Predicted polypeptide sequence is orthologous to G3067
ggtgttttcactacttccacaagtggaagggcttttgaatctattgagattttaggccatgacccatcactgagaaaagcattgatagtatgcagagtcattgctggcagggtccatagacctctggaaaacattcaggaaatggcaggacagacagggtttgattcattggctggcaaagttggtctctattcaaacattgaggagctttatttgctcaatcctagagctcttcttccttgctttgtggtcgtttgcaaaccctgaagctaaggttaaagtaatgccagtttgcatgtttgggtacaatgtgattttttttaagttggaagaattgattctggaaaaagctactccgagtatcttttatggcagcagaattggttccggtagatctgaatgaattcaaacttgctaaatattgattgtttagtttttaagggataaggaggttcttcaccaagattttgaagaattttggttcaacttcccaagtcatgtgtgcttctttgtttattgaatgaatcacctattcatacatttgtaactttttttagtggcactgaaaattntcatctgcagaaggatgatgaagtgccctaagtacatgttgtaagatattgacatcaacctcagcttaactaattaactaccctttggatgtttccacttggaataa

SEQ ID NO: 8657 - DNA, 396 bp, Lotus corniculatus
  Predicted polypeptide sequence is orthologous to G3074
attaaatggagagcaaagtcaaagaaaaattattgtaaaggcactgcctaagagaggcatcaccatatgcaatacctacattagattagaatttctaaatttactatgccacggctatttttaaatggaacaatatctgcatttttagtctaaactataaggagagcattcaatgcctcctaaacttcctaaccatgcactatggatctgtctaacactagtaaaaaaacctatattctaattctccatcagaacttctacagaagtcatagttgaactgacacaggtttatctagacttcatcataatcttccacatcatcatcaatccttgtattcaagttagccagttgtatgggatcgatggccattttttccacatcagacaaggaccatc

SEQ ID NO: 8658 - DNA, 559 bp, Lotus corniculatus
  Predicted polypeptide sequence is orthologous to G3074
gcataaaatcaactccatatggaacttgatatacattataggcctacaacaagtacacaaagctaacataactggttaacatacataagctacacatgacgtgaacataggctaacatggataaaccatattgaatttttttcttgaaaaggacatcaagatcacttttttttttcagccaaaagcatgggacatgtttcgacagctagtggatactcataattgtccatgagcttttaactaactaataactaatagatgatattatttacccttcctcatcataatcttcttcatcctcttctatgtgcgtaccaaggtttgcaagctgcacagagtcaatagccatcttgtccacatctgatagtgaccaacccggaatttcttcatgctggctctctgttggaggttctgatatctcctgtttagctgttgtgcttgcctttttgtcctcgttttcgttggtgttggcattcagatcaagattatggaactctgcgctttcagcaggaactgcagcgttctcctttggtaactcctttgtctctgaactatcatg

SEQ ID NO: 8659 - DNA, 584 bp, Lotus corniculatus
  Predicted polypeptide sequence is orthologous to G3074
attcttcaaagcagcttacatctattaatatacttctgctttctgatagacaaacagaaaagtagaaaaccattttgtcaggcaatgctcaaataacacaacataatgaaatcaactagtagccaagctctaacaactgtttgacctgtactagcaaggtggatgtcgcctaaaaacatccattttgagcctaaaagtgcacaaagctctactaagtactactaacattagtgttaagaggaagctacatctgctacacaggaacattgacatcccagatatagaagaaatatgtaattcagattctctggttactagaggatagccatcaaaatactaatatgtactcattcttctgttttcaccatctttagctaatcccccaaaatgtacactagaacttacccttcctcatcataatcttcttcatcatcttctactctactaccaaggtttgcaagctgcatattgtcaatggccatcttgtccacgtcagaaagggaccagccgggaatttcttcgtgtttaatctctgtttccgcaagttcaggcaatgaggcctgagcagctgtgctagcaccttt

SEQ ID NO: 8660 - DNA, 551 bp, Lotus corniculatus
  Predicted polypeptide sequence is orthologous to G309
cagttctcaaccccacaacaattcacttttttttcttctagctttccttttctgataatgggtatgaattgaaattaaaattaaaaactaccaaaaaaaaaagctaggatgcgagttgagttgagttgagttgagttcagctgagttgaatcagtgagtcgccaccgaattagaagcgagttgccacgcagaggtggcaatcaatggcctagtgtgccaaccaagagtaagacacccattattctcctccactctgtaaccgtcgccgccggcgaaaagcgccaacaacatgctagcttgcttgaacgcgttggacccgaggtgaaccggagagagtccggccgagttgaaccgggttcgccactgagtcagtgtctcgtgccgttcgatccggtcggaaccctcgcacgccaccacgttgcagatttgcttccccaggtagatctccgtcatggccttgtcctgcgactcgacggcggaggagccttcgagcgagtcgaagagggctgagtagtagtggagcgactcagtgaaccggtctaggaaactag

SEQ ID NO: 8661 - DNA, 497 bp, Lotus corniculatus
  Predicted polypeptide sequence is orthologous to G309
cggcgaggctgttgcagacgaagccgcggaactcgaactggacgccgatggtttgagcaagctgagcgagcttccaacccacctgctgcaaggcgtcggagttgtccggctgcggtggtccgattccggtgaggcggaaagtgggtggtccgccggggcgcaatgcgagtgcctgcatgagcgccggccactgcatcccctgtttcaggccgaaatcgacgacgtggactcttccggcggtggcgaaagcctcaagaatggcctggttggcggtgaagtgtgcgaacttcaggtagggacaggactcgtagaagtgcatgtgaagcacgtcgtggagggaggaatcgacggtgtcagggaagattccatagattctccgagcaagagcttgtgcgaaataggaagcaaccttcctcatcgcgccggcttgcgacgcagcgaccacccctatgtgcttcacgagcgtgtccgcgagcttgtgattctccttctgaact

SEQ ID NO: 8662 - DNA, 568 bp, Lotus corniculatus
  Predicted polypeptide sequence is orthologous to G309
ggtcgggccccctttttttaaaaaaaacactagtaattcacagtacaattacaaattaaattacagttttttcttttttttttcacttcctttatttaccctcagcctcgctggctcgctcactcactcactcagtagctactgactcactcattcaacatcaatcaaaccatcgatcccattgggccattctcataataatcatcccaattaaaatctacatcggagagtcatttctttcttcttatcatctcctaactcagtagggcccaaaccgagtcaactcactacgactcactgggttgtggaagcttccacgcggaggtggcaatgagtggcctagtgtgccacccaagcatgaggcacccattgttctcctccaccctgtaaccgtcaccgccggcaaacaatgcgagcaacatgctcgcttgcttgaaggcgttcgacccgagatggaccgggttgaatccggccgagcccatcctggtcctccattggaccagggtctcgtgccgctcgacccggtccaccccttcgcacgccagcacgttgcatatctgctccccta

SEQ ID NO: 8663 - DNA, 586 bp, Lotus corniculatus
  Predicted polypeptide sequence is orthologous to G309
aagaaatccgcaggaaaattggtggcagagagagagagagaagaagaagatgaagagagagcacgagcaagtgagtgggaagagctggatgggaggcggcggtgtttgggaggaggaagacgagcttctcgcggtggtgggttacaaggtgaggtcatcagacatggcggaagttgctcagaagcttgagcaactagaagaagccatgtccgatgacaccatcgctcaccacctctcatcagataccatccacttcaaccccgccgacatcggcacatggcttgaaaccatgctctccaattccaatttcgaccccactctggcaaccaccaccacctccgattacgacgacctcaaagccattccgggaagagcaatctacgctcctgattccccttcctccagcaaacgcaccaaaacctcctcctcttcctccccctacgccgagtcgtcaactcgctccgtcgtggttgtggattcccaggagaacgggatccggctcgtgcactcactcatggcctgcgcggaggctgtcgaccggagcaacctcgccgtcgcggaggcgctggtgaagcagatcggacac

SEQ ID NO: 8664 - DNA, 484 bp, Lotus corniculatus
  Predicted polypeptide sequence is orthologous to G309
ctgtgaaaggtgaatgctcgtcaatgccgaccggcaaggccaagatgtgggaggaagaacacggcggcgccgccggagttgatgagcttctggcggctttaggttacaaggtgcgttcctctgacatggctgatgttgcccagaagatggaacagcttgagatggtgatgggtattgcacaggaagatggaatctcacaccttgcttctgataccgttcactacgaccctaccgatctgtattcatgggttcaaaccatactcaccgagctcaaccctcctccaaccaccaccaccaccttgcttgatccatcttctctcttggaaaatcaccaaatcaacgaccctttaaacccttcttcaattcttctcaacaacaacgcttcaagggtcttcaacgatgattctgaatacgatctcagagctatccccggcatcgccgcatacccaccaacccaagacaacagcaacgacgaaaccgaacc

SEQ ID NO: 8665 - DNA, 553 bp, Lotus corniculatus
  Predicted polypeptide sequence is orthologous to G351
gataaagcaaagttaattaaatagatagatgaataaatgaatgaattatatgataatgaatgactgtcaaaatacaatgtagaagaaatcctaaaaccagctaataagctccaagtccagctagctagctactgtatatgtacaagaacaaatcaaatcccaattcccaaacaattgaaaagctaattaagcactaattaactttgatctaaatgcattaattaattaataataatgagggatttcaatcttgggcaaaagacgtggcttcttcgaaggcaggggactggaaacctcttcttccacgaaaaatttgctggcggagaagtccggaaaagccggcaggttcagatcgaagttgcgctggtggctgtgtgtggatcccacaccttccgatgcggtggctgtggcggtgctactagcaccaccaccgccttcatagtggcaacgcttgtgtcctcccaaggcctgtcctgtagggaaggatttctggcagatggagcactggtggaccttgcctccaccgttggaggcagagctggtggtcacggcg

SEQ ID NO: 8666 - DNA, 457 bp, Lotus corniculatus
  Predicted polypeptide sequence is orthologous to G351
tcactcaattttctcaaaccaccactctctctaatggccttagagagcttgaattcacccaccgcagccaccactcccttccggagtagctaccaacaagaggaggaggaggaggaggagcttcaccaccatgagccttggaccaaaaacaagcgctccaaacgacctcgtttcgacaacccaacaacaacagaagaagagtacctcgctctctgcctcatcgatgcttgcacagagtggcaacaacaacaacaaaaacaacaacacagacaataacacaaagcaccttgcgcgcagaatcatcatccaattcacagtcacaatcgccgccgcaacaacaaccgccgctgaaacttactcacaagtgcagcgtgtgtgacaaggcgttcccttcttaccaagcactcggcggccacaaagcaagccaccgcaaatcctcatcggaaaatcaaactcc

SEQ ID NO: 8667 - DNA, 550 bp, Lotus corniculatus
  Predicted polypeptide sequence is orthologous to G351
gtttttgttaaacaatgaacaaatttgtctgtacagagaaagagtgaaactgaaaacaaacaaaatctgaacctaatcccaatgggccctgacccataacaacaaattcaatccaattaaattaaattaaaattaaaatccatcatctgaaactgaacaaagctacgccgtttcaccaccatcgaaaaacaaccgcggcctcgtggcggttaccggcagagggctctccacctcctgctcaccgcttcggatcttgttcgtcctgcaatctccgccgccgatccccagtggcgtccagaattccgtcagcggcgcggggaggttcagatcaaatccacggaggctgtgtgccgaggcggcgccgccgtcggaggtagtcgtgacggcgctgctggtatttgcgtggacgtggctgtgggtactgttgctgctcttgccgccttcgtagtggcaccgcttgtgaccgccgagtgcttggccggttgggaagctcttgtgacagattgaacactcgtgcatctttccgccgttaccggtggatgtcgacacg

SEQ ID NO: 8668 - DNA, 474 bp, Lotus corniculatus
  misc_feature (16)..(16): n is a, c, g, or t
  Predicted polypeptide sequence is orthologous to G351
catgaaataaataaantgaattcccactttcaaaactacattaaacgcaaagtgaagtcagagagaagacttcaaaatactcctaagtcttacgtttctactatatttacaaattaaaaaaaaaaaacatcacaaaattttctcaataatcaaaaaggaaaaaaaattcctaaaatggggctttcaataatgaaggctatgtttgattttcagtttgcgagtccgatattggaattcgacgtcacacatttcaatgccctaggtgtgaaagaggctttgaaccttcgtcattcaatggagttgagggatttcgatcttgggtatcatgaaaacacgttgcttcttcttcatcacagggtgagggctctcaacctcgtcttctccggccttggtgcttggaaactccggcagagcgggtatgttcagatcgaagtcacggtggtggctgtggctcacggtgtgggtggatccaac

SEQ ID NO: 8669 - DNA, 566 bp, Lotus corniculatus
  Predicted polypeptide sequence is orthologous to G363
ggatgaaaacttcaaataaaccattgatcaattacaaatacacacctcactgtacaatgcaagccctgccaattaaccatttcatgtctgaagagaacgaaaattcaaagatgaaagatgctaatgacttcagagtgaggacatcgatagatgtaaatgtttgagcatgatgtgccattgctacaaaaatactaaagggaagcctggtacatcaaagctcccactatgcgcaggtccggagaaggttacgaccaattagtctattgtacgcagccttaccttgttgttaacacaagaagccttctattatttaaattgaacaagacactttttttttttcttaaagcctcagagtgagatcaggagatgtagatgtctgtgcaggaggtgtagtttctacaaaactaggacttgaattatgagcatgttgttcatgttcatgccccaaattaacaccagcccttgcatctatctgcctgaaacttccaggccaaaacagaccaacatcaccatcttgcatgaacattggtgtcccgaaacagtagtctttctcaaatcttgctgca

SEQ ID NO: 8670 - DNA, 508 bp, Lotus corniculatus
  Predicted polypeptide sequence is orthologous to G385
agaaatgggtgagaaattgattaaccaatgtcttaggtgcatgcaaacatagctcccaccaattactagtctgggatcctcttctcaaacacacaaataacaatgaaggataaagagttttcatcaaaataaaacgaactaaaccctagtaaccaaaaagctgaccctaattaacttaatgtatttagtcctagctagaaaagtttaacaagggtagcaaggtctagattgaaatgagctcttaacatttactattataatctagggaagtcaattcccgaaccttaatcctctcaactcttttaatttgaggaatcatgcaaggggcgctcttgacttctcaccatctttgaattagaagccgaagttcctcactacctttttccaccccttaattcttcaagtaaacacacaatccattagtcttggaactcaagaccttcaccaattaaagaagccttaattcgttcaacagtgcaggcaatgaggttattaacagtagcaacag

SEQ ID NO: 8671 - DNA, 595 bp, Lotus corniculatus
  Predicted polypeptide sequence is orthologous to G4
ccccccttacttcccaaccacaagatctgacaagtatgacagctatgtgtggaggagcaatcatctccgacttcatcccggcggcggcggcgggttcccgccgtgtcaccgccgacatcctctggccgaatttgaagaaacccaattctaggtcgatgttgctcgacgatgacttcgaggctgggtttagggagttcaaggctgactctgattacgaagaggaggaggaagatgatgatgtcgctcaggatttgcttgctggtgctaagggatttgcgtttactgctactgctgccgctaagaccaagcgtcccaattccttctctaagggatcaactgctgcaaagtctgtggaatcaaatgagcaagctgagaagtatgctagcagaaagaggaagaatcaggatagggggatccgccagcgtccatggggaaaatgggcagctgagatccgtgaccctagaaagggggttcgtgttgggcttggaactttcaagactgctgaagaagctgcaagagcttatgatgctgaagctaggaggatacgcggcaataaaggcaatgtgactttccctgttgagcctcaattgtcttc

SEQ ID NO: 8672 - DNA, 501 bp, Lotus corniculatus
  misc_feature (317)..(317): n is a, c, g, or t
  Predicted polypeptide sequence is orthologous to G428
ggaccaaactataagcattcattcagaatgtcagcagtttttcatcaagaatacaagggaagaaaattacatgatcatttcccttttgatctctttgtgggaaatgtaagcatattactgtcagtaatctgcttctagtttataatttacaaaagaaaatacaggcaacagttactaagaatatacatttgaatgcatgcatatacatatgcacctcattcatcagaaaggaaccgtccggtcagatgttccatcatagaaaactgcatgttctcagatggtttccaatgtcgttttctctgattaataaaccaatngttaatttgcttctggtctaaccccgttgccttagccaattcaatcttatcagattccgttgggtaaggccatttgtagtgaacattccaccactgaagcagtgtttgtcttgcttccttgggaagcttacccttctttttcttctttgagaactccaatttcaaagtaccaatgtgactccca

SEQ ID NO: 8673 - DNA, 681 bp, Lotus corniculatus
  Predicted polypeptide sequence is orthologous to G428
atcaaagctaaaatcgtttcgcaccctcagtaccctcgcctcctccaagcctacatcgagtgccagaaggtgggtgcgcctccggaaatcgcgcgtttgttagaggaaatccggcgagaaaatgacctgtgtaagagggacgtagtttccacgcgctttggagccgatcccgaactcgacgagttcatggaaagctactgtgatatgctggtgaagtataaatcagacctggctaggccttttgacgaagcgagcaacttcctcaacaagattgaaatgcagctcagcaatctctgtactggtgcttcagttcccactctttctgatgaggggggtgtatcttcagacgaagaattcagtactggagatggtgatgctcaagatggacaacaattaaggggagaagatcgtgagctcaaggataggcttctacgcaagtttgggagtcacattggtactttgaaattggagttctcaaagaagaaaaagaagggtaagcttcccaaggaagcaagacaaacactgcttcagtggtggaatgttcactacaaatggccttacccaacggaatctgataagattgaattggctaaggcaacggggttagaccagaagcaaattaacaattggtttattaatcagagaaaacgacattggaagccctccgaaaacatgcaatca

SEQ ID NO: 8674 - DNA, 341 bp, Lotus corniculatus
  Predicted polypeptide sequence is orthologous to G43
ctcttctaaacaatttcaatcttcttcttctaaacaatctcaatttcaatcttctcatcatcatctttctcaaatggccaaccctgatgaagtctgtgccctttaccgcatcaaactgcacctcctcggcgaactctctcccatcccgatccgcaccacccacacccacacccacacccacgacgacgacttcgccttccagttcgatctaccaaaccctaactcatcccaatctcaatctcaatctcaatctttcacttccgatccaatcttcgaattcgactgcaaacccataatatttgacatagaaaccgaatctcctaaacctatacccgtccaca

SEQ ID NO: 8675 - DNA, 529 bp, Lotus corniculatus
  misc_feature (113)..(113): n is a, c, g, or t
  misc_feature (118)..(118): n is a, c, g, or t
  Predicted polypeptide sequence is orthologous to G450
gacaagactcactaaacaatcaaataaagaaagccaagtctataacaacatagtaatttagagtcattattgttcgagttcataatcaatacttaattagactctctcacatngtttngtttggaacattaatcatataacaaagtaacaaaccatattgatacacaaactataatgtaacaccctgctatgctcatttgtgtctgctgcagcttatcatggtattagttgtacaaaaccaaactgggcaccacaattacaaaggaaaggagcaggttctcaattaaactggtaccacttgtctagctagctagctcctgttcttgcatttctccatggctcttggtgcaagaccaatggcttcctttcctttcatgatacgcaaacgcttgcatgattcaacaaacatctcccatgggacatcaccgacaagcatccagtcaccatccttgtcttcataggttgggacataatcagagctgttcaatagatccatcagcttactctcattcatgaaatccttcatccc

SEQ ID NO: 8676 - DNA, 603 bp, Lotus corniculatus
  Predicted polypeptide sequence is orthologous to G450
tgggtcgggccccccgaaacactagtggtattcacaaaagtttactcaccatggagctggtagtctcatcatcaacaacaacaaggagatcaagatggggtttcatgaaactgagctcaggcttggaattggattgcctgctgcagcaaataatattgaagaagttgtgaggaagagaggcttctctgagactgaatctgagactgacacagtggatttgatgctcaatctctcctctaaggaaccaacttcagctggggcagatccaagtcagaaacccaagactaatctgcagaaagagaagacacttttgcctgcagatcctgccaagcctccagccaaggcgcaagtggtgggttggccacctgtgcggtcgttccggaagaacatgttagctgtgcaaaagagcgttggagaggagagtggtggtgagaagagcaataatggtggcggcggcggcggtgcgagctttgtcaaggtgagcatggatggagcaccttaccttcgcaaagtggacttgaagatgtacaagagttacagagacctttctgattccttggccaaaatgttcagctccttcaccattggcacttgcgagtcgca

SEQ ID NO: 8677 - DNA, 573 bp, Lotus corniculatus
  Predicted polypeptide sequence is orthologous to G450
agctccactttcttatcactgactctgtttctgtttacttgttgtttgtctattctgatttctgactcaaagaagagaagtaatgacaagtgtggtggtggatgcagagagagacaagtatagcatgataaactttgaggaaactgagctgcgactagggattcccggcgccggtgagtctggtatcaagatcggtggtggtagtggtgggaagagaggcttctcagagactgatgctaatgtggatttgaagcttaatctttcttctgatttgggctctgcctcttcctctgtttcttcaactctgcctccaaacaaaggcaaggagaaaacagctgcaacaacacaagctaatgacccggcaaaaccacctgccaaggcacaagttgtgggttggccaccagttcgatccttcaggaagaacatcgtgaatgtccaaaagagcaacaacaacgaaggcgcagagaaaaaggtcaccaccaccaccgccacaaccaccgcaggcaacagcgcagcagcagcagcatttgtgaaggtgagcatggacggtgcaccatatctacgtaaggtgga

SEQ ID NO: 8678 - DNA, 542 bp, Lotus corniculatus
  Predicted polypeptide sequence is orthologous to G450
ctacggaaaacattgacatttattagttactggtcaagtatggaggcactggacaaggtcacatgtttgttcctggaaacaaaaacggggtcatatataaacattttctacattgtcctccctaaggaatttccaactattttctcatgcatataatacacatatacgaaattaaattttacaaaaaagaaaaagatggcacagacacataataataattaataacaataacaatgtaaattaaaactcgatcttattcctcctatatggcttgctcgaaccaatttgcttccttgggacgcagaggatcaacactatcaattcagcttctactcttgcacttttccactgcccttgggcgctagcccaatggcttcagaacctttcattatgcggagacgcttgcaagattctacgaacatttcccagggcacatcaccgaggagcatccagtcaccatcctggtcttgataagtgggcacataatcagagccgttcaaaaggtctatcaattggctctcattcatgaagtccttcatcat

SEQ ID NO: 8679 - DNA, 496 bp, Lotus corniculatus
  Predicted polypeptide sequence is orthologous to G450
gtgaaaattaagtaaaatacaaacgatatataggtacaacagacaagcacattatggatcagcttactattatgcaagcacacaacaagtaaagaaataaagtcttgcgacataattcagatcgagtcattatcgtttctgttcacaatatatacttagaattaatctcacagttgggtttggaatattatataacaaaccatattaatgatacacaaatataattaactatatttttaacaccctgctttctttgtccatccgtgtctgctgcagcttcttcacctgacttgattcagttactaagtcaacttggaccacatggaatatggagcagttgcaatggtaacgactagtctagctccggttcttgcatttctccatggcgtctggtgcgagtccaatagcttcctttcctttcatgatacgtaaacgcttgcatgattcaacaaacatctcccatggtacatcaccgacaagcatccagtcaccatcc

SEQ ID NO: 8680 - DNA, 413 bp, Lotus corniculatus
  misc_feature (43)..(43): n is a, c, g, or t
  misc_feature (50)..(50): n is a, c, g, or t
  misc_feature (53)..(53): n is a, c, g, or t
  misc_feature (56)..(56): n is a, c, g, or t
  misc_feature (63)..(63): n is a, c, g, or t
  misc_feature (74)..(74): n is a, c, g, or t
  misc_feature (76)..(76): n is a, c, g, or t
  misc_feature (79)..(79): n is a, c, g, or t
  misc_feature (81)..(81): n is a, c, g, or t
  misc_feature (85)..(85): n is a, c, g, or t
  misc_feature (89)..(89): n is a, c, g, or t
  misc_feature (95)..(95): n is a, c, g, or t
  misc_feature (102)..(102): n is a, c, g, or t
  misc_feature (110)..(110): n is a, c, g, or t
  misc_feature (116)..(117): n is a, c, g, or t
  misc_feature (122)..(122): n is a, c, g, or t
  misc_feature (126)..(127): n is a, c, g, or t
  misc_feature (131)..(131): n is a, c, g, or t
  misc_feature (147)..(147): n is a, c, g, or t
  misc_feature (151)..(151): n is a, c, g, or t
  misc_feature (157)..(157): n is a, c, g, or t
  misc_feature (167)..(167): n is a, c, g, or t
  misc_feature (175)..(176): n is a, c, g, or t
  misc_feature (183)..(183): n is a, c, g, or t
  misc_feature (187)..(187): n is a, c, g, or t
  misc_feature (191)..(191): n is a, c, g, or t
  misc_feature (198)..(199): n is a, c, g, or t
  misc_feature (204)..(204): n is a, c, g, or t
  misc_feature (206)..(206): n is a, c, g, or t
  misc_feature (214)..(214): n is a, c, g, or t
  misc_feature (217)..(218): n is a, c, g, or t
  misc_feature (223)..(223): n is a, c, g, or t
  misc_feature (225)..(225): n is a, c, g, or t
  misc_feature (245)..(245): n is a, c, g, or t
  misc_feature (248)..(248): n is a, c, g, or t
  misc_feature (251)..(252): n is a, c, g, or t
  misc_feature (258)..(258): n is a, c, g, or t
  misc_feature (261)..(261): n is a, c, g, or t
  misc_feature (275)..(275): n is a, c, g, or t
  misc_feature (277)..(277): n is a, c, g, or t
  misc_feature (289)..(289): n is a, c, g, or t
  misc_feature (301)..(301): n is a, c, g, or t
  misc_feature (331)..(331): n is a, c, g, or t
  misc_feature (343)..(343): n is a, c, g, or t
  misc_feature (349)..(349): n is a, c, g, or t
  misc_feature (358)..(358): n is a, c, g, or t
  misc_feature (386)..(386): n is a, c, g, or t
  misc_feature (404)..(404): n is a, c, g, or t
  misc_feature (410)..(410): n is a, c, g, or t
  misc_feature (412)..(412): n is a, c, g, or t
  Predicted polypeptide sequence is orthologous to G450
ttttttttttttttttttttttttttttttttttttttttttnaactggnaancanccaaaanctcattcatananaananactntatnattttncctccanaacaattnccaaannttttntaanncatncaaaaaaattattttnaaantttttngccaaaaaancattatannactgggntccnaatnaaactcnnccaancnggtttttngtnnaactngnacttaaaaactaaacttttnagnttnngttttngcncttttccactgctntnggggctagcccnattgcctaaaancctttaattattcgcaggcgcttgcatgancccacaaacatntccaangggacatcncccactagcatccaatctccatttttgncttaatatggcggcacanaatcanana

SEQ ID NO: 8681 - DNA, 556 bp, Lotus corniculatus
  Predicted polypeptide sequence is orthologous to G450
aaacactttgagagaattagggggaagagaaaaagtttttattttcctcttattgaaaatctggtgctaagaaaagcactttcagattcattgagaagccaaaaatggctactttgttgggaaaggtgcagaatgatttgaacttgaaggagactgaactatgcctgggtttgcccggtggtggtggtggcggcggtggctctgatcaggtggaaactccaaggtccaatgggaagagagggttctctgagacagttgatctgaagcttaaccttcaatccaaggaagatctgaatgatgatgtgaagaatgtttcaaaggagaagaccctccttaaggaccctgccaagccaccagctaaggctcaagtagttggttggccaccagtgagatcatacaggaagaacatgatggtacagaaggtgaacaatgaggatcaaggcactgagaagacaacaagcagcactgctggtggggcatttgtcaaagtttccatggatggagcaccttaccttcgcaaggtggacttgacaatgtacaaaagctacaaagagct

SEQ ID NO: 8682 - DNA, 478 bp, Lotus corniculatus
  Predicted polypeptide sequence is orthologous to G450
gaaaaccaaaatgacaatttaataaaagaaaaagtatgatgttcttcttttcttacctttctatgacaaacaaaatgctcacaggcttacattaacttgtagagagggagactagattaccagtgcaatacaaaatttacatactaagggtagccttaatgactgtgattaaagtgaagtaagggagaaccttaaaaacctcgaccgtccacctcaaaatgatgtagacgtttacagcaaacctaatatactgtcatcaacatatcttgcatcatcataaaaagtttaggatgctccaatctcctatatagaattatacataagcaagaagggtattatatgctcagatgtgatctgtcatcttcatggatcagtgtagataaaggcatgcttcattgctctaggtgcggcttttgcacttttccatggccctaggtgctagcccaattgcttcagaactcttcattatcctcagcct

SEQ ID NO: 8683 - DNA, 632 bp, Lotus corniculatus
  Predicted polypeptide sequence is orthologous to G450
ggtttagagagaaaaagagtgaaaaattcatcatatggagaagatgatggtgtttgaggaaactgagctgaggcttggccttgggttgcctggaaatggaggcacagcagcaggcactggtactgaaggtgctgctgcagaaggagctgtgatgagaaagagaggattctctgaaactgagtcgactgagactgaagaaacagcaaccactactgtggatctgatgcttaacctttcccctaaagaagcttcttctgcttcggctgctgctggtggggcagatccacgtgataagcttaagacttcttcgcctaaggagaacaccctgctggtctctgattctgccaagcctcctcctgctaaggcgcaagtggtgggttggccaccagttcggtcgttccggaagaacatgtttgcggcccaaaagagcagcggagatcaagagagcgagaagaacagcagccctaatgcaagctttgtgaaagtgagcatggatggagcaccttacctccgcaaagtggacttgagcatgtacaagacttacaaagatctctctgatgccttaggcaaaatgtttagctccttcaccattggaaattgcgagtcccaaggcattaaggatttcatgaatg

SEQ ID NO: 8684 - DNA, 521 bp, Lotus corniculatus
  Predicted polypeptide sequence is orthologous to G489, G714
ggaccagaaaattaaaccgctacaaataacattttatccagcataattaaagataaggtgcagttttccctagcatattatctacgggggtcccattatctacataatagtcggcattacatgtaaactatcagctacactttcggatcatcgctatagacccctttctaaccattcagctggacatcatcaggagatggcagcacccctttctaaccattcagctggacatcctcacgagattacagcaccggataatctggatttccaagacacgcccataataaagcatctacggatctggagatgggggtcgctgcgggtctggtggctgaggccacattgggggtgccaggtaaggatgagatggctgagcatacatattgggatccatcacaggctttcccattatgacaccagcaggtccaactggctgaggcatgccgtagcaataaggaagcgcgtcaccaggcccagccacaggcatggatcctctggggattgatgcgagcacttcatct

SEQ ID NO: 8685 - DNA, 510 bp, Lotus corniculatus
  Predicted polypeptide sequence is orthologous to G519
tacgggccccccgcacaaaaaccagagtcatcacaaggaagagaagaagaagaagaagaaaactcaaacccacacgaatgcaaggtgcattggaattaccacctggtttcagattccaccccactgacgatgaacttgtcaaacactacttgtgtgccaagtgtgcttctcaacccatcaatgttcccattatcaaagaactcgacctctacaagtttgatccatggcagcttccagatatggctctttacggtgagaaggaatggtactttttcactcccagggaccggaagtaccccaacggttcacggccgaaccgggctgctggaaccgggtactggaaggcgaccggagcggataagccgatcggaaaaccgaagactctggggatcaagaaggcgctggttttctatgcagggaaagcacctaaaggtgtgaagactaattggatcatgcatgagtatcgtcttgccaatgttgatcgatctgccaccaagaaaaacaacaaca

SEQ ID NO: 8686 - DNA, 533 bp, Lotus corniculatus
  misc_feature (37)..(37): n is a, c, g, or t
  Predicted polypeptide sequence is orthologous to G519
cgcaaacagagagacgaagatcatcatcaacattcanacaacactacatcaccatcatcatcaatcaatcaacaggaattcaaacaccaagggaagggtgaattagagttgccacctgggttcagattccacccaacagatgaagaattggtgaaccactacctctgcacaaaaggtgctggccaatccttcaactactccgttatcaaagaaatcgatttgtacaagtttgatccatggcagcttccagaaatgggtttggatggcgagaaagaatggtacttcttttctccgagagaccggaagtatccgaatggttcccggccgaaccgggcggccgggagcgggtatgggaaggctactggagctgataaagcgatggggaagcccaagggcgtggggattaagaaggcactggtgttgtatgtggggaaagcacctaaaggaatcaaaaggaattggatcatgcatgagtatcgtcttgccaatgttgatagatcagctggaaagaaaagcaacttgaggcttgatga

SEQ ID NO: 8687 - DNA, 373 bp, Lotus corniculatus
  Predicted polypeptide sequence is orthologous to G522
acaagagcttcaatgtcacgttcatttagtttattatgtccaggaaattaaacagcactcgtttttttaggtataattagttgagattcctaatattagtatatgcccttaaatcaattcaagcagccactatttccacatgtcaacggggaagctggggtttgacgttgaggcattttcaggcttcatttcatggttttctatgtccctgaattcttcattgctattgttcttcaactgaaagatgtctttggttatatcttgactgagttgtgaagcaacaaacttgtcaagagctctccaatcatgagccacttgctgaaggttttgctgttgagcttgttgtatgattgatgcagcatggttgtcttct

SEQ ID NO: 8688 - DNA, 539 bp, Lotus corniculatus
  Predicted polypeptide sequence is orthologous to G591, G793
gatacaaaaggaagagcatttcaaagtgaacttgacaagttatttccctttacatgaaattttccaagacaagatggggtcagcttgcattttttaagctattgacatcgaaccctatattgacaaagcagaaagaacggcaaaaaggaaaggacaatggcatcctactttgaatgcaacttgatgagagccaatgactaaaggaggtttggaattggaacagacgaataacgcgtgggtcccaaaactataaggtaacccctcgatggctcgatgggatcactgaaaggtgaaccggtgcctgaggtttgtctatgaaggaggagaagtttcaggcttaactatactagagttttctgatggttgtgactggtatattgctgatgctagtgagatcggcatgatgcagagtgcctttgattggagaaactgcatggcagccccaatattttcttccatgagcttagctacctgtttttctgtgccgtcatttgaccacttctcccaggctggttggttccttccaccctcgccacctt

SEQ ID NO: 8689 - DNA, 518 bp, Lotus corniculatus
  Predicted polypeptide sequence is orthologous to G591, G793
gggtcgggcccccctcgagcaatctcggctccgcctcggctcggcgactctggcttagtcggacccgacatcggacttgccggtacggctccgatgatgcttcagctcacctccgccgatcatggcaaccatcatcacctcgccggcggtggtccctttcatgcgcctgtgtaccagttagggttgagcttggaccaagggaaagtagtaggaggaggagggttcttgaagcccgaggacgcttctggtagtggaaagcgtgtccgtgacgacgtcgttgatggtagacctatgaatgtttatcatgggcagcccatgtctactacgatgcctgctgctccccatcctccagccatgcgtcctagggtgcgggctagaagaggacaggctacagatccacacagcatagctgaaaggttgcgcagagaaagaatagcagaaagaattagggcatagcaagagctggttccaagtgtcaacaagactgatagagccggcatgttagatgagatagtgga

SEQ ID NO: 8690 - DNA, 550 bp, Lotus corniculatus
  Predicted polypeptide sequence is orthologous to G635
accaaaaaaaggtcttagccttaggatttagttaaaaacttaaaataaagtgacacgttttggtgtaactaaaaatttgacatcactacaattaattatgacaaatattagacaaataaataaagaaaagggagacttttcttttatgttctctatccctacagccctaaaaaaaactatggacctaaatatcattaggccatgttccaagaatcatgcaactgatggattatcttcttggtcaccatgctcaaacatgccatcaattttattgtagaaatttgtcctacatatttcttatcctgtccaccgtattgtaatcacttggttgccggtgtttcctcattggacattgccctttccatgtcctcacgatactgccaacttttattgccatctgtattcttgatctcctcatatttcagtaccaaagatgtccacagagatttgcactgtccaggacttctgctgatcccatcagccaacaaattttgcgatatctcttcccagagagccatccttcccttcacaacttgaaatctgtcgcgta

SEQ ID NO: 8691 - DNA, 419 bp, Lotus corniculatus
  Predicted polypeptide sequence is orthologous to G653
aggataaatgatttccttactctctaagaatacaacagcatccagtagagaatacaacaaaaggctgtcatcaacttggaaagttagatcttgcaaatcacgctctcattggtcattactgaatgtgcattggataaataaatcacacaagaaatccacgccagacatagaaggaaatatcagaaaaggatcaagtcactatagaacaattgaaaaaaaaaggccacacatacaaacacttgattgatagaccaaatatcttctttaaaaaaattgaaagcaatacaagacaccaacaatcaagattctggaactgaggctgctgcccttttgattgatgcagacttaataagatgattatagctccctttctccttaaaaagctgagagaaatgatgcttgcaatacaaaatgccctc

SEQ ID NO: 8692 - DNA, 487 bp, Lotus corniculatus
  Predicted polypeptide sequence is orthologous to G653
gaattcggcacgaggttgaacttgctctgttctgtgggtatatcttttatctttacccttcaaaatcttcttcttctttagctataaagcttcaatctttagatcacacccaccttcccgatccaccatttcccaattcattctctcttcgcaagatctagaagccacagcgatgtcttttcttggtacccagcaaaagtgcaaggcttgtgagaaaacagtgtatcctgttgatcagctttctgctgatggtacttcttaccataaagcttgcttcaggtgctctcactgcaaagaacattgaagctgagcaactattcctcaatggaaggtgttctttactgcaagcctcattatgagcagcttttcaaggagactggcacattccagaagaacttccagtcgcctgcaaagctagctgacaagaatactcctgaactgacaaggtccccaattatagtgcgggcatgtttctgggaaacaaaaa

SEQ ID NO: 8693 - DNA, 425 bp, Lotus corniculatus
  Predicted polypeptide sequence is orthologous to G732
ctgatttctgattccccttcttcttcttcgttcccaaaaccttgttcctccgatttagggtttctcagtttctctgatttgaattgattcatatagcaaaaaatccccaatgtttacagagtttctatgacgctcgtcaaccccatgcgtcgaattcgtctccaacactccttctccgttgcattcctctactggttctacgtcttctcatgaactccctctccaccatcgcttaatctctctaatttcccctttctttcaattttgctaccaattagatctaccaaaccctaatttcacaaaaaacaaaaaaaattcaccggaaggaatggcttcggttcaacgcggttccagttcgggatcggaaggcggagatctggctattgacgacaggaagaggaagaggatggtgtcgaaccgcgaat

SEQ ID NO: 8694 - DNA, 430 bp, Lotus corniculatus
  Predicted polypeptide sequence is orthologous to G748
ctctagtaaaatacacttccaaaaatattaacaaatgtacatgaattcaaactcatcaaactaagtacattaaaagaacctattctaatgaagggaaagaccaaaatggtccccaactcacaagaactctcctattcaggagttctcatgaaagttaagggatcttgacaatgctgcagggttagcccgcaacactgaagagtctacatggttcttttcatcaccctttgttgatttgaaggccttaaacatgcttccaccactgagtgactcattcttgattcctagagttgcccatatagaactcttggcagcttcattcgggtcatcaattcttaatgttttcggagtcaaaacagacccgtttctctgctttgatggttcttcattttgcaaagagtccttttcactcacatcatcaacatcccta

SEQ ID NO: 8695 - DNA, 393 bp, Lotus corniculatus
  Predicted polypeptide sequence is orthologous to G869
agctctgatgctgaggcttatgacatggttgctgaattggctggtctagaaataccagacttgagtcttctgacattgcctccatcaccaccaccaactgttgctgatgttgttgttccaactggctctgagccaaaccctgtgcttgattttgatttcatatttgattgtccaggacagggctttgatgatgataccaaccttggtggtggccttgaggatatcccattttttgggtttgacgataatgtgcctagccagcttcctgatttcgattttggtgattttggttctgatgagtttgctggttgttttgaagaacccttccatataccctgcgcctaaagttttgcagctattacataggaataaaaatcaagagtaatacatagt

SEQ ID NO: 8696 - DNA, 499 bp, Lotus corniculatus
  misc_feature (320)..(320): n is a, c, g, or t
  misc_feature (396)..(396): n is a, c, g, or t
  misc_feature (405)..(405): n is a, c, g, or t
  misc_feature (422)..(422): n is a, c, g, or t
  misc_feature (465)..(465): n is a, c, g, or t
  Predicted polypeptide sequence is orthologous to G881
gaaaccgacagacttttctgtttcttccactctagttaatacagaattaacatttcaaagtcgtccatgaatttcacattttcatcacaataacacaaacctccggtcaacccaagactcatctcaaaggaggaaagtacatactacccatttaacacaatctgtgagagatgaggcaaaggacctaattaagtcagtcagcagctatttctaatacaatatacaaagtcacattttcaaaagataccaactgggctttatgtggcggcaagcaggacatcaaatagaaatataaattatttccccatccttgttctttngttgcccaatttccatctctgcacttgtaccagagagaattcaacaaccagaagagggttttaacagcctccaatngttagagtngtatgcaattgtccttngatcgccatgaaaataataattttcacccggagtttaaacttngaattcatcaaaccggtgactgctccaactttat

SEQ ID NO: 8697 - DNA, 559 bp, Lotus corniculatus
  Predicted polypeptide sequence is orthologous to G921
gttagactctagaacaaacaatttagtgcatctttagaaatcttctataattgattctaaagtcaaattcaattctcaattgaaacttttgtaagtagcttctgtgtgtcggaattgattctgagaaaagagaatgttatacaagactccaaatgtgaaagtacacttttcattgatgttgcaccctgagccttagacaccttttgcttggatgattctcttgttcattagtccattatagaatagccctttcggctataactctgtgaatgattctaaaatgtgcttttgcttctaatttcagtcaaccaatgagttggaggaggagctgaagcgggtgacagcagaaaacaaaaaattggttgaaatgctctcagtggtgtgtgagaactacaacactttgagaagccaattgatggaatacatgagcagaaatcctgagaaggagctcagcccatcatcaaagaaaaggaagtctgagagcagcaataacaacagtgatctggtgggggttaacaatggaaactctgagagcagctctactgatgaagattctttc

SEQ ID NO: 8698 - DNA, 558 bp, Lotus corniculatus
  Predicted polypeptide sequence is orthologous to G921
tgcaaagaagtgtagatgatcaatctgtcctggttgctacttatgaaggggagcacaatcatcctcaaccttctcaaatggaggcaacatcaggctccggccgcaatgtgagcctagtaggctccatgccttcttcaaagtctctcagctctcctgctccagcagttgtaactctcgacttgacaaaatctcggtgcagcaatgattccaagaatgcagaacccagaaaagattcagctaagttaccacaggttttggtggaacagatggctacttctttgaccacagatcctaattttagagcagcacttgttgcagccatctcaggaaggcttttgcaccagaattgaatggaaatttggttgagcttagctaacttagtgtcaaactgttgagtattccatagagtggatcatttttttttagagcataggatctctatgtaaatacaacatggaagattgggacataattctcactttgatcctggaagtggaaatatagagtggatcaatgcggatagcatgatcagttcagcctggtcggctcttcattttg

SEQ ID NO: 8699 - DNA, 514 bp, Lotus corniculatus
  Predicted polypeptide sequence is orthologous to G937
agtgatttagtatgtgtaagataaggtatgtaaagaaataatccagcaattaggtctaatcatgaaaccaacaaaacatgcagagactctcaacacgggactgcttctcatggggcacagtgacaacaagaaatgaaagaataattgatatgtagaaattgaccttcctcatttttaactcggagtctcaaatcaaaactcatgtagaatagaaggcaaactaagccttcaaaatttccaatagcctctctcctttgaccctcttctatgtattattattcttctgtagccgtaaaactcctcccatgtatacttgtatctgcaaaatgcatggtgtaggagtagtatcctatacataaactggtcctggtttgtgaatgtgacttctccagctataactctcggatttagtatcatcatcatcctccatgctgtcaccctcggtcggggatgtccctcccctggaacctgcagctaaatgaaggggactttgcggcgaaccggacacagaact

SEQ ID NO: 8700 - DNA, 570 bp, Lotus corniculatus
  Predicted polypeptide sequence is orthologous to G938
ccaagcatgcacttagattaactcaaattcagaacagaattcaaatcttatttatatcacagtcttacatggaaaaatcttaggaaaaacaaggctgcactaatagaaacacaaacacagggctaacattatgggaacatacaagcctttattataaacccataccagacctgccaaaagcataataaaatatctagttgtatacctagagggttggttacatgtgaagaaaattgcagtaaaaaattctggtcaagggaactaacttcacatgataagggtggccttggcctaccctttgaaggaaaataaaagagaccatgatgataaatgagttttcccaattctcagtggtcattttcagtcactggtaccaaattgaaatatctggctgtttttgatgtgcctccatgcctactccttgttgcatgtcctccttgaaatcaaaggatgccaaatcacaaggggacccaaacatcaaatggaaattattgttgctgctttgatggggggccttcaaaggagaattcaaagctctgaaccggtcaaactgattttcctctcttgcaa

SEQ ID NO: 8701 - DNA, 428 bp, Lotus corniculatus
  Predicted polypeptide sequence is orthologous to G938
ctgaagtacatgctgaaaatgatggaggtttgtaaggcccaagggtttgtatatgggataattcccgagaagggaaagcccgtgaccggggcatctgataatcttcgtgaatggtggaaggataaagttaggtttgatcgcaacggtccagctgccatagccaagtatgaagcagataacgcaatcccagggaagaatgacggatgcaattctatcggtccgactccacacaccttgcaagagctacaggacacaaccttgggttctctcttgtcagcactcatgcaacactgtgatccccctcagaggcggtttccattggagaagggtgttcctccgccatggtggcccacagggaacgaagaatggtggccgcagattggaatacctaaagatcaaggtcctccaccttacaagaaacctcatga

SEQ ID NO: 8702 - DNA, 405 bp, Lotus corniculatus
  Predicted polypeptide sequence is orthologous to G938
caggttacaggacaccaccttgggttccctcttgtcagcactgatgcagcactgtgatccccctcagaggcggttccccttggagaagggtgttcctccaccatggtggcccacagggaatgaagaatggtggccccaaattggtttgcctaaagatcaaggccctccaccttacaagaaacctcacgacctgaagaaggcgtggaaggttggtgttctaactgcagttatcaagcacatgtctcctgatatcgccaagattcgcaagcttgtgaggcagtccaaatgccttcaagataaaatgacagccaaggaaagtgcaacctggctctccatcatcaatcaagaggagtctttggctcgagagctttatcctaattattgccctccattatcctctgctgg

SEQ ID NO: 8703 - DNA, 458 bp, Lotus corniculatus
  Predicted polypeptide sequence is orthologous to G938
gtaagactgccacttcagcagccttcttttgcaatcaagggagaggctgtaacaaacttggatttcatgcggaaacggaagatctctagcgacttcgacatgatgatggatcagaaaatttacacctgtgaacatctacaatgtccttacggtgaagttcgccttggttttcaagacaggacttcgagggacaatcatcaattgaattgtccatacagaggagcttcttcaaattatggcggtccaaatttccatgttaatgaggcaaagccagtcatatttccccagtcctttgttcaacccaaatcgactgctcagtctgttaatttggttccaccttcaattgatctaaccgggctcggagttcctgaagatggccagaaaatgattggtgacctcatgtcagtctatgatacaaatgttcaaggcagcaaaaatctaagttccagtaaccgtgt

SEQ ID NO: 8704 - DNA, 404 bp, Lotus corniculatus
  Predicted polypeptide sequence is orthologous to G962
aacagctcaagctttgtttcattctattccaacatcagataaacattgaaccaaaaatgaccaacaccatatgcggtcgcctacacatacagcaaatgtaaagaacaaaaataacaatggtgattacaaaacactataaacacttcctaattcaccataataatctaattaattaagaaaaaaactatcttatatgcctcatcatcacaattatcacacactcaaacggaacattagaggccgtcattataggcttgtgcttcttctgaagctgaagccgtcgtcattgtaggcttgtgctccttctgtgtgaacttgagtctcaagtttcaagccgattgggcagtcccagacccaaatctgaaattagagcaactactctgcctcatcaaaagagaagaact

SEQ ID NO: 8705 - DNA, 487 bp, Lotus corniculatus
  Predicted polypeptide sequence is orthologous to G975
aaatagaagatcgatcttgccttctatgaatgtagcatggtaggatatcagatcaagctgcattacattaggaaaaagacaatagcatcattacatactaaagggtcatattgcataatgaggatatctatcaaacctaccactaccattacttctgcaagacacttgttccttcaattggataagcagcaaagtcaatcacttcgactcctccgcagccgaatcatcagaatcagaatcctctatatcatcttcagattcttcaaactcagatctgccagactcataggcatctgcagagggtttaaaacatgcataaggatcttctccttcatggctaacttcaatattagcaactcttcctaggaaagcaccaaagtccccatccccaagcttatgcaaataaatatcatatttcatcaacttccgacgaagttcttcgaacgacacaggccttttatatgatctcaacaatttcctaatcttc

SEQ ID NO: 8706 - DNA, 655 bp, Sorghum bicolor
  Predicted polypeptide sequence is orthologous to G1033
tactggactcgcttcaagcaacgccgcagttcgtgcacacatccaaaccggcaaaccctcgtcgtgatccggccccaaggtctcgagataaaggcgagggcgaagtccagcggcggcgactccaggctttcggtgaagaagggcaaggctcagaaggacccaaacaagcccaagaggcctccgagcgcgttcttcgtcttcatggaggagttcaggaaggactacaaggagaagcaccccaatgtgaagcaagtctctgtgattggcaaggcttgtggtgattctgacaagtccaagtctgaggtgaatgacgaggacgaggagggtgacgagtgatggatgacggatggagggagctctcgcctgcccaagtgcttgcagtcagtagggaaattctcatcgtcgtgggcctaaccgggcttttgctgctccttttagcctctggaagctgtctgtctgtctttctagatgcagtagactagtagtagtcgccgctcgctctctgagttggtagtcgcaagtgttgtccgtccctgaagtgatgcagtttagctggtagtgtgttcgctttttcggcacttgaccgcttgttggaatggcatgggatgtttagcctgcagtctgtacttacccacgagcatctatgatgcctctg

SEQ ID NO: 8707 - DNA, 684 bp, Sorghum bicolor
  Predicted polypeptide sequence is orthologous to G1033
gaattcaggcaggagtaccaggcacagcaccctggcaacaagagcgttgcggccgtgagcaaggcagcaggggaaaagtggcgtgctatgtcagagcaagagaagcaaccatatgtggaccaagctgggcagaagaagcaggactatgagaagactaaggcgaactttgagaagaagagcacaagctcaaagaaggctaagactgatgatgacgatggctcaaagtctgaggttgacgatgaggatgacgaggacgatgagtaaatactgtctccgcagtcatgagatagcaaatcgagtgttaggtccccaactagcttaccggcttgttatctttaatgttaagttgtttggaacaggtgtttatgaaggggatctattagtttcgtgaggttgttagtttagtgcattagcaaagaaaaagctgaatgctgctagctgttctgttgcttttcttttgttgctgctagctgttctgttgcttttcttttgctaaccacttgtcacaactttctgtacctgtttcattgactaatctagtgactagtcagttattggtttaatgtttggttttgattttatatattccttttttgcatgcattctgtccgccctacggaagttgaggtgatctgttctgtatgaatggtgaatataattgcttgcctgcttgtggctcgtttc

SEQ ID NO: 8708 - DNA, 628 bp, Sorghum bicolor
  Predicted polypeptide sequence is orthologous to G1033
tcatggaggagttcaggaaggactacaaggagaagcaccccaatgtgaagcaagtctctgtgattggcaaggcttgtggtgacaagtggaagtccctgtctgatgctgagaaggctccctacgtctctaaggccgagaagctcaaggttgagtacaccaagaagatggacgcctacaacaacaagcagtctggaggccccacagcgtctggtgattctgacaagtccaagtctgaggtgaatgacgaggacgaggagggtgacgagtgatggatgacggatggagggagctctcgcctgcccaagtgcttgcagtcagtagggaaattctcatcgtcgtgggcctaaccgggcttttgctgctccttttagcctctggaagctgtctgtctgtctttctagatgcagtagactagtagtagtggccgctcgttctctgagttggtagtcgcaagtgttgtccgtccctgaagtgatgcagtttagctggtagtgtgttcgcttcttcggcacttgaccgcttgttggaatggcatgggatgtttagcctgcagtctgtacttacccacgagcatctatgatgcctctgttttaacaatctcagaactcaatagatgcctgttttaagt

SEQ ID NO: 8709 - DNA, 878 bp, Sorghum bicolor
  Predicted polypeptide sequence is orthologous to G1048
ctcgccgtccgtcccgatggacatcgacctcttcgccgacatcgacctcgacgccctcctcgcctccttctccggcgaacccgccgccgtctccgacctcatcgtcccgtccccgcctccgccggccccggcggcgcacgatgcggcggaagcggggtcgccggagtcggtgacctcccgggcgaacccggccggggaggtgggtctctcggagatcgagaggttcctgatgcaggaaggggaggcggaggcggagttgggcggggaggtcgaggggatcagcgtggaccagttcttcgacgcgctgtacgacggcggggaggggaaagatgaaggggaggcagaggcgggggcaagcacggatgcggactccggcagggacgaggtggtggaagtcgtgacgccggaggcggagacggtggaggtggatggcgatgatcccgtcagcaagaagaagaagaggcaaatgaggaacagagattcggcaatgaaatccagggagaggaagaagtcgtacataaaggacttggagacgaagagcaagtatttggaggcagagtgccgccgcctcagctacgcacttcagtgctacgcagctgagaacatggtactgcgccagagcttgatgaaggataggcctgttggtgctcccacagccatgcaggagtctgccgtactcacggaaaccctgccgctggtttccctgctgtggctggtgagcatcgtctgcctcttcctgatgcccgttctgcccaaccgaagcccagctgctccaagcagcggcggaagagatctcgtgatggcagccggaaagacaagcagtgaaactccagagatactggaactcatcctccatggaaggcgttgcaagagcacga

SEQ ID NO: 8710 - DNA, 768 bp, Sorghum bicolor
  Predicted polypeptide sequence is orthologous to G1048
gcatcctcgttggggacagcgagggcgagggtagccccaagctcactggtgagaagagcgcggatagggcgtgcgcgggagaggatgaggtggtggtgggtgtggattgcggcgatgattccaacagccagaagaagtggagacaaatgaggaatagggattctgccatgaaatctagggagaagaagaaattgtatgtaaaagatctggagatcaagagcaagtatctggaggcagagtgctgccgcctaagctatgccctccagtgttgcactgccgagaacatggtgcttcgccagagtttgctgaaggataggcatgccggtgctcccacagccatgcaggagtctgccgaactctcggaaaccctgccgctggtttccctgctttggctagtgagcatcttgtgcctattcctggtggacgacatgcccaacagaagcctggtggctccaagaagcctcgaaagagatcttgtaaagctagccaggacatcaataaacggtgtaaagatgaccagaatgacaaacaacagtgacaatcctggggctttgggactcatcccccttggaagacgctgcagaggcacaagggcgaggatcaagtcaccttgggttccttggcatgcagtagctgcttgctaagccgccagtcatcatgcgaaaccttttgaggtgttgttaaacataacatattggcacatgggacgactgtatgcatcgttgctgtgaaagtgtgaatctttgttccgctcttttcctgataccc

SEQ ID NO: 8711 - DNA, 830 bp, Sorghum bicolor
  Predicted polypeptide sequence is orthologous to G1076
tcccctccagaaaacaagcaccacacaaaccctaaagaaattcatcctctcctcgctctcgccgtctactattttcatcatcaccaccaccaccgtaccacttcttctactcgcgccgccgaattattaatattatcgctctcctcctaccctagaaagatggcaggcctggatttgggcacaagctcctaccttcaccagcagcaccagcaccaccaccaggtgcccctccacctccaccacgacgacggcgtcggcgcggggggcggcggctctgacgatggccaggactcgctgtcgccgggatcaggcggcggcggtgggggtacgcccagctccgccggaggcgccggaatcggcggcggggagatcgtcgctcgccgcccgcgcggccgcccgccgggctccaagaacaagcccaagccgcccgtgatcatcacccgggagagcgccaacgcgctgcgggcgcacatccttgaggtcgccgccggctgcgacgtcttcgaggcgctcaccgcgtacgcgcgccgcaggcagcgcggcgtctgcgtgctctcggcggctggcaccgtcgcaaacgtcacgctgcgccagccgcagtcgtcccagacgggaccgacctcgccggccgtcgcgacgctccacggcaggttcgagatactctccctcgctggctccttcctcccgcctccggccccgccgggggccaccagcctcgcggccttcctggctgggggccaggggcaggtcgtcggtggtagcgtggctggcgcgctcatcgccgcggggccggtcgtcgtcgtggccgcgtcgttcagcaacgtcgccta

SEQ ID NO: 8712 - DNA, 627 bp, Sorghum bicolor
  Predicted polypeptide sequence is orthologous to G1078
cgaccggtgggggaaggtgctcgaccgcgtgcactgcgtggacgtgctcaaggcgatcaagagcttcgcgggggcggcccgcgcgatccacgcgctccagggcgacgagctgcgggtggcgcggcgcgtgaggcagtactcccgggagctggaccgcaagtccaggatgctgcggcaggtggagaagagctactacgactcgtacctgcccggggtcatgtcgatgtggcactgggggaggccggcgtggagggaccacatgcaggcgcgcgacgcgggcgacgaggtggcgcagcgcagggacgagatcgcggcttgccggaagatggtggaggacgagatgcggaggcatgccaaggccatcgacgccacgaggacggccacggtcaccggcgtgcaggggaagctgcctgccgtgttccaggccatggccgcgttctcggcgtcgcttgcgaattcgctggaggccgcgtgcagagctccacagcagaacaccaacatgcagtagtagctactgtccggtcattcttttttgcgtttgcatttttggttttcatcgtgttttcagcatctatcatacaaaaatatacagaatacaaagagagaccatagaaatacgaataagac

SEQ ID NO: 8713 - DNA, 557 bp, Sorghum bicolor
  Predicted polypeptide sequence is orthologous to G1084
ttttttttttttttttttttaacagaggacatgtgaacggaccaatttgaaggattctcgtacaagaccccatttgtaagccagatcgactacagccaattaaggcatggcaactagcaaaatgctccatataacatgaaagtatgacatctatgccgtccccggattgcggacttctggtctaggtcatctccccattcattggcttcagcagcagtactcttgctggcaacaagaaacctttctacagttttagtgttgtttctcctcacgctcaaagctcagagattatgatacaagcatgactggtccttgagcactatacaaggctttggagaaatgggatgtgctgcttccaggttagaagatgaggaggctgtcaagatgtgctctgaatgtcaaagtgaagaaattcaaccaagcgcgggtaaacggcgggagtaactatgactctcttaaaagcctccctccgtcttccacttccactcctcgttcttgttcacacagcagcagcctcctggaaaagagagggaaaggccatctccctcactctcact

SEQ ID NO: 8714 - DNA, 759 bp, Sorghum bicolor
  Predicted polypeptide sequence is orthologous to G1089
attttccccctctgcagctgcacgggcacccacacaattcatccaacgcccaccgggcctcaacaatctccccaccagccgccgccgccgccgccgcatcaagcgatagaactaggaacccctccccaagaatctcaagaagacaaggacgccgtccagtcgccgccagccgcctcgatgggatgcgggcagtcaaagatcgatcaggaggaggcggtgagtcggtgccgggagcggaagcggctgatggccgacgccgtggtgtcgcggaacggttttgctgccgcccacactggctacaccgtccgcctcaagagcaccggcggcgcgctatccgatttcgcccaaggcgaggcgcccgaccctagcctggtgtcctcccatacccaccacgctcccgctgtggcggcggcatctatctcgactccgccaggcccttccgcagcttccgtcaccagcccctccccgccgccgccgccgccattcgccgacttctctcattctagcctccaaaggtcctcctccactcccaatattcctatgccggagccgagggccgccgccaaaaaccgccctcctgccgatgctcctatccgagaggaggatgaggacgaggaggaagacgatgggcatatcaagaccgacagcgacgacgatgacagtgatgaagacgacgatcaccatgagcatgacgatgttaatgtggacggcatggtgcatggacagcaaccaaagcggattttgatgagtattgtggga

SEQ ID NO: 8715 - DNA, 617 bp, Sorghum bicolor
  Predicted polypeptide sequence is orthologous to G1113
aggtgcggcggctgggcaactgcacccacgcgttccacacgcgctgcatcgaccgctggatcgacctgggcgaggtgacgtgcccgctgtgccgctcccacctgctgccgcgtcgacgcgccggcatacttggcatgggcatggcacgcctcggctagtcgtccgtccgtgttcgtccctgattcattctcttgccacgtaagatacgtgcccgcgtggttggcttcaggccgcgcggccggtacgcgtacagatgccactggtgccggataggggcggaccaaccgcgaactgattgcgcgcgattaggacgacgatcgactaaccaccaccctgatgttgttgtgtcgatggatgggcgcaagacaaattaactggaggttggcataaagcatacttgacgcgatatattattgtgtgccggcgttggacgggcaacgctcttgtattattatatatcagaagaaaatcaagttacaaactgttttggcttcggggcgcaaccgtgcaaatgatgtccacgccggccagtaatttggtgcctgctctggtgtgtggagcgttcagcttcagagtattgtttaaatcattatttggaaaatcattcaaataaaaat

SEQ ID NO: 8716 - DNA, 824 bp, Sorghum bicolor
  Predicted polypeptide sequence is orthologous to G1140
tcgccagcaccagcatgaagcaggtaatcgatcggtacgactcccattccaagaatctccaaaagtctgaagcgccgtctcagctgcagtcacatattgatgatggcacttgtgcaaggctaaagcaggagcttgctgaaaccagccttaagctcaggcagatgagaggagaggagctccagaggctgagcgtccaacagctgcaagagcttgagaagaccctcgaatctggcctcggctctgtactcaaaaccaagagccaaaaaatccttgacgagatcagcggtctggaaagaaagagaatggaactgatcgaggagaattcaaggctgaaggagcaagtgacccggatggcaaggatggagacgcagcttggcgtcgattcagaaattgtgtatgaggaagggcagtcatctgaatctgtgacaaacacatcctatccgcgcccatcaacagacactgacgactgctccgatacatcgctcaggctagggctaccattcttcagctcgaagtgatggaaaatcaggaaacttgacatgttcagtagcggagcggtgctgattacttgccctctccgttctggattggggagcaggattgctggattagtgaccaacgcgtcgcatcaaaataaggcattctgagtgctgtatgatgtgtgtattctgaaagtgagactgcttttgttatatacaggcagcatggtaataatacaacgggtacccgctaggatgctacctgcagtccgtgttctgtcctctgttttttagtactcgtataatccccctgcaaaccatgtttacctgcagctcatgctttgt

SEQ ID NO: 8717 - DNA, 793 bp, Sorghum bicolor
  misc_feature (733)..(733): n is a, c, g, or t
  Predicted polypeptide sequence is orthologous to G1140
ctactggcccttttcttgccttcgcctttcctctcgctcccctcctctcctttcgcatccccatcgcatcacaccacgactccacaccgccggttggcttcgctgctccgacctcgatcttccacctcccgcctccgcctcgtgaagcgcgtggggactgggcctctggggttcgcctctcggcgcggcggccgagtgcctgcgtcctctacggagagggatcggcggcggggatggcgagggagcggcgggagataaagaggatagagagcgcggcggcgcggcaggtcacgttctccaagcgccgccgcggcctcttcaagaaggccgaggagctctccgtgctgtgcgatgccgacgtcgcgctcatcgtcttctcctccacggggaagctctcccagttcgccagctccagtatgaatgagatcattgacaagtacaacacacattctaaaaacctggggaaagcagaagagccttctcttgacttgaacttagaacatagcaaatacgcaaatttgaacgagcaacttgtggaagcaagccttagactcaggcagatgagaggtgaagaacttgagggattgagtgttgaagaactccagcaattggagaagaacctggaaactggtctgcacagggtgcttcaaacaaaggatcaacaattcttggaacagatcagcgaccttgaacggaagagtacacagctggcagaggagaacatgcaactgangaatcaagtatcccagatacctccagctggcaaacaagcagttgctgatactgaaaatgt

SEQ ID NO: 8718 - DNA, 678 bp, Sorghum bicolor
  Predicted polypeptide sequence is orthologous to G1146
aaccacaatgatcagaattcaattgacaggagtggaaacatactcccaggtactgttgtagattcgaagatctgtcatcctactgaatttgacttctacttgtgtagccatgctggcattaagggcactagccgtccagctcattatcatgtcttgtgggatgaaaacaacttctctgctgacgagttgcagactcttacaaacaacctctgttacacttatgcaaggtgcacccgctctgtatcgatcgttccaccagcgtattatgctcacctggctgccttcagggctcgtttttacatggaaccagagacttctgacagtggatcggtggcaagtggtcctgcaggccgtggacctcagtcagcatcccatagcactcgggcccctggtggtgcagctgttaggccacttccagctctgaaggataacgtaaagagggtcatgttctactgctgaggctaggctggggcgcttatggtaccctcacttgtaaatatgtttggagatcgtaataatctggcagctgctactttgggtgctgtactgttaccatttactgtactggtctacgtttcttcctcgagcaccgcatgtatgcactcatgctattgtgtccacggatcatgtatgcacgctgtaacatagtaataccctcggttgtgtgtgtatgtacgt

SEQ ID NO: 8719 - DNA, 599 bp, Sorghum bicolor
  Predicted polypeptide sequence is orthologous to G1146
ctgcctggtactgtggtggactcaaagatctgccatccaactgaatttgatttctacctctgtagccatgctggcattcagggaacaagccgccctgcccattatcatgtcctgtgggatgagaacaaatttaccgcggatgggttgcaaactctcaccaacaacctgtgttacacgtatgctaggtgcactcgctcagtatcaatcgttcctcctgcatattatgctcacctggcagccttccgagctcgcttctacatggagccggataccactgacagtgggtctatggcgagtggtgctacgacaagccgtgccccaggaggggcacgcaacaccagggctggtgttggaaatgttgccgtgaggccattaccggccctcaaggaaaacgtgaagcgtgtcatgttctattgctaagattgacgctgtgagcaagcaattatcgggctttacctaagacttttgagtatttttccaagtacctgcactgttttggtgatggtggcacactgttatgcaccactgaagttaataatcagaagctgtgaattggagctaccttttatatatctggtattgtaaactggtttgcggta

SEQ ID NO: 8720 - DNA, 619 bp, Sorghum bicolor
  Predicted polypeptide sequence is orthologous to G1146
ccaagatttgccatcctacggaatttgatttctacctgtgtagccatgccggcattcagggaacaagccgccctgctcattaccatgtcctgtgggatgagaacaagtttacagctgatgagctgcagactctgacaaacaacctgtgctacacgtacgctaggtgcactcgctccgtgtcaattgtgcccccggcatactatgctcatctggcagccttccgagctcgcttctacatggagccagatacctctgacagtgggtcaatggccagtggggcccgtgggcctccaccaggtggggcacgcggcatcagaggggccgggagtgttgcggtcaggcccctacccgctctcaaggaaaacgtgaagcgtgtcatgttttactgctgagctgcattcaccaaggaatcctggagtattccatgtatccgcactgtttcggtgatactatcggacactgaatttatgcattaagacttccagttcattcaagtgatctggggattttatgtacgcttgttttgtattcgtgatgttgtgacgctgcagttcgaggagctttagtactgtgatgtgtgaactatttgttgacaagttgtaaccagccatacttagtg

SEQ ID NO: 8721 - DNA, 767 bp, Sorghum bicolor
  Predicted polypeptide sequence is orthologous to G1146
aatggactcaacctgcctgcgcccatctgaccgtgagaacaacattcgtcaggttgttgagcaaaatgactacaatagaactgaacgtgcaagtgaattcggtctggaggttgactatcatcctacttcagttaatgctagagttctgccagcccccactctgaagtaccgtggcactggatctgaaagtttgtgttgtccaaaggatgggcagtggaacatgattaaaaagcaagtagtacatggtgcaagggtgggcaactgggcctgcgttaacttttgtcataatttacctagagatgttgttggtaaattctgttctgatctggttaagtggtctcgtactactggagtggacatggataacttgagaattccaatatacgctgttcgtcctgaacaagttgaaactgatcttcataagctatgtcacgatgctgggaacaggctaagagtgcaaaagatagatcttttgcttgctatactgccagagaaaaacggcaacttatatggtaatttcaaaaggatctgcgagacagagattggtatcatgtcgcagtgttgcctggataaaaatgttagaagtgcaggtcctccatactttgctaatgttgctattaagatcaatgccaagtttggaggaaggaacttagaatttgctaatcccaaagaaagcttaccggttgtttcgattgaaccaacaattatatttggtgccgatgtcactcaccctgctgctctggatgatactgccccttccattgctt

SEQ ID NO: 8722 - DNA, 665 bp, Sorghum bicolor
  Predicted polypeptide sequence is orthologous to G1146
agagtttgacttcttcctgtgcagccatgctggcatcaagggcacgagccgtcctgctcactaccatgtcttgtgggatgaaaacaacttcacagctgatgcattgcagacccttaccaataacctttgctacacttacgcgaggtgcacacgttctgtatccattgtcccaccagcatactacgctcatctagcagcattccgcgcccggttctacatggagccggacagctcagacagtggatcactggcgagtggctctcgcggaggagcgccgtccagctcttctacatcccgcagtacccgtgccgccaccagtggagccgttaggccccttcctgtgctcaaggacagtgtcaagaacgtcatgttctactgctgatgaaccggagcctgtgtctacaagcagcatgactcttaacaacatgagcaggcagcctgcctgaaatttgatttgcttggtgttgtagtttgtttggtcagtaataatctgcttgctatgagcaaaccgtgttcaaagacgttgtgtttcagtgcatttgcttagtgtttgtttgaagaagtccggccagagcggatccgctctaggccctgcttgtactggagggatcccatatgttattttgagactattagtttcggatcatatcttttcctctaggttc

SEQ ID NO: 8723 - DNA, 652 bp, Sorghum bicolor
  Predicted polypeptide sequence is orthologous to G1198, G1806, G558
acatgctgcagatggccaccgcggtggacaggctcaaagagctcgtcggcttcgtcacccaggcggaccatctccggctgacgacgctgcagcagatgcacaagatcctgacgacgcggcaggcggccaggggcctcctggcgctgggcgactacttccagcgcctccgcacgctgagctcgctgtgggcggcgcgcccgcgggaggcggcgattagctagatgcctgcggtggccgccagccaaaagctcactggtgaggtgaccgcaccaaagaacacgacgacgacgacgaagagtagtagcagttcgctgtatactttcccaagtggagaacgaagaaatcgacctcgctgggtttggatgaagaatgcaaggcttctcactcaatcagcggcggtggccgcgtttctcagcaacagcaagtcagcaagtggtgtgcgtttgtcaggcgattagagaataaacggaaatcgattgaggtctttttatttggcgggcggaaagacgtgtacatatcttgttttggtacccggccggggcctcctagaggcgtatgattgatgatgatgctggccttttataactactagagttgagggtatatatatacttatcatatatgtaattacctgtaactagtgttggtcaaa

SEQ ID NO: 8724 - DNA, 635 bp, Sorghum bicolor
  Predicted polypeptide sequence is orthologous to G1198, G1806, G558
ctactggtgacgtcctccgctatccttagttgaaggaagaacttcacccagacatgcggtgaggtgattagtaataagtattgatttaagggagatcattttgagcatgttatgatggagctctactctggatatcttgaagatcatttcaacctccacaagctaagcatcggcagcgccgcctcgccgccggagtacatgacgtcggcgtcgccggcgcagttcgcagcggtgcccctaagaatggggtacgggcggccggcgccgtcgactgcgccgccggcgccagtaatggcgggcatgtggagcagcgaggccttcaaggtcgtcgacagcggccacggcaccagcgcgtccaccgtcatggaggccgacaccaagttcgagacaaggctagaagatgttcaggtagcacttgagccaacaagaagtacggatcaggaaacaagcaagccgccagagagggtcatgagaaggctcgcgcagaacagagaggctgctcggaagagtcgcctgcggaaaaaggcctacatccaccagctagagacaagccggatgaagctggcccagttagagctggagcttcaacgggctcgacagcagggtgcatatgcaaatgggaacatgggagactc

SEQ ID NO: 8725 - DNA, 630 bp, Sorghum bicolor
  Predicted polypeptide sequence is orthologous to G1198, G1806, G558
tcatgggtcaaatggcccttgcccttggcaagctgtccaaccttgaaggttttgtgatacaggctgataacttgaggcagcagactcttcatcagatgcaccggattctgacagttcggcaggcagctcgatgtttcttggccattggcgagtaccacaaccgcctccgtgccttaagctccctctgggtttctcggcctcgagagatactgggtgcagatgaaggcaattgtggggagataagcattgcggcacaagcatctcaaagccaattttcatccttctgattcacgcatgatttggaactaaccttcgtcttaggagcaagagagaaacgactgggaagttgaaagagaagttttggatgccatcagatgtctgagaggcacagagagctggaaaatgaatgaagctttagaacagggagtgtttctgaaaatgtgcggaacctgtaggagcaatttccaggacgtgaaattgtttagttcactggactcgtgtccagtactgcacgttcttttggttctgtccagtctagattctcaaacagctctgcctttggttctgtccagtcagaattctcaaaacagctctgcctaggtaacgaaagaattcattctgcaactctac

SEQ ID NO: 8726 - DNA, 776 bp, Sorghum bicolor
  Predicted polypeptide sequence is orthologous to G1198, G1806, G558
atgccgagcctttgggccacctcagcacgccatccacacagatgtgaacagcatgcaaccttctcgagttaccgactttggggcacttgcgcagtcagctggattccgaatagaagatcttgctaacctcaatgcaaatgctttgttcaatctgaagccaaatacccatacaattaacaacagtcctcttcagtttggaagttacggaaaagccgtttacgaaagaaggcatacatccaaaaccttgagagtagcagactgaaacttactcagttagagcaagagcttcagcgggctcgtcaacagggtatttttatttcgacatcaggagatcaacctcaatcaacaagtggaaatggagctttggcatttgacatggagtatgcacgctggttggaggagcacaacaaacatgtaaatgagttgagggctgctgtcaatgcacatgccggtgataatgatcttcgtggtattgttgatagcattatggcacactacgacgaaattttcaggctcaagggtgtggcagctaaagcagatgtttttcatgtgctgtctgggatgtggaagacccctgctgagagatgtttcatgtggttaggtggcttccgatcatctgagcttcttaagttactggcaggtcacctagagcctcttactgatcagcagcttgttggtatacccaacctgcaacagtcctcccagcaagctgaagatgctctttctcaagggatggaagcgttacaacagtcgcttgcagaaactctagcatctgg

SEQ ID NO: 8727 - DNA, 825 bp, Sorghum bicolor
  Predicted polypeptide sequence is orthologous to G1198, G1806, G558
tacccgtcttcgctgatttctgccgctccaattccatctctttcctgcttagaacttcttcctctgcttctccccttcatagcttttggtgccttgtcatcggcgacctaaccgccggcggccggataaactaagctagccccttggctccaaaagtcgtctcccgtagagagcacttgctcacctgctcctcacgcccctctgctggaactggacttgcgcggtgtggagatccatccggacctggttcgatttcttcatttcgggaaggtgtcgccaccatgattctcagttaaccacagctaaatgccttttcttaatctttccgggtcgggaacatgcagttaaatctgaccagtagctgttgttggtaaaggttgcttctgtgtccagcgggtggatcactggactgtgggttgtgttaactgcaggctggcttatcagcctacccataaggaaagcgaaaaagagacagcaaagcaatttgttgtctcattcttaggagctggcgagtactcggcatggcagatgctagttcgaggactgacacctcgactgttgtagacatggatgataagaatcaaaggttagagaatggacagggtggagctatggtcctgccttctaattcatctgatcgatctgacagatctgacaaacctatggaccaaaaggttttgcgacggcttgctcaaaatcgtgaggcagcacgaaaaagtcggctgagaaaaaaggcatatgtgcaacagctagagagcagtaagctaaaacttgcaagcctggagcaagaactccagaaagctcgacaacagggaatcttcatat

SEQ ID NO: 8728 - DNA, 833 bp, Sorghum bicolor
  Predicted polypeptide sequence is orthologous to G1198, G1806, G558
ccacccgcaccgcaagccaggcacgcggcttctggaagcttccctctcatctggttggttggtcacccacgacccaaatcgcccgcccgcggctcctccgccgccagccaggcaggtgtcgtctctgccctcggtacgaccgccggattcgggcgctggggtgggttgtttttggtctcccccaccggccacacacccacaccagcctcggccccgccgtctctccaagaccttggtcgactcctccgcccgggcatgcccccccaccgccgatcgcacacggtcgtatgattgcaatgaatcctgagatcgtactaccgtcttggaaacaattttcggcatcggtcaatcctgtgaaacactagaccgctcatcaccttgcaactggaaaggagagagcaaagtgatttgctgtctcctggtgatcgatgctcttgaggcctagtgatggctgatgctagctcaaggactgacacatcaatcgttttagacgacatcgacaagaatcagaggatggagaatggaagtggtgcggttctaccttctaattcttcagataggtccgacaggtctgacaaacctctggaccaaaagacaatgcgacggcttgcccaaaatcgtgaggcagcaagaagaagtcggctgaggaaaaaggcatatgtgcagcagctggagagcagtaagctgaaacttgcacaactggagcaggaactccagaaagctcgccagcagggaatcttcatttccagctctggagaccaaacccatgccatgagtggaaatggagcattgacttttgacatagaatatgctagatggctagaggaccaaaa

SEQ ID NO: 8729 - DNA, 849 bp, Sorghum bicolor
  Predicted polypeptide sequence is orthologous to G1198, G1806, G558
aagacggttttgccattaatgactggttttggatccttttgctggagatgtgcatagtgtgaggagagagccagggtggaggatggtcagagccttcataaggccttcaggtggggctctgctggagacgacgaccgccgccgccaccatcacagggcatctgagctcccccaaggtctccggagcgcctctagctccccaccgacgacgatgatggcagcctcttccaccatgagcaaggaatcagcaagctacgacatggcggaattcgaccagtcagcaatctttctctaccttgaggatggccacgatcaagaacaacaacgacagactctgaacatctttccatcgcagccaatgcatgtggccgagccaattcctgctaagggtgttagcatgggcatggtgacagccagcatgcttcccaatggcaactcttcttcacccaagagacaagagcaaggtggccagcacaggagtgtcgctgctcctgcaggccccgttgtgccgttgcctagtaacaacttagccaaggataacaggaatagccttactaagaaggaagaaactagcggtggaaagggtgcagcatctgcaggtattgttcaggagagagtgaaagaccctaagacactgaggaggcttgcacagaatagagaggcagcaaggaagagcaggcttaggaagaaggcttatatccaacagttagagacaagtaggatcagactcagccagctggaacaacaagttcaagtggcaagagtacagggtgtcttcttgggcactggtgagcagccaggtttttcttctgccccttcaccagctgcagtatttgacgtggagtatgga

SEQ ID NO: 8730 - DNA, 834 bp, Sorghum bicolor
  Predicted polypeptide sequence is orthologous to G1198
caggcaagccaaagcagtgtgtgagaggagaggagagctgagaagagaaacaaacagacaaacaaacaaagaggaggcctcttcccccctctcctctgtgcttgttgcatgcttttgctacaaggatgagctagctagcagtggccatggtgcacggcgaggagagttcttggaggatggagagggcagcgctgcctctcaaccaggcgttcgcgtatggagcccaagcccacgccgccgccgcaccgccgacctgcttcctggacttccagcctgcggcggcagccgctgcctacttcgggttcggggagctggaggaggccctcatccatggcggcggcggcgctggcaacgcccacggcgtcgatcccggcgtgatcatcaagaacgacgtcgcgcaggcaaagtcggcggcagcggcaggatatctcgcgggcgctggcaggccccccacgctggagatcttcccttcgtggccaatgaggcatcaacagcagctacacagtgggaattcgcagtcagtagggagcaccactgactcgagctcagctcagaacacaatgtctcagatggagttggtgtccccagcctcctctgcgccgaggcaggaggtcatgatggtgaccactgatgattacagctacaagccaggcctcgccgctgcgcccgctgctgctgccgccccgccaccgagctttcagcagcaccacccgctcccgctgcagctgcacggaggagacggaggaggaggagggggagaccatgacaagaggaagcatggatccacaagaaaagatggcaagttggtagatgccaagacggaacggcggctgg

SEQ ID NO: 8731 - DNA, 758 bp, Sorghum bicolor
  Predicted polypeptide sequence is orthologous to G1226
gagggcaacccggccagctgagcgttagtcgcagctcttgcctgcctagcatgcagctctaaacccaagtcgtgctcgtgcagcagacgccaagttgtggcaggtagtagctaggaaggaggcaacgccaggccaggccatggcgctcgaagctgtggtgttccctaaggagcacctcgtgtgcacggtcaaggcgcgctcggcgtcgctgggatgcggcttccacatagaggagctcgaggacaagggcggcgaggttctgcaaggggaggctgccgatgcgctgctgccgccgggtgccgatgccggtgcgggcaccatgtgggagtgggacgcggtgctctgcccgtgctccactgcacctggcgccgtggaggagtgctgggacgtgcagcaccagctctccgtgtccccgccgccgccggccgtgccctccgccgtcgcagcgtcgtcgttcgggcgcggcaaggccgccgccgcgtcggcgcggagacggcggcgacggccgaaggcggtgaagaacacggaggagatggagagccagcggcgcaaccacattgccgtggagcgcaaccggcggcggcagatgaacgagtacctctccgtgctccgctccgccatgccgccctcctacgcgcagcggggtgaccaggcgtcgatcgtggctggtgccatcaacttcatcaaggagctggagcagctgctgcagtcgctggaggcgcagaagcggcgccagggcgggtgcaccgagccaccgc

SEQ ID NO: 8732 - DNA, 541 bp, Sorghum bicolor
  Predicted polypeptide sequence is orthologous to G1272
gtttggaagccggagggggtgagaagttttctcgccttctcggatacgtcgccatccaccccccgcttccaccactctcggcgggtcgggcagaggctttgcagctttgggtcagatacagtgctctccaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttg

SEQ ID NO: 8733 - DNA, 819 bp, Sorghum bicolor
  Predicted polypeptide sequence is orthologous to G1274, G1275
cgatccccggagccgctacactataaatacaaagcttccccggcggtggtctagccggccatggcggcagtcggagcgcgcccagtgctgtaccaccacccggcgccggcgggcgacgccgcctccatgtcctcctacttctcccagggaggcagctccaccacctccagctccgcgtccgccagcttctccgccgcgctcgcgccgacgacgaccacgctcgccgagcagttcggcatctccgagttcctcttcgacgacgcgggagtcgccggcgcgccaggcgtgttcgccgatggctcggcccccgtcgtcgtgtcggatgccgccgccgctgctggtggtggtgcaatcagcgcagccgctgggagcgcggctgcggcggcggaggccgtgccggagcggccgcggacggagcggatcgcgttccagacgaggtcggagatcgagatcctggacgacggctacaagtggaggaagtacggcaagaagtccgtcaagaacagtcccaacccaaggaactactaccggtgctcgacggaagggtgcaacgtgaagaagcgggtggagcgggacagggacgaccccagctacgtggtgacgacatacgaggggacgctcaaccacgtcagccccagcacggtgtactacgccagccaggacgccgcctccggccgcttcttcgtcgccggcacgcagccgccgggctccctcaactaatcccgatggcccaccagcgtcgcgacgttccgctccggtccaccgcacagtgtttcgattcccagatggcagctagctgagctagctacactactacta

SEQ ID NO: 8734 - DNA, 791 bp, Sorghum bicolor
  Predicted polypeptide sequence is orthologous to G1274, G1275
agatcagcaggcacattaactgatacacaagcaaggcggctagctacagctagctggtgcgtgcagtgcatgcaaatggcggcttccctgggactgaaccctgaagctctcttcgcttcatactcgtctgcctactcctcctcctcgccgttcgtgtccgactacgcggcgagctccccggcggccgtcgactccgccacggccttctccgcggagctcgatgaccttcaccacttcgactactcaccggcgccgatcttcacagctgtcggagccggggctggcggcgatcgcaacgagaagatgatgatgtggtgtgagggcggtggtgatgaaaagagactcagaagcagtggaaggatcgggttcagaacgagatcagaggtggagatcttggacgatggattcaaatggaggaagtatgggaagaaggctgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagtcccggagccgccgccatcacccagtacggcggcggcggcggtaatagcggcttctacagcccgccgcacagtggctcgccgtcggctgcctcatactcgggctccttcgtcttctgacttttccgggccttgaccttgacccagagtgatttacctttaccccagtcgtaggatgagaagagtgttcagagagatcagttcagcggccggctaaattc

SEQ ID NO: 8735 - DNA, 855 bp, Sorghum bicolor
  Predicted polypeptide sequence is orthologous to G1313
tctggtgctagtggtggcggcatctcgcttaggcgagatccccctcctcccccggtttccacccctctgctctgctccacccgagtcgactccttcccttgcaatccgctgctggtcagctcacagcagcagaggaggaggaggaggagtccattggaggagctcagctaggctccacgctgggctcgatcggcaccggctgctgcgagattccgcgagcgcgcgatgtaccgggtgaaaagcgagggcgagggcgactgcgagatgatgctgcaggaccagatggactcgccggtggccgacgacgtgagcagcggaggcgggtcgcctcatcctcacaggggcgccgggccgcccctgaagaaagggccatggacgtccgcggaggacgccatcctggtggactacgtcaagaagcacggcgaagggaactggaacgcggtgcagaagaacaccgggctgttccgctgcggcaagagctgccgcctccgctgggcgaaccacctcaggcccaacctcaagaagggggccttcaccccggaggaggagcgcctcatcatccagctccacgccaagatggggaacaagtgggcaaggatggctgctcatgtaagtgcctagccgaaatacttgattccctgtgctgcacttcttctgcacatccgtatttcgtatttcagtctgcacatgtcgaatacttgattccctgctctggggtctgatcaggtgaagtttccagggagaattgatgtgttcgttgggtctttattacgtacgtgcagtctttaattcaggatgtgtatttctgtagttatttagcgaattattctgttttgtgtcacgtactggaactgt

SEQ ID NO: 8736 - DNA, 654 bp, Sorghum bicolor
  Predicted polypeptide sequence is orthologous to G1324
tttccccttttctttcctcatattacgggcctgtttggtacagctcacaacagcttcatgaagctgttgtgagctgtttttttgccaaacacttatttccaaaacagcttcatggatgaagctgttttttccctcctctcacaaagacataagttggatgaagctgaaaaaaagtagcttattgcagcttctccctcatttctctctctcaactatacatgaagtagttagtgaagctattttgccaaacactttctccaaaacagctcagcttcatctagaaagtcactcatgaagctattttgtaaaaaaacagctttactagtgaagttgagctgtgccaaacaagacctacatattcgattttggcactagtatattaccgaaatgattttggcacgtcgaaaccgaaatgattccatcaatcgtgtgctctggactcctccacgcatggctgtggactgagatgctgtcgtgataataacgctgagagtaacgaccgagaccgacagcgatattgcggccttgtttcagttcgcaaaaaatgttgaaaaacggcactgtagcactttcgtttttatttgacaaacattgtccaattatagagtaactagactcaaaagattcatctcgcggtttacagatgaactgtgc

SEQ ID NO: 8737 - DNA, 695 bp, Sorghum bicolor
  misc_feature (682)..(682): n is a, c, g, or t
  Predicted polypeptide sequence is orthologous to G1361
aggctttcgatcgatctccctctctctctctatattccactctactcgtcaggccttaaacgaggagagactagatagagagggcgagatcgatcgtcttcgtcatcgtcgacggccatgacatggtgcaacagcttcaacgacgtgcgtgccgtggagaacaacctggccaccgccgcggccgtggccgccgccaagaaacagcagcaggcctcctcccacgtcaacctcatcaggacctgcccctcctgcggccaccgcgcgcagtatgaacaggtgcaggcggcggcgacgatccaggacctgccgggtctgccggccggcgtgaagttcgatccgacggaccaggagctgctggagcacctggaagggaaggcgaggccggacgcccggaagctgcacccgctcatcgacgagttcatccccaccatcgagggcgagaacggcatctgctacacgcatccggagaggcttcctggtgtcggcaaggacggcctcatccggcacttcttccaccgcccgtccaaggcttacacgaccgggacgcggaagcggcggaaggtccacaccgacgagcagggcggcgagacgcggtggcacaagacgggcaagacccgtcccgtgttcaccaacggcaaactcaagggctacaagaagatcctggtgctctacaccaactacnggaagcagcggaa

SEQ ID NO: 8738 - DNA, 1055 bp, Sorghum bicolor
  Predicted polypeptide sequence is orthologous to G137, G145
gctgagggtagctgcagctggggctagctggaagggttgggagccatggggagggggcgggttgagctgaagcggatcgagaacaagatcaaccgccaggtcaccttcgccaagcgccgcaacgggctgctcaagaaggcgtacgagctctccgtgctctgcgacgccgaggtcgcgctcatcatcttctccaaccgcggcaagctctacgagttctgcagcggacagagcatcacaaaaacacttgagaggtacgaaaagcatatgaggccagatactgctgtacagaacaaggagaacgagttagtccagagcagtcggaatgagtaccttaaactgaaagcaagggtggataatttacaaaggactcagaggaatttgcttggtgaagatctggggtcacttggtatcaaagagcttgagcagctcgagaagcaacttgattcatccttaaggcacataagatccacaaggacacaacatatgcttgatcagctcactgatcttcagaggagggagcaaatgctgtgtgaagcaaataagtgccttagaagaaagctggaggagaccagcaaccaggtgcatagcaagtgtggagcacggtgccaacttactcggctacgagcggccactcccccccacagcaggccccatcacatattggcaatggattgttctttcatcccctggaagctgcagcagagccaaccctgcagatcgggttcgctcctgaacatatgaataacttcatgccgacatggctaccctgaagatggatctttgaggcaaaggaataaataaagatgcgatggccagcatcatctactactgcaagagtgacagtcatatatatatatatatatgacctagtttgtgtgtcgatgtgtcgaaacgcataaatttgtgatttgttatatgtaatgtataagcacaaacgaaacatgcaggactagttgcttgcttcgatgtatttgtgtgtatccgtgtaaagggccgtgcgcacagcatatgagtgatgagattttctctaataaggccgttatgccgccaatcgt

SEQ ID NO: 8739 - DNA, 736 bp, Sorghum bicolor
  Predicted polypeptide sequence is orthologous to G1382
atcccggcaccgccaatggccgattcgccaaaccctagctccggggacctccccgccggcgctgggggctcgacagagaagccggtcctggcggatcgacgtgtggctgcgctcgccggcgccggcgccaggtacaaggccatgtcccccgctcggctgccgatctcgcgggagccgtgcctcaccatccccgccggcttcagccccggcgctctcctcgagtcccccgtcctcctcaacaacttcaaggttgaaccgtctcccacaactggtactctgagcatggctgcaatcatcaacaatagcactcatccagacatactgccttcgcctagggataattcagctggtagtggccaggaagatggaggctctcgggattttgaattcaagcctcatctcaattctcaattggcggctcctgcggtcaacaatcaaaatcgtcatgacacccctatgcaaaatcatagctcaaatcatgcctcaccatctagcagtttgatgactgaaaataaacctctctgctcacgggaatcgagtcacacatcaaatgtttcaagtgctccaaaccaacctgtttcaatagtttgtccatctgacaatatgcctgctgaagttggtacatcacagatgcgccagataaatagctctgaaaatgctgccccggaggcacaaactgaaaatgtagctgaaaaatcagcagaggatggctataattggcgcaaatatggacaga

SEQ ID NO: 8740 - DNA, 575 bp, Sorghum bicolor
  Predicted polypeptide sequence is orthologous to G140, G146
gcacgaggctcagaagctgcccagagctaccaccactccatctcatccccacccttcctcctactattctccttcaaacagcaaaatctgtgtgtctcctgccagctaataagaaaaagagcatgcacatccgagaagagcaagctatgccatcaacagtgacaggcatcatggtgtcgaccctgacttcggcggggctgaagctgaaggagccggcgacgatgtcccctggtggctccgcgtcggttgctgctggatttgggtctgctgcagagaggaacaacggcaggggcaagggcaagactgagatcaagcgcatcgagaacacgaccaacaggcaggtgaccttctgcaagcgccgcaacggcctcctcaagaaggcgtacgagctctccgtgctctgcgacgccgaggtcgcgctcatcgtcttctccagccgcggccgcctctacgagtactccaacaacagcgtgaaggccaccattgagaggtacaagaaggcaaacagtgacaactccagcgctgctggtacgattgcagaggtcacgattcagcactacaagcaggaatctgct

SEQ ID NO: 8741 - DNA, 572 bp, Sorghum bicolor
  misc_feature (559)..(559): n is a, c, g, or t
  Predicted polypeptide sequence is orthologous to G140, G146
cggcacgaggtatcctcttccaattccctccctggatctcttcctgcatgcagagaggcactgccgcaccaccaccaccaccacccatgctcaacatgatgactgatctgagctgccggccgtcggaggtgacagagcagctggcggcgccgacgggctccggcgacaagcaggggaggggcaagatcgagatcaagcgcatcgagaacaccacgaaccggcaggtcaccttctgcaagcgccgcaacggcctcctcaagaaggcgtacgagctctcggtgctctgcgacgccgaggtcgcgctcatcgtcttctccagccgcggccgcctctacgagtacgccaacaacagtgtgaagtccaccattgagaggtacaagaaggccaacagtgacacctccaactctggcacagttgcagaagtcagtgcccagcactaccagcaggagtcctccaagctgcgccagactatcagtagcttgcaaaacgcaaacaggaccatagtgggagattcaatccacaccatgagcctcagggatcttaagcagctggagggcangctggagaaaggc

SEQ ID NO: 8742 - DNA, 496 bp, Sorghum bicolor
  Predicted polypeptide sequence is orthologous to G140, G146
gcacgagggatcggaggaaccaaactaggagtagagtcccctttcctagcttgcttgcaagtccaagaaactagcagagagaggaacaagctgcgatctccagcatggggcggggaaggattgagatcaagaggatcgagaacaacacgagccggcaggtcaccttctgcaagcgccgcaacgggctcctcaagaaggcgtacgagctctccgtcctgtgcgacgccgaggtggccctcatcgtcttctccagccgcggccgcctctacgagtacgccaacaacagcgtgaaggctacgattgagaggtacaagaaggtacacaccgttgggtcttcctctgggcccccactcttagagcacaatgcccagcaattctaccagcaagaatccgcaaaactgcgcaaccagattcagatgctgcaaaacactaacaggcacttggtcggtgattctgtgggaaacctgacactcaaggagctgaagcagctggagag

SEQ ID NO: 8743 - DNA, 699 bp, Sorghum bicolor
  Predicted polypeptide sequence is orthologous to G140, G146
gggcaggctggagaaaggcataagcaagattagagctagaaagaatgagctgttatatgctgaagttgactatatgcaaaaaagggagatggatctgcagactgacaacatgtacctgaggagcaagatcgctgagaataatgaaacggggcagccggcgatgaacatgatgggagtgccatcgacaagcgaatacgagcacatggtcccttttgactcgagaaactttcttcaagtgaacatcatgcagcagcctcagcactactcccatcagctgcaaccaacaaccctgcaactcggatgacgaaattaattacctgaagatgaatctgcggccaatgatccatgcacgcgagcatgcagttatatcatgtgtccaatcgagatcaagaatctactctacgtttgtataattattattaataatcgtgattagtacaactgtcagcagtatgtgtgtgacaactctacatatatgttgtgtggctgtacggcgaggtcttttgcgacaacatttgcagcagcagcagcatttggtgttgttcatcgatcgatcgcaaaaattaagcttgccaccactgtgtgtgcatttgtacgtgttaattcagctgctgtatctgttaattgcaccctccattagaacgcacgcgtatgcatacttatacttatttatgtatatgagatttgtgtgtgttatat

SEQ ID NO: 8744 - DNA, 590 bp, Sorghum bicolor
  Predicted polypeptide sequence is orthologous to G140, G146
gagatcaattacatggccaaaagggagactgaacttcagaatgaccacatgaacctcaggaccaagattgaggagggagagcaacagctgcagcaggtgaccgtggcccggtctgtcgcagcagcagcagcagccaccaacgtggagctgaacccattcttggagatggataccaaatgcttcttccctggcggccccttcgcgacgctggacatgaagtgcttcttccctggcggctatcagatgctggaagcgacggcggcacagcaccgccagatgctcaccactgagctaaacctcggctaccaactggcgctgcctaactctgacgctgccaacaataaccctcatcagttctaaaccgcatgcacgagaagcttttcaagcgaactgtgtgacccatggaagctggctgttgccctctagctgttcttggcttccataaccttattgtgatgtgtattgttgtgtacttgtgtgtgattctccttgctactctactgatggagaactaaacctaatcgattagacataatgatcaaatgctacagcatctatgaggctgcgatcaggttaagttaaaaacataa

SEQ ID NO: 8745 - DNA, 680 bp, Sorghum bicolor
  Predicted polypeptide sequence is orthologous to G1435
cctcatcctcgtaacccgccacacggacatggaagacgacgacgacgccggcgccggcgccggcgcgtgcggccgcgtgctcgagtgggagcacggcctgcccacggaggaggagctgacgccgctctcgcacccgctcgtccctccggcgctcgccgccgcgttccggatcgacgtcaggggcaccggccccgccttgccctcctcccccgccttcgactgccccaggcgtctatcgcgcgcaaggcccccacctctcacctgtcctgccgcggcgaggaccaggacgacgactaggactatgagggggagggggaaaggcactataatcgctccggctggaggtgtcagagagctgttgggtcctgaagtgggagccgtactccggcgggaaggccggaggaggctgctgcggctttccggggctgcgcgtgcgcttgaggtagatgcggtacttctggaggtggctggcgacgttctcgcgggtgaggccctcgacgttcatgaggcgcacgatggccttgggtacggcacccttgtcgccgaggtgcgccaccgcctcgacgaaccggtggtgcagctccggcgtccacaccatccgcgccttcttcccggccctcccgcctccgcacgagccgccgattccggaggtggcgtcctccccctcctcctccctctcc

SEQ ID NO: 8746 - DNA, 721 bp, Sorghum bicolor
  Predicted polypeptide sequence is orthologous to G1435
gcaggcctcttccttcctcctccccacgggcacaaatatctccgtccctgtcccctatctctcctcacccgccgccggcggtcgaatcgacggaggcgggtggctggattgctcgattcggatgggcgaggaggccatggacgactacgagctccacatggtgtgctacggcggcgacgacgacggccgcgtgatggagtgggagtcggggctcccgggcgccgacgagctgacccctctgtcgcagccgctggttcccccgggtctggcggcggcgttccgcatcccgccggagcccgggcggacgctgctggacgtgcaccgcgcgtcggcggccacggtgtcgcggctgcggcgcgcgccgtcgtcgtcgtcgtcgggcagcggagggagcggctcctcctccttcgcgcccttccatccccatccgcaggcggcggcggcggcgggacacgcgaggggggacgaggatgcggactcgtcggcggcggccttgggcggcggcaacgcggcgacgacgaccaccaacacaggcaccaacagcaagcgtccccggctggtgtggacgccgcagctgcacaagcggttcgtggacgtggtggcgcacctggggatcaagaacgcggtgcccaagaccatcatgcagctgatgaacgtggaagggctgacgagggagaacgtggccagccacctgcagaagtaccggctgtacgtgaagcgg

SEQ ID NO: 8747 - DNA, 600 bp, Sorghum bicolor
  Predicted polypeptide sequence is orthologous to G1435
atgggcgaggaggccatggacgactacgagctccacatggtgtgctacggcggcgacgacgacggccgcgtgatggagtgggagtcggggctcccgggcgccgacgagctgacccctctgtcgcagccgctggttcccccgggtctggcggcggcgttccgcatcccgccggagcccgggcggacgctgctggacgtgcaccgcgcgtcggcggccacggtgtcgcggctgcggcgcgcgccgtcgtcgtcgtcgtcgggcagcggagggagcggctcctcctccttcgcgcccttccatccccatccgcaggcggcggcggcggcgggacacgcgaggggggacgaggatgcggactcgtcggcggcggccttgggcggcggcaacgcggcgacgacgaccaccaacacaggcaccaacagcaagcgtccccggctggtgtggacgccgcagctgcacaagcggttcgtggacgtggtggcgcacctggggatcaagaacgcggtgcccaagaccatcatgcagctgatgaacgtggaagggctgacgagggagaacgtggccagccacctgcagaagtaccggctgtacgtgaagcgg

SEQ ID NO: 8748 - DNA, 603 bp, Sorghum bicolor
  Predicted polypeptide sequence is orthologous to G1451
tggcgatgacccgtggcaggaatttgtgaacagcgtgtcctgtataaagatactttcaccggaggaggttcagcagatgggcaagccgggcattcagctcttgagctcggctccttcaagaaggctgagcaatggctgcgacagctatgcgagcatgcaggaatcaagaagcctgagcactgggatggcgccagtgggttcggtcgagttctgaagacagggatgccccatagcccttggctttaggattctccttctgtatgtttctgcagcactagctagttttgcgacttggaacaaagcacatagatcaaacgagctctatgctattccacgtctgatgatgtcctatggtacaggtgccagccatatctggaaaattttgttggtcacctgctgtcgagtatccaactgtggatgcttcgtgctcgtgcccccagctcgccttcttctgccgtgcctgccccctccccgacgtcactattttacgaacgttcagccgaaacgaaaccagcggtcaattcccgacagccatttctttccatttttggaaaatgtatatgttactttttatttttagacagaacaggaatcattctattc

SEQ ID NO: 8749 - DNA, 727 bp, Sorghum bicolor
  Predicted polypeptide sequence is orthologous to G1451
cagattcagcagctactacgagttacgtagcgagctcgagcggttatttggtcttgaaggccaattggaggaccctgtaagatcaggctggcagcttgtattcgtcgaccgggaaaatgatattcttctcgtcggcgacgacccgtggcaggagtttgtgaatagcgtatggtgcataaagatcctctcgccacaagatgtgcagcagatggtccgcggcggaggcgaccttctgtctgcacctggagcgaggatgctgcagagcagtgtctgcgatgactattctgcaggccacgacatgcagaacctcaccggcaccattgcacctgtggtgcctctggactactgagactgagatgaagaccggaatctgaagttctgaaccaaaaccagcaattcagcaccggaggattgccatccacaagtcgtttcagttcctatgatcttctctcatgtcctgttggtcagaaataacctagtcattaatatagctagatgagatgatcccttgtatcattatggtaatggacatgttgtacgatagctactgtagctatgtgatagccatagcctaagctctaaatggcagggaagaattgttctatgaaagtatgaacgcaggcactcactgtagaggtgatctagccctgtagttctctatattatcttatatcgaaaactgatggttccttgtggcgcctaaactattgaaacctgtcaccttgtc

SEQ ID NO: 8750 - DNA, 575 bp, Sorghum bicolor
  Predicted polypeptide sequence is orthologous to G1480
cgcggctgatgcggtaccgtgagaagcgcaagaaccgccggttcgacaagaccatccgctacgcgtcccgcaaggcgtacgccgagacgcggccgcgcatcaagggccgcttcgccaagcgctgctcctcggaggccgacgacgacgcgctggagcacgacgaaggcgcgtgcttctcgcccgcggggtcggcgcacgcggcgtcggacggcgtcgtcccgtccttctgttgaggaggaaagaagacggcgaaccccggcagacggcggccttccccgcctgcctgcccggcggcgacgacggctccttagttttgccaactctgtcgactctgaacctttttttttttggtctctcctccctctctcttttgatcgaggggttgctagctctggatctgaaactccgaatgcatgggacgcgagctccgtgtagcatgaataactgtgtagttgttcgatggacgaatcaatggcgttcgcatggaattctcctcttgtaatcctctcggtcctcaccgtcactgtaatccacccttgtatatgaccatctagagtgtttcttttccaggatgc

SEQ ID NO: 8751 - DNA, 582 bp, Sorghum bicolor
  Predicted polypeptide sequence is orthologous to G1480
ccaaagcctcaggcctacatgccatacacggcgactccccagagccacagcgtgtcgtccgtggacgtggaggtggtgccggagcggggagacttgccggcggtgaggccggtgccgctgatgggggagagccgggaggcgcggctgatgcggtaccgtgagaagaggaagaaccggcggttcgagaagaccatccggtacgcgtcccggaaggcctacgccgagacgcggccgcggatcaaggggaggtttgccaagcgcgccgaccacgacggcgacggcgacgccgacgacgccgaggccgaggccgccgtgccgtcgtcgtacgtgctcgacttcggctacggcgtcgtgccgagcttctgatgatctcgatcggcccaccccggccggcggtcccaacgcgcgcgcatgcatgcatggccgccacggaacgccgcgcgcgcgcgcgcgccttgtacttgtatcaatgtatagggaggaagtagtaatcccatgtacttatttttgagcaagcccttgcgtaaactagccatgtataatttgtatactacgtggtaacaagctgcagtagccgcatac

SEQ ID NO: 8752 - DNA, 653 bp, Sorghum bicolor
  misc_feature (653)..(653): n is a, c, g, or t
  Predicted polypeptide sequence is orthologous to G1480
ttcgcgcgttccatggacgacatcaagaccatcggcgtccagggcgggccaccagagctcgacctcaacggcgccaagctcttctactccgaccactccatgaaccacagtgtgtcatcgtcggaggcagcggtggtgcccgacgcggcggctggcgcggcgcccgtggtggcagtggtcagcaggggcctggagcgggaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgccgggggctggggaggacccgctggaggagcacgaggagatgtactcctcggccgcggcggccgtggctgcgctcatggcccccggcggagccgacgcggactacggcgtcgacggcgtcgtgcccacatattgatcgatctccgcagcaattgcaacgccgacatgtacactagtttgcctcgagcttttggggctgtaatttttgctgcatgctttgcatgcaaagctctcgtgtatatgagaggacttccaagcgcgcgagcgctctcttttcctcctcttctctattctatatagtatattattactatacgaactgctatn

SEQ ID NO: 8753 - DNA, 485 bp, Sorghum bicolor
  Predicted polypeptide sequence is orthologous to G1480
gcacgaggccacgccgcgctgcctccccagtcccctcccctccctccccaccaccaccaccaccacaagaaccgcgtcggcagacaccaccgctgtcattgccgcggccaggcgcgccagccaggagaaaggcgggaggcgcctgctgtgcttagccgcttgctgacctcgctcgttcgatggagctgcacaagtactggggcgtgggtggccggcggtgcggcagctgcgaggcggcgccggcggcggtgcactgccgcacgtgcgtcggcgggtcgtcgtcgttcctctgcacgacgtgcgacgcgcgccccgcgcacgcgcgcctggcccacgagcgcgtgtgggtgtgcgaggtctgcgagctggcccccgccgccgtcacgtgcaaggccgacgccgccgtgctctgcgccgcctgcgacgccgacatccacgacgccaacccgatggcgcgccgccacgcgcgggtccccagcgcgccc

SEQ ID NO: 8754 - DNA, 820 bp, Sorghum bicolor
  Predicted polypeptide sequence is orthologous to G1494, G789
tgctcatgccgcgctgcggtggccgtgctgctgctacggacctgcctcataaaagctctcctgcttgcagcttgcacggaggcgggggtagaagacgacttcgcaaggcatctctgctcgagcggagcagtactccgttcaggagacgaggcgttctcctccggtgggtctggaagcaactatgggggatccgggctgccaagtgacagcgtccatgtccacaagaggaaggggaggtgtagagacgactcagatagtccgagtgaggatgccgagtgtgaggaggcaactgaggagaccaaaccgtcgcggcgacatgggccgaaacgccggactcgtgcagctgaagttcataatctctcagagaggagaagaagggacaggatcaatgaaaagatgcgcgcgttgcaagagctgatcccgcactgcaacaagactgacaaagcgtcgatattagatgagacgattgagtatctcaagtccctccaaatgcaagttcagatcatgtggatgacttctgggatggcaccaatgatgtttcctggtgctcaccaattcatgccaccaatggctctaggcatgaattcaggttgcatccctgcagcgcaaggcctaagtcagatgccaagattaccatacatgaaccaccccctgcctaatcatatccctctgaactcatctccagctatgaatccactgaatgctgcgaaccagatgatgcaaaacggtcacctcagggaggcaagtaatcacttccttcacctagatgggcgaacagcggtggtacctcaggtaccaggaccccatgtttatggacatc

SEQ ID NO: 8755 - DNA, 737 bp, Sorghum bicolor
  Predicted polypeptide sequence is orthologous to G1510
acccacccatcgctaactctctcgagctaaaacccttgctctccccgcccgcccatttccctttccccttaggcgtcgctgcttctccggcggatcggattggcgatccatcatcgccggcggatcgcacccgcctacaaggctttgttgcgggatcggatcggattagcgatcgatctgtcgcgtaggcctgcttgctttgctttatttcccatcccatggaggtggagatggaggtggagatggggacggatcccaatcccagtcccaatcccaatcctaacacttccccctcggccgccgacgacgccgccaccgcctcaggcgaggccaaggcctgcgccgactgccacaccaccaagacgccgctctggcgcggaggacccgagggacccaagtcgctctgcaacgcctgcggcatccgctaccgcaagaggaggaggcaggcgctcggtctcgacgccgcggccgccgactcacagcaagatcagcagcagccgaagaagaaggccaccgccgatccgcagcagcaggatcagcatcacctgagaaagaaggccgccgatccacagcagcaggatcagcatcacctgagaaagaaggcagctgccgctgccaccaccgatccacagcagcaggatagaaagaaggccgctgccgccagcagcaccaacaagaaagacaaagataaggaggacaacaagaagaagaaggatcagcaagtcaccgtggagctc

SEQ ID NO: 8756 - DNA, 836 bp, Sorghum bicolor
  Predicted polypeptide sequence is orthologous to G1510
cttgccttttgatccctcgctccaattgcccattattccgacatacacacagcaccagccgccaccgccgccgcggctgctgttctcctcctactctctccatattatctctcatctgatcttcactcatcacctagctatatatactagatcctgctagctaggtcctccatagctctatccaaatctcgatatcgcaagcaaattcctgatctcatcagtccctatagctcccatgtctgccatctacatgagccagctctccactgctctccctctcatggagggagatcaccaccaccaccaccaccaccaccaccaaggccacttccaagccttcacgctgccaaaggatcccccaatccttttcccctttgtgatcagcaatagtagcgccagcgaaagcagtctgagctatggatcggcagatcatcacttgttgaggcagcatcgtcaaactatgctcgagccccaacatatgattggtggatcgtcatcagctgcgagtagtgtctttgcgacgccgttcccgactgtggagagcatccgtgacgacatgatcgagcctgcctcgtacgatccatacgatatggggaagctgcaccaggtggtcggtggcgggtcgtcgatggatgcttgcagctggacgccgccggcggccaagatgaggatcacgaggaaggccactgccgccgatcccagtggtgccgggaagaagccgaggagaagggcgcatcaggcagcagggtacgacgccgacatcaacatgagcggccaaccaaatttgggtgttattagggtgtgctccgactgcaacaccaccaagacgcccttgt

SEQ ID NO: 8757 - DNA, 815 bp, Sorghum bicolor
  Predicted polypeptide sequence is orthologous to G1510
acacggctgacgttctctcgaccagcctctgtctactacttcgttcaccccttcggcttcgtctcttctactcttcctccctcgtctccggtggttccttgatctatggatggttggcgcctgatgggcggttgttggatccgatggaaagctagtttctccggatcggatcagatcacatctcccggtaaccgttccgatcaacctcttccggtattttttcagaggaaaggttggccaacgggcttccggtggttggatttggtggcggacttcggttaggttcacatatcgcttgcagttcggttcgcttcaatggaaagctgatgtctctaggttagaagaataactatgagtaagaaaggaaggatggctgctagattgggtagctagctgttggctgcttggttctacagtagcttggagcttggcttctaggtgttctagtgatggtggtggtggtgtttggttcaggggatggattaaattagtgtctgaaatagctgtttggtttaggtgatcttaagtagacgacctgattataattcagggtagtttatcgttgcaataatctaaggtttggtgtgcgtttggtctgtgtgagttttgtgttaggtgagtcatgaactaaagttatgtgatgtttagtaggtcaggtgaaggttcttctcttatgtaagatgtcaagtttgtatctattatcagcttagctgtgatatactactatatatatatatgagtggtaaatttaggtatggaaaatctgtgttggtgcctctgatcaggaatggttaacatctcttatctttatggtc

SEQ ID NO: 8758 - DNA, 641 bp, Sorghum bicolor
  Predicted polypeptide sequence is orthologous to G154, G1797
gatatacagcaagtcaaagcagatgctgtaagcttggcaaatagactcgaagcccttgaaaagaccaaacgaaagttcttgggtgaaaatttagaagaatgctccattgaagaactgcacaatttggaggttaaactggcgaagagtcttcacgtcatcagaggaaagaagacacaactgctggagcagcagataaccaagctgaaggagaaggagaggaacctgctcaaagacaacaaagaattgcgcgataagcgcaacctccagcctccaccggaggcgccaccagtcctgaaccgctgtctccctccttggccgcgtaacctgccggcgccaccgagcaacgacgacatggacgtggagacggagctgtacataggattacccggcagggagcgctcctccaacagggactctggttgagccacggattttcagctcggctaaaaggaataaaaactctctgaaagcatcatcaaagggcacatgccaatggttttacttgcaccttgtatacaaagttgtgctggaaatgtaaaaaagtatgtagtatgtggatgaaagaaacggctgggtagctagctgcaaacctgcaagcctttctggggcctgaaaatgaaaatccatacacggatacaccc

SEQ ID NO: 8759 - DNA, 563 bp, Sorghum bicolor
  Predicted polypeptide sequence is orthologous to G154, G1797
gttgctcggtggcgccggcaggttacgcggccaaggagggagacagcggttcaggactggtggcgcctccggtggaggctggaggttgcgctgctgcagcgataagaacagcaggttcctctcctggaagtggtagaagtaagaaacaacagaggtcaggaattggttactagagtttcaggatactctgggcccatgcattatgttaccttctccttcagcttggttatctgctgctccagcagttgtgtctgtcaaaacaaaagtaggatgcatatcaacttgggcgaacagtatctttgttatcgtctatgtagtaatttcagaggctagggtttatgtgggaggtctggcatgaactaaccttctttcctctgatgacgtgaagactcttcgccagtttaacctccaaattgtgcagttcttcaatggagcattcttctaaattttcacccaagaactttctgcaactcgtgtaaagacaatgaatggctggccttttagctccgaggaagaatgccattaatctttagtaaaatacatgattgctcaccgtttggtct

SEQ ID NO: 8760 - DNA, 728 bp, Sorghum bicolor
  Predicted polypeptide sequence is orthologous to G1638
tggaagccactgcccaatcgccggctgacactcacaagatacctgcctccctctggatcgctatctcttttctagtgctcagggaaagctagctcagagctgttgagagaaggaagcaaggagacggagagggagggagggaggaaaaaaaaacacacacacacacacacacacacacacagaggtgttgagcaagaaccgaggcggatcgccttttgttcctcctgccgaggactagcctgcctgtcggcgccgcgagagatcaagaggaggcgcggttcagtgattcctacaggggagggagaagaggaggaacaccgggggcggagagagatgatgcgggagatgtatatggacgtgctgccgccggtggaccacataaccgcacggagcaactggttcccggccgcggcgcgtctctggacggcggaggagaacaagcggttcgagtctgcgctcgccgggctcgacctctgccacccggactgggagaaggtggcgcaggccatccccggccggacggtccgcgaggtcgtcagccacttcaagaacctccagctcgacgtccagcagatcgagagcggccaggtgcccttgccggtctacggcagcggggccagctcgttcactctgcagtgggacggcaatggcggctacgggcccggggacttcaggcacgggtaccgcttcggcggaggctgcgggaagcggcaccatggccgcacgcc

SEQ ID NO: 8761 - DNA, 587 bp, Sorghum bicolor
  Predicted polypeptide sequence is orthologous to G1646, G715
cttgggagaccactgcccggcagccgcgaggaactcactcctgcaagatagcttcatatacagccatagccggagtacgtatatgtagctacgcaacctcagttcaggcgagctagctagccacaacgccgaccaggcgagaacgaagagaagcatcgatcgattgggtcacaagctcccagcaacttttaatccaaatccatggacaaccagccgctgccctactccaccggccagccccctgcccccggaggaaccccagtagtgccgggcgtgcccggcgcagccggccctccgccggtgccgcaccaccacctgctccagcagcagcaggcccagctgcaggcgttctgggcgtaccagcgccaggaggcggagcgcgcgtcggcgtcggacttcaagaaccaccagctgccgctggcccggatcaagaagatcatgaaggccgacgaggacgtgcgcatgatctccgccgaggcgcccgtgctgttcgccaaggcctgcgagctcttcatcctcgagctcaccatccggtcctggctgcacgccgaggagaacaagcgccgcaccctgcagcggaacgacgt

SEQ ID NO: 8762 - DNA, 635 bp, Sorghum bicolor
  Predicted polypeptide sequence is orthologous to G1646, G715
ggccgacgaggacgtgcgcatgatctccgccgaggcgcccgtgctgttcgccaaggcctgcgagctcttcatcctcgagctcaccatccggtcctggctgcacgccgaggagaacaagcgccgcaccctgcagcggaacgatgtcgccgcggccatcgcgcgcaccgacgtcttcgacttcctcgtcgacatcgtgccccgcgaggaggccaaggaggagcccggcagcgccctcggcttcgcggcgtccgggaccggcgtcgtcgggggtggcgccccgggcggggcgccggccgccgggatgccgtactactatccgccgatggggcagccggcgccgatgatgccggcctggcatgttccggcctgggacccggcctggcagcaaggggcagccgatgtcgatcacagcggcagcttcagcgaggaaggacaagcagggtttgctgcaggccatggcggccccgctagcttccctcctgcgcctccgagctccgagtgatcgccatgatgtgtacgtcacgcactcacgctgtgtgtatacactctactatagcaaacatggtaatggagctgcatacagaacgaataaggcgtgacgcgtgtcagacagtgagagtacgtagtaatttgta

SEQ ID NO: 8763 - DNA, 677 bp, Sorghum bicolor
  Predicted polypeptide sequence is orthologous to G1646, G715
gaaaagcaccatcctcttcctcttcctcctccgcccccaatccccctcctcgtctcgccacaggccacaaccctagctgcccccgaatccatggatcccagcaaatccagcacccctccgccgcctccagtcatgggcgcccccgttgcctaccctccggcgacgtaccctcccggcgcggccgccggcgcggccgcctacgcgccgcagctctacgcgccgcccgcagctgccgcggcccagcaggcggccgccgcgcagcagcagcagctgcagatgttctgggcggaccagtaccgcgagatcgaggccaccaccgacttcaagaaccacaacctcccgctcgcccgcatcaagaagatcatgaaggccgacgaggacgtccgcatgatcgccgccgaggcccccgtcgtgttcgcccgggcctgcgagatgttcatcctcgagctcacccaccgcggctgggcgcacgccgaggagaacaagcgccgcacgcttcagaagtccgacattgccgctgccatcgcccgcaccgaggtgttcgacttcctcgtggacatcgttccgcgcgacgacgcaaaggacgccgacgcggcggccgccgcagctgctgcggctgctgctgccgggatcccgcgtcctgccgcgggagtaccggccaccgaccccctcgccta

SEQ ID NO: 8764 - DNA, 576 bp, Sorghum bicolor
  Predicted polypeptide sequence is orthologous to G1666
gcacgaggctactacctagtacctactacggtcaagcagagcgcgtccattcagtcaatcatctgcatcccgctcatgggtggcgtgcttgagctgggtacaactgatacggtgttggaggacccggacttggtcagccgagcaactgcagctttctgggagccgcaatgtcccacatacttggaagagcaagagccgagcccgagctccaacaccccatcggcaaacgaaaccagcgaggccgcagcagacgcagacgacatagttgtgttcgaggacctcgatcacaatgccatggaaatggagacgattactgccgtggtcgagggacatggacaggagctacgagaagccgagagcctgtcaaacgcaagcctggagcacatcacgaaggagatcgacgagttctacagcctctgcgaggaaatggacgtgcagccactagaggatggctggatcatggacgggtctaattttgaagtcccctcgtccccgcaaccaacgcccccggggaacctagctgatggctctcgcgcgaccagtttcatggcgtggacgaggtcctcgcagtcgtgc

SEQ ID NO: 8765 - DNA, 703 bp, Sorghum bicolor
  Predicted polypeptide sequence is orthologous to G1760
aaggtcatactcattatccatttcgttaccatgttttggttttctattcacttcaatctaatatgcagtaatgtcaaacaggaccatattttgaaaagtgaaattgaagagttacacaggaaggttaagtcctaaaagcaattgtcgttttttcttggttcaatggaagttagtgacatcttaatttatactgacattgaaacagggtagcctaattcaccaggaaaacatggaactcggtagaacagtagatgtcatgtcacagcaaaaagttgaactacacaggaagctccaggccagtgaaccaagaggtgttgctgatgcaagctctagcactccctacagctttagtattacaacacaatatgcagatgtccctgctaatcttgaacagaggcaatcacaacaaaaagagggggatcgacgcaaggaactgatggctcctgaactgggacttcaactgcactaagaagatgcagtacaagttcgaaaataccatggtgtgtttcaacaatttcatacagtgcagagcactctggttgcaatgagtatttgtgaaatatactagctgagtgagcaaaatggcttgtgtaaataatgtcacatgaggctcctccatattgaagatacactgggtttcactttggcatttgcatcatgtatatgtacttggtttccactaatgactgaactttgcaataag

SEQ ID NO: 8766 - DNA, 697 bp, Sorghum bicolor
  Predicted polypeptide sequence is orthologous to G1789
ctagcttagcttccttcctctcgagcaagctccagaaaagctacggaatggcgtcgatgcagtcgatgacgagcgcagcggcgcgcgcgcagtggacgccgaagcagaacaagctgttcgagcaggcgctggccgtttacgacaaggacacgccggaccggtggcacaacatcgcccgcgccgtcggcggcggcaagtccgccgaggacgtcaggcgctactacgacctgctggaggaggacgtcggccacatcgagtccggcaaggtgcccttcccggcctaccgctgcgccaccggctacggggccgcctgacatgcaggctgaaacatctgaagatctccggagatgatgaacataataggacgaacgatcgatgatccagaagatacaaacatgtgtgtatataggattaatgggacagcatgcatgcaatggtccaagctgcaactgcaagtagtgatgtgaaagcaaaaatcagattggatgcatgcatatgcatgtgttaattaataataataaattttagtatggggtgagtactagacagtcacgcgagatcgaccgacccatctatctcccatgcatgcatgcatgcaagcttgtgttctctctccctacttgtcaacttgtgtgtgtatattatgtactattattgtaattatatatatgctactataatcgcatctgtgtagcat

SEQ ID NO: 8767 - DNA, 716 bp, Sorghum bicolor
  Predicted polypeptide sequence is orthologous to G1821
agaggaaaacttcgacccttcaactcaacccgacgacgaccgagacgaagattctattcacgtgttagccacatcgccgacactctctgcgaacatattacgaaacgctcgtctctgtgaagagctgctttgcttgttacttgatccgccatttccttttggccccagacgacgactgacgaaccaccgtgttccgtccctcaactccagattccctgatcgcgcccactttggctgccccaacagaccagacgacgataacataaataaataaataaaaaggcgaagagaacatcgtttctcatatctcaaaagaaaaatcaaagccgacgatacagaggccctttgctgcactctgcttatacatcctacaaaggcgacgaagcgtcacatatttgtcgacgcaatatttactcttgcttgaccggaagtcgaggacagcgaaaactcgcacgcgctgacggtgttctgtctcccccccttctggcttctagcatcttgctcgcccctcattttctgacgccctgtacctacctgtctcttttctggtacagctatcaacaaccaaagtcggtggcccactgcggcaaccacgacgacgactgttttctccccatatccaacgtgatctgattgcttcttttttgcaattcaatatcgaacggcgacacaatttgctattgctgatcaacttgctcttctgcgctttcgatctc

SEQ ID NO: 8768 - DNA, 587 bp, Sorghum bicolor
  Predicted polypeptide sequence is orthologous to G1850
gggttttttcctcgtgctgctgctgctgctgctacctttctcaccgtctctctctcctctctcctctccgtcctgtcctcctcccgttggtgggagtataaaatttcctaatccgcaatcgaagcttccagaaggcttcctcatccgtaccttcctcccaacgcgcctcgctctttcccgcatctggaagctacggtttcgccggcttagatccagccgggctacgggcgctggccagatggccgagcagggcggcgccgcccccggggaggccgttggcagcgacaccactgcgcctgcgccagcgccagcgcttgctgcagacgcggccgggcagaggtcgctgccgacgccgttcctgaccaagacgtaccagctggtggacgacccggcggtggacgacgtgatctcgtggaacgacgacgggtccacgttcgtggtgtggcggccggcggagttcgcgcgcgacctcctccccaagtatttcaagcacaacaacttctccagcttcgtgcggcagctcaacacctacggatttaggaagatggtgcccgaccggtgggagttcgccaacgacttcttccgcc

SEQ ID NO: 8769 - DNA, 676 bp, Sorghum bicolor
  Predicted polypeptide sequence is orthologous to G1850
attccctcattttcagccccttggtcttgcaattgcgacggccctcatctatcgcatcgtcgccctcgatctccctgcgaaggccctcttattcattcgggagtactctagccagcaaagctttcgaacccctggacctgctggtgacgactgaacatcaacgcgtccagttcttgagtccgcatctagcccttacgccattcgttatcatctcagcttggcgcatcgaaaaccattcatcctcagttcaaaggaaccagaaccgttcttttttgacttattgtttgctacctaaggttcgacaacgatcaacggcgactcggcccggttaaacgcctcttccatccgtcatccgtcgaatcgactcttgaacatccgtattgttctaatcgcaggccggcggcgaaatcatctcgaagcaaaacatagagtggcaaaggcactccttatataaacacataatatgtctggtgacggaaccccaacccccggggttggtagcagcaatgccagcgagtttgttcgcaagctttatcggatgctcgaagatcccgcgcatcaggacgttgcaagatggggaaaagatggcgatacgttcgtcgttgttgagaacgaaaaattcacgcgttcaatcttgcctaagcacttcaagcacagcaacatggctagtttcgtc

SEQ ID NO: 8770 - DNA, 568 bp, Sorghum bicolor
  Predicted polypeptide sequence is orthologous to G1855
gagatggataggatattaaggcccgagggcacagctatcatccgtgacacagttgacgtgctcacgaaagtccaggcaataaccaagcggatgcggtgggaaagccgcatcatggaccacgaggatggccccttcaatccagagaaggtcctcatggcggttaagacgtactggactgccaaaacggaggaggagcattagcacacaggcgacacggctcactgaaaacctgaaccaggcttgttctaccagttgggaggatggcatcagggttttgccgtctcagtgtagtatgggaccgcctggtcacatgttcctttcacctttctgtaattctttgtagctgcaatcagatgagaagctgagggaggagtttgaggggtgattggacctctagttgatacaggaaaaacggttttgtagcaggggaagaattcgctggtcttgcataggttcctggccctgttccacgaggggttgagctaggttttagtctgtaatatgatggcaccgagcaggcagtgttaccgtatattggagtgacactaatagtaataggtatttattc

SEQ ID NO: 8771 - DNA, 522 bp, Sorghum bicolor
  misc_feature (20)..(21): n is a, c, g, or t
  misc_feature (74)..(74): n is a, c, g, or t
  misc_feature (82)..(82): n is a, c, g, or t
  misc_feature (93)..(93): n is a, c, g, or t
  misc_feature (105)..(105): n is a, c, g, or t
  misc_feature (502)..(502): n is a, c, g, or t
  Predicted polypeptide sequence is orthologous to G1917
tccttcttcgccggcgcggnncggccgccgccgcgagcggggggctacttctctctacaagggactacaagctncgccagcngactccatggnccctcaaggtgnaaaggtgtccaagattctatagacactcgctacaaggcccttgaaaagagactcgctgctttagaaggtcagcaaagcactggggctgcaccggatgtggatacaccatctgattagtctgttcactacgaggcttggacacctatgatttacggctgttttcgtcatcctcacttgtcttctcctttgaaatcaagaggcctgactgacaacaaaataagctagaatacttcttttgtactgcaaatgtctgaggctgagattttcccgtacattctgcctgtgtttcatgccataaaagcacatgatcagaactctgattgctcaggcatacttagcgtggacccaacccaatttgagacaacgttgcaatgatttttgccgcaccaaaaaaaanaaaaaaaaaaaaaaaaaaaa

SEQ ID NO: 8772 - DNA, 618 bp, Sorghum bicolor
  misc_feature (604)..(604): n is a, c, g, or t
  Predicted polypeptide sequence is orthologous to G21
gattagaaattgaaatcgaaaacgcagtcgcgtgcagaggtgttcctctgttcgtcctcgtgctcacttctcgattccattgcgatgctcacgtcccggtgatcaccggcggccaggggcttacagtggtatcagaagcttatcgatcctcggcctcacaatccctacccaccctcccgtagcgaatcggagttcatcggagcagcaggtcggaggcggaacgagttctcgcagcagcttcggccgccgcgaattaacctcgcttctgcgtcgatttctggttgtctcaccttcgattcgttacccacccaccccacccaccaaatcgaggtccggatctctcttcgcgcgcgtcgtcttccccatcggcggcggcggcttcttcaccattctctacggcgacgcgtccacctccaccagcgtcgtcgtcggcgtctcttcatcgactggggtctgcatcgacactagggttcggcggcgtgaaccactgtgagcttattcctcttcgctcactactttctgtgatactagcgtcgatttcgacctagggttgcgtagcaattgtctgcgtgtaaaattccgtaagtcggcttcgatttgctantggtggcgtgtggt

SEQ ID NO: 8773 - DNA, 958 bp, Sorghum bicolor
  Predicted polypeptide sequence is orthologous to G2107
cacagctctagcaggaccgaccaaaggcacccgcaccatccgcggctcaagcaagcagagaagtgatcagaagagaagatgtgcccaatcaagaaggagatgaccggagagtcgagctccccctgcagctcagcctcgacctcttcggagcaccaccagacggtgtggacgtcgcgaccgaagcggcccgcggggcggaccaagttccgggagacgaggcacccggtgttccgcggcgtccggaggcggggcaacgccgggcggtgggtgtgcgaggtgcgcgtgccggggaggcgcggctgcaggctctggctcggcaccttcgacaccgcggacgccgcggcccgcgcgcacgacgccgccatgctcgccatcgccggcgcgggcgcctgcctcaacttcgccgactcggcctggctcctcgccgtgccggcctcgtacgccagcctcgccgaggtccgccacgccgtcgcggaggccgtggaggagttcctgctccgtgaggtggtccaagaggacgatgcgctttcggccacgtcctcgacgccgccgtcgtccccgtccagcagcgacgacggaagcacctctgatggcggggagtcctctgaatctgattcgtctccggccgccaccggggcctcgccgttcgaattggacgtgttcaatgacatgagctgggacctgtactacgcgagcttggcgcaggggatgctcgtggaaccaccgtccgcggtcaccgcgttcatggacgaaggcttcgccgatgtgccactatggagctactagagactctgaggccgttgtactctgaaattttcggtttctaaagcttggcctctaatggctagttttggcagtgtaacggttacttcatttggtaatgatgagacagaccaagtttgggaaaaaaaaaaaaaaaaaaaaaaaaaaaaaaaaaaaaaaaaaaaaaaaaaaaaaa

SEQ ID NO: 8774 - DNA, 1046 bp, Sorghum bicolor
  Predicted polypeptide sequence is orthologous to G2107
caacattctagacaccactcgaacgatcgccacttcaccaccgccgccgccgaatccatggagtacggcgtcgccgacgactacgggtacgggtacggcgggtacgacgaccagcaggatctgccgtcgtcgtcgtccgtggacggtgacgagtacgcgacggtgctgtcggcgccgccgaagcgccccgcgggtcggaccaagttccgggagacgcgtcacccggtgtaccgcggcgtgcggcggcgcgggcccgcggggcggtgggtgtgcgaggtccgggagcccaacaagaagtcccgcatctggctcggcaccttcgccaccgccgaggccgccgcgcgcgcgcacgacgtcgccgcgctcgcgctccgcggccgagccgcctgcctcaacttcgccgactccgcgcgcctgctccgcgtcgaccccgccacgctcgccacccccgacgacatccgacgcgccgccatccagctcgccgaggactcctcttcctccacgccggacgcctccgccgccgccgctgccgtggccgtggcgtcatctgcctccgtcggccaggccacgccctcgtcgtccgcgtaccaggccggggacgacgccacgggggctgcaatgtatggcgccgagtacgcggcggcggcaatgtatggcgctggcatggacttcgaccactcgtattactacgacgggatggtgggcgggaacgagtggcagagcgccggcagcagcgggtggcatagcaacgtggacgccggcgacgacgaaggcgccggcgacatgtcgctctggagctattactgagctctgcactgcaccagcacaaattcaggtgctggggctggcgctgataggggcaggggagtctgaatttgaattcaaatgttcgtagtagtatacacgagggaacggcgaaagggcgcgcaagaatgcatttgccgttcttctgcctttttttttggtgggagagaataataaaagacctgcaactctgccaagagtttatactatttttttaaaacataaaaaaaaaaaaaaaaaaa

SEQ ID NO: 8775 - DNA, 619 bp, Sorghum bicolor
  Predicted polypeptide sequence is orthologous to G2141
gcacgagggctggtgaagacaattccagctccaaaattcctgacacggaaggccagaaaagataacgcacaaaacagggaaggcaacctgatgacctctggcagaaatgttcactttggtccatctgtgccatctgaatccatacatgcagctacgagagggaccggtagtgatcaggctgtctcaagacatcagccagaactgaagcgaactactacaaccataactggaaagggccatcaaactacaggatctctgggagaagagctgctgataccactagacaacagcaatgtgaacattcatcatctaattctagtccaacaccccatacaaatcgatctgtgtttgacacacttgaatcgtcatcaaggggctcccagaaaacagtgaatcaagaaacaagctctgacaataacaagatgagaccagaaaggaatagcacccaggaagaaggtatatctcattcagcagcagcagcagcagaaccaccaaggaataacaacttcctattgcataataagacagagataccagaacatagtcctgggtctgcttctcctatgcactgccatgatgatatggacatcagttcagacttgcatactatggagaagtc

SEQ ID NO: 8776 - DNA, 881 bp, Sorghum bicolor
  Predicted polypeptide sequence is orthologous to G2141
aagagagaagattagccagaggatgaagtttctacaggacctagtgccaggatgcaacaaggtggttggcaaggcactcatgctcgatgagatcataaactacgtgcaatcgctgcagcagcaagttgagttcctgtccatgaagcttgccactgtgaacccgcaacttaatttcagcaacctgtcgactctcctacacaaagatatgtaccaaccatgtggcccatcagctaattcggtctttccattggaaggtgccggtgcagcttttccattttgtgaccaaggggatcttttccagaactttggttcgggtgctatggaggatcagtgctctctaagtctgttagacacggctctaccccacacggccaacccacagtttgcttttcaaaagcagcaaagggacttctgggaggatggcctacagaatgctttgcctaccggtagtgagcaaagacaggaggatgggcttttagtaccgaactttgatggtcagttacaagctgatcaggcaatgattgagttctagtccctggtgatctccaaggttgatatttttgtatataggcggtacgaagaagacctgtggcgagcaaagctctcctaagctgaccatcattagagtttaggcctccaaactgattcattctgtgatatgctggatgtttggcaactcgattcttcccatagagaccttgtgatcgatctcgcaaaattgaagtagattgtgtactagatatggtgcaaatattacatgcaccatcttctaaagttctactaatatgtaagagcgctggctggtattgggacgatgccgtgttactgtttgttgcatttttatcttatgatgacgaaagtacaagtatgagattttctcc

SEQ ID NO: 8777 - DNA, 637 bp, Sorghum bicolor
  Predicted polypeptide sequence is orthologous to G217
aaatgaggagctctttaggcttcttgagcatgataatgcaaaatatcctcttgatgaaaaaactcaaaaagagaaaaagaaaggaagcaagcgtcagcaaaatggaggacctcttgtccctgaaattgaggattttgatgaagatgaacttaaagaggctagttctatggttgaagaggagattcaataccttcgagtggccatgggtcatgaaaatgaatcgtttgaggacttcgtgaaagcacatgatgcatgccaagaggaccttatgttttttcctaccaacaatagctatggtttagctagtgtttctggaaatgctgataaggtttctgctttgcaaaatgagtttgaaactgtgaagaagcgaatggatgatgaagcaaaaaaggcttctcggcttgagcagaagattaagctgctgacacaaggatatcaggtaaggtctggaaaactgtggtcacaggtccaagatacatttaagcagatggacactgctgcaacagaactcggatgcttccaagagctgcagaaacaggaacatcttgccgcttcataccgaatcctaaatttgactgaagaagtgaataagcagaaagcactagaaaggaccctccagagccgctatggtgagctt

SEQ ID NO: 8778 - DNA, 745 bp, Sorghum bicolor
  Predicted polypeptide sequence is orthologous to G222
tgcagtgcaactgcaactgcaagctctcgctctctctctctgctcgaacggcttgcttcgaacccacttgatcgctgcgtgcgtcgccggctccctcagctcagctctccccgtaccgtacgtgcgcagttctcggcacgctaccccatatatacccccggccggtctcggccggatagagatgcacaggcggcagtgacgacggacggactagggtagctgctcctcagctatccagatcgttcgttgccttcagccttgcttccttccgtgtcgggcggaggcggacgcggacgcgcgcagcagcagcgggaatgggacgccacgcggcctccggcggcggcggcggcgtgcagcagaagctgcgcaagggactctggtcgcccgaggaagacgagaagctctacaaccacatcatccgctacggcgtcgggtgctggagctccgtgcccaagctcgcagggctgcagaggtgcggcaagagctgccgacttcggtggatcaactacctgcgccccgacctgaagcggggcagcttctcgcagcaggaggaggacgccatcgtcggcctccacgagatcctggggaacaggtggtcgcagatcgcgtcgcacttgccgggccggacggacaacgagatcaagaacttctggaacagctgcctcaagaagaagctgcgccagcgcggcatcgaccccagcacccacaagcccatctccgccaacacggcggcggcggcattgga

SEQ ID NO: 8779 - DNA, 781 bp, Sorghum bicolor
  Predicted polypeptide sequence is orthologous to G2226
cgctggcggggctggtgcgcaaggcgctggtgttcctggacctccaggacgacgacgccggggaccgcctcgtggcgtcagcgcccggcctgggcctggcggaccggttcctgagggcgttccggccggcgctgtacggggtgctggtgtcgacgtcgacgacgtgcagcgcggcggaggcggacggcgacgactgcagcgtgtgcctgtccggtttcgtggccaaggccgtggtgaaccgcctcccctgcggccacctcttccaccgcgcctgcctcgagacctggctccggtacgagcgcgccacgtgcccgctctgccgcgccaacgtgcccctcccgcccgaagagacgcccgtgctccgctacccggagctcgagtgatccggtccccctcctccggcgagcggtgacccccccccgggcggggctcggggtcgggctcggccgtcgcgcgcctcggctgtgtgctgcaagctccgtgtggccttccgtgtgtgtgcgcgtagcaaaaaacaaagtataggagcagtagtagtagagttgctgttgctttccccccctttccctttcccttctcgttttgtgttttttttttccttgtttttcttcttttccccatttctcttcttgttgtttccgtgctgtcgctgtagcgtgtaaatactgcagttcgcacttcgcagcagagagtagagtgctcccgtggctgtgctcatggtgtagcactttttacgagctcagctcgtgtacattgcaatgcatgcttcaattcaactccc

SEQ ID NO: 8780 - DNA, 898 bp, Sorghum bicolor
  Predicted polypeptide sequence is orthologous to G227, G242
ttccgttcccttcccagttcccactccatctctcttctagttttcttcctcctcttctttcttcctgcaccctttggtactagccatcgctcccatccaagctcatcgtcctcacagatcgaccgacggatcaggccacacgcccccaatcaatactcactcaggactactagctagcttcgagtaagcaaacaaacatggcgtcgtcttctccgtcctgccgtggcggcggcaataaggcggacgtggaccggatcaagggcccctggagccccgaggaggacgaggccctgcagcggctggtggcccgccacggcgcccgcaactggtcactcatcagccgctccatcccgggtcgctccggcaagtcgtgccgcctccggtggtgcaaccagctgtcgccgcaggtggagcaccgccccttcacgcccgaggaggacgacaccatcctccgcgcgcacgcaaggttcggcaacaagtgggccaccatcgcgcgcctcctctccggccgcaccgacaacgccatcaagaaccactggaactccacgctcaagcgcaagtactacgccgcttccgccgccgacggcgatgcggcaaacggaggtgcagcggatgccgacgacgagcgcccgctcaagcgcaccagcagcgacggacacccggggctctgcttcagccccggaagcccgtccgggtccgacctcagcgactccagccaccacagccttccctccgtcatgccgtcagccgcttctgctgccgctgccgtcgtcacctcccagcagcagcagcagcagcacgtgtaccgccccgtgccgcgcgcgggcggcgtggtcgtgctcccggtggcgccgcctcttgcgccgcggccgccttctcctcctcctcctcctccgcc

SEQ ID NO: 8781 - DNA, 727 bp, Sorghum bicolor
  Predicted polypeptide sequence is orthologous to G2344, G929
ctttttttttttttttttcgattgacacttatttttattttcattttgtacaatatctacataagcagaagtcaggtggctaattaagtcatacctgagctcaggcctttctactttacaagcattaaactaatcttatcctatccccgtgacccctattctttgtgctggtcgtgcacatccgcaacgctgtgttcaatctcggagtgcatgccgaccagttcagggtgcgcgagtggatcagcttgatggtgctcctcggtcatatgatcaggctgactcacgtggcctgcatcgtgacttgactcctcctgcgagcccttcttagagtcgtcgagatatgcttcactgtccgcgcccattgacgcgttgttgtcgcctgaagacgcctcgtcctcgccctcctcgccattcttcttgcgttgaaatcgaccgctcttgccgcgccgcctgtttgtggcgtgtttgtggcgagattcgtgtaaatatggcttgcgttgttttggcagtttgttttcttgttcgagtttagcgcgttgttgtcgtcgcttcagaatgcggtggtattgtttggcattgacgtataacggttcctctactacttcaggctgtgctactcgttgtgtatataaattgaggttcatatagttgtgtgccgcattttcctggatagatgtgacatccgcgtcagcaaaatcgaaataacgcaatgcacactccgggcacg

SEQ ID NO: 8782 - DNA, 773 bp, Sorghum bicolor
  Predicted polypeptide sequence is orthologous to G2344, G929
ttatgtaaatgccaagcagtaccatggtattttaagacgacggcagtcacgtgccaaggctgaacttgagaaaaaggtggtcaaagccagaaagccataccttcatgagtctcgtcatcagcacgcgatgaggagggcaagaggaaatgggggacgcttcctaaacacaaagaaaagtgacaatggtactcccaatggtagagctgagcctaagaaaggagatggtaactccgagcatctccatgtccctcctgacttactacagctacgacagaacggggcttgaagtagcgttctggctctggcatcctagaacagcagtttctgcccacaggcataggcatttgaaaccggactcgtagctccacagtatgcgcagccatatctgcggtaacgctcgttcacctgaatgagctttgtaccgaggtaggcatgcaatgcaatctgggcgcaggagtccatcaggtgtccaatgccatatgggtgtatgctgtttcaggcaattcattcttggctttcacgttccaccacccatgtgtagcgctagtgtgttgtaagtgaaactaagcttgtgctctgtattgggccgttcggcgaaactgtgaaacatctgtataattaagatcgaactctggattaactcggtagtgctttgtctggtttttcttttagcttttgaactgtaacacggccacagctgaactcatgttggctttgttcgttgctcagcaacgtcggtcttgtactcttgtactgagtattcatgtgcttgc

SEQ ID NO: 8783 - DNA, 738 bp, Sorghum bicolor
  Predicted polypeptide sequence is orthologous to G2344, G929
aatgccatattaagaaggcgtcaatcccgggctaaggctgaatcagaacggaagcttgtcaagggccgtaagccctatcttcatgagtcacggcatcagcatgccttgaaaagggccaggggagctggaggtcggtttctcaattcaaagtcagacgacaaggaagagaactccgactcaagtcacaaagagaaacagaacggagttgcgcccaacaatggccaaccgtcaacccctccgtctcccaacggtgcatcatcagctaatcaggcaggcagtcgtgaatgatgattcagaactcacaaccgaagagattttagcccctgacgctagatgtggcatcagttttgtacagtaagtgctagcgggcagcagcgggatggtgtcagtcggttgttgtaggacatgttccatagaaaaaacatagatgagtcgacaggttttggagtattggtctggtcctctgtttattcacctttctgtacaattttagtattattgtgccccttcccctggatagcttcggtcagcgcttaagaaagttaagtgtgtagcatattggcttattttttttgctttgcttggacttggagatttggtagtggagttcataaccctactgtcctgcatcatcattcgtggggcaaattataatactcctagctggctatgtgtatgttgatgacaataaaccctaatgtaggacatgtgaccacctcatctgaatctagctttgtt

SEQ ID NO: 8784 - DNA, 621 bp, Sorghum bicolor
  Predicted polypeptide sequence is orthologous to G2394
ctactggatctaataaacgttgccgcaccgccgctggagactgtgaagcggaggaggaagaattcgagtccaagtcttggagctgcccccgcttgggtggagtggatctggccttctactctaggggaaagagcaaagcacattatcttgtaaaaattagcattttcctacatttatctcaaatcaaatcatctctgcttctgggaacagcaacctgtaatttcccatgcaacctcttggttgatggatgctcttcctgttgaatcagaaagagaaagtcaaacagatagtcaccctttactcatggagcatgtgattggcatcccaagggatgatgttgcttctacatcaacacctcgccgagacaacaatgatggcatggatcacttgcctcgtgattcagaaagttcttccggaacaactgctgcatataactccccgaatactcctatagcaagaagagatgataatcgccgtcgccgtcaacagagtctgaattctggcttctggatatcaattgaactagctgtaaatcttagccagattatagctgctatctgcgttctgtctgtgtcaaggaatgaacatcctcatgctccattgtttgagtgggtcattggt

SEQ ID NO: 8785 - DNA, 722 bp, Sorghum bicolor
  misc_feature (46)..(46): n is a, c, g, or t
  Predicted polypeptide sequence is orthologous to G2394
catgcttcaagctcagagcatcttgatgagggcggcatcctcggcncaggaactaagaaggaaagagttgtttcagctgaagatgctgtgtgctgcatctgtctaacaaagtatggagatgatgatgagctccgtgagcttccttgcacacatttctttcatgttcaatgcgtagataaatggctcaagataaacgcagtgtgcccactctgcaaaacagagattgggggtgtggttcgatctttcttcggtttgccatttggccgccgccgtgtcgataggatggctggaagaggtgtagcttgctcaagattcaatgtatagaacaatgttgcttttctgtgatatcctctcttacgcataaagagccatgctcatgttgttgcaatggtttgattgactgtcaagaaaagcactgtgtgattgacttcaagacaatgacacctagtgaggaacctgatgctcctaggcgcaagtttctgcagaaatgtgaaggacctaaggtgctggcgtgctgctatactctgatgtaacatttttccaaggatgtaaatgaggaacatgaagttcacttgccaggtatattgcaagcaacttcacaggtcttctagcatcggccttggtgttctttactgccagttctgtgattctctttatcacggcagtgcactgcaggcttggtaaaatgtgaaataaaaggcaattgcctatatttcgaaccc

SEQ ID NO: 8786 - DNA, 794 bp, Sorghum bicolor
  Predicted polypeptide sequence is orthologous to G2394
aaatgctgtgcttgctaatcctaggattattgcgctgtttgaccacttcaagatggccctggattgtttctttgccgtctggtttgttgttggaaacgtgtggatattcggtggccgttcttctgctgctgatgcaccaaacttgtacaggttgtgcattgtgttcctcactttcagttgcattgggtatgccatgccgttcatcctctgtgcaatgatatgctgttgtcttccctgcattatatctgttatgggttttagagaagatacaaacaatacaaggggtgctacctcagaatctatcaatgctttgcctacatataaattcaaaaccaagaaacgccgccatggttcaggaagtgaagctgaaggacaagaaggagggatagtggctgcagggactgacaaggagcgatcgctttctgctgaagacgctgtttgctgcatttgtcttgcaaagtatgcgcacaatgatgagctccgtgaacttccatgtgcacactgtttccacaaggattgtgttgataaatggcttaagataaatgcactttgccctctatgcaaatctgagatagcgggctcgtctggtacttctgatgctcgtcaattagatcagaacgccattcctgtgcaggagatcgaaatgcattaggttggtctgctctctcagcttttcacataagaatacatctgattgtggctccccgtcttcatgtataaagttggagattgatgtatggaatgtagtgacacatagttttttttaatcactgctatctggagaagttacagct

SEQ ID NO: 8787 - DNA, 842 bp, Sorghum bicolor
  Predicted polypeptide sequence is orthologous to G2394
gcgaggaaggcgactccttcctcgcggccgcccgcctcgaccccgaccccgaccccgatcgcttcgcctccgcgcgccgccgccgcgcgcgcagtgtccatcaacacggccgccctccgtgtgtggggcgcatctggtgctacctcgccgggctagggttggctttacccccgtctaccttttccgtctcgtctgacgcgcgcaggctccgtgcacgcggtcgtcggctctcgctccggttctgactgcgcgccgtcccccgcttgctccctcctgctacgggtgggccactgctgccgtcgcgtccaccgacgaattcccctacagagcaactatcttggagttggagatctatacctgaagattcatttgaaatctggaagcttctgttgttgggtacagagaaatatttcctgccttttgaggaagactgcagatcttctaaatgtgaaatttgcttcttttcttgtctactcctgaatgctgatgaactcagcctctcacgttacttagctcaaggtcgtactggtacggacactgaggatggagcaagcaacaggtgtaagtggtcctgagcacataattgatattccaagggaaattggtccttctgcttcggtttctcgtagtgttggtagagagaaccatgaagaattgaatcccgtggacaggccttcaacaagagctctagtacctgccttgcaggcaccatcagcaataggtgccgtacctaatgcagggcagacttcaggcactaggagaaatgataactatgttcgtcggcacagaagccctttgaattctggactgtggatttcaattgaagttatcgtcaatgtgag

SEQ ID NO: 8788 - DNA, 767 bp, Sorghum bicolor
  Predicted polypeptide sequence is orthologous to G241
cgcgaccaggacagtgctcccgtccccaaagacaaacaaacagggcaagcagcaagcacacgcctctccctcctcgccctgcctagctgcattcccccacacctcccctcgacacagacaagccaatctagcaaagcacacagctgaagcagacaacactcgtcggaggaggagatccagtagcaccaaataatggggagggctccgtgctgcgagaagatggggctcaagaaggggccatggacgcccgaggaggacaagatcctggtcaaccacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaagaggacgccatcatcaccctccacgagcagctcggcaacaggtggtccgcgatcgccgccaggctgcccgggcggacggacaacgagatcaagaacgtctgggacacgcacctcaagaagcggctggagcccaccaccaagccggaggagcagcacggggcgcaggcaggtggcgccggcaagaagcacaggcccaagcgcggggccgccaagaagacgacggccgacgacgtcgccgtcgtcccagctaccaccgcgccggtgtcgcctgaacggtcgccggcctcgtcgtcggtgaccgagtcgtcgtccatgacggagcaggagcaggagcagggcaacacggggagctc

SEQ ID NO: 8789 - DNA, 688 bp, Sorghum bicolor
  Predicted polypeptide sequence is orthologous to G2457
cccaaatcgcgccggcagatcatgtgtgctatgtgcactgcaacttctgcaacacagttctcgcggtgagtgtcccggggaatagcatgctcaacatcgtgacagttcggtgtggacactgcacaaatctactgtcagtaaacctgagagcactgatgcactcactcccagaacaagatcagctccaggagaatatcaaggtccatggcgtcaatggcaccttgcatgatcagtgcggccatttggagctcggttcttcttcgtcctcaaagttccgacttccaatgatgtactcgccgcaaaacgagcacctgctgcaggaacaaacactgaataatgctcgtcctccagagaagaggcaacgggttccatcggcgtataacaggttcatcaaggaagagatacgcaggatcaaggcgaacaaccccgacattagccacagggaagccttcagcacagcagccaagaattgggcacattatccaaatatccatttcggtttaaactccggacgagagggtggcaagaagctcgtggatgaggctgttgcagcagcaccggctccgaaaaagatccaaggtttctactgatagatgtccgagctcatcaatcatcaactgggtggaagaattaataccacaaattataatttctgtaagtaaagaattaagggggaaagggaaagtta

SEQ ID NO: 8790 - DNA, 780 bp, Sorghum bicolor
  Predicted polypeptide sequence is orthologous to G255, G664
cacctcgatcgcactcgcagcagcagcagcagcagcaaccaacctccactgccgcccgcaacgcacccgagaggcgaggagggggaagaaaagcggcggcggctgccaaaaggaaggaccaggaaagcagcaggcaaggtagcagcatcggattggttgggtgcccggccggccgagcgtaccacaacacctccatcatggggaggtcgccgtgctgcgagaaggcgcacaccaacaagggcgcgtggaccaaggaggaggacgaccgcctcgtggcgtacatcaaggcgcacggcgagggttgctggcgctcgctgcccaaggccgccggcctcctgcgctgcggcaagagctgccgcctccggtggatcaactacctccgccccgacctcaagcgcggcaacttcacggaagaggaggacgagctcatcatcaagctccacagcctcctcggcaacaaatggtccctgatcgctggaaggctgccgggaaggacggacaacgagatcaagaactactggaacacgcacatccggaggaagctgctgagcagggggatcgacccggtgacacaccgccccatcaacgagcacacgtccaacataaccatctcgttcgaggcggcggcggccgcgcgtgaccgtgaggagaataagggcgccgtgttccggctggaggagcacaacaaggcgacggcggcggcggccgccgcgatcggccgcgatcatcatcagaaccaccaccccgccggcgactggggccaggggaagccgctcaagt

SEQ ID NO: 8791 - DNA, 949 bp, Sorghum bicolor
  misc_feature (40)..(40): n is a, c, g, or t
  Predicted polypeptide sequence is orthologous to G255, G664
tcgctcccctgcccgccctgcgcagccgccgcccgcctcntcacacagcaaagcgatagccaaagcgaaagcgaaaagcgaggcaagaagcaggccgatggggcggtcgccgtgctgcgagaaggcgcacacgaacaagggcgcgtggaccaaggaggaggacgaccgcctggtggcgtacatccgcgcgcacggcgaagggtgctggcggtcgctgcccaaggcggccggactgatgcgctgcggcaagagctgccgcctccgctggatcaactacctccgccccgacctcaagcgcggcaacttcaccgccgacgaggacgacctcatcatcaagctgcacagcctcctcggcaacaagtggtcgctcatcgccgcgcggctcccggggcggacggacaacgagatcaagaactactggaacacgcacatccggcggaagctgcttggcaggggcatcgaccccgtcacgcaccgccccatcgccgacgccggcgccggcaccgtcaccaccatctcgttccagcccaacaaacccaacgccgccgtcgcagcgcaggcgccacaacatcagccgatcaaggcggtggcgacggccgtcgttaaggtgcccaggtgccccgacctcaacctcgatctctgcatcagcccgccgtgccaacagaaggaagacgaggagctgggcctcaagcccgccgtcgtcgtcaagcgggaggtgctgcaggccggccatggcggcagcctctgcttcggctgcagcctgggcatccaaaaaggagcccccgggtgcagctgcagcagcagcaacagccaccaccgcttcttggggctccggtccggcatgctcgacttcagaggcctcgagatgaagtgaatgaataagccgcccatggccatacgatcgatcgaaatggccagcagccgaatcttctccttcgtttggtttggg

SEQ ID NO: 8792 - DNA, 829 bp, Sorghum bicolor
  Predicted polypeptide sequence is orthologous to G2574
gaggtacggccaggaaagccattgcgtgccttgccgaaagctgagcggagctagctagctgctgctcgatcgagaagggaggggtaggccggccgttgcggctagctagctagcttggttggttggttaagttgccatggaggtcgccgtcgaaaggccgccgccggcgccgcaggtgaaggcggaggagaagagacccgacgccaagccagagatcgccgcccggccaccgatggtaggaagcgctcttccgatagtcttcgaaagctttccatcgacgcaaagagacgcggccggcggcatcaacgtcaagcaggaggaacgcaggctggaggcggccagggcggagatgggcgaggtgagggaggagaacgagcgcctcaagtcgatgctgtcccgcatcgtcagccagtaccagtccctgcagatgcactttttttacctcgtcaaggtgcaggagcaagcatcgtctgcagccaaggtggccgagaagaagctccccgtcgcgccggcgccggcgccgaatcccggcaccgacgacgacggccccgacgacctcgtctccctgagcctcggcaccagggcaaatagcggtggcgcaccccgccgcaaggggcacgagaggtcgtcgtcctcgtccggcaccgctgagacaaccaccgccgccgacgctgatgaccaaggccaccaccagctctccctcggtcttggtttcgcgcgcggaaacgggctgccgtcgtccaccacgacggccacggacgacgacaggcgagccacgcgtccacggcgcccgtcctgaaactgacctccgacagcagcggcagtgccg

SEQ ID NO: 8793 - DNA, 413 bp, Sorghum bicolor
  Predicted polypeptide sequence is orthologous to G2579
ctttttttttttttttttttgcatggccgcatggggttcaacttcgtctgtcaacaaaagacatcccaattatgtgctgttatactgcaagtttgtgtcaaacagacaacgggactccattcaacaacagagttggatacccccaacgcagaattgtatagacagccaatagggcgctttattaattcatcctttgtagggggaacttgaaacttcaaaggatagacagccaatagggggctttattaattcattctttgtagcagaattgtatagacagccacggaattctccctgttgctgctcctgccattgattcagtggcgaggatgctactaccaaagagtgagcccatggcctgggggcctccgtgaccttgaaggataaaaaatcagatcccgtaggatggcaac

SEQ ID NO: 8794 - DNA, 670 bp, Sorghum bicolor
  Predicted polypeptide sequence is orthologous to G26
taattgttcagatctgccatggcaatgatgaatttggggaaagctttgttgaggttaaagtatctgaggcagacttgagcagaaatcctgtaagattaactgagatcgagagctcggatggcgactgcatcttcatgagcccaagcagcagcaagtcattccgttgtcattatggcggaggtggaggtgaaggtgatcttatctatatctttttgggtccctcccgattagtctacaacatgaaagatggtactatggcaccatttgctgcagacataccagaggacaaacttagggaagcagatggtaaaccgatgaatccagtatggttatttccttatgaatgaacttgtgcatatcaactctgttagtctgatcctgtaatgagtcttaacgttagaagcactgatgccaattggggctaggggccatgatgtcttatttctcagagctgaaacaagttttctgttgttttatatggtctgttctgatgattttttagtagtaaacttatgtgtacttcttctgttttcaagttccaatgtggatttttattgcatttgcactcttgccttgtgggggagtctactagttcctatctagatgagcatcggtttcagatttgctggacaatattatgctgatgttcctctataccaaaattctctgc

SEQ ID NO: 8795 - DNA, 541 bp, Sorghum bicolor
  Predicted polypeptide sequence is orthologous to G2604
catcaacgaggttcaggttggagtttactttcctttggattgggacaggataagggccgctcgggatcatgagactcagtacaagatacttgaggaagaaggccaggaagcaaggcgcaagaaaggtgagctcaagaagaaaatccaggaacagctagctcagaatacaaaccaacccattgtgacggtgggctgagtacgtctggaacagccacaggctgattcgatgatccgtacaaggctgaagacgatcagagcgggctgcctgggagcaacagccaggtgggtccaaatccaatatggtacctacgtgggtgcgtaccgtaccagtgcatgtgccgccattccctgatatatatcatatatgtgctatgcgcatgcatgttgttcatttctgttttccaaaggattggtggtgtacgtgtctgtgcctgcgcatgttgtaaacaagtactgtatttgaatacagcctcttctacctatttcttcttggtttctgtattataaattgaagatgcttttacgagacaagaactccact

SEQ ID NO: 8796 - DNA, 564 bp, Sorghum bicolor
  Predicted polypeptide sequence is orthologous to G2604
gtgccgtttgcagcaccgtcactgccgtgccggctccaggaactgagatggcacagttagtttgtggaggatgccacactctcctgatgtacttacgtggtgcgactagtgtacaatgttcttgctgccacaccgttaacctggctatggaagcaaatcaagttgcgcatgtaaactgcgggaactgccgtatgctgctcatgtaccagtatggagctaggtctgtgaaatgcgcagtctgcaattttgtgacatcagttggggcctcacctggtgcagagcagaagcccagcagctgatgatagtgtccctgaaaatactgagatcacctatgaaggcagcttctgaaaggatgctttgagtgcacatgcatagagttcttccctgaagcaattctttttttttctctcctcatctccattctcccccatccacttctgcgttccttcgatgaatctggcgaacccgcagaataaatgagagttttggaaataactagggctcaacctcgtcgacttgtccataaaatcaaatgagacatatataaacctatggtattttctc

SEQ ID NO: 8797 - DNA, 656 bp, Sorghum bicolor
  Predicted polypeptide sequence is orthologous to G261
aaatgcagtcctgtacagatccacgaactaaggtgtctgagattgatgttaatatggagcctgctgttacagaaactggtctatcaagggaccaacctgtcgaggagcctcctcatgcagcaactggggtaaacgatggcttttggcagcagttcctcactgagcagcctggttctgatgcacatcaggaggcccaatcagaaaggcgagatggagatgataaaggcgatcagacgagaataggagatcgggaaaaattttggtggggaaagaagaatgttgaacagatgacagaaaagctggggcatcttacctcggtggagaaaacctgactgtttgtattacttgtagttgtaggtgaaaaaacagttagtacagaaacacataggacgttggtgcctctgacatgtactttgcagtgtatcatatcttcgccacctgcacctgttgactgacatcgaatttgtagtcatacttttttcccttgtactttggtcgtgttaagaatgatgcagagactagttgataatatacttttgttaggagtgctgcattcatacttggtcagtagacatttcttggtactgctgtccacagcttctatgatttttcaggtttgtcgacgtggctatatatgtagatgataatattcactt

SEQ ID NO: 8798 - DNA, 684 bp, Sorghum bicolor
  misc_feature (65)..(65): n is a, c, g, or t
  misc_feature (80)..(80): n is a, c, g, or t
  Predicted polypeptide sequence is orthologous to G2682
gcaataaacttggtggtctgaagtagggcattccttgtcgacggcttgagaagcgcattttccangaaacacagccgagnagagtagccagagtagaattcgcagtcagagttgcttgagcaagggtctccaggcaagttcttagagctcttttggcagacattgttctcacaagtgtagtcgtaagtccaagcagggttggcgttgacgtctccacattcagatgaagaattgcaagcagatccaacgcccttgacagaagcgcatttgccattgtcagtgcaataagcattgctgtagcaagagtatccagtgagggctccagtgtaaggagttccacaactgcagttagagagttgtgctaaacaagagtcgtgataggcgctagagtcacaagtggcgtctttagcggcggcgtagcagttaacgaaagtagtggcgcaagcgcagagggcggtttgattttcagcatttacttggcagtcaattaaagcagaaacacagtctgggcatccagcagaacacgatcctccaacgttaacgcattgatagtttgcatcttggcatgtaatagcgtcagctctctttgaggtcttggaaactccagcgctcaattgttcatagagagaagatgcaaaacaagatgagaagagaagtgctacaatgattaacgacttcatgttt

SEQ ID NO: 8799 - DNA, 767 bp, Sorghum bicolor
  Predicted polypeptide sequence is orthologous to G274
tgggtgatgaatgttgtgccgaccatcgcaaagatgcccaccctgggggctgtgtatgagcgaggattgatcggcatatatcatgactggtgtgaagctttctctacttatccaaggacatatgatcttatccatgctagcggtcttttcaccttgtataaaaacaagtgcagcatggaagatattctcctggagatggaccgcatcttgaggcctgaaggtgctgtcataatacgggatgatgttgacatcctgactaaggtgaacagcctcgctctgggtatgaggtggaacacgaagatggttgatcacgaggatggccccctcgtgcgtgagaagatcttatatgctgtgaagcagtactgggttggtgggaatcagacagctgtagcttgaagcaagcacgtttccgaggttctaacatgaggaattctgcaacccaaccttacccgacgatcaagaattaccttaggagtcatcctgtggcaaggaaaatggtcagcccttgtaggggtagcactgaagcagccaggataccgtacttggtggtgatcgctgcaaagcctgcaaccacataatgtcggtgacaaatttttggaattcttcgttggttgtgtactctattcaaaagcttgtatcttagaaaatttctctacggtccgtactgattcgagtgtaatttattaagtagagtagctttctgtaagcaagaaatacaaggttttttggacaacccaggtatatttatctacacctgaatgatcctg

SEQ ID NO: 8800 - DNA, 732 bp, Sorghum bicolor
  Predicted polypeptide sequence is orthologous to G274
atctcagaaagaaagcaagggcacagcacatcacttgacttcatttactagcaacaacctgagtggggcttgctggcactggcgagcggcgcggcgcggcaccacaccagagcacgctgaggagagagagagagagattcatgaggggatcaagaatgaatccaggtgaccgtagaacacggagcacgatgacaatagtaattgtgatgggtttatcctgcttcttttacatactaggtgcttggcagaaaagtgggacaggaaggggtgatagtatagctctgagggttaaccaagaaactgactgtacaatcttgccaaatttgcactttgagacccaccataccataagtggcactaatccattgatcatgtccaataaaatgattgagccatgccacatccgatacagtgactatactccttgtcaagaccaggaccgagcaatgacctttcctagagaaaatatgacatacagagaaaggcattgtcctgtagagaatgaggaactgcattgtctaattccagcaccaaaaggatatgtcacccctttctcttggcccaagagccgtgactatgttccatatgcaaatgctccgtataagagtctcattgttgagaaagctgttcagaattggatccaatatcagggagatgtgttcaaatttcctggaggaggaacgatgttttccaatggagcaaatgcttaccttgatgaacttgcatctgtca

SEQ ID NO: 8801 - DNA, 692 bp, Sorghum bicolor
  Predicted polypeptide sequence is orthologous to G274
aagagagagagagagagagcagccgcctcaggcctcacagcccacagcccccgcctcattcgctccgccgctggcgattggtgaagagagctccgaggtggtatcccttgtatcgcatcgcatagattccgggctctactcgtcgcggttccggcgaggtccgcctatccgcgccccgctctggatctccggttgatttgttgttctgcaaggtggtatggcacgaaacttgactgagaacaggaccagaaatacattaattgtgattgtgattttgggcctctgttccttcttctatctcttgggtgcttggcagaaaagtggttctggaggaggagacaaaacacatcagtgggtcattgagcagatgaaatgtgcacagctcccaaatctgagttttgagacccatcatagtgcatccaaccttccgaatgatactggtagttccaaaattgaacctttcaagccatgtgatgagcagtacactgattacactccttgtgaggagcaaaagcgtgcgatgagcttccctagagataacatgatctatcgggagaggcattgtccactggataaggagaagcttcattgcctgatcccagcaccaaagggttatgttactccttttcgatggccaaagagccgtgattttgttccttatgccaatgtaccacacgagagccttactgttg

SEQ ID NO: 8802 - DNA, 658 bp, Sorghum bicolor
  Predicted polypeptide sequence is orthologous to G2791
gacaggatgaagaatttgcaggagctcgttccaaactccaacaggactgacaaggcatccatgcttgaggagatcatcgaatacgtcaaatttctccagttgcaagtcaaggttcttagcatgagcaggctgggcgcgacggaagccgtcgtcccgctcctgacggagtctcagaccgagagctccggcggtcttctcctgtccccgaggtcaggctcatcaggcaggcagcgggcaggcggaggcagcctgccgtcgtctgaggcccgggacggcgcggcgttcgagcaggaggtggcgcagctgatggagaacaacatgacgacggcgatgcagtacctgcagagcaagggcctgtgcctcatgcccatcgcgctggcgtcggcgatctcggatcagaaggggtcctcctccgccgcggtccagccggaaaatggcggcgccaaggaaatgctgcgcgccgtgaagcccctgggaagcccgatccaagggagatgaaatggagcccttggggggcggctcatcggtgcagtgcagtccccggcatcaaagccatctcgagtttagattccccaagtcctaagttcctaacagcttgcgccttgtttttgcatgatcctttggcaacttgtagccatgaaatgaaacctggacctag

SEQ ID NO: 8803 - DNA, 626 bp, Sorghum bicolor
  Predicted polypeptide sequence is orthologous to G280
gcaggagcgggggttcctgcatccacagtgaagagaggccgtggtaggccaagaaaggagaagacattggaaactggggacttgaaagttgcacagatgacggagggtcaacataaagctctgcctgcacaagctgtagaccaaggtgggcttatgcaaaatgaagttgaagctaggattttgcaatcctttggtactcctttgatggagaagagaggtcgtgggcgacctagaaagaggcctctggaaactgaaactacagaaacccaagttgatgcattggtgaagaagcgagggcgtggcaggccaagaaaggccaggccttttgaaactggatctgtggaaactgcagttgaggtgtctagggacttggcagaagatgggcctgaaaaagatggggatgttgtgtcagggaagaaagcagaagctcaaggtgtacttttggttgaggagatagacaatggcactgcagatgctggatgtttggtagtgccaagagaggaggtagcaattgctccaatggatgctggaggtgtgctattatctggagaggaggcagccgtcgctcccatggatgctgggtgtgcaacgccaagggttgatccgatggatgtgggcaccaagag

SEQ ID NO: 8804 - DNA, 662 bp, Sorghum bicolor
  Predicted polypeptide sequence is orthologous to G280
gagggctccagtggtgagcccgctgcagctcccgtcgtcagcgctgatgctgctgccatgcctgtcaagcgcgggcgcgggcgtccgccgaaacccaagaaccccgtcgccgaggacgcagctcccactgcggcttccgtcgtcagcgctgatgccaatgctgtgcctgtgaagcgtgggcgcggacgcccccccaaagcccaaggacaccatcactgtggccaccgaccgggccaccagcggcatgctcagcccacgtggccgtggccgtggccgtggccgcccgcccaagaaggccaaggtcgccgtggaagatcccagtggtgagcctgctgcagctcccggcgttgctgctgatgccagtgctgtgcctgtcaagcgtgggcgtggacggccccccaaggtgaggcctgcagtggttggggcgccgtctgagtcttaaaccacgcacgatgaatcttgtgatggtaatggttgcaaggtttggtagtagcctggctcatcaaattgagttctgcactaacttttgcagttggttaaatagcgtcggttaaagagtactctcagtaatctagatgtgtttctgtagtctgtacatcgaatggtgggtgatgtgtaatagttgactgctgctgagagcgatttaatcagtgctatttcct

SEQ ID NO: 8805 - DNA, 634 bp, Sorghum bicolor
  Predicted polypeptide sequence is orthologous to G2802
gaaatgcagcacgcatcggttgttctcgatcatgatcagttccatgtgccagcaatccttctccatcaccatgacaaatttcagcctcagcaccaacagcatcagccacaacaaaagcttgaccgcaggtctgccggcttggaagaactgataatgggatgcacgtcgtccacaagcacgaaaggggaaacttcaattgctcacccccaagagacagaatggccttacccgtactggccacctgacaaccaagatcatcatggatagtagcaaggactggtaaaatagtggcgactggcgatgaatgctaaaaggaacactaaccacaaccactttcactggaatggtttttgtctgcttgaacatgcagcgatgcttttcttggagaatgtacacctactatagtggggggaagaacagagaaaaattgatctctgtagatctccctcaataaaaaaaaggaactatgtgagctctccaagacagaaaagacaaaatggccaacgaaaagagaagatgaaagatcgatgggaggaaaggtattgtttgtgctgacactgaagggatcatgtgcgggccgctagatgtattagagaccacttaatcaagtacaactataatcagttcaccgttt

SEQ ID NO: 8806 - DNA, 794 bp, Sorghum bicolor
  Predicted polypeptide sequence is orthologous to G2802
taagcaatcaagcaaagcagctgcaacagattatcatcactcatcacttgctcaatttcactacaacgagaaaggaaacgcatgcaggcttgctctgctatgctctgttgttcccatttggggcggcggcggcattggaggtccagccgcttggttgcttgtcactagtcactactgggtctcttgtgtcagtccacccctgcttgcatcgcagcatccactgtagcaaagctcctgaaggaaggatcctggcaggtttgctgttggggaccgtcacaactcaaaacaggaatgtggtttatccttgctttctttgtgagctgtttcttgcaacagaacaagaacaaagcagcaggtccagtcttctcctagttgcaagaaacaaagaggagtgaatacctacagctgcatcagctctcccatcctgtccgatgattgtgttgtgtctgtcagtctcggagggaagggaagacaggctgaggctggccctggctgtaagttgtccacatgtatgttcctcctctcccttgcttgccctgctttgctgcgtctgcttgctgtgattttacttagcaattaagttggtttccttttgagctcttatctggattggattagtgcttgagaataatataagtactgttggtagtctaagtacttatttattagtcatcatcagttgttggtagtagctcagttcaggccctgtcctgtatgtatgtatgaatgtacaccatgtatgtaaccacgtacggatattgtttgaaaatgtgtttgttgatcaattaatggac

SEQ ID NO: 8807 - DNA, 569 bp, Sorghum bicolor
  Predicted polypeptide sequence is orthologous to G2826, G2838, G362
gcacgagggcggaaacatataccaagcttgctggtcgcctcacaacctacgacgaaattaaacaagctctagccagctagaattcttcttgggggctcgctcgcagccggccatggcgaagccgcaggaggtgcgcagcgtcgactccttctcgcagctgccgttcatccggccggccccggcgccggcgcagccgagggacgccaccatccggctgttcggctgcgacttctccaacgaccagcagcggcaggccaagcagcagcaagacgccgcgtccgactcccccgacaacgccaacggcagcacggtcacgtccgagagcaacggcggcgccaagagcggcggcgcggctgcggcggccgcggccgctgcggccgccgagaggaagttcgagtgccactactgctgccgcaacttcccgacgtcgcaggcgctgggcgggcaccagaacgcgcacaagcgggagcggcagcacgccaagagggcccacctccaggcctccctcgccatgcaccgctacgtgcccggccacatgtacggcctcttcaactaccaccaccaccacc

SEQ ID NO: 8808 - DNA, 569 bp, Sorghum bicolor
  Predicted polypeptide sequence is orthologous to G2887
tgcccatactcaaggacgccggcgcgctgtggctttgatgtgaagaccaagccgttgttgttgcctctccattgtcagcacttctttcttttttggtttccctgtccttgcttggaattaaacgatgatgtgttgttaacttatttttatttactcctagatcgactagatagacaggcatgcacataggactttaattcttttagttgaaaaaaaaaggttattactaggagaaatggagtgcgcatgtaagcgatttcctataatatagtatatatatttgtattttccgcatcatgtgaatatgaaagagtgttaaaatagctgagcttctattttgacgtgtcatatatgcacagtaagtcagtacagttcatgaacggtacaggtcgtcggcagccggctgttggatattgatgagattttcctccatacaaacatttttttttttaaaaaagaaaaaaatataacataggtgttcgacaaggacgtgcgtgtgaatgtgtgatcatcatatttgcagtgcacagtacacggcagctcaacatgagtacagatgaatttcgtgg

SEQ ID NO: 8809 - DNA, 507 bp, Sorghum bicolor
  Predicted polypeptide sequence is orthologous to G2979
tggcagctctacattacaataagggtgataaagatgtatcgcccaatggaagaacaaggatgggaacacagactgtacattctcagctgtgaaggatcatcccgctgtgaatgatcaatccctatttatggttgcacatgcaaagtcaagtaaggtgctctctgcaaaatgtaaggatcgacaccaaatgtatccatcaacaagtgacctatctgcttccttctctcgactttattcctcattggacatctccgacgacgacgaacattgctgggaacttgactgtagctgcaacttctgatcatccttgcatccatgtggaagccgaacagagaccgcacacacattgcttcctaaccttgtatataatatttctactcaacgctctgttatgcttttggatactacatctgacagagcatacaatggacatcatactaatcttgtataatatcaacacgcaccactctaatgttttttatatgcgcagctcaaatctgccatccg

SEQ ID NO: 8810 - DNA, 742 bp, Sorghum bicolor
  Predicted polypeptide sequence is orthologous to G2982
aacctccctactcgcacgtacttcttctcatcgtgtcgctagggtttcttccctcttcaattcctccgctccaaattccggtccggcgccgaaccccactccatgcccaccaccggcggtggtgggggtagctccgcctccgataagggcggctccgcatcttcgtcctcggcgtcgctccccacgccaccaccctgcgagagcaccgtcgcctggcctctccctctcaacggacttgacatcccgggagacgacacgccatcgtcgcaaccagctgccactgcgagcaagaagaaaaggagaggggcacgagcagttggccctgacaaaaatggtggtggattgcgccaatttagcatgagagttcgtgagaaagtcgaaagcaaagggagaacaacctataatgaggtggcagatgaactcgttgctgagtttttagaccccaaaactaatattgacactctagatcatgataatccctccgcgcaacaatatgatgagaaaaatattcgaagaagagtttatgatgcactaaatgtcctaaaggctatggacattatatctaaggataaaaaggaaatacagtggaaaggcttgcccaagacaagtatgaatgatattgaagaattgaagaaagaggtcacaggactaaaagatcggattaagaagaaaaatgaatatctgcaggaattagaagaacaatatgtatgtctccaaaacttgggtcgacgaaataagcagc

SEQ ID NO: 8811 - DNA, 801 bp, Sorghum bicolor
  Predicted polypeptide sequence is orthologous to G2990
tagtcctcctaacactacctgcactccagtttctcactagagcctgcagcctgctagctaagccaccgagcatattgagtccagttgctacacactactgcaccctctgctagctgcgtcggcgatgtgtctgccgttctcctgcggcggcggcgacaaaggcgacgattggtcacatgactctagcagcgtccaccaccattttcggcagccgccacaaccacaacctcctccgccaccaagggaagacgaaaagcaaacttattataagcctccccctgagaaagaagcatatggccaccatgggaccaacatgcctgccggcggcggcgatggcatgaataatggaggagctcgtgcggcggaagtgaacaagaacggaggagggcacacgacggacttcggctactcagatggcaacgtccatgcttctgtcggcgttttccgaggtcgagagagtcagagcgctgccgggaagaagatcgtggcgtccaccgctccagcggtgcaagccttcaataacaagcatagggatatggccgcagctcaacaagctcctcagggtatgtatgtcgtctctgctagtcctcgccaccccaccatggccatgggtcgtcggcagcatcgatatcgcatcccagcgaggccgctgatagcatgaaggcaccacttcaagtactaccgatgggtcgtcgtggtcctgaagactactagctatatataccctactgctgctgcagtcaccacacagacgccgtgttccccaacaatttcgttcgttctacggtaatcgtgagtgtt

SEQ ID NO: 8812 - DNA, 598 bp, Sorghum bicolor
  Predicted polypeptide sequence is orthologous to G2998
ggttttaacgtggaaatctcagggcatgggaggcaatttgaattgagtgcaacagttggtggctttgttagtctgtgatggagatgcacttgcctgggtgtaatgatgagatctgccatagtatatggaatggacattttacaatgtaactagtcttgacaacagcatccagcagactaatctctcttagtgtctgaagaacgatagtcaaacgatgacgggttttgatttgtgatgtgaatattgggatttgggtggagttgaggggagctggagcagctaaagccttggtttgaagaggtaaaatgtagaattgtatgtaggaaaaaaaatgtacagttgctaacacaatgtgctgtagtcccttggcacaagctggggaggactaatggagcttctggtacaattttacgcaatttcatggaaggcttacagatgggttagttaggcatgtagtgtgatacaattatcgtttctgttcacccgagccattttttttgaagagaaatcaatgtgacgagcagctaagtggtgatgttacccttatatatctgtgtatgtgcggtgtgtaactgggtgatggtgatggtgtgtggtc

SEQ ID NO: 8813 - DNA, 543 bp, Sorghum bicolor
  Predicted polypeptide sequence is orthologous to G2998, G2999
gatggccgtggggttgaccttcgtgccctcggctctgtgcaagaagcggtccttaattgaccaagctcacggcggagaggagaggatgctggagttcgctcgacactttaggtggcgcatccacaaggccagtgcggaagctattgacgccttttgcgcccatattggtgtccccggaactggatgagcaaaaacatgcacctcgcctccacgctgatcgtgcccgtgcgtgggaggttccaacgcctaaagctcactgcggaccaagcctaaagttcagagtacaaaaatttgggaacaggaggttccaacgcctcaacaagctatttgattgttgtactgtccaatcattttttaatatctaacattatctttattagttgttttttgaatctctaatggtgtgtgatctactgcgttcaaataatttgccctcaaatccaattgatagcctaatccaaccgctctgcgggatggtatggagatatggtgaaacttattcatggatttactgacgcatgaaaaaataaatattggagattt

SEQ ID NO: 8814 - DNA, 526 bp, Sorghum bicolor
  Predicted polypeptide sequence is orthologous to G3054
gcacgaggagcacacagcagatactcctagctacttccagttccagctcggtcttggcctcttggaagagagcagctagttactcttacttgcgacgatagtgtctgtgaattgcgagaaacgagtgagcaatcatatatatggcggcgtctctgctcggactgtacagcggcgggaggggccacgccaggagcggcggccgccggtcggctgcggcggtgaagcggctgctgtcgagcttgaggcgctcttggaggagacgtgcggcgcggccgaggcgaagcgcggtgaggttcgggtatgacctgcatagctactaccagaacttcgacgacggcattgcctcctactcaggccaccaccgcttgtagctgtactgtacctagctagtgtacagtaattccctcttgccacttctgtacttaattagctcgtgcagtcattgactcattattttttatggaagtcattgactcattatatgtaagagtaacactaaatctgcgatcgattagcagaataataa

SEQ ID NO: 8815 - DNA, 627 bp, Sorghum bicolor
  Predicted polypeptide sequence is orthologous to G3054
ctcgtggctatgcatagtcccaacgcgccgctccgtctgcggctcgacgcctcgccgggcaggtttgtctccgggccagtcaagaaggagatgaccgccgagtcgcgccggagcgcatccgccgccgccgtcggcggccgacctgaccgggcttcaggcgcggcacaatcgaacttcacaagtatggagggggccttatggacatagacggcagggatatcgcagcgctccgccattgacagccagaggtctggacagctgcaaatgcccattcataagtggaagggctctgacaagatcggcgggatctatggtgattggatagacgacaatgagtaggaaggggctatggtaggctgaagggagactgttagtatctgtacgactatgcttcagctggtgaaagttcagcaggcttagaagatctagttagcattgcaaaaccttgtctcgacaaaatgcagggtgtttgtcctatgttatgttcctgcatgtcctgctgttgtaaatgtgactcaatttgggcttccttggtagctgaacaagaaactcagtttgggtttcaacaaagatgtaaatgtgacttctatatgagatatatttagatgttttgcaaaaaaaaaaaaa

SEQ ID NO: 8816 - DNA, 563 bp, Sorghum bicolor
  Predicted polypeptide sequence is orthologous to G3055
tcgcgcgccatcgggaagatgttcttcaagaccaagctctgctgcaagttccgcgccgggacctgcccctacgtcaccaactgcaactttgcgcacggcatggaggagctccgcaagccaccgcccaactggcaggagatcgtggccgcccatgaggaggccacggagcagcgggaggagcaccagatccccatcatgacctcgggaagtgtcgtcgctggagacggcggcggcggcggcagctcgcaagggggcagggcgtacaagggtcgacactgcaagaagttctacactgaagagggctgcccctatggtgacgcgtgcaccttcctgcacgatgagcagtccaaggcgcgggagagcgtggccatcagtctctcgcccacggttggcgctgggggatacaatgctgctgcctctgccaatggagtgatggtgcagaagccatccaactggaagaccaggatctgtaacaagtgggagatgactggatactgtccatttgggagcaaatgccactttgctcatggttctgctgctataactgcagaacttcacaagta

SEQ ID NO: 8817 - DNA, 825 bp, Sorghum bicolor
  Predicted polypeptide sequence is orthologous to G3060
accaatgcctcacctagacatggttcctccttccaccttcggtgcttcagccacagccaagatcagtgtcgatgcatcccttgctggcgccatcatcgggaagggtggtgccaacacaaagcatatatcccgagtgactggggccaagttagccatccgggacaatgaggctgatcccaaccataaaaacattgagcttgagggaacatttgaccagatcaagcacgctagcgcaatggtcacagagttgattgtccgcatcagtggtaaggcgcctggcccacaagccaagaataacccaggaggcagggggcctggttctcatgctgggggtcctggaagcaacttcaagaccaagttgtgtgagaacttcaacaaaggctcctgcacctttggggacaggtgccactttgcccatggcgaaagtgagctgcgcaaacctgctgctgcttgataggtatgcttattgtgccctgtggtgattactctgcctgtatggctgaataacaccagaaccaaggacagtcacccatggtgaaatgtattgagcctcatgcttcctgagatagatccgttccgtggcttgtatttgatcatcttactgctgtaactctttgatagagagaagcaatggcctgtcttctagtttttgtaggtttgccgtattggtctccctttatcttccccctgcttctgaatcctatttctgtatcgtttcttaggcacttttggctggcggatcattgtgattctgttaacttgaacagttgctattgatgttatccgtttgtgaattcttaatagctcttttgaaatccagatgtc

SEQ ID NO: 8818 - DNA, 865 bp, Sorghum bicolor
  misc_feature (854)..(854): n is a, c, g, or t
  Predicted polypeptide sequence is orthologous to G3074
aagaaaagcacacacaaaaaaaaaggagtactcctccgtagactacgacatcgtccgtcgaggcggcgaggaggcggaggcggaggcggaggcgaagatgaggaagaagctcggcacccggttccccgcggctcgaatcaaaaagattatgcaagcagatgaggatgtcggaaagattgcactagcggtgcctgttttagtctcgagggctcttgaattgtttttacaagatttaattgaccggacttatgaaattactcttcaaagtggagcaaagacactgaattccttccacctgaagcaatgtgtgaagaggtacagttcttttgatttcctaactgaagttgtcaacaaggtaccaggtcttggtggcgctgattcctgtggagatgaaagaggattacctagaagaagaaagtcaaatggcagtgacccagagaatgatgaatcaagatctagtaaaatggtcataagaaatgcaaacatcagccccagaggacgtgggaggggtcgaggcagagggcgaggtcggccaccaaccaagagaaaggaagttggttatgtgcaatttgaagatgagagcagcatgtttgctgaacaaggtgaacccttaccaggagaggaaacagttcaagagatcaacaatggcaacgagatcatgcctcaaagcacgcaacctccagtagaggctccgccaacagcccctgcacaagctacaagttctaaggtggaagaagcgaacaccaatcatcagtcagattggcctatgccagatgccattggaagcatcggtgtcggtccgtctggttttgggcatctgacagtgcaggtcgatgaagacgaggactacgacnatgaggactag

SEQ ID NO: 8819 - DNA, 592 bp, Sorghum bicolor
  Predicted polypeptide sequence is orthologous to G309
gcagatctgcaacgttgtggcatgtgagggcgcggagcgcacggagcgccacgagacgctgagtcagtggcgcggccgcctcgtcggctccgggttcgagcccgtgcacctgggctccaatgcctacaagcaggcgagcacgctgctggcactcttcaacggcggcgacgggtacagggtggaggagaaggacgggtgcctgaccctggggtggcatacgcgcccgctcatcgccacctcggcatggcgcctcgccgctccgtgatcatggggtggggttttggacgctgatcaaggcacacgtcccccggccccgggcatggcgcagcctccccgagctcgccggcgcagttgaagctgtagacgtcaatgaacgctgaatgaattgcagttattaggcgaccgggccacggttctcgccggcgtgatgagatggactggacactttgactccgaccggatcgggcctgtgttcgttcttgtttccgatccccctctcttcccgttgcttcaatccgtcaactatggtagcccgtagcccctattgttatgtttaaatgtctattattattattatgtgtaattcctcccc

SEQ ID NO: 8820 - DNA, 610 bp, Sorghum bicolor
  misc_feature (600)..(600): n is a, c, g, or t
  Predicted polypeptide sequence is orthologous to G309
cgagcggcggcgcgggcgacgcggcggcggaggcgtacctggagcgcgagatctgcgacatcgtgtgcggcgagggcgcggaccgcagggaacggcacgagccgctgtggcggtggcgggacaggctgggtcgggcggggctggccgccgtgccgctgggcgccaacgcgctgcggcaggcgcggatgctggtggggctcttctccggggaagggcactgcgtggaggaggccgaagggtgcctgacactgggctggcacgggcggccgctcttctcggcgtccgcgtggcgcgccgcggaagagaacaatcagagtgacagctgcaacgcggacggcagcaggagcagcggcagcggcagcggcagcggcagtgaggagagcaatatcagctgcagcagctagggctaggtatcccaattcccgtcgtagtttttactgtaaattcggtgagggtagcgcggttggttattactgtaaaatcgcggtgcgtgcgcgcggtccaaatggtttgcatcggtcgtaaatggtagactgaaatgacatgaaattctgttaagcgtgtcgtcatagttgaataaacgacggcactgatcgaaangcgcccctgg

SEQ ID NO: 8821 - DNA, 664 bp, Sorghum bicolor
  Predicted polypeptide sequence is orthologous to G309
agcttcccctctctcgcccgcttcctccctccccctccccttcccttcccttcccttcaccactcccacttcccaaccctggatccaaatcccaagctatcccagaaccgaaaccgaggcgcgcaagcaattattcgctggctagctaggcctgtagctccgagatcatgaagcgcgagtaccaagacgccggcgggagcggcggcgacatgggctcctccaaggacaagatgatggtggcggcggcgggggcaggggagcaggaggaggagctggacgagatgctggcctcgctcggctacaaggtgcgttcgtcggatatggcggacgtcgcacagaagctggagcagctcgagatggccatggggatgggctgcgttggcggcgccggcgctaccgctgatgacggcttcatctcgcacctcgccacggacaccgtgcactacaatccctccgacctgtcgtcctggctcgagagcatgctgtccgagctcaacgcgcccccaccgccgctcccgcccgcgacgacgccgccggccccgaggctcgcgtccacctcgtccaccgtcacaagtggcgccgccgccggtgctggctacttcgatctcccgcccgccgtcgactcgtccagcagcacctacgccctgaagccgatcccctcgcc

SEQ ID NO: 8822 - DNA, 724 bp, Sorghum bicolor
  misc_feature (479)..(479): n is a, c, g, or t
  misc_feature (625)..(625): n is a, c, g, or t
  Predicted polypeptide sequence is orthologous to G3111
cctactggaaaaaaaaaaaaaaagcacgacaacttctcggcgtcttctccgatcctcgccctcccccgtcgccacggcgtatatatatgcggccgagctctccactcccgagtcccgagaactcgttccacctccacacggcacaccaacggcttgccggctgcgccaacaactggagctttcagcgcttcgcgttccatcagatatacgtatgacgcaaggctctgaccaagcaggcgccggcgctggcacgcccccggcgcccagggcatcagcaggggcggcgggcgccatggcgctcgggagcatcctcaccgtggcgggcatcctcctgctcttcgtcttcttcgccttgggcatcatcgccctccagtgctgcatcaacacctgggacagggaaacagcccagcagcagggcgaacaagcaggcaggcggcggcgccgtggtccgcgggcgcccgggccggccggggagcaantgggtgggtgggacggtgcggaccaccaccagcaggggcgtcgacccggagctgctgcgcgcgctgcctgtcacggtgtaccaccaccaccaccacggcacgtcggaccaccaccagcaggacgcgggggtgggtggagtgcgccntgtgcctcgccgagctccaggacggcgaggaggcccggttcctgccccgctgcggccacggcttccacgccgagtgcgtcgacatgtggctcgcctccc

SEQ ID NO: 8823 - DNA, 657 bp, Sorghum bicolor
  Predicted polypeptide sequence is orthologous to G326
tgtcagttgtcatcgaaaaatgtgagcaccgcgagcaacaaacggaagctgagctcctgtgcctcgacgatcgatggaccaacaacctctggaaaccatgtacccacatcaggaccagcactcaccagggagatctccttcggggatcaaacggtctccacccctgcagctgagaggcctgctgtgaggatcgacagcgagacgctcgcgcagaatagggacagcgctatgcagcggtacagggaaaagaagaagaaccgcaggtatgagaagcacatacggtacgagtcgaggaagctgagggcggacacaaggaagcgggtgaaagggcggttcgtcaagtcgaccgaagccctgaacgccggctatggcggatgagccatatggcctgtaaactgtggtttgctgtgtgcctgcgttacgtgcagtagcaatgttggtggtacggatgctatggcggaatcgataagcagtgttagagagccaagtttttgcgttgaagcaattgtggtcattgggcagtagtcaactccagagattgcacggtattgcttgtaagagacgaccccctgccatctcatcagtatgtagcttacatacagtactgatttaccatatgatgcatgtggtctttgcagtgaagtaacttgttttgtt

SEQ ID NO: 8824 - DNA, 580 bp, Sorghum bicolor
  Predicted polypeptide sequence is orthologous to G351
ggcgcaagagtccgagctccgcttccggtgctccgtctgtggcaaggccttcgcgtcgcaccaggcgctgggcgggcacaaggccagccaccggaaaccgacgcctgtactacaggcacaagcgtcgtcgtcgtcagccggaggtgcggcggcgtcgtcgtcggggataacgacctcggccggcggcagcagcgggcaggggaggcacaggtgcacggtgtgccatcggagcttcgcgacggggcaggcgctcggcgggcacaagaggtgccattactgggacgggctctcggtgtcgctcaccgcgtcgtctgcgccatcgggttccgggtcgaccgtgaagggatttgatctgaatttggtgccggcgccggcggcgacggcggccaacgcggcgacaaggtggagagaggaggaagaggtgcagagccccttgccggtcaagaagaggcggctgtccggcccgtccctggaccttagtttaacgatctagagttccgtttgatgaggcatgtgtagagtttttcctaccttcattcgttattttagttggattttggtttggtgttttgacctggtg

SEQ ID NO: 8825 - DNA, 676 bp, Sorghum bicolor
  Predicted polypeptide sequence is orthologous to G351
acaccaagcccgctgccccggcggcgacgcaagagtgcaacgtgtgcggcaaggcgttcccgacggggcaggcgctgggcggccacaagcgccgccactacgacggtaccatcggcagcgccgccgcacccgcgcgcgcgtcctcctcctctgcggccaccagcagccgcaacacggcgccgccgccggcggtcgccttcgacctcaacctgccggcgctgccggagcgatgcgccgtggcggaggacgacgaggtgctcagcccgctcgccttcaagaagcctcgcttcatgatcatcccggcttaatccttattaagctcgtccatcagctagcagcaaattaatcgatctgttcattgtagattaattagttgagttgttgtgcttgtacctagcttattgaattgttcatgtaggtgcttttagttggtggtgaatagttgtagtatatatcgtgtatatacaattatacgtacataggcactgttcattatgtattcttcattgtttagttacgtataggaggatagtaggagttaggagtaggtagaagcaaggatcaattctttctttcattggttgaattggtgtagtagtatatatatatatatatatatatatatatgcatgtaaataaatacaatacaataaagaaaaattgagaagtctacagt

SEQ ID NO: 8826 - DNA, 700 bp, Sorghum bicolor
  Predicted polypeptide sequence is orthologous to G354
agctcgatcgcaagcccttagtttagttccattccatccccagctgaccgtcagggtacatatatggcgaagcacccgagagactccggcgccggcgccgtgccgctctccctcgcgctgtccctcggcggcggcggcgtggccgccgagcacggcagcaacaagaggcaccggcgcgcggcggcgggcggcggggacggcggcggcgagttcgtctgcaagacgtgcagccgcgccttcgggtcgttccaggcgctgggcgggcaccggaccagccacctgcggggccgccacggcctcgcgctcgggatgcccgcgccggcgaaggacgacgccaaggagaccaccacgaagcagccagcggcggcgtccgcgagccacctgtgccacgtctgcgggctcagcttcgagatgggccaggcgctcggcggccacatgcggcgccaccgcgaggaggccgccgccgccaccaccgcgcaggcgccgcccgtcctcctccagctcttcgtgtagagttttatttgcccgtacacggagaggccattcatcgggggatttctagtttgcagtagaggaattctttgcgtttcagtcgtccgtctgcacattgtagattcaacagtacaattgttggcatatttgccaattgattgatgattgattgattcattcattcatttagttacacatgtaaatacaa

SEQ ID NO: 8827 - DNA, 810 bp, Sorghum bicolor
  Predicted polypeptide sequence is orthologous to G354
atatatatatatatcttgttagcttctaatcgagatcgagtagttcagctgattattcaccggcaagaacaagctgatcgacgagtgcaatcatttgatgaagaggtttgcagtgcaggagagcgagatggcgcgcgtgctgatgctcatgtcacactcgcacggccaggaccagtcgctgccgctgccggtgatcgccgccgggcgcggcgacggggcggcgccggagcgggtgttcgtgtgcaagacgtgcaaccgcgtgttcccgtcgttccaggcgctgggcggccaccgcgccagccacatgaggcgccaccgcgccatgacgggcggcatgcccatgccaccgccggcgacgacgaggatcgtcgtcgacaagaagccggacggcgacgtcgtcggcatcatccaccacgaccacggccacggcggcgtcaagcccggcgggctgtggctcgacctcaaccacccgccctgcgacgacgacggctgcgacgccgaggtggagtgcggccacattaatgccgccgccgccgccggtgggatcacgttccatcagttcctcgacactggcaccatggccgtcgactgccttggctactagataccaccaagctccatgattcttctccctgccacgtactactggtgcaccggccggcctccgttttttttctctggaatcttcttctccatttgcttctgcgtggaggggagaaatccacattttgtagcaatagtagaatgaaggtgcctaatgcatcatgattcatgaatgcatggatgatgatgtgcatgaaggttttgggg

SEQ ID NO: 8828 - DNA, 682 bp, Sorghum bicolor
  Predicted polypeptide sequence is orthologous to G363
gcatgagttagaaaacattttcttctttcctcttcacttttttcattttatctagatcctggcctgttcccccatggcggtggcacccaccaggctgcagtctccatccccatggtggcggcgcctccaggtgtggcgcatcaccatgagcacaaagatgtcaccatggcctcgtcaacggcgaagggcgttgttagtccttccgaaggttcatctcatacttggagagggcagatttgttctcatttttctaagacaatagctctttcagtactagagcaattgctagtggagtggttgctggcgcagccttgctatttgctactcccactaccggcagcggcggcagtggtgatgagacgggctcccagcccctctttgcctggttgcgcagcttgtgcgccttcttgtggctgcgcgagcgccttcgagctgcagaacttcctggggcagtagtagcaggcgaagaccgcatggaacctgggcagcgaccacggcaacccgttaactgatctttggctagttttgtgggattcgatagatttgttgatacgtatatctatcagattttgtattgatatattggtcaaaaaccgatatattttgacagcggaaatctgtaatcagatgtctagacagaccctaatattaaccatgaatattattttttaatgttttcttt

SEQ ID NO: 8829 - DNA, 605 bp, Sorghum bicolor
  misc_feature (25)..(25): n is a, c, g, or t
  Predicted polypeptide sequence is orthologous to G385
ccgtgcctactgcaaagctctcctngggctctgtagcaactgtgaacagcctcatcgcctgcaccgtggagcgcatcaaggctgccgtctgcgtggaaggcaacccacagtagccttccatccatatgatctcgaggaggggggcagcaaggttttggggaaatattagtggggagtcaagaacgcacctcagactctccttgccatgtggtgctcatactgcaagcgaaaattcagttcgttaggaaaaagaaggcgtcaccactatgcaaggggggatggttcgggtattgacttccccgttgatcaagtctactacagaaaggatgctgcggagaagatgctgtttctggatctctttcaatatttttagggtttccatttgctgctgtgtacttcgtcatgttcgtggtgtcgccgttgttcaggctaaggtgcctgtgcctgctcgtagctagagaacagagatttgttgcgtctttttttttttggatttgcaaagatttgtagaatctaggatcaatcatttcataaccaatgcttggctaaaacgtgcccgttgttgtttgtagctttttgctatttaaaacgatgcaattcaattt

SEQ ID NO: 8830 - DNA, 715 bp, Sorghum bicolor
  Predicted polypeptide sequence is orthologous to G4
gaagctgcccatgcatacgatgaggcggcaaaggccatgtatggccccaaggcacgtgtcaacttctcggataactctgctgacgccaactctggctgcacgtcggcgctttcgttgctggcatctagtgtaccggttgccacgttgcaacggtctgatgagaaagtggagactgaggtggaatctgtggagactgaggtccatgaggtgaaaactgaagggaatgatgacttgggaagtgtccacgttgcctgcaagaccgtggacgtcattcaatctgagaagagtgtgttacacaaagcaggggaagtaagttatgattacttcaacgttgaagaggtggttgagatgataattatagaattgaatgctgataaaaaaattgaagcacatgaagaataccatgatggagatgacgggtttagcctttttgcatattagaagcatggttatggggagaagtaggaataacttcattctagatgttaggaaaacgcttcaacctgaagcgttgtagtcattcgtggttttcatcttactgagacatagctttatactatgagccaaccggtacaagaagttgtcctgtgtgttgagttcctgtactatagtaggaaatgagtccgtgtttaatgagttctcttggttgttaatattgcacatttgctcggctgaactcaagttagctcaagaaaaggaaaagtaagtacaccga

SEQ ID NO: 8831 - DNA, 876 bp, Sorghum bicolor
  misc_feature (84)..(84): n is a, c, g, or t
  Predicted polypeptide sequence is orthologous to G4
aatgcaacaaagctagctccacccccaaaggcctgtgctgatgaggttttcagtaacctgaacaatgacaacaatgatttgtcngcaacgtttgcgttcaatgacaataaggttcctgtgaagccagctgaggttgccagtttcctccctgcagtgaaacctctggtgcccagtaagagatctgcgactaacatgctttctgaccagaacagcaactcctatggctcttctgactttgggtgggacgatgacaccatgacctcaggctacacctttgctcccaataatgctataccagcatcttacatgcaaggtggagagtcaaagagaatgaggaacaactatggtgtagccatgtttcagggaaatggcgcccccagtctcgcacaagtcatgcctggttttgatcctgagatgaactatcagccattgccttatgttgagagcagctcatcagatgcatcaatggacagccttctaccacaggatggggcaagcaatggggatatctggagccttgatgagctgctcatggcagctggtgcttattgagaagctatggttattatcagtgtggcgtgttaacagcaaaaaagtggctcctacctgtggtgatgctggaggggcaagccagttgaatccgctacattttgtcgcggtagttatatatggtagattacatatatatgcttttgccagttgaactctatgaccatgtttatagtatgttgctgcgtggtgcgtctatgattggaagcgagtttgagactgattcaataatttaccttgcctatgcctgctggactgtagtgtgcgtactgcatgttatgtgtatatatatatatggtgtgcttatgtattgcaattcttttccgg

SEQ ID NO: 8832 - DNA, 776 bp, Sorghum bicolor
  Predicted polypeptide sequence is orthologous to G4
gacctgcacacgtaaacagacccaaaaaaaccctctcggaacaatgtgcggaggcgccatcctcgcggaactgatcccgccgacgcggcgcgtggcgccgaagccggtgaccgagggccacctctggccggcgagctccaagaaagccggcagcggcagcaacaagaggcaccaccacgaatacgccgacgacgacgattttgaggccgccttcgaggagttcgacgacgactttgacgtgcacgaagacggcgaggaccaccctgaccacttcgtgttctcgtccaaatccgctttctccccagcgcacgacggccagggcaacccaagaaccgcgccgaaacctgcagcacaggcacagcccgctctgctccttcgaggggagaagggtctggaaggagttgccgtgaagcctgaaactactatggacatgttcgacgtgggcagcttcttcgacatgaccttccccaccttcccagccgcgccggcggcggccatggagagctccttcgctggcagcagcgccacgtcggagacccggagccccgggaagaagctgagatacgacgacggcgactcgtccgaggggagcggctgtggctccgcgctggagctcgctgacgagctggcgttcgatccgtttatgctactgcagatgccctactctggcgggtacgattccctggacggccttttcgccgcacaggccgtgcagcaagacgtgaacaacgacatgaacggcgtcagcctgtggagcttcgacgagttccccgtcg

SEQ ID NO: 8833 - DNA, 827 bp, Sorghum bicolor
  Predicted polypeptide sequence is orthologous to G4
catttcgctctcgcaagccaccgatttgtttactgctcgctccggcgcgctgcggcggagcacccgacgacaactgaaccatgtgcggcggcgcgatcctcgacgacctccgcgagccggagctgcgccgggtcacggaccgggacatctggcagaagaagaagcccaagaggggcggcggcggcgggaggcgctcgttcgcggcggaggaccatgaggacttcgaggccgacttcgcggatttcgaggctgactccggcgattcggatttggagctcggggaaggggctgacgacgatgtcgtcgagatcaagcccttcgccgccaaggggactttcaatagtcctgaggaagctgcaagagcttatgatgctgaagcacgcaggattcgtggcaagaaggccaaggttaactttcctgatgcaccagcagttggtcagaagcgccgttctggctcagcttctgctaaagcacccaagtcaagtgttgaacagaagcctgtcgtcaaagcacctatgaccaaccttgccaacacaaatgcatccttctaccaatctgttaactacccctccaacaatccatttgttcagcatgccaatatgccattcgttccagcaatgaactttactgcttctgttgaggatcctatcatgaatctgcactctgaccagggaagtaactcctttggctgctcagacttggcatgggagaatgataccaagacaccagacatcacatccattgttcctatttccactattgctgaaggtgatgagtctgcatttgtcaacagcaattcaaacagctcaatgttgcctcctgtcctg

SEQ ID NO: 8834 - DNA, 902 bp, Sorghum bicolor
  Predicted polypeptide sequence is orthologous to G4
cactccgcatttccgccgcttccgcatcacgcagacaagcaagcatagctagcgaccaacccaccccaccgcccgcgagctcagacttagattcccctcgcgcaccgtcccgttcggccccacagcccagcgagagggcctgccagcagcagcagcaggcttcagccagccatgtgcggcggcgccatcctgtcggacatcatcccgccgccgccgcggcgggtcacggcgggccacctctggccggagagcaagaagccgaggaggggcgccggggccggaaggaggagggccgggccccccgtggaggaggaggaggaggaggaggacttcgaggccgacttcgaggtgttcgaggtggagtccggcgagtcggagctcgagtccgaggatgaggccaagcccttcgccgcccccaggaccaggagcgcgctctctttagatggattaaacactagtgcagttgttgttgatggccctgctgcaaattcagttaaaaggaagaggaagaaccagtttaggggtatccgccggcgcccatggggtaaatgggctgctgagatcagagatcctcgcaaaggtgttcgtgtttggcttggtactttcaactctcccgaagaagctgccagggcttatgatgctgaggcacgcaggatccgtggcaagaaggctaaagtcaacttcccagatgaggtttcgacgattcctcagaagcaccgtgctggtcctacccctctgaaagtgcctgagatggactttgaagagaagccgattatcaagccggcagtcaacaacatgaccaactcaaatgcatatcactaccctgttgtcgaccacaacatacccgagccatttatgcatactcaaaacatgtcatttgctcctttcgtgaattctgctgc

SEQ ID NO: 8835 - DNA, 760 bp, Sorghum bicolor
  Predicted polypeptide sequence is orthologous to G4
gcaaacctgaaaagttcgctagcgtacgactcgaccagagccaaccaaaccaacaagcaagcaagtagagagacaggcgcagagcgaagatgtgtggtggtgcgatcctcgccgagctcatcccgagcacgccggctcgccgcggtggcggtggcggtggcgcggcgtggcccggcggcaagggcagccagaggaaggccgacgacttcgaggccgcgttccgggagttccacgaggactctgacgaggacgaggagatgacggaggtggtggagagcaagcccgccttcatcttcagcgccccgtcgtccccagcgacgaagcccagggcggcgcgccaggagcagccgatccggcgccggaaggccgcgcagcagtacaggggcgtccggcgccgcccgtggggcaagtgggccgccgagatccgcgaccccgtcaagggcgtccgcgtctggctcggcaccttcccctccgccgaggccgccgcgctcgcctacgaccacgccgcgctcgacgtccgcggacccagggccaagctcaacttcccctcctcctccgccgccgccgctggggccccagccagccgcaagcgcgcccgcgcctccgacgccgccttcatcgacctcgtcgaccaagaggaacaagagcagctcacggcggcggcgacgacggccttgaagcacgaggccgccgaagaagcagccggcgagagctccggtgcactcccggacttctcgtggcagggcgtgctgtcggcgta

SEQ ID NO: 8836 - DNA, 813 bp, Sorghum bicolor
  Predicted polypeptide sequence is orthologous to G4
gctaccacccacccttgtatcccccatctccattgttagactcttggctagaattcttgccatgtgcggcggggccattctcagtgatctctactcgccagtaaggcagaaggttactgctaatcacctatggacagagagtggcagcagtaagagtgggaagaactggaaaaggaagagttcttgggagtttggtgaagatgactttgaggctgatttcgagggatttgaggatggtgatagcgaggaagatgtggattttgtacatgagggccaagagttccaaacgaacagttcgaatctcgtggtggggtccaatgttcatactgccaaagtcgccagcaggaagagaaggacacagtatcgtgggatccggcggcgcccttggggcaaatgggcagctgagatcagagacccacgcaagggcgtccgagtctggcttggcacctacagcaccgctgaggaggctgcaagagcctacgacacggcagcctggcgcatacgtggcaagaaagccaaggtgaacttccccagcgccatcacaaatcccgagaaacgccgccgggggcgtgtggctcggccacgaaagaagattgcatcccaggagacgctgaagctcaacgacgcctctgatgatcatgtcatctcagcaggcagcagcactgatgatgccattgccgtcaagcttgagttgccagagtcggcttctccgccacccatgtccagcgcatggcttgatgcgtttgagctgaatcaggtcaatgagttaagctaccttgaagttgaagaaactgttggtgagactagggtgac

SEQ ID NO: 8837 - DNA, 771 bp, Sorghum bicolor
  Predicted polypeptide sequence is orthologous to G409
gcgagctggcgcgaaggctcgggatcgcgccgcgccaggtggccgtgtggttccagaaccgccgcgcgcgctggaggaccaagcagctggagcaggacttcgaccgcctcagggccgcgcacgacgacctcctcgccggccgcgacgcgctcctcgccgacaacgatcgcctccgctcacaggtgatcacgttaactgagaaactgcaagcgaaggagtcgtcggcgtcagagccggaagagtttacagttgccactcaagagacagcctatgctcttttcgaagaagacaagctctgcctctgctccgagatcgccaccggcagcactgcagcggcggcgccagggagcaacgacagcccggagtcctacttcgccggtgcgtgctcgcctccgtcgtcgccagaggacgacggctgcggtggcgccgacgaccgcaccttcttcctcccggacgccctgctcgccacgggcgtggaggagagcctcgagcgcggtgccgaagaggacgatggcgctgggacgcagctcaacaactgggcatggttatggaacgatcagcagtattagggaatgcacgcatgatattattgcagtgcaaatttggtctcgagctttgctgatgttgatacggtgtattctgctaattggccaggtggttgatttatgcctccacattgttcactgacatttctcacatcagtaacgtttgaggtgtaaaatggccaaagctgggccggatatgtaactaaatggagaactaaattacttg

SEQ ID NO: 8838 - DNA, 817 bp, Sorghum bicolor
  Predicted polypeptide sequence is orthologous to G409
aattcatccaaaaaaagtctaaaaaaaaaacttgcagcggcatccaccaccggagctgccatcatcggcccgtccctccgtgtcaaccccctcctcagaagttctatttgcagttcggcccctggccggtccgcccggccaccggaaggagccgctcgccggaggaaggcccccctgtctccttgccctgcggcgggttcatggggttctcgctgtaccccatgaagacgtccacgcggctgctctggagcactagcttcttccgccataagctcagctcctcctcctgcttcctctgagcccgccacgatcgtgttgtcggcggcggcggcggtccgctgctgctgcgcggtcctagcatccgttcaagtttgtgtttgtgtttgtgtttgtgttcgtgtgcgcgcacgcgcgtaccggcgtacgggtttcaagattgggttttgttgcgttcttggggagaggaagggactagggcgcgggcaagaatcagcatagcatggatccgagcgcggtcagtttcgactcctgcggcgcgcggcggggcggcggcggcggcggcgcgcagatgctgctcttcggcggcggaggcagcgccaacagcaacggcttcttccgaggtgttccgatggcggtcctgggcatggacgacgcgacgcgcgtgggcaagcggcctttcttcaccacgcacgaggagctcctggaggaggagtactactacgagcaggcgcccgagaagaagcgccgtctgacggcggagcaggtgcagctgctggagcggagcttcgaggaagagaacaagctggagccggagcgc

SEQ ID NO: 8839 - DNA, 790 bp, Sorghum bicolor
  misc_feature (706)..(706): n is a, c, g, or t
  Predicted polypeptide sequence is orthologous to G409
ccctccaagcaaaaatatatattagcgaatattaaagcattttccttatagagatatatataaaaaattagaacaaaaaggtttttccttttcgcgactccgtcgtccaccaccaacctcctccgatccggccgccgtagcgtagccgaattgtcccactccgggactcgctcggtcgacgagagggtgtttccggcgagtgctctcggccgatctcctccgcgcggctgaggagatcccgcggtcgcacgggggctggggcgtgcatgatgggattttggttgattccgatggagactccggcgaggcttctgtggagcaccagcttcttccgccacaagatcgccgccatgctcgcctcctcctcctgcttcttatagatcccacccctcaccgtcgtcgtcggcagctagctcgctagcttctgtacatacgtcgacgcccatataaatattattagtcttcatcgatccactcccgattaagtaataattcgggcaaagaatctccaagcttttgcctcgacgatctttgcattgatccatggagtccggacggctcatcttcaacgcgcccggctccggcgccgggcagatgctcttcctggactgcggcgcagccggtggtcccggcggcggcggcggcggcggcttgttccatcgaggcgggagaccgatgcttggccttgaagaagggcgcggcgtanaacggcccttcttcacctcgcccgacgagctcctcgaggaggagtactacgacgagcagctgccggagaagaagcgccgcctca

SEQ ID NO: 8840 - DNA, 764 bp, Sorghum bicolor
  Predicted polypeptide sequence is orthologous to G428
gcgccgcctcgctctccgatgaaatggtagggtcctctgaggacgaaccatgctcaggagacacagaggcgactgacctgggtcaggagcacagctcacggttggctgaccgtgagctcaaggagatgctgctgaagaagtacagtggttgtttgagccggctgcggtctgagttcctgaagaagaggaagaaagggaagctaccgaaggatgctcggtcggcgctgatggactggtggaacacgcattaccgctggccataccctactgaagaggataaggtgaggctggcagcgatgactgggttggacccgaagcagatcaacaactggttcatcaaccagcggaagcggcactggaagccatcggaggacatgcggttcgcgctaatggagggtgtcacgggcggcggatcatcctccgggacgacgctctacttcgacactggcacgatcgggccgtgatcacactctgacgacatcagttgcagcatacaatttactgggcatgtagtgtttgcattgcagttcaactgcattgcgctgcactgcactgccaatgggggtaattgttggttgatgatatggagattagtcacatgaacgaaccaataaccgctgtcattttgtcgggattttattgtgtatatgggcgacaacgtgttcggtacactgcacacagtatgtagtactacaagggaagttgctgtccagtccagatggccctgtaaagactctgtctgaaagtaccataacaattacttt

SEQ ID NO: 8841 - DNA, 592 bp, Sorghum bicolor
  Predicted polypeptide sequence is orthologous to G450
tcgtaagtagtgaccacatcagcaccgctgactggatcaaccaatttcccctcattcatgttgttccctgattccctatgccaacggggtgacttaccagatgtggtgaaggtgctgaacatcttcttcagagcaatagagaggtccttgtagctgttgtacatcttcaggtccaccttgcgcaggtagggcgcgccgtccatgctgaccttcacgaaggcggagctgttgccgctggcgttggcagcggccgactgctgcttctcaggttcctcttccttcttgctcttcacagactggacggtcatgacgttcctgcggtatgatcggactggtggccaacccacagcttgtgccctgatatgcaacacggagttctagttaactatcacttgattttgtgggtaacaattgctctagtcatagcttgaaatagatattctttactatgctaactggaagatccatcgagattccagccaagatcatgcatgtttaatttataattcttgtttgcaccagctcagctttctgctaataatgtgtataatgacaaatgtgatttggttaaggccaccatgaatcatgacca

SEQ ID NO: 8842 - DNA, 588 bp, Sorghum bicolor
  Predicted polypeptide sequence is orthologous to G450
acccagcgacacccaccaccaccaccaccagcagctaccgacgacgaccgagcacagccaggcagcgcaggcgcaggctcaggcgcagcgcagctcgtcggattcaattcgttcttgagccaagttgcaaaccgcggccgttgcccacgagcgccggccgcaccggagaagctacctaaggagaagcaatggaggtcgccgcagcatcagcagcagcgagcttcggcttgaaggccgccgacgacgttgacaacctcagggccacggagctcaggctcggcctgccaggcacggaggaggagccccagcaggtccacaaggcggcggcggcggcggtggagctgccgctgctgccggccgcgacgacgccgccggcgccgtctacgcctaggggcaagaagcgcgacgtcgtcggaagcgggaacgaggacgcgcccaagaagcgcgacggcaacgccgacgccgcgccgcccgccgccaaggctcaggtggtgggatggccgccggagaggtcgtacaggaagagctgcttccagcagcagcaggcggcggccaagagcaagcccgcgccagcggcgccggcggacg

SEQ ID NO: 8843 - DNA, 620 bp, Sorghum bicolor
  Predicted polypeptide sequence is orthologous to G450
tcagcggggcagagtacgtgcccacgtacgaggacaaggacggcgactggatgctcgtcggggacgtcccctggagaatgtttgtggaaacctgccagcgtctccgtctgatgaaaagctctgaggtggttaacttagcaccaagagctgctgaatgaagcatgtccaccgcttcaaagggaaaatggcctcttttgcttgctgaggcagtgaggctcttcatgcatcagagagaaacgtgtacagccatcgacttctactttctgttttggtttcagcatgcttttgatgagttgagaaaaggttgggagccgcctgtagcgccaccgggttcgtggtgtatatatatagttgtcatatagatgtgcaagatttttatgcttttgagtatatcacacatatattatttgtcatacggggaataaggccatcaggtacatggagctccccacctgttcttgcctgttgctttgctagctcgtcgtatcatgtcatgtgatgcgcaatgcaggtaaggcgtctggcatgggtaggtctcgtgcgcgtcgtgtaatggtttttgctccaagttttgtgtcttggacgctgtaaaaattgtatggtccgcttggcttttcagc

SEQ ID NO: 8844 - DNA, 888 bp, Sorghum bicolor
  Predicted polypeptide sequence is orthologous to G450
aagcctcctcctttacatttgcaagccagccggcctcctcgtcctggctcgcaagcaaagcaaagcaaacgaagcagaagcagggaagaagaagaaggcgagagccgagaggtgaggagctaggccagtggcgcctgcagcagcaatggcgacgacggacctggggttcgaggagacggagctccgtctgggcctgcccggcggcgggggagaggtggtcggcgaagggaggagctctgtcgtctcctccgggaagaggggcttcgcagagaccatcgacctcaagctgaagctggagccggcgactcccgcggccgtattgaaggcggcggaggcggacgagcatcaggacggtgttgccgccgccaaggaagacgccggctgcgtggccgccgcggaggaggccgccgtcggcgggaagatgaagaggtccccgagccagagcagcgtcgtcaccgccgccgccgtgcaggctgaccccgccgagaaaccgcgcgcccccaaggctcaggtggtgggatggccaccggtccggtcgttccggaagaacatcatgtccgtgcagtccgacaagggcgccggcggcagcaaagacgccgacaagtcctcgccggcggcggcagctggcggtggtgcggcgttcgtgaaggtgagcttggacggcgcgccgtacctgcgcaaggtggacctcaagatgtacaagagctaccaggagctgtccaaggcgctcgagaagatgttcagctccttcaccattggaagctgtaggtctcaagggatgaacggcatgaacgagagcaagctggtggatctgctcaacggctccgagtacgtgccgacctacgaggacaaggacggcgactggatgctcgtcggcgacgtgccgtg

SEQ ID NO: 8845 - DNA, 813 bp, Sorghum bicolor
  Predicted polypeptide sequence is orthologous to G450
cttcctccccaccggcggtccggcctccctcgctcgcccgcacgaagaagaggaagccgccgagcgcggagcccagcacgccgccgccggccatgtcggtggagacggagcggagctccaccgagtcctccgcggcctccgggctcgacttcgaggacaccgcgctcacgctcaccctccgcctcccgggctccgcccccgcccccgctgccgtcgcggcctcctcgtcctcgtcctcgtcctccgccttccccgacgccgaccgcaagcgcgcctcctccgacgccaaccccgaccgctcctccccgctcgccgcttcctccgacgctgcaccggcacccaaggcgcgggtggtggggtggccgccggtgaggtcgtaccgcaagaacgcgctcgccgacgtcgcgggatccagcaaggcaaaccaggccgccaagttcgtcaaggtggccgtcgacggcgcgccctacctgcggaaagtggacctccaggcgtacgccggctacgaccagctcctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgtttgtggaaacctgccagcgccttcgtctgatgaaaggttcagaggccgttaacttagcaccaagagccgcccgatgaggcgcactccacctgttggtacgcactggcttcttgaaggaaagaggaaactttgctg

SEQ ID NO: 8846 - DNA, 760 bp, Sorghum bicolor
  Predicted polypeptide sequence is orthologous to G450
cccttcctcacaaacgcgcagcagaggggccgagacccaagaagaagaagaagaaagcagaagcagcgacagcgagcaagcagaagcttagctagcgtggaggtgcccaaggcgagagggacaacgacggccgcgacaggctagctagcaaccagctgctagctcctgcggagccgaagccgatggctggcgccgacgtcgacgtcgggacggagctccggctcggcctgccgggaggaggcgccgaggcggccaaggccgcgaagaggggcttcgaggacaccatcgacctcaagctgaagctgcccaccgccggcatggaggaagctgccgccgccaagccggagccggcagccgagaaggccaagaggcccgccgaggcgccggcagctgatgccgagaagccacctgcacccaaggcacaagctgtgggttggccaccagtccgatcataccgcaggaacgtcatgaccgtccagtctgtgaagagcaagaaggaagaggaacctgagaagcagcagtcggccgctgccaacgccagcggcaacagctccgccttcgtgaaggtcagcatggacggcgcgccctacctgcgcaaggtggacctgaagatgtacaacagctacaaggacctctctattgctctgaagaagatgttcagcaccttcaccacatctgggaacaacgtgaatgaggggaaattggttgatccagtcagcggtgctgatgtggtcactacttacgaagacaaggacggcga

SEQ ID NO: 8847 - DNA, 552 bp, Sorghum bicolor
  Predicted polypeptide sequence is orthologous to G451
gcccttcgacatgttcatcagcacctgcaagaggctgaggatcatgaagggatctgaagccagaggactcggatcagtcaagaacaactgaggattgtcgcagatcgagatgcacggcttgtgcattcgtgagcagattcttttgttcttttggggtttcttgtgttgtccaaagcgtgtttgtctgccaacaatggagcagcaaaccaaaagcatggagaacgactgacgagaagatgaagctgcttgggttgaaggagagacagagctttgtgcatccaagtgcatgcgtggaagaatgatgtgtggtcactttgtttgttttgttttttcttttgtggtactacttgtaggtgttattagcaacacaaaaaggagtggagagtcgagttgaatctccatgtgtgtttgtacaaagccaaagatcactcttctttcttgtcttacttaagttatatctacccatcaatcaatcagtacttgattgcttctgtaagtgcaagtgctgcaagctaaggggggaaattgggcctttaattccccccctgtgag

SEQ ID NO: 8848 - DNA, 670 bp, Sorghum bicolor
  Predicted polypeptide sequence is orthologous to G451
gcggcggcggccaagaaggctgaccagcagcagcagcagcagggaggagggctgtatgtgaaggtgagcatggacggggcgccgtacctcaggaaggtggacctcagaatgtacaaggggtacagggagctcagggaggcgctggacgccctcttcaccaagtccttctcggccgccgcggcggagggcggcgaccaccagcacgccatcgcgtacgaggacaaggacggcgatctcatgctcgtcggagacgtgccctgggatatgttcatctcctcatgcaagaagctcaggataatgaagggctctgaggccaggtgatcgttgatgcataaacagaggctatggacacatcacgacatgggaaacggatcgaagagcacagatcgtgcctgaggaaggagctgtgtcgtggcttgagctctccagtgttgtacaaagagatgtttgtttctgaatccaagagggagaaaggtctctgaaggcgtgtatataaatcttagctagctgttttgtttcaagtcatgttttgtatgagcgaaggctgtaaaaaaaatgcaaaatgaaatgagaaatttgactaaagctggtcattttcctctccacatccttcgaaaaaaaattctcttcacaggttctcctctctgtatgagataaattacttcctgtc

SEQ ID NO: 8849 - DNA, 695 bp, Sorghum bicolor
  Predicted polypeptide sequence is orthologous to G519
attccaaagctctccagctagtcgtctcctccaaccagcagagaggccgcgcgcgaacgaagcgaaggccccagcacagcaatcagctgagctctcctcgtcctcgccctgctcgtctcgaacctcgaagctctccaatccgccggtcgatcgccggaggttgctaaggtcgtgccggatcgatcgatcgacgacgaccgagatcgatcgaatggactgcggtggcgcgctgcagctcccgcccgggttccggttccaccccaccgacgacgagctggtgatgtactacctcctccgcaagtgcggcggcctgcccctcgccgcgccggtcatcgccgaggtcgacctctacaagttcgatccatggcagctcccagagaaggcgtatggtggggagaaggagtggtacttcttctcgccgagggaccgcaagtacccgaacgggtcgaggccgaacagggcggccaggacggggtactggaaggccaccggcgccgacaagcccgtcgggtcgccgcgccccgtcgccatcaagaaggccctcgtcttctacgccggcaagccgcccaagggcgtcaagaccaactggatcatgcacgagtaccgtctcgccgacgtcgaccgttccgccgccgcacgcaagaagaccaacaacgccctcaggctggatgactgggtgctgtgccggatctaca

SEQ ID NO: 8850 - DNA, 803 bp, Sorghum bicolor
  Predicted polypeptide sequence is orthologous to G519
cctcctcccctcttcctccattagcagcagcagcgtcgaccagcagagcacaagccggcagcgattgagcgagggaggaacacgatgagcggcggcggtcaggatctgcagctgccgccggggttccggttccacccgacggacgaggagctggtgatgcactacctctgccgccgctgcgccggcctgcccatcgccgtccccatcatcgccgagatcgacctctacaagttcgacccatggcagctccccaggatggcgctgtacggcgagaaggagtggtacttcttctccccgcgggaccgcaagtacccgaacgggtcgaggccgaaccgcgccgccgggtccggctactggaaggccaccggcgccgacaagcccgtgggcacgcccaagccgctcgccatcaagaaggcgctcgtcttctacgccggcaaggcgcccaagggcgagaagaccaactggatcatgcgcgagtaccgcctcgccgacgtcgaccgctccgcccgcaagaagaacagcctcaggttggatgactgggtcctgtgccgcatctacaacaagaagggcgggctggagaagccgtcggcggtcgccggcggcgaccacaagccgatgttcgcagcggccgcggtgagctccccaccggagcagaagccgttcgtggcggcgccgggcgggcttcccccattcccggacctggcggcgtactacgaccggccgtcggactcgatgccgcggctgcacgcggactccagctgctcggagcaggtgctgtcgccggagcagctggcgtgcgaccg

SEQ ID NO: 8851 - DNA, 792 bp, Sorghum bicolor
  Predicted polypeptide sequence is orthologous to G519
gccacccaccatcgacagcacccagccgccggagcgcgagcttctttacacagcaggccggagaaacacaggcagccaaagccgccaccgcttttaccgaccgaccgatcggtgttgccgccgcctgtcgggtttaagcaaccaaccagaccaagccatgggattgccggtgatgaggagggagagggacgcggaggcggagctgaacctgccgccggggttccggttccaccccacagacgacgagctggtggagcactacctgtgccggaaagcggcggggcagcgcctcccggtgcccatcatcgcggaggtggacctatacaagttcgacccctgggacctgccggagcgcgcgctgttcggggtcagggagtggtacttcttcacgcccagggaccgcaagtacccaaacgggtcccgccccaaccgcgccgccggcaacgggtactggaaggccaccggcgccgacaagcccgtcgcgccgcggggccgcaccctcgggatcaagaaggcgctcgtcttctacgccgggaaggcgccgcgtggggtcaagacggactggatcatgcacgagtacaggctcgcggacgccggccgcgcagccgcctccaagaagggatcgctcaggctggatgactgggtgctgtgccgcctgtacaataagaagaacgagtgggagaagatgcagctggggaaggagtccgccgccggcgtcggcaccgccaaggaggaggcgatggacatgaccacctcgcactcgcactcccactcgcagtcgcactcgcactc

SEQ ID NO: 8852 - DNA, 815 bp, Sorghum bicolor
  Predicted polypeptide sequence is orthologous to G519
tggagcacaggggcaggacggtcggcatcaagaaggcgctcgtgttctaccacggcaagccgccccgtggggtcaagaccgagtggatcatgcacgagtaccgcctcgctgacgccggcggcgcccgcgccaagaagtccggcaacggcacgctcaggttggatgactgggtgctgtgccggctgtacaacaagaagaacgagtgggagaagatgcagcagcagaaggagaagaaggagatggaatcggaggcgtcgctctcgcactccgacacgcggacgccggagtcggagatcgacgacgacccgttcccggagctggcctcgctgccggcgctggacgacatggtgggtctagccccggccgccggcgccatcctgcccaaggaggaggtggaggacttcggcgaccttggcggcgacgactggctcgcggggatcaacctcgacgacctgcagatgcccggggacgccgacttctttggcaacatgctgtcgccgatggccgccaagatggagcaggacgccggcttccccttcttctgagatcctctgcgactccgaggacggattcagctcaaccgtgtatagttcagatttcttcaggattcagagaaaacaaacaaaaaacaaattctgctaatatctggttgtagtggtgtagtgcagaagtagcagtatgctggtcagttattaagattgaagttcattgtagtactctactgatgctcatcacttgagctgtgataagtgacaacattctttcgtttgtgctctgcaaattcttcaatgctcagaatatattgattcagatgg

SEQ ID NO: 8853 - DNA, 757 bp, Sorghum bicolor
  Predicted polypeptide sequence is orthologous to G519
ctcgcgaaggggtcgaatcggcggctgatttgacttcgctcgctcttcgagcaaagtgaaagtgatccgagcagtcacaggttcggaagcggcgggtcggccggagccggaggagaaacgtaaccaagtcgaggagatatgagcggcggcggcggcggaggccgagcgccggcggcgcagccgcaggagctgcagctgccgccggggttccggttccacccgaccgacgaggagctggtgatgcactacctctgccggcgctgcgccgggcttcccatctccgtgcccatcatcgccgagatcgatctctacaagttcgacccctggcagctcccaaggatggcgctgtacggcgagaaggagtggtacttcttctcgccgcgggaccgcaagtacccgaacgggtcgcggccgaaccgcgccgccggcgccgggtactggaaggccaccggtgcagacaagccggtgggcacgccgaagccgttggccatcaagaaggcgctcgtcttctacgccggcaaggcgcccaagggcgacaagaccaactggatcatgcatgagtaccgcctcgccgacgtcgaccgcaccgcccgcaacaagaacaacagcctcaggttggatgattgggtactgtgccgaatctacaacaagaaaggcgtgccggagaggccggccggagccggcggggccgaggcgagcagccagcaaggcgcgcacgggtcgatgggctcgccgccggagcagaagccgtccgtgc

SEQ ID NO: 8854 - DNA, 609 bp, Sorghum bicolor
  Predicted polypeptide sequence is orthologous to G559
gtcatttcctctcgcttctgctcggttgcagcccagcgtagatcttattcttggccgagaatcctcaagctctccaatttctgttcttgcgccgcttagcaattccgccccgaaattcttttgcggcgcagtcttcacccgaatcttgggtcgtaggttcgtagctaagaagatgaacaaggacaaggctccgatgccgggagatggcggccccagcgacggcttgccgccgcagtccacgcgccgtgccggggcgccgccctcgtcgtcaaccccaccaccggagtacgacatcagccgcatgccggacttcccaacccggagcaccggccaccggcgtgcgcactccgagatcctgggcctccccgacgacctcgacctcagcgctcccggaggcggcgacggaccatcgctgtcggacgagaacgacgaggagctcttctccatgttccttgatgtggacaagctgaactcatcgtgcggggcgtcgtcggaggccgaggctgagtcctcgtccgccgcgggtggcggcggtgagggggctgagctgggccacgcgcccaggccaaggcatcagcatagccagtccatggatgagtccatgtcgat

SEQ ID NO: 8855 - DNA, 605 bp, Sorghum bicolor
  Predicted polypeptide sequence is orthologous to G559
gatgaactttggtgccatgccacgctcgttgggaggcaaccagcagatgttccacaacaaccaagcgatgcaatccatgctggcaacgcaccagctgcagcagctccagctccactcccagcctcagcagcagtcgcaacattctcagcaccagcaccagcaccagcaactgcattcgattcaggcgcagcaacagcagcagcaactgcactcgctgcaggcgcagcagctccagcaggtggcgagagacctcaagatgaaagcgcatctggccggccaaggccagtggggcgatgggaagtctgggagcagtggcagctaagctttactggcactggaatattttggtgcacgtggtggttaggaatggagatcccttgttttggtgatgttgctgtgcaagtgtagttatcgttaactcagttatctacctataggctcagttcagcttcagttttatcgttaactcggtgatctataggctcagctcacctgcaacgtacttcagttcagaaactcggatggtaacagatgtttatctgttggattttgtttgtatctctttgctagtttaagggttaaaatggttggaatttcagggcttc

SEQ ID NO: 8856 - DNA, 707 bp, Sorghum bicolor
  Predicted polypeptide sequence is orthologous to G562
tgaggaactagccaggaaggtagctgacctaacaactgagaatagtgctctcagagcagaacttgacaacctcaagaaggcttgccaagacatggaagcagaaaattcacgtctattgggtggaatggctcactcccagggaccaagtgtcacaaccacattgggaatgagcattgacccaccaaaggtgcagcatcatgatgatgagggccagctccacaagaaatctagtaataacagcaacgggaactatgcgggagtcagccacaaaccggaggctaacactaggtgagagagacaaaggtggtgaggaaagtgacaaagatgagatgaggtgtttcttatctaaccacaacacccatcatcaatcagtgtgttttttcttagcaaagctgtcgttttagtcctcacagcccgctgggggccatgtagagtcgccccactgcagccatgtattatttatggctcgtcgcggtgtgctttgtgtctttgtgtgttgtgtaaacctattgatgtagctattgtaacaaacctagagagcctagagtttttaatgtttgctaactcctgatgagggatgtaaccggccaatttggtgcctgatcgatggttagatgaaatgcgagcaaatatcatttgatagcctgcctcgctttgttgtttggatggttgcaactttgtgggagagaattttatatgggttattg

SEQ ID NO: 8857 - DNA, 560 bp, Sorghum bicolor
  Predicted polypeptide sequence is orthologous to G562
gcacgaggccggtctctctctcctccgcgccacacgcatctcctgctgattgaatcaacttggcctcgcgactccggctgatccgtggcgcctcgctgccgagcggaaccatcacctgatttggcgagactagcagataaaatcatggctcaggatgaagctgtggctacccagaagactggaaatacagcatccccttctaaggattatccaactccttctccatatcctgattggtcgaccatgcaggcatattatggccctggtgtcttgccaccaacatattttgctccagcaatagctccaggccatccaccgccatacatgtggggtcctcagcctataatgccacccccttttgggacaccatatgctgcagtatacccacatggtggagcttacccacacccccttgtgcccatgatgtcaactccattgagcatggagcccgccaaatctgcaaacagcaaggagaaaaattccaataagaaacttaaggaaatagatcggactgcagtgtctgctggcagtggtaacagtaaaagaacaatgtcatccag

SEQ ID NO: 8858 - DNA, 618 bp, Sorghum bicolor
  Predicted polypeptide sequence is orthologous to G562
acaagtggagtcccttactacagagaacacgtcccttaggtctgaaatcggcaggctaacagagagctcggagaagctcagattagaaaattccgctctaatggtgaagctgaaggacactgcagcactgacccctgcagaaccatctccgcacacagcagtcacatcctcgtcctctccgggtgccgccgcggaaaatttcctttccatgatcgacagcgccaaggcggccggcgtcagcaggcacacggagcacggcgagcccaagctccggcagctcctggactccagtccggcaacagacgtcgctgccgtaagctgatgacgatccggctaatattacagcacagcacatgcatgtggcctggggatttcacaagctcatgctgcgcaccataaatgtcagagttattacagacttagtacaccagtttaggcactgattccagtaaagtaactgaggacaccggtaattttatctgctccgctgagtgccggactgcgacctctcctagtgtaccagtgttgtaacatagggtgttgtgctgcatgccaacctttaaacttcgagatcgtcctccttgggaccattttcggcgtaataacaaaatatgttcg

SEQ ID NO: 8859 - DNA, 781 bp, Sorghum bicolor
  Predicted polypeptide sequence is orthologous to G562
acatcaaccgaatggccagctaaggacgacaaggaatcaaagcgtgaaaggaggaagcagtcaaatagggaatctgcccgacgctcaaggctgaggaagcaggctgagactgaagaactggctagaaaagtagagttactgaccgcagagaacacatcactccgaaacgaaatcagcaagctaacggatagctcccagaaactaaggatggagaatgcggctctgatggagaaactagcgggaggtacatcagaccaagcacaagaagcgtccgcaggccaccagacgacggccaccgcgccaccaccgtcggctcgggtcgtcaagaacttcctctcgatgatggacgtcgaaggcccatcgagaggtggcggcagccggcgcacggagcacggtgcgcccaggctccgccagctcctgagctcaggaggccctctggcggctgacgccgtggccgcgagctgatccgcgtccgtccttccctttgtgctgagcgcgtgcacgcgtgtggcctggcgattttttttgaagagcgcccaagctgccccgcgagactaaacgcacgcacgacctgtaaattacagtagctatatgtgttccatgttccagacggggcatcgttccggccactctgctgtgagaaccgagatatggatgccgtctggctgtgttggtgttttgttcactgagcttttgactccgtgttgtctcagttgctgcgccgatgcaaactgaatcaactgacacgatgtagcattactaataataaccaacgcgatgt

SEQ ID NO: 8860 - DNA, 832 bp, Sorghum bicolor
  Predicted polypeptide sequence is orthologous to G562
cgccccgtccacttgcacgcataggcatacgcacctcctcgcctcgcctccccaccgcggcgccgccgccgcctctcctttccgagtcccgcctcctctggcggtgcgtgtttccccatccgccgatcctcgcgacgccgcctcgacctcgaccccgacccggcgcggccgccggttccaggcattcacaaaaaaaaatggggcatgatgaagctgtagttactcagaattcagtaaaagcaccgtcaccacccaaggatcagccagctatttatccatgccttgattggtctactatgcaggcatattatggccaaggggtcttaccaccagcattctttaaccctggaattgcacctggtcatgtccctccaccatatgtgtggtgtccacagaatatgccaccagctgcctttggaaaaccatatgctgcaatatatccacatgctggtggcttcctgcatcccttcatgcccctaatggtaaacccattgagtgcagagccagctaagtctgcgaacagcgaggataatagtttaaataagaaactgaaggaaattgatggaactgctgtttcaagtggtaacagtgaaaaaacaagtggggattacagcctagaaggatccagcgatggaaacaacccaaaggtgagcggaacgccaaagaaaaggagctttgatgataggactacatcagaaacatgtggagtttcagcaactaatggtaaaccaggagaatcaggaagattagcaactttgcccaatgtgcacattccagatgcaacgatgaaaccaagtgtgagcaccggtagtgacttccaagttagtggtgc

SEQ ID NO: 8861 - DNA, 614 bp, Sorghum bicolor
  Predicted polypeptide sequence is orthologous to G591, G793
ccacagtatcgcggagaggctaaggagagagagaattgcagaaaggatgagggcattgcaggaattggtccccaacacaaacaagacagatagggcagctatgctagatgagatccttgattacgtgaagtttcttaggcttcaagtaaaggttttgagtatgagcagacttggtggtgctggtgcagttgcacagctggttgctgatattccactctcagttaagggtgaggcaagcgacagtgggagcacacagcacatatgggaaaagtggtcaactgatggcacagaaaagcaggtagcgaagctgatggaagaagacatcggggcagcgatgcagttccttcaatccaaagcgctatgcatgatgccgatctcgcttgcaatggcaatctacgacacccaacattcccaggatggccactcactgatgaagcctgagcccaacacatcctcgtagtatagtaacatcaaccctagcgtgcatttcaaccccctaatactattaggcaccgatatatccaaaaaaaaaaagtgtatgatatacggagcgttccaatgtgctaaccgtgagataggaaaggaccttaaattggtatatgatgtagcctacc

SEQ ID NO: 8862 - DNA, 837 bp, Sorghum bicolor
  Predicted polypeptide sequence is orthologous to G598
ggcaggcactggcacgctcgcacgcacgcacgcaccagcaccacatgcatggtggagcctagcacgggcagctagctatagctccccgccgccggcgacgaccaccaccaccacatgttgcatgagcagcaggcaccgccatcaccaccgccggaagtagaagcagcgccaccgcccgtgccatcggcgccgagcccggccaggaaccaccaccaccacgacggcgacggcgacgtccacgatgtcgaggtcacgacgttccgcgacatccaccctctgacgcccgacgtgccgacgccccccgcgcgcaccaggtcctgggacaccgccagccaccgctccttctcgtccgaggagcagttcatgacgatgagccgcgagttcacggccatggccgccgccggggcgaccatgcagacaggcggcggcgccaacggtaacggcgggtacgacggcgaccagctcaccagcatcggcgaggacgagctggaggagaccaacccgctggctatcgtccccgacagccaccccatcgccacgcccgccaggtccagggcgtccgccgccgcctccgcctccgggctggaggtcgtgccggcgccgacgccgacgccgcagcagccgcccgcgcacgtggaggccagccaggtgaagaaggaggaggtggagaccaaggtgtcggcgtggcagacgaacgaggtggccaagatcaacaaccgcttcaagagggaggaggtggtcatcaacggctgggagaccgagcaggtggagaaggcctccgcatggctcaagaagatcgagaggaagctggacgagcagcgcgccaaggcggtggag

SEQ ID NO: 8863 - DNA, 739 bp, Sorghum bicolor
  Predicted polypeptide sequence is orthologous to G598
acaccaccaccccggagtccacccaaagcattcgatctccgacgagccgcagatggtttcgcggccgctagaggcttagcgttgaggaggaggaagcagtgtgccacatgttgggtgaacagacggcggctagcactagcagcagcagcggcagcggcagcggcagcgtcgagcatcaggagaggatcgtcgaggacaggcggttgcagccggtgggggagaacgaggaggaggaggaggagttcagggacatccacgcgctgagcccgccgccgacgccgagccagccgtcgtcttaccgcctccgggcgtcgtgggggtcagccgcgggcgggagcaggcacaggtccatccgctccatctggagcgaaaccgcggccgccgagcccttcccgactatgagcagggagttctcggccatggtcgccgccgcagccaacgccgcagccagcgccaactccaacggtgacatcgtcgacagggacgtcgtggacgccatgggcaggagcaggatcggggaggccgaggaggagctggaggagaccaacccgctggccatcgtgcccgacagcaaccccatcccgtcgccgcgccggggcccgcccacccctggaggcgccgacgtcgcgctgatggccgccaacggccacggccatggccacggcaacagcaacggcgaaggtgggatgtccgtggggcaggtcaagaaggaggaggtggagtcccagatcgccgcgtg

SEQ ID NO: 8864 - DNA, 819 bp, Sorghum bicolor
  misc_feature (82)..(82): n is a, c, g, or t
  Predicted polypeptide sequence is orthologous to G653
ggagaaggtgtttagcgggacgcagcagaagtgcaaggtgcgcaccaagacggtgtacccgatggaccagctctccaccganggcgtcgccctccaccgctcctgcttcaagtgccagcactgcaagtccaccctctccctgagcaactattcctcgttcgaaggagtgccgtactgcaaggcccatttcgagcagctgttcaaggagaccgggagttacaacaagagcttccaatcacaatcacccgcaaagattactccggaaaagttggcccctgagctgaccagatcaccaagcaaagctgcaaggatgttttcaggaacacaagacaagtgtgcgacttgcggtaaaaccgcatatcctcttgagaaggtaacagttgaagaaaaggcataccataagtcatgcttcaaatgctcccacgggggctgtgcgattacaccttccaactatgcagccttggagggcatcctctactgcaaacaccatttctctcaacttttcaaggagaagggaagctacaaccacttgatcaagtgtgcttcggtcaagcgcgctgctgaagcacagccagaacaaccagcctccgattcctcctgatcgtgccatttcaacagtgggggtttgaaggcgagagttgggaagcctcctgtttttacttaaaaacgcatgctgtatgtcattcatctatgccctgaggataccggactatctattttggtatcctttgctgtgctagctggatcacatcggtgaaccatggaactgatgtcatttccaatgaaattgttgtgcatcaagtagtgaaatcttcacgg

SEQ ID NO: 8865 - DNA, 739 bp, Sorghum bicolor
  misc_feature (614)..(614): n is a, c, g, or t
  Predicted polypeptide sequence is orthologous to G783
cctactggcatcctcttcctcggtcctccccagcaatcgaagacaagggcagagctgaaccgagccaggtcaaatctggccgcaccgcgtagcttctctctcatcctggcctcgattcgtggttgttttgggaaggagaggtatcggatcaggtcccttgatcactcatggtgcccagggacagggcgcatagcgccacaactgccaccgcggccccggcggagaacctcgttcaagggcctatcctgaacaacaagtgcgaaaagaaggctccaaagaaagtacataaatctgagagggagaagcgtaagcgcgacaagcagaatgatctctttggcgagctgggaaacatgctagaacctgataggcagaacaatgggaaggcatgcatattaagtgacactacacggatacttaaagatctactttcacaagtagaatctcttcgaaaggagaacaatacgctgaagaatgaatctcattatgttgccttggagagaaatgaactactggatgaaaccaatgtgatccgtggtgaaatctcagaacttcaaaatgagctgaggatgcggctagaaggcaaccctatctggagtcatgacacttctagatcnaatattacagcacctcatcctgcgaccacagtatttacattgcaacattcagcacatccacaagtcattgcaacaatggcacttcctctgcaacagccagcagtcgttgagcaatcttatgctgc

SEQ ID NO: 8866 - DNA, 577 bp, Sorghum bicolor
  misc_feature (540)..(540): n is a, c, g, or t
  Predicted polypeptide sequence is orthologous to G811
gggagaaaatctgttttgccctgttttactatggatttctgcaagaaccgaaaaggctaaaactttgtacatacaggacgggttccgcaaggttgatccggaccggtgggagttcgcgcacgcgtcgttcctgcgcggccagacccacctcctgcgcaacatcgtccgccgcggcagcagcggcagcgccggaggcggaggcggaggcggcggcggcaagaggaaggacgcaccagcgtcggtcaaccccgtcgagccttccgcggaggacatcgccatggtggccacggaggtggtgcgcctcaagcaggagcagcgcaccatcgacgaccgcgtcgccgccatgtggcgccgcgtgcaggagacggagcgcaggcccaagcagatgctggctttcctcctcaaggtcgtcggcgaccgcgacaggctgcaccgcctcgtcggcgacggcggcaccgccgccgcgccggggccagataataacgggttcgcctccgggggcgccgccgccgccgaggagggcggcgagaagcgggccangctgctgctcgacggtgacaacatggtggcgctcggc

SEQ ID NO: 8867 - DNA, 220 bp, Sorghum bicolor
  Predicted polypeptide sequence is orthologous to G811
gcacgagctgccctcctacttcaagcaccgcaacttcgccagcttcgtccggcagctcaacacctacgggttcaggaaggtggacacggaccggtgggagttcgcgcacgagtcgttcctccggggccaggcgcacctgctgccgctggtcgtgcgcaagaagaagaagaagaaggcggccggcggctgccgggagcagctgtgcgaggagggggaggag

SEQ ID NO: 8868 - DNA, 611 bp, Sorghum bicolor
  Predicted polypeptide sequence is orthologous to G881
ccgaggccgcccgcaccggcgcccgcaccggcgccgcaccgcccgcagctgcagctgctgcagcaagagggtgtcgcgatgaacgttgagcagcccgtggccgcggcggcgtcggagatgatccggcgcaacctcgcggagcagatggcgatgacgctgacaagggaccccagcttcaaggcggcgctcgtcaccgcgctgtccggccggatcctcgagctgtcgcctaccaaggattgacagacgcatcggatcggatcggttcgattggcatcacatacacgagattcttgctcagattgtcgtgcacccacgcagcaatcgtcaacaactgcgctggctgctttctctgttcatcgctgttagagcaaaacagcgataacagaacaagacatcaggatctgtagtgctgcacgaggaagaggaacaaccggagtccatggaagggagcagagatcattacgccgggtggtcgacgatgtaacatgcgaaatagtagcacaggacatgttagcatgaaattgtacaatccctagtactttgtagttgtaggcgaactgttcatccaattgatcaaatgaaatcattacaatttttttgagtttgaattg

SEQ ID NO: 8869 - DNA, 659 bp, Sorghum bicolor
  misc_feature (610)..(610): n is a, c, g, or t
  Predicted polypeptide sequence is orthologous to G896
gcagctgcaccattcttttcgacgaaggaaacggcaacgcgaccccagggccgcgggcgctgacgcgctgtgctgcgttttttttccccatcgagacaacaagacgaggccagccacgcgcaaaccgaatccaccaacgccaaacgaccgcatcaagtcaccaaccaatccacttcgccggcgagcggcgatccgtctcatctcgtcgcgtctccggcgccgacagccacgggcaactcggctccgagatcggcgggcaggatgatgatgctgatcgactgctcggggtgccgtaccccgctgcagctgccgcacggggctccctgcatccggtgcgccatctgtggggccgtcacgcacgtcgcccccgcccctcccgccgaccccaaccgcggcgccgtacagcaggcgccgggatgggggccgccgccgccgccggtgcacgggcggaagcgcgccgtggtgtgcgggatctcgtatcggtactcgcggcatgagctcaagggctgcatcaacgacgccaagtgcatgcggcacctgctcatgacgcgcttcaacttccccgacgactccatcatcatgctcaacgaagaacaaaccgacccctacnaaatcccaacaaagcataacataaggatggccatgtattggcttgtcca

SEQ ID NO: 8870 - DNA, 665 bp, Sorghum bicolor
  Predicted polypeptide sequence is orthologous to G896
cattgatgcttgtcatagtgggactgcacttgatttgccttacctctgcagaatgagcaggagtggtcaatatgtatgggaagatcaccgacccacgatctggtgtctggaaaggcactagtggtggggaggctatttcatttagtggttgtgatgatgatcagacctctgcagatacctctgctttgtcaaagatcacttcgactggtgcaatgacattctgcttcatccaagctattgaacgtggacagggcaccacctacggtagtatcttgaactccatgcgttcgacaatacgcaacacaggtgactcagcgggtgtcggtggtggtgctgttacatcactaattacaatgcttcttactggagggagcctttctgctggtggtctgagacaggagccacaactgacggcgtgcgagacatttgatgtctatgcgaagcccttctccctatgacgcgttcatggtattgcccaatgtattatatagcacctcccgtttcacgttatcatcgtacatttcactgttagatgtcctccatccatcgcgattgttaacaacgcgtgggattgccctttattcccatgccctcgcaatgttcagtgcacagttgtaaaaggagaatgcactttgacggctcagttcacttgtcttataaaccgt

SEQ ID NO: 8871 - DNA, 844 bp, Sorghum bicolor
  Predicted polypeptide sequence is orthologous to G896
cctactaacaaacgcaaggcaggtgccccagctcgctccgggcttagttagcagccaggcagccatgaacttcggcggaaatggcaacgcgacgacgatccggtgcaagtactgcagcgcgtgcctgaccgtgatccccggcgagcgcgccatccagtgcgcgcaatgcaactgcgtgacgcgcatccggcgcggcgaccgcatcccgccggcgcggccgccggcgcacgtgccgccggcgttccagcgcgcccgcggcaagaagcgcgccgtcctgatcggcatcacctacgccggcatgcgccgcgggtgcggcgagctcagggggcccatcaacgacgtcaagtgcatgaggaacctcctctgccagcgcttcggcttccccagcgagtgcatcatcatgctcaccgatgaccagagggatccgttcaggctgccgaccaaggagaacatccggatggcgatgcactggctggtgcagggctgcagctacggcgactccctggtgttccacttctccgggctgggcgcgcaggtggccgacgacgacggcgacgaggcggacgggtacgacgaggccatctgcccgctggacgcgttccagaggggccccatcctggacgacgagatcaacgaggccatcgtgcgcccgctggtgcacggcgtcaggctgcacgccgtggtggacgcctgctacagcgccacggtgctggacctcccctacgtgtgccacatgtccaggaacgggttctggcagtgggaggccgagagccccccgtcgggcgcctggaagggcaccagcggcggccacgccgtgctcatcagcggctacagcgagggcaaa

SEQ ID NO: 8872 - DNA, 805 bp, Sorghum bicolor
  Predicted polypeptide sequence is orthologous to G896
taccgagcgagggagctctgagctagctagcaacgcgtagcaactcggccggctagtagcttggatcgccatgaacatgggcggcaggaccccggcggcggcgacgacgacgatccggtgcaagtactgcagcgcgtgcctcaccgtgtgccccggcgagcgcgccgtccagtgcacgcaatgctgcggcgtcacgcgcatccggcggtccttgtcctcgcggatcccgctgccgccggcgatgacgaggccggcggcgcccatgggcgccttcccgtgctcccgcggcaagaagcgcgccgtcctgatcggcatctcgtacgccagcgtgcgccggggctgcggccagctgaggggacccatcaacgacgtcaagtgcatgaggcagctcctctgccagcgcttcgccttccccagcgactccatcatcatgctcactgatgagcagaaggacccgttgaggctgccgaccaaggacaacatccggatggcgatgcgatggctggtgcaggggtgcagcagcggcgactccctggtgttccatttctccgggcgaggctcgcaggtcgccgacgaggactgcgacgagctggacgggtacgacgaggccatctgcccgctggactcgttcgacaagggccccatcctggacgacgagatcaacgagaccatcgtccgcccgctggtgtacggcgccaagctccacgccgtcgtcgacgcctgccacagcgccaccgtcctcgacctccccttcctctgcaacatgtccaggaccgggaactggcagtgggaggatcaccgtccc

SEQ ID NO: 8873 - DNA, 708 bp, Sorghum bicolor
  Predicted polypeptide sequence is orthologous to G904
tctgcgcaaagcaagaaccaagaaaccagagaggcgagacgaccaagaaacgagagaggcgagacgagagaccaagaagctcttctcctccgcgctcgccgatgggagcggtgagcagttcgctgctccggcgcggagcaggggcggcggtccgagctccgccgatctctctcgcttcacggccagaggccgcagccccgccggcgccagtcctctccggggccgcgcatctggtctttgaggcctcgctcgcctgtccgtggaactgggatcccaaagctcccggcgccctctccgacgggaacttcgttctgaacctggatggggcggcggtgatgcgtaggcggctccagttcggcctcttcgtcgccatgaacgagctcgcggacggggagggggccgcggtgcggaggctacagatctgcacgagggcagagatagcggactggatcccctttgtaagacaggtgggcatactccgtgaaccccaagcttctgatgacggagattgtctcttttgtctcgaacctctcacgaaggatcgactgcgcagtctaccatgtggccacacgtttcatacgtcgtgcctagagtaccatttcatcaagaacagacttatggagaacagaggttttcgggctgcatgtccggtttgccgcgatgcggtaattcagtcagatttctaggactgttattgggctatatgtc

SEQ ID NO: 8874 - DNA, 762 bp, Sorghum bicolor
  Predicted polypeptide sequence is orthologous to G904
agttcggcgcctgcaactcgcagtgtcacccgacaacctcctcttcttctgctccgtcacggcgtcggtggccgccgccttcgccctcgtctcgctgtgcaggcacctggcgcaccggcgaccacagcaggagccctccgcgtacgacggcggcctcgcggcaagctcaggaggccgaggctccgccgagtcgtcagaagaagaagatcagctcctgccgctgagcgccgccgccgcggcgctccccccgttcatgtacaaccggctggtgaggcacagcggcaagggcgcgagctggacggagacggagtgcgcggtctgcctcggcgtcatccaggtgggcgccatggtgaagctgctcccggcgtgcagccatgtctaccaccgcgactgcatcgacctgtggctgtcgctgtcgtcgcgctccacgtgcccgctctgccggtgcagggttggtgctgcctcggtggccggcgccggccaggagacgacgacgcaccggcagcttgctcaagctcaaccttcccctgcatagatagataaaatcctcacgcgccggcatgtagcagatgtttgtactactaggccagtttcaccgctcactcgtctgtaaagaccaagctgccgcttgtgctgtatatactatgcgagtttgcatacagtttcattagaaacgtgagcatatttacatctcagctattaggggttcgtgatttattaagttgagattacggaaaaaaaccttgtttgtactgttgaaaa

SEQ ID NO: 8875 - DNA, 844 bp, Sorghum bicolor
  Predicted polypeptide sequence is orthologous to G921
gtctcctgagtcctcctcctgaccccctcggcctcgacagctgcggagagacagacgcacacgccgcggtcatcgatgctgctcatggactcggcgcgccgcgccggctgctccccgtccccggtctgcttggacctcagcgtcggcctttcgccgtcgtcgccggggagcagcggcccggaaacgacagctgacactgacgacaggcttgaccgtcccgccgctggctgcagggtggcatcgtccctgtctgacgagcaggccaagaccctggaggccaagctcacccaggtcagcgaggagaaccgccggctcaccgagatgatcgcctacctgtacgccagccaggtcgcgcggcagagctccagctcccccgacaccaccagcaggaagaggagcagggacagcctggagccgccgtcgaattccagcgacggcaacgccaacgccaaggcggagcccggcgaccatgccgccgtcgagagcgccctcagcgacgagggcacgtgcaggcggatcaaggtcaccagggtctgcacccggatcgaccccgccgacgccacgctcaccgtcaaagacggctaccaatggcgaaagtacggccagaaggtgacccgcgacaacccgtccccgagagcctacttccgctgcgcatacgctccctcctgccccgtcaagaagaaggtgcagaggagcgcggaggacagctccttgctggtggcgacgtacgagggcgagcacaaccacccgagcccgacgcgcgccggcgagctccgcagctccgcctccgcgacggccagcggccccgtgccgtgctccatctccatcaactcctccggcccga

SEQ ID NO: 8876 - DNA, 745 bp, Sorghum bicolor
  Predicted polypeptide sequence is orthologous to G927
gattttaatatttgtatggagaaaatatttcctatcaccattgttctttatggaagctaaaggttgtggttgctgctgaacttgcatttgacgttcgaattttttagcaagtgtcccatcgtgcttatggtctacattttgctccctcataacaatattgttaccagctgcttgggttctttttctctatcgatattatcgttggtactcacaattccttgtgcatagttcctctttcttcaaatcaattgtccctaaagttccaatgccaacattctggttaagattctgctccctcatattttcaccggctgctttgtttcttttcttctattgaaatcgttgttgttactcacgattcattgcgcgtagttcctctttgttctgatcaatggccatcaatactacatatgcagaacctaattgaacctaataaaaaaatgaatttgaatttaagaaatgcttattttgactgacctttaatgaattcatggatgaggatggatatcaaatggtggtccacaaagattgtcagtagaggactccacaaagatcggtagaagaggaccaaccgaatctataatattgtacaggatagaagaggaccaacacaatctgtaatataggaagcagatgtagttcggttgaagaggacaccaactcaatctgtaatattgcatagaaagcagatatacgtgcacgtgagactgaacctgtgggattgcttgaattatgagtgaggatt

SEQ ID NO: 8877 - DNA, 746 bp, Sorghum bicolor
  Predicted polypeptide sequence is orthologous to G927
aatgctcctgcatcttgttcttgcccaacctggtacggtgcttgctatgctcactccactttttattttgctgctgctcttcattgtagcatactccagtagctgggtggtggttcggttaggtacggtgccctcacccacatccctcgtcaacgtcgccagcaccagcaccagcaaaaccagcaagatgatgagcttcaggagcaccacccacgatgggttcgtcggccacgccgccgtcaatggagccggagcgccggtgccgtggtgggcgggggccccgatgctgtgcggcgagccgttgggtctggggaggccggtggtggcggccttctcgccggaggaccactgccgggacggccgcttccaggtcctccagggaccgccgctggatcctctcgtgccgtcgctcaaggctcctgtcgcacaccagcaacagactgagaaggggctctctgctgagctcctcaacctctccgtggctcatcaaggtaaagggaagaaaggttctgagcactccgccactgttgctttgcaatcaccattcgcaatatacaatggtcgttttgagctgggccttggtcaatcaatgatttccgctgataactcttatgctgaccaacactatggcctgatttctccttacccaatgggggcaacgcctggaggtcgtatgcttataccactgaatatgccaacagaagcaccaatttatgtgaatgctaagcaatatgacgccattatgc

SEQ ID NO: 8878 - DNA, 619 bp, Sorghum bicolor
  Predicted polypeptide sequence is orthologous to G938
aaaagaccaccgaaacacccaacggcggcctcgtgtatgctttcgcccattcctgctcgccccgtttctccccttccatcctgcttccttctctctttttttcactcccgatttccaaatctcaaacaataaataaccagaagagaagcgaatcttctcctccatcaacccagcaaatcgctcgttcgagcgtccattcgactgagaaattatcgtccgtcgcccccggctggctctcccgttcgccgccagggcccaatttcgtgtggacaggttgccgtgatcctttgctggatggggcagcgcagctagccacaagaggttgcctaggtttgagtttaatcgggttaccaaagtggtagttctcatggatcaacttgccatgcttgcgacggagctgggtgactcgtcggactttgaggtggagggcatccagaacctcactgagaatgatgtcagcgacgaggagattgagcccgaggacctggcgcggcgaatgtggaaggacagagtcaggctgaggaggatcaaggagcggcagcagaagctcgccctgcagcaggcagagctggagaaattgaggcccaagccgatatccgaccaggccatgcgcaagaag

SEQ ID NO: 8879 - DNA, 777 bp, Sorghum bicolor
  Predicted polypeptide sequence is orthologous to G938
caaccaacccaatcagtcattgaacaatctggatttcagcctgcccatggacgggcagaggtccatcgctgagctgatgaacatgtaggacaacaacttcatgacaaacaagaacctgagcagtgacagcgtcaccatcatggagaggcctaatgcgatgccccagaggatccagatggatgagggtttctttggacagggcaatggagtcttggacgatgtcaatagcatgatgcagcaacaacagcaggcaccagtgcagcagcagcagcagcagcagcagcagcagtttttcatccgtgatgacacgccatttgtgagccagatgggcgacatcaccagcacatgggagttcaggttcggttctggtttcaacatgtctagcaccgttgattacccaggcgcggggcagaagaacgatgggaccaattggttctactgaagaataagtttgtaggtctgaaaaacctcgtcataagctttggatttctccatggtgctccatggttctcgtaagttgtcaagtctataggtctttgtcatataggttttgcagtagctgcaagacggctggaacttggaactggtttatacttgtatgtccgtccagccataaaccttttatggaaacttaatgttattcctagttttaattgttagttccaatgctgttcatatatatggctgtcaaaatgcttgtgcttgtttctgtatgtgatgttgtactacctgttatttggtgtctgaatgaagtgttgtcttgagtaaattgtgctc

SEQ ID NO: 8880 - DNA, 749 bp, Sorghum bicolor
  Predicted polypeptide sequence is orthologous to G993
actactcatttcagactcagcaaccacctgcatcatctttctatcgatatcatcttgtcccagccctagcatagcaagcctagaacagtaaagtctcatcaataattccatactgtttctagctagcggcgaatactatccatcacaggccgcagagctgcagcaggcagtagagtacccaagcaaaaaagcaagaaaccaaaggcagcaagactccagggagcagcgcgagctgtagctctagctcatctcatcatgggtatcgagagcatgagccccacggcggcgccggcggaggattcctcctcctcctcctcgcgcttctccgccgcgtccacagccaccacggagtccggcgccgcgcagccacgggctgcttctgcagcaccgggcggcggcgcggtcgttgtcggccgggacgcctctctggcggacgagcaggccgtgacgtcgcagccgttggcggcgtcgacggcagcggccgtgacgcagggatcttcgcggttcaagggggtcgtgccgcagcccaacgggcggtggggcgcgcagatctacgagcgccacgcgcgggtgtggctcggcacgttcgccgacgaggaagccgcggcgcgcgcctacgacgtggccgcgctccgctaccgcggccgcgaggccgcccccaacttcccgggcgccggggcgtcggcgcccgagctcaccttcctggcggcgcactcaaaggcggagatcgtcgacatgctacggaagca

SEQ ID NO: 8881 - DNA, 758 bp, Sorghum bicolor
  Predicted polypeptide sequence is orthologous to G993
gcgagagcaagggcgtgctcctcaacctggaggacgccgcgggcaaggtgtggcggttccgctactcctactggaacagcagccagagctacgtgctcaccaagggctggagccgcttcgtcaaggagaagggcctccaggccggcgacgtcgtcggcttctaccgctcgtccgcggtcggcgccggcgccgacaccaagctcttcatcgactgcaagctgcgtcccaacagcgtcgccaccgcctcgacgacgacaggccccgccgtggggtcatcgcctccggctccggctccggcgccggtggcgacgaaggccgtgcgtctcttcggcgtcgacctgctgacggcgccggccgccaccgccgcggcgccagcggaggccatggccgccgggtgcaagagagcccgggacttggcctcgcccccgcaggcggcgttcaagaagcagctcgtggagctggcactagtgtagacggactaatgcgacggacggagcgatcgatctttctctttccctagtttagcagctagtcgttttctttttgcccgatcgctcaactcagatggtagcatcaccgttcaccgagctgaatttagtcccttctcggcaagcatctcacttagttcgttcgtttgtttatttcccatttcttcttgcattgcttcgatgtaaatcttctcctcaactgtatacttactgctaatggaggaaaaagaaaaacagccctagaaggctagatgatgatcatctgatctg

SEQ ID NO: 8882 - DNA, 1373 bp, Saccharum officinarum
  misc_feature (6)..(6): n is a, c, g, or t
  misc_feature (9)..(9): n is a, c, g, or t
  Predicted polypeptide sequence is orthologous to G1033
ttggcnctnccaccctcgcagccccggccgccaggcaattcgcccctttttcgcccggccgcgggcgggattcgctccgccccgcgcggggctgaccgctgcgctccgtgtcgccgctccaatccgccatgaagggggccaaatccaagggcgccgccaaggccgatgccaagctggcggtgaagagtaagggagcggagaagcccggccgccaagggcaggaaagggaaggccggcaaggaccccaacaagcccaagagggctcccagcgctttcttcgtattcatggaggaattccgcaaggagttcaaggagaagaaccctaagaacaagactgttgctgcggtgggaaaagctgccggcgacaggtggaaaaccctcaccgaatcggacaaggctccctatgtagccaaggctaataagctcaagctagagtataacaaggccattgctgcctacaacaagggcgagagcaccgctgctgctaagaaggctcctgccaaggaggaagaggaggaagacgaagaggagtccgacaagtccaagtcggaggtcaatgaagaggatgacgacgaaggtagcgaggaggacgaagaccatgacgaatgatggagctcgctcgagacgatggaccaagctttgaccaacaatggagctgcaacaaaaggccccggtggcgaaaaactataaggagccctaatccaagaactaggaataagcaggctccattcacatcgtgacgatataacttcgatgggccgcaacgaaagcgcccattgtgggcgcaccggcgctgggcagctgatcgactgaaagatggccgtagaccgaagaccggaacaaggagaacaggtaacataggaaacccgctggggaaggcgatcaatacgaaaagaaaaagagggtcaagagaagatcaactaagaacagacatcgcaaatacgatcactagagcacgaaagtaaaacaggcacagatacacagcatccggcacaaggagagccgactaagcctgcaagagacacatagccgcggccatacaaaagactgaagaagactatacacggggccaccgagactaggcacccctgaacacacaaacgagacgaaggaggaccaaaatgacagaacgcaagcaaacgctctcacagagtaccagtaagaacggagcggtatcaccaatcacacaggtctctaagatcaataacgtagcgatacacaacagaaaagagggtggccacaggcgacagtcaagacatagctctgaggtcaacctgcaaggacacagcgactggatacatcaacaatctattctaagaagaacgtgcacgcgatagatcggtacgaagcctatataaagcaccacgcgtgcg

SEQ ID NO: 8883 - DNA, 634 bp, Saccharum officinarum
  misc_feature (384)..(384): n is a, c, g, or t
  misc_feature (478)..(478): n is a, c, g, or t
  Predicted polypeptide sequence is orthologous to G1033
aatctaacattacccaaactgatattatcacaatgttagccgatgacgacaatggaaacagtaatctaggtacaagcgggcaatctgccagtgcggagcagcagacccacccgccggtggcgcccaacaaggagcgctatccgttatagcacaacaaaagtaaaaacatcacgatgtgaagtgaaactgaataattctgtacatggatataggctccttatagtttttcgccacggggccttctgttgcaagctccattgttggacaaagcatggtccatcgtctcgagcgagctccatcactcgtcattggcttcgtcttcttggtaccctcggcggtattctaatcattgacctccgatttggactttgcggactccttttnggtcttcctcctcttcctccttggcaggagccttcttagcagcagcggtgctctcgcccttgttgtaggcagcaatggccttgttatactctancttgagcttattacccttggctacatagggagcctttgcattcggggggggatttccaccttgggcggggagtttttccaacccaacaacaaactttgtcttaggggctttttctccttgaacctcctggggaaattcccctcttaaatccaaaaa

SEQ ID NO: 8884 - DNA, 1227 bp, Saccharum officinarum
  misc_feature (42)..(42): n is a, c, g, or t
  misc_feature (481)..(481): n is a, c, g, or t
  misc_feature (927)..(927): n is a, c, g, or t
  misc_feature (973)..(973): n is a, c, g, or t
  Predicted polypeptide sequence is orthologous to G1033
taaactgataccctgcaggtacggtccggaatcccgggtcgnaccacgcgtccggcaacgcagacctacacacggttccgtgcacacacccaaaccggcaaccctcgtcgcgatccggccccaaggcctctagatgaaggcgagggcgaggtccatcggcggcgactccaggctctcggtgaggaagaccaaggctgataaggacccaaacaagcccaagaggcctccgagcgcgttcttcgttttcatggaggagttcaggaaggactacaaggagaagcaccccaatgtgaagcaagtctccgtgattggcaaggctggtggcgacaagtggaagtccctgtctgatgccgagaaggctccctacgtctctaaggccgagaagctccaggctgagtacaccaagaagatggacgcctacaacaacaagcagtctggaggccccacagcgtctggtgattctgacaagtccaagtccgangtgaacgacgacgacgaagagggtgacgagtgattgatgacggatggaggagctctcgccctgcccaagtgcttgcagtcagtaaggaaattctcatcgtcgtgggccttaacggggctttgctgctcctttttaaccctctggaaaagctgtctggtctttccttagattgccattagaacttagttaattagttgggccgcctcccgcttctcctgtaaattttgggtaagtttggcacaaatttgtttggttcccctttgaaaaatttgaattgccacttttttaaaaccttgggtttaatgtgttgtttccggccttttctttccgggcaacctttggggaacccggttgggttggccaaattgggggattggtttaaaaccccttgcaaattctttaattttacccccccaaagccattcttatgtattggcctgggtttntaaaattcttccagattcttcactaagatatgcctgtgttttaacnacaaaacaaacactccccttcatcactttggaacccctgtacgtgtgtggccttattacaccacattttcaatacttcaaaaggggcgggccgccctctaaagaatccaaactttacttccccttgtttgtggaagtcaatacccctcttaataggtccactcaattacaatccacgggccgcgctttacaactctcttacggggaaaacctgggtttcccatttaacgccttggagaaatccccctttcacag

SEQ ID NO: 8885 - DNA, 845 bp, Saccharum officinarum
  misc_feature (67)..(67): n is a, c, g, or t
  misc_feature (436)..(436): n is a, c, g, or t
  Predicted polypeptide sequence is orthologous to G1033
atttcccaggggaaccagaccagagcattcccctccgctccacagtccctgcgtcactgcaccctangcctcagcaaaccctaaccgctcgtcgccatgaaggacacctcgttcaaggccagcggcgccaagcgcaagaaggccggcggcgccaagcgcgggctcactcccttcttcgtgtttctggctgagttcaagccgcagtacctggaaaagtaccctgagctcaaaggcgtaaaagaagtgagcaaggcggctggggagaagtggcgctctatgtcggatgaggagaaggcgaagtatggttctagcaagaagcaggatgacaaagcaagcaagaaggaaagcactatctccaagaaggccaaaactgatggtcgggagggagagaaagcaacaaagtccgaggttgaggatgatgatgagcacgatggtnatgacgatgaaaagttaatagtacgatggggaacagcagctttgcaattgggtgtttgcttcttcttaacttagcctccaatgtgttggtccttttgaaggtatatgccggaaggaaaatcttgtcatgaaggaacccttgggcctattgcatgcttgaatgcccgttttaacttgaaagaaccggaatctccttgccagcctcttcaacattgtgtaaaactggtgatattttttggtatatacgacatattaggtgaccatacccataattgggtttgcgacacttcgcattaaaaaaaaaaaaaaaaaaaaaaaaagggcgcgccgttttaagaaacaaacttaatataccgtgctgcgaaataaaaatttttaataggtacctaaattaattacctggcgcgtgt

SEQ ID NO: 8886 - DNA, 858 bp, Saccharum officinarum
  misc_feature (812)..(812): n is a, c, g, or t
  Predicted polypeptide sequence is orthologous to G1048
gcaccaggtcgaggggatcagcgtggatcagttcttcgacgcgctgtacgacggcggggaggggaaagatgagggggaggcgggggcaagcacggatgcggactctggcagggacgaggtggtggaagtcgtgacgccggagccggaggcggagatggagacggtggaggtggatggcgatgatcccgtcagcaagaagaagaggaggcaaatgaggaacagagattccgcaatgaaatccagggagaggaagaagtcgtacataaaggacttggagacgaagagcaagtatttggaggcagagtgccgccgcctcagctacgcacttcagtgctatgctgctgagaacatggcactgcgccagagcttgatgaaggataggcctgttggtgctcccacagccatgcaggagtctgccgtactcacggaaaccctgccgctggtttccctgctttggctggtgagcatcgtctgcctgttcctgatgcccgttctgcccaaccgaggtccagctgctccaagcagcggcggaagagatctcgtgatggcagccggaaagacaagcagtgaaaccttagagatactggaactcatccttctatggaaggcggtggcagagcacgagagccaagattaactacatactttacatttattgcgaactgttgctagtggtaggttttaggctcttgaagcttaccggagaagggacttgcgatggaaacttttcttaccggcttatgtctttttcatctaatcagcaagaacccttctcttacctaatcttccgaatcctacaaccttataaaatntttatccctcttatcccggaaaaaccactggcctttttttaaaggg

SEQ ID NO: 8887 - DNA, 807 bp, Saccharum officinarum
  Predicted polypeptide sequence is orthologous to G1140
tgacaagtacaacacacattctaaaaacctggggaaagcagaagagccttcgctcgacttgaacttagaacatagcaaatacgcaaatttgaatgagcaacttgtggaagcaagccttcgactcaggcagatgagaggtgaagaacttgagggattgagtgttgaagaactccagcaattggagaagaacctggaaactggtctgcacagggtgcttcaaacaaaggatcaacaattcttggaacagatcagcgacctggaacggaagagtacacagctggcagaggagaacatgcaactgaggaatcaagtatcccagatacccccatctggcaagcaagcagttgctgatactgaaaatgttattgctgaagatgggcaatcctctgaatcagtgatgactgcgttgcactctggaagttcacaggataatgatgatggttcggatgtatctctcaagttagggttgccttgtgttgcatggaagtaaactgcaaaagaggctccgtgtggatctgggtggagctgcacggcctcagcggataggcacttgtgttctggtcttatggacgacccccgactactgcaataaacttgcattggaagcgagatcagttaacctgatttgtcatccttgtggcttcatgatgcgatgttccgcttgtaccgtttgctaagatgtttacttttgttcttatatcactattgtactggtcgtgaaatctatctactatgcaaagttacctatggcttgcaacttctctaatgttttactgaaaacagcggcaatgtgaatggcgcgccggt

SEQ ID NO: 8888 - DNA, 1011 bp, Saccharum officinarum
  misc_feature (1)..(1): n is a, c, g, or t
  misc_feature (3)..(3): n is a, c, g, or t
  Predicted polypeptide sequence is orthologous to G1140
ncntacactaactggtctccgcagtacggtccggaatcccgggctcctaccagcctctcgactgcttccgaagcgcgccgcagatctactccaacacctctgctgcggcgccgccgcgggtggaggagcaagagagaggcacgatggccgggaagagggagcggatagcgatacggaggatcgacaacctggcggcgagacaggtgaccttctccaagaggcggcgggggctgttcaagaaggccgaggagctctccatcctctgcgacgccgaggtcggcctcgtcgtcttctccgccaccggcaaactcttccacttcgccagcaccagcatgaagcaggtaatcgatcggtacgactcccattccaagaatctccagaagtctgaagcgctgtctcagctgcagtcacatattgatgacggcacttgttcaaggctaaaggaggagcttgctgaaaccagccttaagctcaggcagatgagaggagaggagctccaaaggctgagcgtccaacagctgcatgagcttgagaagacccttgaatccggcctcggctctgtactcaaaaccaagagccagaaaatccttgacgagatcagcggtctggaaagaaagaaaatggaactgatcgaggagaatccaaagctgaaggagcaactgcaagtgacccggatggccaagatggagacgccacttggcgtcgattcaaaattgtgtttgaggaagggcagtcctctgaattcggtgaaaaaacattctattcgggcccattaacagaaactgacgaatggtcccatacatcgctcaagctccgggctaccattcttcagctcgaaatggtgggaatcaggaaatttggactggccccatggggtaacggagtggtgccaataacctgccccctcccctctaaattggggaaacaggattgtgggattaataaaccaacgggtttccatcaaatttaaggattccaagtggcgattgaaaatgggtattctcgaaaggg

SEQ ID NO: 8889 - DNA, 611 bp, Saccharum officinarum
  misc_feature (411)..(411): n is a, c, g, or t
  Predicted polypeptide sequence is orthologous to G1140
aagacgaaagtgctatagtgtttattttactttaactcctcaaacctaacaccccctacagttatttagggctacaacagaaacacctccttcgggttttcccagctcctatattaccagtataaatacaatccggtactactacagtcctacagctactatatcttgatgaacaagctgtacaggaggggagtatctgcatgctagctagtgaccatcagcgcctgctatctaactgtattttgcttcgttttctgcctgttaaacgcaggaatcagtgtccaaatgcggattaatcaaaggttgccccggttgcagtagcagcaaccatgtgaaattgtgagtgaaacttcagagcgatgggcatgaagttgaagggacatctgagaaacaagctctggcctgcatganagcggcttcacatctcagggaaggcttctgctatagcgcctgacttgccatcttttcttggcagatccttgacagtgcttctacatggaaattttgtagctcttcaaggactttaacatctaggcccctgaagtcctcacccttcaatctggaaacgacgcttttcaattctttgcagcgcattctttcataattgtatg

SEQ ID NO: 8890 - DNA, 682 bp, Saccharum officinarum
  misc_feature (621)..(621): n is a, c, g, or t
  Predicted polypeptide sequence is orthologous to G1146
aaatgatcgccaatggacagacaggagtggaaatattctacctggcactgtagttgataagaatatctgccacccaacagaatttgatttcttcctgtgcagccatgctggtatcaagggaacaagccgtcctacgcattaccatgtgctgcgagatgacaataagttcactgcagatgctctgcagtctctcacatataacttatgctacttgtattcaagctgcactcgctctgtgtcaatcgctcctcctgcatactacgcccacaagctagcattccgtgcccgcttctacatcaaccaaggctatgatacggcgacaagtgtgggctcttttggttcatctgctcctgctgctgctggtccgaagccacttccggagatcaagggtgaactgaaaaggctcatgttctactgctagtccgtgaccactgaaaacctcctgaacaaggctttgctactgaagtctcaagtcccttgactgctctgaaggagacttggataataacgtctgcacttggatgcattattctgttcgctgttccttaaatggataataacgtctgcacttggatgcgtttttctgttcgctgttccttaaagtactgctataattgcagngactgcttggttgtagtttgtggtttgaattttattttataaacaaatgaactttttgctt

SEQ ID NO: 8891 - DNA, 542 bp, Saccharum officinarum
  Predicted polypeptide sequence is orthologous to G1146
gttctaaactctcaccaagttgcagacatctccctaagttgatagagttagatgatacaactagacaataactacataggaaaaatataaaaatacaatggatattactttgccacatgaaaataactccaaacaaaataccattgattcaaagattgcttggaagtaggcaatttacatagcataatgtcaagtacataaagagcctcttgaggagcgtctagttgcctcccagctagaaacatagccaaatggttactgtgagcatgcagagaagggtgtttctagatcttgttaacaccatatacacttgtcaccatttgtacttcaaagtttttctgaaccatatcacataattttaaatacaccactactaaatggagtttaaaaaattgactattatctctaaaggcagcaacacaccatagaaccagtggaattctagacatgttaatcttgttgaggggattggataattttcaagatgttctccccctccaaaaattaaatttatcagaaattaaaataaggttattacaacc

SEQ ID NO: 8892 - DNA, 847 bp, Saccharum officinarum
  misc_feature (3)..(3): n is a, c, g, or t
  misc_feature (9)..(9): n is a, c, g, or t
  Predicted polypeptide sequence is orthologous to G1146
acnaccggncttgaattaccggcccgagccacgcgtccgtgaagcaggagtggaacaacttctatcggaatgtgcaagatcgtgccgctaggggtcttggtcatgagctggcagtcatgtgccaaatatcacgaatggattttgctcttgagtctgtgctgcctccagtgactgcaaggcctgaacatgttgaaagagcgttaaaggcacgttatcaagatgcaatgaacatactgaggccacagggcagggaactcgatctgctgattgtaatactgccagacaataatggttctctttatggggatctcaaaaggatctgtgagactgatcttggattggtctcccagtgttgtctgactaaacatgtttttaagatgagcaagcagtatcttgcaaatgttgcactcaaaataaatgttaaggttgggggaaggaatactgtacttgtagatgctttgacaaggagaatcccccttgtcagtgacagaccgaccataatatttggtgctgatgttacccatccacatcctggagaagattccagtccttccattgcagctgatgatgcttcgcaagactgggctgaggtcaccaaatatgctggactagtgagtgcccaagcccatcgccaggaacttatacaagatcttttcaaagtatggcaggacccgcataaaaagacagtaactggtggcatgaaaaaggaacttttcatttctttaataaggcaacttgacagaagccccaaggatcttattctacaagattggtgtaaataagggacagttttaacactttttgtgaaagaaattgaggcgcctccaaagggctgtgtccaccttga

SEQ ID NO: 8893 - DNA, 972 bp, Saccharum officinarum
  Predicted polypeptide sequence is orthologous to G1146
ggaaaattaacttcggcggtgcattacggtgtgccagcatcaccaaaacagtgcaggtacttggaaaaatattcaggtcttaggtaaagcatgagcgcagcgtcaatcttagcagtagaacatgacgcgcttcacattttccttgagggcaggtaatggcctcacagcaacattcccaacaccagccctggtgttgcgtgcctctggtggagggccacggcttggcgtagcaccgctcgccatagacccactgtcagtggtatccggctccatgtagaagcgagctcggaaggctgccaggtgagcatagtacgcaggaggtacgattgatactgagcgagtgcacctagcatacgtgtaacacaggttgttggtgagagtttgcaacccatcagccgtaaatttgttttcatcccacagaacatgataatgggcagggcggcttgttccctgaatgccagcatggctacagaggtagaaatcaaattcagttggatggcagatctttgagtccactacagtaccaggcagtatgtttccacttttatcaacagcacgtgggtcattgtgattattagcaaacaacctagtgtgatgacgcttctggaccacaacaaaagtaactggaggctggtaatcccgacttcaatgatgcacaagcccttctaaatggcattaagttcatacaacaaaacttgggaaaactgtccctcactgacaccatccctggagaatatgaccccttttggttctgtccaagtggccgccaaaaagaaaggaaaagtccctgaccatgccaccaaaaacagaccctttggggaacttgattaccttgaaagaacctggttaattttggggatgggcttggacctccataaaccggcatactgggaaccctaaggccaccctggaaagcaacaaccgctgcaagggaaggactttaaactttcccaggaggggggaggggtccat

SEQ ID NO: 8894 - DNA, 621 bp, Saccharum officinarum
  Predicted polypeptide sequence is orthologous to G1146
agagccatcagtctccactgtgactccgtgagctgcctgccctgcacactccccgcaccgccgcaccagctcagcaatcatggctcgcctactcctcctcgccgccgccgcagcggcgttcctggccgcgtcggctgcatcgccggtggccagcgacttcatccgcaagtcgtgccgcgcgacgcagtacccatcagtgtgcgagcagagcctggcgtcgtacgggggctccccgccgccgcggagcccgcgggagctggcgcgcgcggcgctgtacaccagcgcggacctcactacatccattgctgcctgctgttgcttctcaagactgaccagacgttacgaaggatgcttgatagatttggactcaggcacaccggcaagagctgattcaagacctttacaacacataccatgatcctcagagaagcgctgtaacaagcggcatgagcatggaactctgaattgccttaaggagtgcttctgggcagaagccggtgagaataatgttctccgacgacagtaggacttgagaccagttggaccgaattgctccctttgcaaggagcaaacgcatgcccaacatcatgtacgttcgcgtggaaccgagttagccagccg

SEQ ID NO: 8895 - DNA, 621 bp, Saccharum officinarum
  Predicted polypeptide sequence is orthologous to G1150
atgtacagtggtttttattactagtacccggcgatcattaccatgggcatatgcatcgatgaatggttccataaacaacaaaatatctgtgtattccaactatcgaataacatatctaatacgtctggcctccttagtcatagactcacaattacataaacccttgggcaaaagattcttattgagtacggcaaaactatcccggctcctccgatctgatcgggttggagtttcccaactaaccgattcttcgggaagaaagaatagaaggtatcatgcatatcttggtcggggctcctatccgacgatggcggaataagcgcctggatctacgactacgtctctttctcagtcttactcgtcaactctctgggttcccgatcgaccgaatctagtgttgagacattcttatcctcatgagatcctgacggaggccacggacgaagaaaaaggctgaaactcggggaggtggcgcacgagggcccaactcttggtcttcacatcgaacaaccacagggcggtgccgccaccaccgccctcgccatcaagggccccggtccccgcgaacctttttgttcctccaccggagggcaaagaacggggggggcgatccgaccctta

SEQ ID NO: 8896 - DNA, 979 bp, Saccharum officinarum
  misc_feature (440)..(440): n is a, c, g, or t
  misc_feature (498)..(498): n is a, c, g, or t
  misc_feature (510)..(510): n is a, c, g, or t
  misc_feature (520)..(520): n is a, c, g, or t
  misc_feature (556)..(556): n is a, c, g, or t
  misc_feature (561)..(561): n is a, c, g, or t
  misc_feature (613)..(613): n is a, c, g, or t
  Predicted polypeptide sequence is orthologous to G1198, G1806, G558
ccaataacccatgatggtctacaatatgaactgagcgttcacttgaacacatacatgtcatcccttcataagatcttagattcaaatatctcactaacacatgagcaatgtgaagaaactaatggacatactagagacagtacaaaaaattatcctatttatgaattaattgaatttattcccttggacgggcaagccaaagagaactcaaagcacgcagccgagagaagtagtcgcttattgcaagtagagctcgtgctgattgtcgggtggttaagatgcgttgcatttgctgaagtgtttgcagccgtaaattatcagcctgtcgtagaaagttctcaagggtgccaagttttcccatagccatcgccatttgtcccatgtaatttgcaacattgccagaaggtccagcagggcccagggatccagatgctagagtntctgcaagcgactgttgtagtgcttccatcccttgagaaagagcatcttcagcttgtngggaggactgtngcaggtgggnatatacaacaagctgctgatcagtaagaggctctangtganctgccagcaacttaagaagctcagatgatcggaagccacctaaccacatganacatctctcagcaggggtcttccacatcccagacagcacatgaaaaacatctgctttagctggcacacccttgagcctgaaaattcgtcgtagtgtgccatatgctatcaacaataccacgaggatcattatcgccggcatgtgcattgactgcagccctcaaccatttacatgttggtgtgctcctccaaacagcgtgatattcatggtcaattgccaaacttcatttccactgggtgatggagcttgacttctgatgtccaaataaaattaacttgttgacagacccgctgaactctggctccacctgagtaatttcaaccggcaacccccaggtttggagggtgcccccaaccttaaaaggta

SEQ ID NO: 8897 - DNA, 742 bp, Saccharum officinarum
  misc_feature (545)..(545): n is a, c, g, or t
  misc_feature (599)..(599): n is a, c, g, or t
  misc_feature (615)..(615): n is a, c, g, or t
  Predicted polypeptide sequence is orthologous to G1198, G1806, G558
gcacgagagtgaatgctcatgcaagtgacagtgatctacgacttattgtagatggcataatggcacattatgatgaaatattcaaggtcaaaggtgttgctgcaaaggctgatgtatttcatatactttcaggcatgtggaagacacctgctgaaaggtgcttcctgtggcttgggggttttcgtccatctgagcttttaaagctcctagcgaatcacctcgagcccctaactgagcagcaaatgctgggtttgaacaacctccagcaatcttcccagcaagcagaggatgcgttgtcacagggcatggaagcactgcagcaatctttggcagagactttagctggatctcttggtccatcaggttcttcaggaaatgtggcgaactacatgggtcagatggccatggccatgggcaaacttgggacactcgagaattttcttcgccaagccgacaacctgcgacagcagacattgcatcaaatgcaacgcattctaacgatccgacaggcttctcgtgctcttcttgccatccatgactacttnttcgcggtgcgtgctttaagttctctgtggcttgctaggccgcgcgaataactntggatcatcgctgttntgagttccctgtgcctgcctgttggaattctatggcacgctggatgcctggatcgcagcgacaccatgaagatcattcatggtcctgtgttttgtgtacaattacttttggctgctgcttggcgaaa

SEQ ID NO: 8898 - DNA, 676 bp, Saccharum officinarum
  Predicted polypeptide sequence is orthologous to G1198, G1806, G558
acaaaataagcagataaatgagctgaggactgcagtaaatgctcatgcaagtgatagtgacctccgtcttatcgtcgatgggataatggcacattatgatgagatattcaggcagaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcaacaattgatggggctatccaatctccagcaatcctcccaacaggctgaggatgcattgtcacaaggaatggaagcattgcagcaatcattggcagaaacgctggctgggtcccttggtccatcaggatcttctggaaacgtggcaaactatatgggtcaaatggctatggccatgggaaaacttggcacactcgagaatttccttcgtcaggctgacaatctacgacaacagaccttgcatcagatgcaacgtatcctgacaatccgacaagccgttcgtgcgcttcttgcaatccatgactacttttcacgtttgcgcgccctgagttctctttggcttgctaggccacgagagtaacatcacccacgttggggtcactccatgaactgatgatctgtgaatgtgggactg

SEQ ID NO: 8899 - DNA, 1024 bp, Saccharum officinarum
  misc_feature (601)..(601): n is a, c, g, or t
  Predicted polypeptide sequence is orthologous to G1246
ggggggggtttttaataacaacactagctctgccaatcctgttcactcatctaacacaatacactaaaaacatctccataagggaggtaaataactcgtggcaaatattcactaaatgggactccacaacaaattgaaccatctacaaccaccgtacaacacactaacatcaccgagaactctaactcactacgcactaaggcccgcaccacacataatctaactaacccaccctctggtcttatacccacctcgttgctgcttagcaactctagaactccgaaccaccttctctataacaatagcaaccgccctcgacaacaccgtcaacctcaccagattcttcaccttaagaagaaagttccgtcaacttcctctttaaccttgcctcaccctcggccggcaggctcctcttcctcccaacattctgaacacctgggacaacacccctgttctcttgctccccgccaatagacacattcctcgtgccccctttcctcttctttctcattgcctgcttcaggagcccttccagaggaaaatgaaaaggttctcaccatcaggctccttcttgttcaaggcgctctgagcttcctcaganaacaaatacacataatcaccccaacccaaataaccttaaaaaaacataaaactatcacaacactccctttaacaccaaatcatcaccaaacaaatacaaacccacccaccacataacttttgtcttcctgaccccatcaaacttcacataaaaaaaaatcctaacataaaaactaacaacactaagcaccagacacaccatctgtttccaaaaacaccactagtcacactatccacgcccaacacaagccacacacaaccaaacaacccggaatccttagatcccctcacaccataacccaccaccaccccttaagtaataaactttacacaaacaaacaccaaggggtgatccgtgtccctccacacctagaacaccccatcactttcaaacgctataattccccacaacaacaccagccca

SEQ ID NO: 8900 - DNA, 963 bp, Saccharum officinarum
  misc_feature (467)..(467): n is a, c, g, or t
  Predicted polypeptide sequence is orthologous to G1272
cagcgagaggatttgcaaagaacaaacgtttccgctgaggcagagaaatggtagcaacggagatggtgataccattgaaatagctgtctatgactactatgcgaagaaaggaattgatctaaagtattctggtgatttgccctgtataaatacagggagggcaaagcgtccaacatattttccaatcgagctatgctcccttgttccgcttcaaagatacaccaaagctttgtcaacgctacaaaggtcatcccttgttgagaagtctagacagaagcctcaagaaaggatgacagttctaaatgatgcactgcaacgcagtaactatgattctgaccccatgttgagggcatgtggcgtttcagttgctccaaaatttacccaagttgaaggaaggatccttcaagccccaaagctgaaagccagcaatggtgatgatatcttctcacgaaatggacggtggaatntcaccaataggaagtgttatcaaacctgctctgtaaataagtgggcggttgtgaatttctctgcacgttgtgatgtccggaatcttatccgtgacctgatgaggaatgcatctgcaaagggaaattcaaatggaggaaccttttgatggtgtgtggaagagaagtcctcctatgaaggcgtgcacccctggtccaaaaagagttggatgattttgttggggggcaaattaaaatctccaaacttcccgggaagctccctaaagttcccctccatggttgtcctcctcccctggaaaagggaaacaatttgccaaaagtcctaatggttcctctgggaaaaagaaaagtggccttggccccaagttgtggttatttgtccacccacagtgttctaacctccgcaacaaaaagtgccagggatccgggaccccgggtttaaattggcggggatgagaaaattaatggcaaaccctgtggggggcctgaaaaccccggg

SEQ ID NO: 8901 - DNA, 784 bp, Saccharum officinarum
  misc_feature (441)..(441): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (468)..(468): n is a, c, g, or t
  misc_feature (471)..(471): n is a, c, g, or t
  misc_feature (486)..(486): n is a, c, g, or t
  misc_feature (489)..(489): n is a, c, g, or t
  misc_feature (492)..(492): n is a, c, g, or t
  Predicted polypeptide sequence is orthologous to G1335
gagcacaatggccaacgactcgataacattcatatattatagatagttcatgactgatagatcgggcagagccacccatgatcatggctgccctacaactcattccaacacaaagacactgatactgctccgagacagatctaaactagtacatctccatacggcttgcttttcttgctacgaccacctacgatagggatcgacgagaacgaaacacgacactggtaccacaactactgatagatagctggctccgacgacttcatccagagtaagccgagcgataccttgagcgggtagggaagcgggcgggagacgacatgggactccgccggatccggcgcgacgggggcgccgcgcctagcgcctagcgcctcttctcggggcagtcgcgggagatgtggccctcctggtggcagttgtagcactcgcgggcaccgncaccgncgncgncgtagccaccaccgncanctccgtagccgccgncgncgnctctgtagccgccggcgccctgggagcagtcccttgccatgtggccctcctcgccgcacttgtagaaaccgggaacggcggccacgccaacaaccggagcggctccgccggcgtaaccaaggttcgccgcccacagacgtaacacccgtcggaatgcgtcaacgttatccggggggaaaaacccccgacttgtccgttgactcgcagacaaaggaaacactagccgagcctgggtgtgcgtagataaattgcggtttacaccaagtgactccacaaagcccaaaaaagcgag

SEQ ID NO: 8902 - DNA, 676 bp, Saccharum officinarum
  Predicted polypeptide sequence is orthologous to G1341
gctgtattttcatttttggattgaataaccagagctgagctttttcgaacctgcatccgagaagagattatctctaccaaaaaggaaaagacggcctcgagatcaattacttggtgtaaatgaatcttgatgggatttatgcgcctactactactatagtgccattaaaaaatgataacagccacacaaaggttgcaaggtatttttgttactagaaatctaggactgtatacattttatacagtgaggcaacattgcttcaggtcagcagcctcttcacgtcgagggtccggtctgagcttcgcttgaagttgtacaccgactcaaatgcctccatgcagacgctggcaaagcccgtcatcgcctggaaaacgttagggaagccagtctgcaggttattcaaggtcattgctcttgtgaccccaatgctcttctcatacttgctcttctcctcatcggtgcggctcctcagagtctcaacctttgcccgcttgtcagctactggtgattttcgtgacatttctctgtaaccttcagcaccaatatatgacccatattttgactctagggatctcagctcctctgccttcttctcaaattctttgaatgcagactctgacctcttcttctgcttctgttcctcagcttgttgaatgacaacaggatggatcactgt

SEQ ID NO: 8903 - DNA, 869 bp, Saccharum officinarum
  misc_feature (667)..(667): n is a, c, g, or t
  misc_feature (759)..(759): n is a, c, g, or t
  Predicted polypeptide sequence is orthologous to G1451
agatatgaagtcgcatgcatgcatgcgtacgttaggatgcattctcatagggcgcccttgggttttttttttgagcaaaccaggcatgtgattgccgtgctaagcaacaagagggctattgcctgatccatcattagagagcctggctacattcacaggattagtatttctccatacaagaacaacgtttcagcatgtataccaacggcggcgacccgccgtcggtagttttctacttaggagttgatgatatcatacgacgaacagaattattaggtggtacataacttggagagctaaggcttggtccgcactgaacttccattccagctccatccatcccaaggtcactagaccattggaagtgcaaaacaagctcgcgggtcgggtcgcagaccagccctcagccctaacctgagggcatgtaacttgctgctgctgcgggcgccctatcctctgctcatcataactcaaccgacccgacggacgcaatcccggtgcttaggcttctcgactcttgagtcctgctaacgtagtcgtcacagctgctacctagtctccgcgcgggggccgagctcaggagctccaagccctgcttgcccatctgctgcacctcctgcggcgagagtatctttatgcaggacaacgtactcacgaattctgccangggtcgtcgcccacgaaaaaggacgtcctcctcacggtcgacgaatacaagctgccagcctgatctcaaaaggtctttccactgggccctcnagggcaaataagcgcccttagtcccctacggagctcatgattacttactaaacctagtgatatcgagcgaacttccgtaaggtgccaaatttgtaaaacctcaccaaagg

SEQ ID NO: 8904 - DNA, 882 bp, Saccharum officinarum
  Predicted polypeptide sequence is orthologous to G1451
agtggccaattgatggcatcagagggatggccttcaaagaggttggctgtggaatgggtgggtagtcatgagctccaacctgtgcagctcaagcttgagaaagtgaatcaccagagtaatgcatctcatgtttctggcaccttgccgccactgtcaacaagagacggttctagtgcccaggcttgcggtacaaatgttcagagtcacctgctttcatcatcatttgcaatccatgatggcttgtcaaccgtcaggagtggtggtgttggcaatggaactgatgcgacaaccatagcttcgttgagatatggtgatatgaatttgctacctgaaaactccatagcaacttccagttgtttgggtgaatcaggaaccttcaattctcttgacgatgtttgtcgtgtaaacccatcacaaggtggaaccttcttgaagggttacaaatcaggggccctcgggagatcgctcgatatcaccagattcagcacctactggcgagttacattccgagctcgagcggttatttggccctgaaggccaacctgacggaccctgtaaaatcagtctggcggcttgatttcgcgtccccgtgaaaagatattttcctttcgctgggacaccccggggaagaagtttccgccctacggatgggttgcataatgatgtggccaaaaaaaggggggggggaggggcccccccccaccatccccctcttgatagatgatggtatgtgagattttttaaaaaaaatgattttatctaatttgttgatgaccaaattattgttcgtgtcgtcattggttggttcttcgacccgtaggagaagtgtcgggttatatagagggtgaggattggatgtgcgggcgctccccccccccccct

SEQ ID NO: 8905 - DNA, 1004 bp, Saccharum officinarum
  misc_feature (634)..(634): n is a, c, g, or t
  misc_feature (638)..(639): n is a, c, g, or t
  misc_feature (792)..(792): n is a, c, g, or t
  Predicted polypeptide sequence is orthologous to G1451
tgaatgggtaccgttccccccctcgagtttttttttttttttttttagcggtattggtactcgatagaagaactaggtgctgcctgctggcatgtatacaacatgtagtagttactgctaagagtctatatcataggaaatcatcagacgtggaataacacagggcttcatttgatctatgtgctttgttgcaagtcacaaaactaggaggtgctgcagaaacatacagaaggagaatcctaaagccgaaggctatgggctggctccctgtcttcagaactcgaccgaacccactggcgccatcccagtgctcaggcttctcgattcctgcatgctcacatagctgtcgcagccattgctcagccttcttgaagaagccgagctcaagagctgaatgcctggcttgcccatccgttgaacctcctccggtgaaagtatctttatacaggacacactgtttacaaattcctgccatgggtcatcgccaactagaaggacatcgtcctctctgtcaacaaatacaagctgccagcctgatctcaaagggtcttccaactggccctcaaggccaaatagacgccccacctcactacgaagttcatcataactgctgaatctagtgatatccagcaancttnnaacggttccagatttgtaaaccttcacaaaggttgcaaactgttgatttgcttgttcagaattctctgcacatggaacataacctgactcatctaagcaacccgcactatgtagtggttgattcaaggggaaatcattctgagaagggctcangacattggaggttgagtatggaatcgtgtctgaactgttatcattctgaaggcttggaatgccaccttgcttcaaaagggctgggagtctattgttacaccaaataaaagtgatttgaagaacagacttccattttgatccataagccatctcctcaggtatggtgctatgcggagctttgggggatgttcatgaagcctatccacggtcct

SEQ ID NO: 8906 - DNA, 1274 bp, Saccharum officinarum
  Predicted polypeptide sequence is orthologous to G1510
cgtctctgtaaaagagctatcattcagtgtactactccatgtagaacatgattatacagtgactgtgccacaagtacaagtctaacacacaaatataaaatgtggccatccaaagaaacacttcaccacaacacgtggccactaagaagcacacaacaacattacagaaacttccggcatttgcgcctgaacatccaaattttgaatgagagaacttggcgccactaccctagtacaaaatgccttcacatgctcctgacgaaccaacaccagccatccacacgctccaaatctgccaacctccatagctccatagcatgctctccatagctccatagcatgcaggaaagtttcatcttcaaccatggccatagatctaaatacagcacacgctaaagaaaatgaagagccctctatacctgcaggaaaattccatcctcaaccatgacaatagatctaaatacagtactaagtgaatgatatgaagaagcccttgccagacctaactcaagaagttcatgatgatgatggtggacatgaaatccataaccgccaggaagatcaactgcatctcattcaagaagcacaaattgcatccactcacaggtcagtcccaatatccccagaaaaaacgaaatggtggtgggcatggcataaatctcaataatcccgcgttgtgacgggccacgaaaaagaaactccatgaagggaatgtctcccctcaagtcccactactacaagcaagttacttggtatgggtacaaacaaactttaaacctccacaaaattcctatgaaccacacacatagcaagtcttgaaggttgacaacacccatcaacaagacaaaaaactttaatttcgacgcctcccactaaaccaaatgattttgagccccaattaaaaactggtggtcacccacatgcacccaccatagatcaagcaccccacaggaactcgagtctttcctttacgggtgcacgaagacattcacccacatcgtggacctaatgttcgcggtcacacgtaataataggaagcattgtattcacttggtactcagaaaacacactgtgccacaaatagtcccaaaggaactctactgagataaagaaacacaaagacgtttcatgcagaacaccacaagactggtcacggatatacacacaatctctaaagatccgtccactttcgacaacactcacatagtgtcggacacacattacagtccacgaactcacatgcgctctctactgctcgacacacaatatctctt

SEQ ID NO: 8907 - DNA, 604 bp, Saccharum officinarum
  Predicted polypeptide sequence is orthologous to G1660
acagcgagcaatttttctaccacgcccaaagatcacgggtcatgctatgttacaaggcgggtgactagagctggtcattcatcagagaacgagaatcacaggcaccagcaccagcaggagaaagaggaagtcgtatgcccggtttctcggatctgggccgcctgctcctccgttctcgcggcttcctggttccgcctcacctccgcggcctccctcttcgcctccgctcggtggcttacggctgccagctcgctggcgagactgtcctgctcgcgcgcccgttttcgctctatcttggcctctatccttttcatttcagcttcaattttcgctttctggagattttcccaagcttggatctttgcttcctccctctgaaaccttgcaagatactttgccttctctgcctcctgccaatctgccgctcgattctccctgttgatatcgacagccttataggctgtagtactcgtggaatgtacagcggctttctcttccttgcttgcccaagcagctatagtagtcttgcctaacctttcgccaagatccataaattcctggtcttgtacttatttgtggctcctcttcagacatctccatcttg

SEQ ID NO: 8908 - DNA, 865 bp, Saccharum officinarum
  misc_feature (1)..(1): n is a, c, g, or t
  Predicted polypeptide sequence is orthologous to G1772
nagcggcgccctgggtgttttatttgcaccccaaaaataggttcattgaatgagatcagattccgattacatacagggcaaccaatggaaacaactatggccgactactacacgctcaaatcagcaaaactgcagcttgctaacaagacatttcccagctgcataagagccctatgcgttaacaggaacaacaggctacctaacctaactctatagcatttacagggtaaacgggaccactatacaaaggatgggctaccaggtctaaatgtcagttaccacctatctacaaacattgaaccaagcctctcaccctgcactttgcgcagctatcaaagaaccatgaatcctgccttctttccttcccttgagcacaagaagcattgccctttgtcagctctggaaccaagaaaccaaattatttacttgcagggcagcaagattgattgaagttgtccaagaagcaattcctatacccattatctagttcccgagaaaccacaactggatcctgcgttacttgggtgacaagaaccctggccagcagagccactacaacaaacacatgggatctcattctgaattaaacagcctctatttgatggatgctttgaaaaaactgacaaacaaaggtgttcctccccagatggatgtaattggacaatctgttccctttggattaagatcaaacgaagccttggttcaccgggaatcccgaacggacctggagggttccagcttcctatatggagtcgattaaactggggtaacctgggctaactgttcccgggtgaaatggtacccgtccaaatcccacaaaatacgaacccgagcttaaggttaaacctgggggcctatgagtggg

SEQ ID NO: 8909 - DNA, 711 bp, Saccharum officinarum
  misc_feature (632)..(632): n is a, c, g, or t
  Predicted polypeptide sequence is orthologous to G1772
agaacaaaagaccattggtcctactttattattatcaaaagtaccaagaagcagttccgagcacaaacagtccaccagcagatctggtggcctaagccagaaagaggattcactctaaagaattccctctaaacttcagaaacatcacttaaaagctagcgaacaggcaaggtcagcccgcaaaccaagccaaaccgaaaacaagttcaacaacaatcttggcctgaacatcaagcaagaaccattagaatgaagttcacaaacacactaaactatgacttgctgtccacagtgacagtcaattacaatcttagtttcaatttagcttgatccacccagccaacctggtccttgttcaaaacattccatctactgtgctcaccctcagacaagctgatttgctacatttgccatggaacttatgatcaagtcctgtacttggaatcggagggagtacacgatccaacccagcgccaagccagcatcaacaaatatgcgtattccaatctccactcttagtgcagaggtaatcatctgatattggcatcagagattcccctagaacggatcatcatgctatggcatccctgatccagggaacactgaagatcttcccgtcatctatcaatgtntctatgcagtgaaatggtgagatattggcatattttaactcccagattcctgaaagaaatacatcctccaacaaattac

SEQ ID NO: 8910 - DNA, 720 bp, Saccharum officinarum
  Predicted polypeptide sequence is orthologous to G2
gcatccttgcacccctgcacgtaccgcggacttaacgggccgcgagcgcacccactgccgtccgcttggataagcgcaggcgtagctgaaagaaccccggggggacactacgcgtgtgtggatggtggcaagctcagatgggtcactttcttggaaagaagtacatctaccttgttctgtatgacagtgtaatcgaactaccaagagcgtatgacaggccatccattcgtttcaatggaccggatgctgatactaacttcgactctagttcctatgatggagatgtcccacttccacctgcaattgagaaagatgtggttgatggggacatccttgatctgaatttgaggatttcacaacctaatgtgcatgatctcaaaagtgatggtaccctgactggttttggattaggttgtaattctcctaaagcttcaagctccattgtttctcagccaataagccctcagtggcctgtgcatcctcacagcacactgatgcaaccccagcatcaacatctgtatgcatctccttgtccaggcttctttgtgaacctcagggaggcgcctatggaggagaaacgggcagagccggcgggtccccatccccaaccggcgttcccggcttggacatggcaaatgcagggctcccctgccccgtttctccctgctactggagcatcattaggattttttaccgccaccgtcacccgtgtggaccccg

SEQ ID NO: 8911 - DNA, 786 bp, Saccharum officinarum
  misc_feature (526)..(526): n is a, c, g, or t
  misc_feature (740)..(740): n is a, c, g, or t
  Predicted polypeptide sequence is orthologous to G20
ggggctgcaggccgtggctgtggcgcggggaggggagggcggctcgtcctcgtcgctcagcgccgttgcgcgggctgcggctgtgtcgtcgtccggggagctggtgcccaggagggcgttggcggtgcggaaggagcgcgtgtgcacggccaaggagcgcatcagccgcatgcctccctgtgccgcggggaagcggagctccatctaccgcggggtcactcggtacgcgccgcaccgtccctgcctcccctccgtgctactttgttgccgcctgctccagagcttaggccctcgccaatcttgtgcgcgcgcttccatcggatggctccttgtctgaatctcctttgctaagagcttcgcgcttccatcggatggctgcttggctgaacctcctttgccaagagcttgtcatgttgtttcggccattcgggatctacaatgtgcgcgcaattccaatgcactgtagctgtaggtcgaatggttgcggcacagagtttcttcctcccatgcaccgaagaggtttatntccccgtattcagttggctgttggtggaattggaaatgaggcgatctcccaggagcttccgttagttaagctctcttgagtctaacagcgttgacttcccatcttaccggcataggtggacaggtcgatattaggctccactttgggaacaaacccgtgggatccgaatccgaacaaaaggggaaacagtatatttagttcctatgataacaanaaggctgacaaaggcctattaactttgtggattaaataatggggaa

SEQ ID NO: 8912 - DNA, 587 bp, Saccharum officinarum
  Predicted polypeptide sequence is orthologous to G2116
gatttgaaacatatatataataattatggttaatatgaagtctactacattatcagtaaatataagaggaagcactgcatgaatatggtacgatacaaagcagtgtgcatagtgatggacaatctgttcggtacaaagcacgcacacacataatagcttatactgatatgtctattcaatccataaagttctaataggtgttatgacagaaaatagcaggcgcaatattttacaatggtcagtccaggaacctttggtgctcagcagaagctactaactcttgaggcattacttgtctagcactgcaaaagatgcctaacatggcagcacagcctattttgtggccttggttgaggcagactttcgggtgttgatttttggttggaggctggagccatctgttttgcgcctgattagtgcttttagtcttctgctctgatggcaagcgaggtgaggcgctcttgtcgtcatcagggaggtcatcagagccaaaatcttcatcagtgataagatcctggtagatgcaatcattttttggtgcggtatcagttgcagaggcttgtggaggtgtttgcgaagagcccgca

SEQ ID NO: 8913 - DNA, 1002 bp, Saccharum officinarum
  misc_feature (13)..(13): n is a, c, g, or t
  misc_feature (522)..(522): n is a, c, g, or t
  misc_feature (566)..(566): n is a, c, g, or t
  misc_feature (636)..(636): n is a, c, g, or t
  Predicted polypeptide sequence is orthologous to G2116
cggacgacctttntttttttttttagcttgccaacacaaaatgtacagggctcaacaaattgctgagaatacattgtatgttcaaaggagaggattcatgaagcagtcaacatggctaaaaacaacaaagtaccatcagagaatttcactccaaaatccaaatgccctgataataccgaacccagaaacaggaaatgagcccaaaacaaacagacttgaagggttcctggatcattctactacatggattgatcagccagtgcgataacgaacaatttcaactaattgaatgaatcaaataacaaataagcttacagagcaggaagcagcacaaggatgtcaggctattatgaacaatggggacctactggaacggcagattctcattggtaggtctcgttagaaggtgctgctgctttcactagcagagatcgagctgctctctgacttcacaaccagtggccccttcccaatgtccaaaccctgcagccggccaagagactcttgctgcattatgtctgngagagtgtttgggtgggacagcatctggtggtttggcacattgngatggggtgggtggaacggtggaggcaactgggtgctaccaaggtgtggagatgcattttgctgggaatngcggaagaaggtagagttgattgaacatggtaaaatctatgtatatgtctcgctgaatgggcatctaccagagcatgctaaacctttcacgtctgcttagtgcatattaaggatacgggttgagctgtgctcatgctgaactttttaagttgattttgaaaagcagcggccttttatatgggtgacggaagccgtttcacaaagttgccttcgtagttgaaaacagcctctcttagaaacgtatgctgtacaaattttgccgtcgggatggcgaatcgcaaattatgataagactttgctattcttgtcagacccagattttcggcccgactttcggagaaaaaggactaccgtaataattattta

SEQ ID NO: 8914 - DNA, 1112 bp, Saccharum officinarum
  Predicted polypeptide sequence is orthologous to G217
aacaaatgaacaccttattctttattgcgggaaattactcactgaaaacaacagatacctgacgctaatttacttcctataggacacaggtgcacatgcaatcgggaacgccagcagactggggctgaggcgccacataagatgaacacccaagcctaagtagactccatgggaacaatatggacaaacatggcgatggctgcgcacgagatgaccatcggctgcatgctgacagcacaagccctgcttaatgaccaaatgccatgtgcctgcacatatcttgggcctacaacctgcaatccggaaaccgacttgggcggcctgactcatgggccgtggaatagatgcaaaaccagatcgcagggcctgattgagcacaactagcctacgaagctgaagcttagtgctgtcctgcatctccacctcctcatttatgcgcagctcagcacgaaaaggagttcctctcggtgataaaccaaagcgtgggccacttcctagatggcgacataccaatccttggaggaataccaacaccagggcttgccaaaggagtcgccattggattcggagacgtgatctacttcttaacgcggggaaccaccagagaaaatactgaggggtgaagcttttgggttggacacttccaaacagaggcgttggggaatcttctaaagacgggcaagatgtttcggcctccaatataaatgcaataacccttcccaactgggaactcgtggcgaattccaaatggtttaattaccaaacccttggagtctggaaagagctgcgaaaccacaggtttgggggaagaatcttccttcacaagcctacgactaatacggaccacgcattgcccaacttgttggaacctgtgtcaccccggaattcgaaccggacatacggggaacgatttcctattgggtagataaactcgctaaactggatacttcaaccggtgaatatatcggcaccttaccaaataccgacgagattaggatgacggggctctaggcatctctctattattccaccagccctcataaaaaacacccaccctataacaatacaccaaagaacttaatttggctaactactataccaccagtaatatg

SEQ ID NO: 8915 - DNA, 679 bp, Saccharum officinarum
  misc_feature (516)..(516): n is a, c, g, or t
  Predicted polypeptide sequence is orthologous to G217
ggaaatgcaggacagcactaaacttgagcttcgtaggcaagctgaactgaaaaaaggcctgcgatctggttttgcttctattccacagccaaggaatgagtaccagatagtcatgccacctattacagaggatgagacagaagaagctgaagagaaaattgaagaggacatgtcagacagactggcacgagaaagggctgaggaacaggctaggcaggaggcattgctcagaaagagatccaaagtgttgcagaggagtctgcctaggccacctgctgcttcagtagaaattatccggcaatctcttattagaagtggagaaagcagaagcagaagcacctttgtgcctcctacatcacttgaacaagctgatgaactaataaatgaggagctccttaggcttcttgagcatgataatgcaaaatatcctcttgatgaaaaaactcaaaaagagaaaaagaaagggagcaagcgtcagcaaaatgggggagctcttgtccctgaaattgatgattntgatgaagatgaactaaaagaggctagttctatgattgaagaggagattcaatatcttcgagtggccatgggtcatgaaaatgaatcttttgaggactttgtgaaagccatgatgcatgccaagaggaccctatgttttttcctaccaacattacctatggtt

SEQ ID NO: 8916 - DNA, 880 bp, Saccharum officinarum
  misc_feature (803)..(803): n is a, c, g, or t
  Predicted polypeptide sequence is orthologous to G2394
agccccgaccccgatcgcctcacctctgcacgccgcggcgcgcgcgcagtgtccactggcacggccgccttccgtctgtgggggcgcatctggtgctagctcgccgggctagggttggctttaccctcgtctaccttttccgtctcgtctgtgggggcgcatctggtgcacgcggtcgtcgtctctcgctccggctgtgactgcgcgccagccccgcttgcttcgtcctgccacgggagggccactgctgccgtcgcgtccaccggctaattctcctacagagcaactatcttggagtttgagatctatacctgaagattcatttgaaatctggaagcttcttttgttgggtacagagaaatatttcccgctttttgaggaagactgcagagcttctaaatgtgaaacttgcttcttttcttgtctactcctgaatgctgatgaactcagcctgtcacgttacttagctcaaggtcatactggtacgaacgctgatgatggagcaagcaacaggtgtaagtggtcctgagcacataattgatattccaagggcaattggtccttctgcttcggtttctcaaagtgttggtagagagaaccatgaagaattgaatcctgtggacaggccttcaacaagagctctagtacctgccttgcaggcaccatcagcaataggtgccgtaactaatgcagggcagacttcaggcactcggagaaatgacaactatgttcgtcggcacagaagccctttgaattctggactgtggatttcaattgaagttatcgtcaatgtgagccagatngtagctgccattgttgtccttggtctggtcaagaattggaacaccacaagctccattacttgagtgggtccatagtt

SEQ ID NO: 8917 - DNA, 760 bp, Saccharum officinarum
  misc_feature (485)..(485): n is a, c, g, or t
  misc_feature (630)..(630): n is a, c, g, or t
  misc_feature (644)..(644): n is a, c, g, or t
  Predicted polypeptide sequence is orthologous to G2457
cacgctgcttgctctctcccccgagcgaggctcctccgaagttcgaacatatataccaccgcccgccgcgccgccgccacctccacgccggccagccaccaagcaagcatggatatggtttcgcagtccgagcacctgtgctacgtccgctgcacctactgcaacaccgtgctcgcggttggggttccatgcaagacgctgatggacacggtgactgtcaagtgcggccactgcaacaacctctcctacctcagtccacggccccccatggtgcagccgctctcgtcgactgatcaccccttggggccattccagtgtcagggaccctgcaatgagtgcgggaggaaccaaccgctgccgctggcctcgccgacatcgactgagctcagcccgagaatgcccttcgttgtcaagcccccggagaagaaacaccgcctcccatctgcttacaatcgcttcatgagggaggagattcaacgcatcanagctgcgaagccagatatccctcacagggaggccttcagcatggctgccaagaactgggcaagtgcgacccgcgctgctcgacgagactgctctgctgcacttcacagcgtcagacctaagtggccactctcagtctgagccgcngattgagaaggcangacagcatcaactcactctcacaatgacgccattaaggcatcgagggcgagccaacagatcagacatcacttatatatattatgcgatcgcgacgcagcatgcttatcccacatct

SEQ ID NO: 8918 - DNA, 623 bp, Saccharum officinarum
  Predicted polypeptide sequence is orthologous to G2535, G961
agcagcagccgccttgccgccgccgtgcccgtgctcgttgttactgccgtgcttgctggccccgcctccgcccgatgactccttgtggtggtgcttcttcttgaacaccctgcacaccacccagccgtcctcctgcccgccgtccgacgacgcagccgcagcagcagcagcagcggcgaccgtggcggcagcggcggcggcagcatcgccggagccagcagcagcagggtcgtcaaggcggtactcatgcataatccagtcggacttctggccgtgcggcgcgcggcccttgtagaagacgagcgtcttgcgcatgccgatgcgcttgacggcgttgtagatggccttgtcgcggccggtggccttccagaacccggcggcggtggcgcggttcgtgcgcgtccccgttgggtacttcttgtccttgtggctgaagaagtaccagtcgttctgggggcccgaaccgatcttgcatttctcttggatgtcccatggctcgagcttgttgaggtcgacgtcgcggatgacatcgaggtcgatctcctgggagggcaccttcttgcggaggtagtagttgagcagctcctcctccgtcgggtggaacggaaccccggcggcacgca

SEQ ID NO: 8919 - DNA, 725 bp, Saccharum officinarum
  Predicted polypeptide sequence is orthologous to G2574
agctggtggtggtggccgtggatgaacgaggccgaggcggcggaggtggtggagcccgaggtgagcatggccaccgccgcggaggtcgtggacgccatggccgtcgccgccggcgggagcgggtggttgtgcgcgccctcgtacgtggtgatcaggatcgacgtgtcctccgcgcaccgctgcacctgcttcctcaccgggcagtgcggcgccaccgtgcagcggtagtaggcgcgcgggcacgggttccccttggagatcttctgaccgtacttccgccattggcagccatcgggcatcgtgggagtgtcgcatttgaccctgacggaaaccctagccttcttgggctgctgctgcacctcgtcgtcagctccgtccccgacaccggtgctcgggctcttacgggcggtgcccgcggcggcctgcatagcaggcctggcgttgtcgtcgtcggcgctgccgctgctgtcagagctcaggttgaggacaggcgcggcggacgcgtggctcgccttatcgtcgtccatgggcgccgtggacgccgacagcccgctcccgcgcgcgaagccgagcccgagggagagctggtggtggccttcgtcatcggcggcaggggtggtcatctcatcagcggtgccggacgaggacgacaacctctcgtgccccttgcggcgggagggggcgccaccgccaccgcttttggcccctcgtgccgaggctcaggg

SEQ ID NO: 8920 - DNA, 747 bp, Saccharum officinarum
  misc_feature (581)..(581): n is a, c, g, or t
  Predicted polypeptide sequence is orthologous to G264
tttcggtgttctatctcttttttatgacagagaaggatcgctttacatatatacaagctatctggtctttccctacaatctcatagtggtagcttggcaggccattgcgttgtaccagcgctgtgattagttagaacagatacactgatagcctgcaggcaacataaccttgttgtttgcacaaacagtgtccacggtaacagggtcgggcagtcggccagaagaaaacaaactatggtatctctggataccataggaacatcttaatccaaatacttccatccgcatgctgaacagactgtattaacaaccgcagccgatatagtgtctcattgatcgaagggtcaagtacaaaacagtgatatacgagcatataatggtaaagatactcggagccattgtgataaagctagagccgctgatgtctgggtccatgttctttcagtcgaggcaggctaccttctgagattacatcttcatatcatcgtgaccaactgcattacctgcatctgcaccgagttccccctcatgcagaaggtcctcccagaaatcatcatttaactctgcacttggcctgccanttagacgctcagagccaccagaagaaacaccttgtggggactcgaaaccctttgcctcaacagatgaactttcgagatcagatggcacaccattggcaagttgatctatcggctccagcggtaaaaacactggctgtgacccttgctccaggcttaaaccagtgcc

SEQ ID NO: 8921 - DNA, 784 bp, Saccharum officinarum
  Predicted polypeptide sequence is orthologous to G274
ttacgtaagcctggatgctctagagcggacgccctttctttttatttgtgtgggctaagttgaatctgaaatttacagttggattcaggtaaaaggcctgagcacgtgtcgtgacattacgcaggtacggtctcggacctaaataattcgactgcacgaaaaaagctatcactgaattttacaacaatagcaggccgattgcgcccatcacccatgtatggttgctgcaaagtctcacttcttgggatcaatggatgcaggcacctaaataagccagcagagaattgaagtaccaatgattattcttttctcagcgctgtccaagcccttctgggaaagtgcagaggttgtggccatacagaatacctaaacctgctctagctggtctgatgggacaagtggctcatgctcgtcaccagcatttgacattctatccatgccacacaatccctggggactttataggcacaagagaggccttgtccagggcagtcaaaaccttgtttccttcaccgtttgctccctaaacaaaatggtatcacgcttcgtccatggcctaaaaaccgcaactgggaacattggttgactctctcaaaaagttccctaaccctccaaaggacaccaactgttaactaccatagtggacactattataataatgggttgcataacctcagatacgatacccaacatgtcgggtctatcgataacctccccgggctatgagttcaacattactctgtccctgggataccatccctcccgcgcaacgataaactccgct

SEQ ID NO: 8922 - DNA, 2616 bp, Saccharum officinarum
  Predicted polypeptide sequence is orthologous to G274
caggctagaagatcataaaatgaacaactttcaatctgtcaagtgaaagccacagtagcgaccatcgactgctactatcatgcctgaacaaccagaatctagttgcatgacaaatgaaccttcaatttcaattttcaagcacttcagtgttcagaggaaaactaaataaatacctattgctattagtgttactccaatatacggtaacactgtctgctcggtgccatcatattacaaactaaaacctagctcaacccctcgtggaacagggccaggaatctacgcaagaccagtgaatcttaccctgctacaaaaccgtttcctgcatcaactagaggtccaatcacccctcagaaccctccctcaacttctcatctgattgtagctacaaagaattagagaaaggtgaaaggaacatgtgaccaagcagtctcatactacgctgagatggcaaaaccctgatgccatcctcgccgactggtagaataagcctggttcaggctttcagtgagctgtgtcgcctgtgtgctaattctcctcctctgctttggcagtccagtacgtcttaactgccatgaggaccttctctgggttgaaggggccatcctcgtggtccatgatgcggctttcccaccgcatccgcttggttattgcctggactttcgtgagcacgtcaactgtgtcacggatgatagctgtgccctcgggccttaatatcctatccatctccaagaggatgtcggttatatcacacctgtcttggtagatgctaaacaaattgtcagcatgcaagaggtcataggttcttggatacgttgagaaagcttcacaccaatcctggtatgtgccaatgaaccctcgctcgtatattgccccaagggtgtcccggtcagagttaacagggacgacattcatcacccacacagggtactttactaaagaagcagcgaacccacccatgtttgcgttcatgtccatcacatttctgtatctattctctgctatgggtatggtgcgcttgtagtatgccaccctcttctcccacaacttcttgtcctcatcaaacttctttgcatccaatcctggaatcatgcccctttttatcctggggggaactaagaatgccctctctggccatttctccactgctcctcccgccacttctccctggttgcttacttcaggcaatggagtaacacaggcttccatctgtctgtaccaagcagcatcaggattgtcactcttgcagatatggggtgtcttatatgtcttcttaatgttggaacactcaaggtggttcttaggcttctgccagatggagagatccctcttctcaaccaccttgttccagcaaaggctcctcgcgacatcctcaatcttgtcttgctcttgcttgaggtcctcctttgtcctctcccaccccgcgtggtgcgtcttccagttgattggaggacccgagagaatccaatatcctcctggccttagaatcctatcgacttcagcaaggtatagtccatcatgtgcatgccaaggaatcagacagcgagagcaatgtgccatatcaaatgccctagatgggtaaggcaaccggtgcttccccatcacaccgatgatggcagggacacctctttccagtgcgaattgcacctgagcttcatgcgtgtctcttggcgcaaatgacatggcaatgatgttcctcttcagcaagtaagctcccaaactagcaaccccacaacctgtgtcaacagccgtcctgatctttccatccgataatgagattagcttatcgatatcatctatgtaagcatcagcaccacgcgggaacatagtgccaccaccagggaacttgaacttatcgccctcaacctggatccagttctgcactgctttctcaatgctgagctccttgtgggggatgttgttgaaataggcatagtccctgctatgaggccacttgaagggggtcctgtacccaggcggtgctgggatgaggcatcggacctgctcgtccttgccaggacaatggcgctcccggtacactagcatggcgcggtcgaaccggcgcccgcgcgtacggtcctcacacggcgtgtactcactgaagttgagagggcatgccgggaactgctgcagttccccatcgccgtccgtgttgttgatggtgagctggtggtgtgcgtcgaagtcaagcatctcgccggagcctggcccaaacgatggcacagagccagaggactgtgccgtggcgacagtgggatcgcagccaacccgggtgatcgccgagttgcctatgggctttggaagcgtggtgttctgccatgcaccgaggacgtagaaggcgatgcagagcgcgcttacaacgaggatgtatgtcaggcgctgcttcttggattcctgcagctgctgggctttgggagaagctgggtagtcctttgccatggctcctgcgaacaagaagccagctcaggaaggcagagcactggaggacgccaagacgacgaagaggaggcagagtacccccaagctccagagggggaaaaggccggaaggggcacaggagaggagcaccacgggtcctgcctatttatgcgagctctgcacttcagcaatggtgag

SEQ ID NO: 8923 - DNA, 660 bp, Saccharum officinarum
  Predicted polypeptide sequence is orthologous to G2754
ccgaaacaacagagacctgactcagtgctcaagttacatagcaaggcctataccatacagaggacatccagctccgctttggagtaaagccatcagctaatgttgctggacgaagctgtaaatgcaacgcaggcacgcagcaacagaacagcagaaagcaagtcagaaaagcagcttgcagactcatcagaagttcacagcaagcctagcctactgctgcaggctcaacacccagatcaacagtttttctggggcatatacgcaaaaaatatccgcctgaacatcggccaacaggcgcctcatcgtccgcttgatgagtggctagcaaaatgggcacccaaacatggtgccgacatcgctcagctcgtgagcgacgagagcataccaccaccgctcttggttggcaccacgacctcccagccaggacctttcagcgggatcagtggcgtggcatcagcagcaccaggtggtccggacaggtcgctccggtccatcagcttcaagaggtcttcgtcgctaatgtcagtctggatcatccggtcttcctcgtcctgctcgtccctaagcagcgccagcagctccccctccgctaagacgttaggctttgctctttcttgttcaaactgtcccttccctatcaccggacgcgtgggtcgaccc

SEQ ID NO: 8924 - DNA, 682 bp, Saccharum officinarum
  misc_feature (23)..(23): n is a, c, g, or t
  Predicted polypeptide sequence is orthologous to G2789
agtatttagggacgtagtcaaanactggtgtagggcatggaaggaactgggaaaacaagaggtagcaaggatccgagtacaaagaaagactgtacgtcggatcttacatactagagtacgatgtgttgtactccactagagcggacgacctgtttatttttttttaacatgcgaaatcatatgctgcaattcccacggaaattctccacgatacaaattcaagtaaagctcgaagaagaaagctaaatcacttaaccatctaagctgcgtgctggctgatcaattattagaacggcgccggacggccaccggcggcgcccgggttccatccgtaggctgcttctggcggcagctgcacgttgctgagcaggttcggtggcagtccctggaagaggcttggatccacgccgctggcggcgagctgcgccgattgctgcgcacccgcgagaattcctgcgctgtcggcctgtgcctgtgcagcgagcatgtcatcctcctccagcggaaaccgctcgtacaccgcgttggcgaaagatgctgccattatcaccacgggcccagctgctgtgagcgcgccaacgacgctgtcaaccaacacctgcccctgggcgacggcaagggaaaaggtgagccccgtggtttcaggcggatcgggttgcgggaggaatgatccgtaaaagga

SEQ ID NO: 8925 - DNA, 829 bp, Saccharum officinarum
  Predicted polypeptide sequence is orthologous to G2791
ctatgcacaaaagagaaaccagatagatcatccagatacagttcaagttactgaaacgcaactatcgctgagcaacctgatgcagttatacagcaaaaaagaaaagagagaaggcaaaaagaaaaaggcaaaatcaactgatgctcaataggtacgaaaaaactgattctgggaagaaaattagtagacagggctatgcactctggtcagactaacttcctatcctgtactctacgggctttgctgcattcttcagccgtctgagttctgtcttctgcagttgtgtcctcatgctcatgggaggagcatgtctttatttcaccgttcaggagggattgcagcagcggacacacctttctgagtggatatggcggaagcaagggcaactggcatcaagcagagccccttgttctgaaggtactgcatagcgctggtgatgctggttccattagcttcacaacctcttcctcaaagacgaaggtgtcttccgagtctagtgcgtccagtaatccttgaacgtaggttggacctgcacaaggttgaccgtggtaaccctcagtctgaaattctgtgagaaggggaagaactggctcctgaagctcctagcctactcctggtcaaaaaccttgcacctgaagctggaaaaaatttcacctaatcaattttttcattcccacaagggttgcctgggtgtgccttattgaactccgggaagaaaaccggcagcactcttcaacctattctaaaatttttccgctggcaagccggtcacgaatactatgaaggatcatgcgctggccccaaaaagcccatataacggtggttcccg

SEQ ID NO: 8926 - DNA, 410 bp, Saccharum officinarum
  Predicted polypeptide sequence is orthologous to G280
cacgaggctgcccccgcacgcacggcagcggcgacccatcgtcgatgtggccgtggaacatctgacgcggttcacggagaccgtcgtgatcaccgcgttcgcgcatgacgtttgcattttcttcaaggttgtcgagatgatacagaagtaagatggcatgcaaggacggaagcgcgcgcgcgcgcgtgcgccgggcagcgggcactgtagtttcagatattacattcagccgtgcccgagaaatgaagttgactatagctaggtcgattactaggttatattatattatatgttttcacaaattaaattgcatgatggccgcagctcagagtttcagttgattcatttcatccctttgtgtgtgtaatattgtacataattttgattaaataaacattgtacagaattta

SEQ ID NO: 8927 - DNA, 756 bp, Saccharum officinarum
  misc_feature (588)..(588): n is a, c, g, or t
  Predicted polypeptide sequence is orthologous to G2802
ctgaattatattatttattaattttatttaaatatattggaagctatctgcaatacaaaagtataaacatatgtgtcaggacttgttctatatcatgactgctcaaacccttgtgcctatacctagctaattgatcatctctaggcgtgacaagagatggacacagcaatcatttcttccacaggacatccaaagcctatccaacaagcacaaggattaggagaaagatcctgtcagagcgcggccagcgcagcagtgaagatgttggggaggcacattggcagcagaccggcaagacacgtcctgtgatcgtctgcaaagatgtttcaggaggtaattttgctagttgtgttgcgttcattcaggatcagaagtttattaagcctctatcattatattgaacaaaactagtaatatattagttagcttgagatgcttttgaatgtgtttgtattcgacacacttgcactctaattatgcaagctactagtcatactcgcaaataatcatgaaataaccctttccatgcaccacccagcctgtgtgttcacctttccttttttattaaaaatgaaacaccaatatgtntaagtagttctattattacatgtagagcaatcaataggtttggtgtatctccaactttgttaaaggcgagtacggacatgctgaagcacagtgggaacacacaactcataattttacttgaaaagggaggcaaacttatggataaaattgcatccacccaccacaaaa

SEQ ID NO: 8928 - DNA, 727 bp, Saccharum officinarum
  misc_feature (410)..(410): n is a, c, g, or t
  misc_feature (644)..(644): n is a, c, g, or t
  Predicted polypeptide sequence is orthologous to G3060
cataacattcaggggctttagtggcaaattaacgttttctcaaacttttttcaaaaaagctgaaatctaaagtttaatcgactgaaatcgcaatacaacagtctaaccgcctaacgctgcaaggaaaaaaattcacagtaccaaatggaaagagcacagggcttctctcatgcctaaagcacctcgactctcaagcagcacctctccgctgctcggtctccccatgggcaaagtggcaccggtcgccaaaagtgcaagcacccttcacaaatttctcgcacaacttcgtcttgtatttgttcctgccccccaaaccaccgcctcggcctcctgttgtctccgcggcaacaggtggttttttcaccggcatgcttgccctgatggtcgcaataaggtccctcaccatgtcnctggcttgcttgatctggtcaaaattgccttcaaactcaatgttcttctggctggggttaaactcctgatcaccgattgaaagcttgacccctgtaactctgcttatctgcttagtgttgaccccaccccttaccgattattccaccggcaaaagaggcatccacacttattttgggagttgccaaaacccccaaattttcttgctggaagggccattaaaaactttgttccanagggttcaggtcggcctccattatttacccccccataggaggtccttcattaaaacatttagggggggtttcccaaactcctc

SEQ ID NO: 8929 - DNA, 805 bp, Saccharum officinarum
  Predicted polypeptide sequence is orthologous to G3060
ggggggggtttttgtttggcgcgtttattttcgcgttttttttgttggtttttttaagcctagttagtcaaaatttggataatttttaccaaatacaaacaaaatgctataggaattctgatacagtgtttttctcccccaattctctcatctaaacgaggccctaatatacatggtgatgacaaattccgtcacgctgcaaactctgaatgtcgaacccaatcacaacagaagatagacagaagttggaacttgaaaccatggtaatactgatcgttttggcaacaaatgaccaatttgtacagatcaatcgcggaaacagtatatatagacaacaaattttgctgtggtacagactaaactatatcacacagacatctccatctccatacagcaggaagaacggaagacaaatgaatgaagttgggtgcaggggaactctcaggctgaggtcgggaagcaaagcacacaaaagccttccttcccgtgccgtgagcttctgcccgcggaacagagctcttatgaacgcgtacgtggcaagaggggcggcaccattaacaggtagggaacgcccttttggggggcttgcgggtgattcccggccgaacacccgcggggcgggtcgcaccggcggtcctcatggccaaaattgccaactgttgcatgattctgaacccagcagggttaccaaacctgtgggccaacttttaaacttcccaagaaaaacacaggtgtaagacaaacaaattcattttgggggacccttgggttaaccgggaattcgggaccgtacctggggcgtcca

SEQ ID NO: 8930 - DNA, 539 bp, Saccharum officinarum
  misc_feature (474)..(474): n is a, c, g, or t
  Predicted polypeptide sequence is orthologous to G3111
acgcttttttttttatatcaatataactatgtatgtatttgcgtaaattacaggagtgagaagtgctagtttacatacatacatcctacgcttcacccaacgctccaaaatatgtcctccaaaatcacacgccacacccaaaaatacagtagactgaaaaaaaaaacagtttttttttttgaaagacgaacgacgggtcaaggcaagaaggtgtcatatccaggagccggacttgcggccatgagcacgtgaccgcacctcccgcaggcgccgggcgccatgacgggcggctgcgactgctgctgctgctgcttgtgctgggccggggcggcgacgatgccggcgcggcaggaggggcaggtggcgcgcgtgcggagccaggcgtcgacgcaggcgacgtggaaggcgtggccgcagcgcgggagcacgcgcagcgcgtcgccctcggcgaactcggccaggcagatggcgcantcggcggcggcggcagggcggggcggggcggcggccggtgaagggcacggtggggcaacgccgtt

SEQ ID NO: 8931 - DNA, 829 bp, Saccharum officinarum
  Predicted polypeptide sequence is orthologous to G326
aggtatgcatgtacgggcccggaattcactgggtcgatccacgcgtccgtgccatttatattcgtcggcgtaggctggtccggccccagcgattcgatttcgtgcgcctcgtggtccacgtgcgcgcgggctttgtgctccctctctctcgccccctctctgtgagttcgtcgggtaggttggtggcggcgtgtgacatcatcaactggctcgtatgaggcttctgcagccacaagcgggtgcacaactcctgggaggaggtggtcgcggcactccactggcgcgcggacgccgcgcggctctgcgtcacgtgcgaccgccacgtgggcggcagccacgtgctgtcgccgaagcacgtgcatgcgccgctctgcgctgggtgtgcctaactccctgtcatagaccgcgcagcaaatgggagcgtctccccaattgcgggcgccgaaccggggttccttctaaccgaataatgatagggtcgcgaatccccggaaggagtccaaaattaagggattgatccgaatgcctactgagagagcgaagcacgcctatctaaatgtgcgggaagtgggcatcaaaacgcccctgggagattagaaaccccaggggcaggggacgatgaacatagaaagaaagaaagagttgggacaagaaaaaaggtggtttcgtgttcccaggatccaaccagaaagacccctattatgtcctgggggggggtacatggcaacggaggagggagcggagaaaattgagatgggggggtggcgggaaaagtaaagtgcgaggggtgggaaagatccgcgctcgatgggggggggggcggattttg

SEQ ID NO: 8932 - DNA, 723 bp, Saccharum officinarum
  Predicted polypeptide sequence is orthologous to G326
tcagtagtagcaacaaaaatacgaccggatagccacataaacaaaacacttggctgtaaactcactctccggcgcttttccggtctcgtatgaccacatgcatgggggataatctatactggatgtaagctacactatttctcgttctgatgatggcaacagcaaaagggagaggggggtaagttgtttcatgctttcctatactttctcaggactaaggtgacagttctccaccatctttttatctgataacctataaacactaacaattgcttagcccttatcataaaatctattccataccaacttcattgttgctggacgtaacgcaagcacacatctgacttggtcttcacagctcacaggccatattgtttatccgccataaccggcgttccagcgcttaggtcaacttgactaaccgcccttttactctcttccttgtgaacaaactcagcttcctctactcttaccggatgtgcttcttatacctgcggttctctttctttttcttaccagattactgttcctatctctaaaccggttgagcgggggcatatccatgctcttggatcgctgtataaatgggtgagttgaaatttttaaatttcaataagcggatccctctaaatggttctgatcggtttgtttggaactggtttaatagaatttgaaagctcctataatattggaattaaatgcattctatacaatttaaacgct

SEQ ID NO: 8933 - DNA, 543 bp, Saccharum officinarum
  Predicted polypeptide sequence is orthologous to G351
aactagtcgggctcgtttgtcgttttgtttatttcggagtgtttctgcggtttttttttttttcctattatttattgttttaaaataaaaaatataatatgtgccgacaaaattcaaatacaagtttattattttcaccaagcaaccaaaatccatttaaaagaacgaaggtgcgaaaaactctacaagcctcatcaaaaggaactctaaattgataaaaaaaaggaactctaaatcgttaaactaaggtccaaggacggaccggcaatccgtctcttcttgaccggaaaggggctctgaacctcttcctcctctccccaccttgtcgcatctttggcggccatcgccggcggcaccggcaccaatttcagatcaaaccccttgacggtcgacccggaccccgatggccccgactacgcggtgagcgacaccgaaagcccgtcccagtaatggcacctcttgtgcccgccgagcgcttgccccgtcgcaaagctccgatggcacaccgtgcatctgtgcctcccctgcccactgatgcctacg

SEQ ID NO: 8934 - DNA, 985 bp, Saccharum officinarum
  misc_feature (710)..(710): n is a, c, g, or t
  misc_feature (857)..(857): n is a, c, g, or t
  misc_feature (947)..(947): n is a, c, g, or t
  Predicted polypeptide sequence is orthologous to G4
cggaggcgccatcctcgcggagctgatcccgccgacgcggcgcgtggcgtctaagccggtgaccgagggccacctctggccggcgagctccaagaaagccggcatcggcagcggcagcaacaagaggcaccaccacgaatacgccgacgacgacgactttgaggccgccttcgaggagttcgacgacgactttgacgcgcacgaagacgacgaggaccaccccgaccacttcgtgttctcctccaaatccgccttctccccagcccacgacgggcgcggtgcgcgggcggcggcgacccagaggacgaagcgcggccaccgccagctccgcggcatccggcagcggccctggggcaagtgggcggcggagatccgcgacccgcacaagggcacccgcgtctggctcggcaccttcaacaccgccgaggacgccgcccgggcctacgacgccgaggcccgccgcctccgcggcagcaaggccaaggtcaacttccccgcagccgtcgcgcgcgcccgccgcggcaagggcaacccaagaaccgcgccgaaaccgcagcaacaccatgctgctgcagcacagccactgcccgctctgcttcttcgaagaaagaaggggcaggaaggagttgccgtgaaacctgaaactatggacacgttcgacgtgggcagcttcttcgacatgaccttccccacctttccagccgtgctgncgccggccctggagagctccttcgccggcagcaagggccacgtggagacctggagcccccgcgaagaagccgagataccaaagagggtgacttgttccgagggccacgggcggtgccttcccgcttggaacttgcttaacaaactgnccgttcaatccgttattgctggttgcaaatgcccttatttggggggggaccatttccttgaaggccctttttccccaaagggcgcggctncaggacgggacacacgacttgaaaggggtttagcccct

SEQ ID NO: 8935 - DNA, 1009 bp, Saccharum officinarum
  Predicted polypeptide sequence is orthologous to G4
cgcggccccaccacagcccagcgagcgcctgccagcagcagccagccatgtgcggcggcgccatcctgtcggacatcatcccgccgccgcggcgggtcacggcgggccacctctggccggagagcaagaagccgaggagggccgccggagccggcaggaggagggcccccgtggaggaggaggaggacttcgaggccgacttcgaggtgttcgaggtggagtccggcgagtcggagctcgagtccgaggatgaggccaagcccttcgctgcgcccaggagcggggtcgctagagatggattaaacactagtccagctggtgttgatggccccgctgcaaattcagttaaaaggaagaggaagaaccagtttaggggtatccgccggcgcccatggggtaaatgggctgctgagatcagagatcctcgcaaaggcgttcgtgtctggcttggtactttcaactctcctgaagaagctgctagagcttatgatgctgaggcacgcaggatccgtggcaagaaggctaaagtcaacttcccagatgagttttcaacgaattctcagaagcaccgtgctgggcctacctttctgaaagtgcctgagatggacgttgaagagaagccgattatcaagatggccaacctcaatgcatatcactaccctgttgtcgggcacaacattgctggagccattatgcatacctaaaacatgttaatttgctcctttgggggaattctgccgccccccgtcaggaaccttttggaacccttttttcgaccaaggttgcaactccttcaatggtcaaacctcaacttgagaaagacaccagaccccctgtcaatacatcggtagttgtgggggaatttgtattccccaaaacccaaaaatgtttggttgccccttggatgggttagcctcggtgatcccaagaatgtggcccctattaatttcctgtgacagcgcttaaaggatcctttaaccctttcttgtgaaggtctccatcgctgtta

SEQ ID NO: 8936 - DNA, 1270 bp, Saccharum officinarum
  misc_feature (1172)..(1172): n is a, c, g, or t
  misc_feature (1181)..(1182): n is a, c, g, or t
  misc_feature (1203)..(1203): n is a, c, g, or t
  misc_feature (1225)..(1225): n is a, c, g, or t
  misc_feature (1241)..(1241): n is a, c, g, or t
  Predicted polypeptide sequence is orthologous to G4
ttactgctcgctccggcgcgctgcggcggagctaccgacgacgactgagccatgtgcggcggtgcgatcctcgacgacctccgcgagccggagctgcgccgggtcacggaccgggacatctggcagaagaagaagcccaataggggcggcggcggcgggaggcgctcgttcgcggcggacgatgaggacttcgaggccgactttgagcacttcgaggctgactccggcgattcggattttgagctcggggaaggggctgacgacgacgtcgtcgagatcaagcccttcgccgccaaggggactttctccagaggtggcttaagcaccatgactactgctgattatgatgcccctgtagcaaggtcagccaaaaggaagagaaagaatcaatacaggggtatccgccagcgcccttggggcaagtgggctgctgagatcagagatcctcagaagggtgttcgtgtttggcttggtactttcaatagtcctgaggaagctgcaagagcttatgatgctgaagcacgcaggattcgtggcaagaaggccaaggttaactttcctgatgcaccagcagttggtcagaaacgccggtctggctcagcttctgctaaggcacccaagtcagtgttgaacagaagcctgccgtaaagcagctatgaccggcgacacaaatgcttccttctacccatctggtaactaccccttcaacaattccattgtcagcatgccattatgccttcattcccacaatgaacttttacggcttcgggtgaggatccataatgaatctggcctttgaacaaggaagtaactcctttgggttggtagaacatgccctggaagaatgggtccaaaaaaccaaacttacatcccttgggtccatttcaattattggtgaaggggagagtctgctttggcaacagcaattcaacaggctaatggtgccttctggtctggaaaacaggctgtgattaactggggggctgacaatagatccctaataggggtcttcggaggggggcagggatcaagcaaacctttgaacttggggaacaaggagtgggaaacatgacattgggatttaggaatgccctcccggaatttttttgaattagaccgccctaaagaacctgggccggggaaagccttgtatgggcgccgcggttccctgngatatatcnntgtaagaacaaagtgtttcgnggtgttgtcctgattgttgttnttgggacgtataggangcattttctttagtggattgtgtcgtagt

SEQ ID NO: 8937 - DNA, 711 bp, Saccharum officinarum
  misc_feature (487)..(487): n is a, c, g, or t
  misc_feature (507)..(507): n is a, c, g, or t
  Predicted polypeptide sequence is orthologous to G409
cgcgcccagggtggcgaacagcagagaggaggaggacgacgaagcgccgtctgacggcggagcaggtgcagctgctggagcggagcttcgaggaagagaacaagctggagcccgagcgcaagaccgagctggctcgccgcctcgggatggcgccccgccaggtggccgtctggttccagaaccgccgcgcgcgctggaagaccaagcagctcgagaccgactatgaccacctcaaggctgcctacgacgcgctcgccgccgaccaccagggcctcctggccgacaacgatagcctccgggcacaggtggtctccctaacagagaagctgcaaggcaaggagacatccccgtcggccaccactgctgcccaagaggtcgaccagccagacgaacacaccgcggcgtcaggcactgagaaactgctggcgcagcagctcaaggacgacctccacagcagcggcgactgcactggccatggtgccctctnctcagaggaagaagatggtngtgtggtcaatgacaagggcagctttgatctcccgatgccatgtttgctgccggggtcacccaccatggcgccgacgccgaggaggcacagctggccaactggacatcctggttctggaactgatcgatggatggatgtgcaaagagcaaatcctctcctggtttccaccctgttctgcaccatataattactgtggtgaatat

SEQ ID NO: 8938 - DNA, 582 bp, Saccharum officinarum
  misc_feature (580)..(580): n is a, c, g, or t
  Predicted polypeptide sequence is orthologous to G428
gaagagcagaagtaattttatctttataagcccttcagcctatctaaaaattaaattgggtagcgagtattacaaatccatgagccaatacgtgaaactactaattaaatgcttttgcaggtctcctcaattcgcccatacatacagtttgttttgatacgatggcaccatatacacatgtgatcttgtaaaataatggggcaactgactaatgtgatcaacctcagctcgacagatttattgtcaattttgaccgggcagatcgtcacttcacatgccaggtcttactactgattgagttggccaattgtcatcccaagtggtgtgtgattcagggtccaattgtgcctgtatcgaagtagagtgtcgtcccagaagatccaccggcaacaccctccatgagcgcgaaccgcatgtcctccgatggcttccaatgcctcttcctctgattgatgaaccaattgttgatctgctttgggtcgagaccggtcatcgctgcaagcctcaccttatcttcctccgtaggataaggccagcggtagtgcgtgttccaccactctagtaatacttgccgtgcatnct

SEQ ID NO: 8939 - DNA, 842 bp, Saccharum officinarum
  misc_feature (104)..(142): n is a, c, g, or t
  Predicted polypeptide sequence is orthologous to G450
tacattactgctcattcccacccctttacgcctccactctgtgaggaggtgcacactctcgaacatcatattcatactcgaagtttgtatgccgatcctttgcnnnnnnnnnnnnnnnnnnnnnnnnnnnnnnnnnnnnnnncgacctcaagctgaagctggagccggcgacccccgcggccgtcgtgaaggctgagggggaagagcaggacgacggtgctgcccttgccgccgccaaggaaggcgtggccgccgccgcggtttggccggcgggaagatgaagcggtccccgagccagagcagcgtcgtcaccgccgccgccgttcaggctgaccccgccgagaagccgcgcgcccccaaagctcaggtggtgggatggccaccggtccggtcgttccggaagaacatcatgtcggtgcagtccgacaagggcgccggcggcagcaaagacgccgacaagtcctcgccggcggcggcggcggcagcagcagttggcggtgccgcgttcgggaagggtgagcttgggacggcggcgccataaccttgcgcaagggtggaccctcaagaatgttaccaagagcttacctggaagctgttcccaaggcggctcgaagaaagaatgtttcagcctccctttcacccatttgggaaagctgggggggttctccacggggatggaaacgggtcatggaaacgcaagagccaaagcctgggtggggaattctggcttcaaacggggcttcccgaagttaccgttgccccgaaccttaccgaaggaaccaagggacccgggtcgaactggggaattgcctccagtccgggccgaacagatgccccgggtg

SEQ ID NO: 8940 - DNA, 767 bp, Saccharum officinarum
  misc_feature (573)..(573): n is a, c, g, or t
  misc_feature (576)..(576): n is a, c, g, or t
  Predicted polypeptide sequence is orthologous to G451
agcagtgattgatggatagatataacttaagtaagacaagaaagaagagtgatctttggctttgtacaaacacacatggagattcaactcgactctccactccttttgtgttactaataacacctacaagtagcacaaaagaaaaagaagaaaaaaacaaacaaagtgaccacacatcattccacgcatgcagatgcatgcatgcacttcgatgcacaaagctttcctctctccttcaccccaagcagcttcatctcctcctctccatgtcgtctttggtttgctgctccattgttgccagacaaggagagatggtagtacaacacatgcccatacatacccatgcacgccttggacaagaaaccccaaaagaacaaaagaatctgctcacgcatgcacaagccgtgcatgcatctcagcgataatcctcagttgttcttgactgagccgagccctctggcttcagatcccttcatgatcctcagcctcttgcaggtgctgatgaacatgtcgaagggcacgtcgccgacgagcatgaggtcgccgtccttgtcctcgtaggtgatggcgaantcngaggggttgacggcgggcgcgtcggcgccaccggagaaacagaggaacatggcctccagcgcctcccggagctcgcggtaacccttgtacatcttgagggtcaccttcctgaggttaggcgccccggtcatgctcacctttcacaacagcccggaccccggggcggcaggggcctccttcgccggcgccgg

SEQ ID NO: 8941 - DNA, 1000 bp, Saccharum officinarum
  Predicted polypeptide sequence is orthologous to G451
caaagcttctctcctcgatcctcatcttctactcatcctcatcctcctcctctgcctccctttctcaagagccaagaacacagcagctagctagcaagctttcctttctcttcgggtccatggagatcgtcgacgccgacaacctgagcgccaccgagctccgcctcggcctgccagggaccagcagcagcgacgactggcagaagaagccgtcgccctccgtcggggccaagcgcgcgctcgacgacaccaggagcgaggcctcggggaccagcccggccgccgccggaggcgacgaccacgacaccgccgcacctgccaaggcgcaagtggttgggtggccgccggtgagggcgtacaggaagaacaccttccaggcggcggcggcggccaagaaggccgaccagcagcagcagcagcagcagggaggaggcctgtatgtgaaggtgagcatggacggggcgccgtacctcaggaaggtggacctccggatgtacaaggggtacagggagctcagggacgcgctggacgccctcttcaccaagtccttctctgccgccgcggcggagggcggggaccaccagcacgccatcgcctacgaggacaaggacggcgacctcatgctcgtcggagacgtgccctgggatatgttcatccttttatgcaagaggctcaggataaatgaagggctctgaggcccagggatcggtgatgcataagcagagggctccggagcacccacacaccttcaccctgtgggaacggtttccaaaggggagagccacagatcgtggctccggaaacggtggggggttgggcctctcccaggggtggccaaaagggaaggttggtttctgaactccaagaggggggaaagaacctttgaagcggggtaaaaatcctaagctggcggtgtttttttttaaggacggttttgtttgtaccaaaagtctttaataatgtggaaaaggaaagtgggaaaattggctcaaggtggggg

SEQ ID NO: 8942 - DNA, 939 bp, Saccharum officinarum
  Predicted polypeptide sequence is orthologous to G519
ctccagtctcctccagccagctgaggccgattgaagaaacgaccccagcaatcggctgagctctcctcgtctccagtccggcggcggttgctagtaggtgaccgatcgagatcgaatggactgcggtggcgcgctgcacctctacaagttcgacccatggcagctcccagagaaggcgtacggtggggagaaggagtggtacttcttctcgccgcgggaccgcaagtacccgaacgggtcgaggccgaaccgggcggccgggacggggtactggaaggcctccggcgccgacaagccggtggggtcgccgcgccccgtggccatcaagaaggcgctcgtcttctactccgggaagccgcccaagggcgtcaagaccaactggatcatgcacgagtaccgcctcgccgatgtcgaccgatccgccgccgcacgcaagaagaccaacaactcgctcaggatatgccaagaacacagtagaatgaaggtatggaagtgtgctcctgggatatgtgtcggggcctcgatctcttgcagcttatgtactggctaggtaggatcagttgtgatctgtatggcatctcagaattcctttgcagcaatgcaaccgaagattacatgtgccggtgtcttcttcgctccatggcagaccttacactgtgtgttttccaccattcccttctttgccagattaagtttgcactgtattcctccctgtgatagcaaccacgccaaagacttgaccccaggccgagcttttgttctttcaaaggaaccttgccccaggcattctggccctggatcaattcttttggccgctttgtgtaaccacgaggtttccaagccttccttccttaaaaaaaaaaaaaaaagggcgggccccttttaaggatcaaactttcttacccttgctgcgcaagataagatttttttagggccccc

SEQ ID NO: 8943 - DNA, 925 bp, Saccharum officinarum
  misc_feature (569)..(569): n is a, c, g, or t
  misc_feature (572)..(572): n is a, c, g, or t
  Predicted polypeptide sequence is orthologous to G519
cagcgggccggagaaaggaagcaggcagccaaacccaccaccacttttaccgaccgaccgatcggtgtggccgccgcctgtcgggttcattcatcgccacgccagcaaccagaccaagccatgggactgccggtgaggagggagagggacgcggaggcggagctgaacctgccgccggggttccggttccaccccaccgacgacgagctggtggagcactacctgtgccggaaggcggcggggcagcgcctcccggtccccatcatcgccgaggtggacctctacaagttcgacccctggaacctgccggagcgcgcgctcttcggggtcagggagtggtacttcttcacgcccagggaccgcaagtaccccaacgggtcccgccccaaccgcgccgccggcaacggctactggaaggccaccggcgccgacaagcccgtcgcgccgcgggggcgcacgctcgggatcaagaaggcgcttgtcttctacgccggaaaggcgccgcgcggggtcaagacggactggatcatgcacgagtacaggctcgcggacgccggccgcgccgccgncgncaagaagggatcgctcaggctggatgactgggtgctgtgccggctgtacaacaagaagaacgagtgggagaagatgcagctgggggaaggagtccgccgccggcgttcgcacccccaaggaggaggcgatggacatgaccacatcccattcgcactcccacttgcagtcgcacttgcacttcgggggcgagacccgcacgccggattcggaaaatcgtgaccacaacccctttcccgaagctggacttcgttcccagcgttcaaggacaccgtcggcggcaatttgtatgggtccccaaaaaaaaacagtggcataacggaagctccttcccccacccccggcaaaaacaaca

SEQ ID NO: 8944 - DNA, 764 bp, Saccharum officinarum
  misc_feature (589)..(589): n is a, c, g, or t
  misc_feature (624)..(624): n is a, c, g, or t
  misc_feature (642)..(642): n is a, c, g, or t
  misc_feature (700)..(700): n is a, c, g, or t
  misc_feature (734)..(734): n is a, c, g, or t
  Predicted polypeptide sequence is orthologous to G635
cacgctcttaaactatcaaaagaggatgtccttctttattcagctaaggttattcctggaaatgagacacgggtaatgaagatgatgaatcgcctcactgatcttggcccaaaaattatcatgggtaaagattctggcctgcatacctctgggcatgcctaccgagaggagctggaggaagttcttcggattgttaaaccacaacatttcttgcctgttcatggagaactcctatttctcaaagaacatgaattacttggaagatcaactggcatcaggcacacaactgtaataaaaaacggagagatgcttggtgtgtcacatctaagaaacagaagagttttgtccaatggatttgtttcattagggaaggaggatcttcagctcatgtatagtgatggggataaggcttttggtacatccactgatctctgcattgatgagagactaagaattgcatctgatggcattatttttgtcagcatggagatcttccgacctcagaaggaacatggtttagcgcagtcaggtttgaaaggaaaatttaagattactacaagatgtctatggcttgataatggaagaatgntggacgcactctacaaagcagctcatgctgcattngtcagctgtcctgtgaantgccacttagtcacatggagaggatggtagctgaaatcttgaggaaaatggtacgaangtatagtgggaagaggcctgacgtcattgcggtngctacagagaacgccacggaggtttcccag

SEQ ID NO: 8945 - DNA, 837 bp, Saccharum officinarum
  misc_feature (553)..(553): n is a, c, g, or t
  misc_feature (567)..(567): n is a, c, g, or t
  misc_feature (618)..(618): n is a, c, g, or t
  misc_feature (716)..(716): n is a, c, g, or t
  misc_feature (749)..(749): n is a, c, g, or t
  misc_feature (774)..(774): n is a, c, g, or t
  misc_feature (815)..(815): n is a, c, g, or t
  Predicted polypeptide sequence is orthologous to G653
atccgattcccacatcccctcgtcgtcgcttgtttgttgctgccttttcctttccgccgcggcaaaagcgaggcgcgggcgagctgggggagggagacgaacccgtcataattccatcgcttaatcgcgcctcgtgctcctgcgcatataagcgcggcaatcgggacgccgggggagggtgctcactcttcatcccacccacgccacgcgcgcgcaggccaaggccggatcgggctctcagtcagatctcgccggccacgacccgtgagacagggagagagggaggggttggccggtgctcgggagaagatgtttagcgggacgcagcagaagtgcaaggtgtgcaccaagacggtgtacccgatggaccagctctccaccgacggcgtcgtcttccaccgctcctgcttcaagtgccagcactgcaagtcgaccctctccctgagcaactattcctcgttcgaaggagtgccgtactgcaaggcccatttcgagcagctgttcaaggagaccgggagttacaacaagagcttccaatcacaatcacccgcanagattactccgganaagttggcccctgagctgaccagatcaccaagcaaagctgcaaggatgttntcaggaacacaagacaagtgtgcgacttgcggtaaaaccgcatatcctcttgagaagggtacagttgaggaaaaggcctaccataagtcatgcttcanatgctcccacggggggctgtgcgatacaccttncaactatgcagccttggagggcatnctctactggaaacaccatttctctcacttttcagggagaangggaagctacaccacttgatca

SEQ ID NO: 8946 - DNA, 762 bp, Saccharum officinarum
  misc_feature (500)..(500): n is a, c, g, or t
  misc_feature (696)..(696): n is a, c, g, or t
  misc_feature (702)..(702): n is a, c, g, or t
  Predicted polypeptide sequence is orthologous to G707
agagcatcaaatttctaattcctacatatatattgcagaataaattttaattgatgtaggtaaataagcatttccatgtaaaccactacaccggccactttatcgatcagacattattggctgataaatgcctagctacacttatgcatgctaccatgacctatggacgacaccactacaacacaacatttctgaactctcaagtttacatgacatatagcttacctcacaacagagaatggacagtactatattataataactaaacaacgagccggccaaaaactcaacgtttgattccctgatgaaacgacgggactgaaacataagattagccatctactaaccattattgtccactatgcaaaggtcctgtatcaaacagctaggttgccagggagaacaagcagacgatagagaccgagtcaatacccgaaccaccaccattgctctgtgctaaggacctgtccgagctggatccttatcacctagcaaaggtntctttgcagcacgaggttcgttcttgactcaggctcgtcgtcggcgaacatcccctgcggcgacgtcaacattcaggcgtcgcactgcagcgctgtcttgatcttcttgatggtgcaggatatgaggttgttcacggtttcaactgattccacggtgagctgggcggtcggctggctgttgacgagtttcttgaanggcacngtgagtagcgagcccgctgtcttatgctcggcgccgaaactgtttgggccgtccggcaag

SEQ ID NO: 8947 - DNA, 705 bp, Saccharum officinarum
  Predicted polypeptide sequence is orthologous to G8
gtgcagggtgacgcctctgtacttggagctgcccctcgagaagccggtgctctgccgccgcaggacgtgcacgaactcctccttggataggctcttcatctgcttcatgtcgtcctcgtagtcgctgagattgaaatttatgtcggcgtcgacgccgcggaacttgatcgccgctcgatcgtacgcccttgcagcagcatgagcagtgtcgaatccacctaagtacacctgctttccgcaatcccagatgtgggactcccagcggccggtgcggcggtaaaaggtgacgccgcggtactgcgagctgcgggagcgctggccgcggcgagtcttcttgaccgggtgcagcttcacagggggcgggggcgccggcggcgtgccttgcgtgtggccgaagtcgtcgcggaagaagccgagctcgcccccatgcagcggaactggtgagagagggtagggaggggtcccgaaaaaggttctgaccccggtggataagaatgtagagagaggtggttggagtcgcgtgagggttgtctcccctctctccacccccccccccacgcggtggggtgagggtcggggggagggaggaaaaacaaaagagagccatgggtccccccccgcccccccctcgtatgtttcggatgtagaattcctgtaggggaggaggaagaaatagaaaaagtatttatgataagtgggagtgtt

SEQ ID NO: 8948 - DNA, 818 bp, Saccharum officinarum
  misc_feature (805)..(805): n is a, c, g, or t
  Predicted polypeptide sequence is orthologous to G881
gagaaaaaattataatgatttcatttgatcaatcagatgaacagttcgcctacaactacaaagtacaggggattgtacaatttcatgttgttttcctgtggcagtatttcgcatgtcgatcaccccggcgtgatgatctctggtccacgccatgtcaagccgcgcggactctgtttgttcctcttcctcgtgccgagctgcagatcctcatgtcgtctggttctgttatcgctgtttcgctctaacagtgaacagaggtggcggccagcgaattgccgcgtgcgtgcaagacaatctcagcaagaatctcgtgtgatgccaatcgacccgatgcgtctgtcaatccttggtgggcgacagctcgaggatgcggccggacagcgcggtgacgagcgccgccttgaagctggggtcccgcgtcagcgtcatcgccatctgctccgccaggttccgccggatcatctccgacgccgccgcgcccacgggctgctcgccgttcatcgcgacagcgtcctgctgctgctggtggtggtggagctgcatctgctggcggtgcggtcccggggcgaccgcagcgggccggctttgtggggacggcggatttcggacctgtgtttttttgtttgggggccgtggcctcctgatccgtctttgtgcattcttgcgcctgttggttatgattcctggtggggcttggccgattataattctacacattttatatggctaactatggttgagagtttctaaagtcatcgtttgatacttatttatgatttggggggtcatggactaatagataacnatgatgtatctca

SEQ ID NO: 8949 - DNA, 1004 bp, Saccharum officinarum
  Predicted polypeptide sequence is orthologous to G938
tacacctgtaagtacaacgatccaatccctcagagcactgagaacaagccgccgccgccaccaccacagtcacaggccttccagccggccttcaaccaacccaatcaggcactgaacaatctggatttcagcctgcccatggacgggcagaggtccatcgcagagctgatgaacatgtacgacaacaacttcatgacgaacaagaacatgagcagtgacagcgtctccatcatggagaggcctaatgccatgccccagaggatccagatggatgagggtttctttggacagggcaacggagtcttcgacgatgtcaatagcatgatgcagcaacaacagcaggcaccagtgcagcagcagcagcagcagttcttcatccgtgatgacacgccattcgtgagccagatgggcgacatcaccagcacatcggaattcaggttcggttctggtttcaacatgtctagcaccgtccattatccaggcgcggcacagaagaacgacgggaccaattggttctactgaagaataaactcgtagggctgggaaaccttggtataaagccttggatttctccatggtgctccatggttctcctaagttgtcaagtctataaggtcttgtcatataggttttgcagtaactggaaaacggctggaacttggaactgggttatacttgtatgttcgtccagccattaaacctcttattgaaaacttaatgtattccttattttaaaattgttaaatcccaatgatggtcaaattatatgagctgtaaccatgtcgtgcctggtcccagtagacacaaaaataaaagaggggggccgctctcaaaggatctcaaactattgtacacggtgtatttgaaatgtcaacaccatctctatcagggtacccccaaatccaatcctccagggcctgctcctaaacacctctgtaaaggtgaaaccccctggcattccacaatttcttgggctggctcaccactccccttagaacagttgt

SEQ ID NO: 8950 - DNA, 974 bp, Solanum tuberosum
  Predicted polypeptide sequence is orthologous to G1006, G22, G28
cactctcaacaatttaaacccataatcaacaactagaaatatgtttgaaaatatagattttgaaaatgattatgcccttcttgaatcaattaagcatcaattacttgaagattgggaatgggaaaatcctgtaacaagctccgataattcaacctcaacttatagccgaaacaatagtattgagtctaataattccttatcgaatgattttgattattcaactgacaaatttctttccgatttgcttaatgataatgacgttggatatggatcggatcctgtaatcccaaatgtgaaatcggagcctgaaatttggaatttcgcggaatttgcggcggcgacgcagtatacggcggcggaggtgagagtggaaccaccaccaccacaacctatagtgacagcgccgccacagacgctgccgacggcgaggcactatagaggtgtgagacagagaccttggggaaaatttgctgcggaaattagggatccggcgaaaaatgggcaaagagtgtggttgggtacgtatgagacggcggaggatgctgcgtttgcttatgataaagcggcgtttcgcatgaggggttcacgtgcaatgctgaatttcccactgaggattaattctggtgagccggaacccattagagtcaggtcgaagaagtcatcaatgtcgccggaatgttcttcttcgtcgtcatcggataatgcgccggggaagaggaggaagaaggtccctcaagtggtataaaatgggtcgggtcggtttttctcacggatcaaatatttgggcttggatagtttggtaaaacgtatgagataaacaaagatattttatgagattctaaaatcatcaattcaaccgtaagaaaaactaacctcaaaattattatcttttcccatgtaccattcaacccctagagtcgtttggtattatgaataagatataataatttcaggttaaaatttttattctacgt

SEQ ID NO: 8951 - DNA, 980 bp, Solanum tuberosum
  Predicted polypeptide sequence is orthologous to G1006, G22, G28
aagtttcaatcgatacgtaaaattaatatttctttcaaataattatcaaagataaaataatattaatgaaaatatattaatgaaaatcaaactttttacaacttcggattaaccctatgacgataatttttttcattggacttttgattcttctccactatcatagtccgatgcatagagtatttcgaatttattaagggttcgggaaaaatatgcacaaagtatttcgcgttcggaaaagtgccggctatttaactgaccaatagttgatggacacctgtcaattgttcgatttgacatccaatttgtatagcacttgatctactctccactcctccgtcacatttccgaacggcttttcttctccgtttcattgaaccgttttccgacgagcttaccggttcaggcgatgctcgtcttttcgccgtaactcgaaccggttccggttcattcaaaccgatccggtgcgggaaattcaaatgtgcttttgatcctctcattctataagcagctttatcataagcaatagcagcttcttcagctgtttcatacgttccaagccaaaccctagctccgttcttcgccggatctcgaatctccgctgcaaatttcccccacggccgctgtctaacgcctctataatgtcttcccttcggtgtttcagccgccggagctgccgtagtctccaccggagaaggtacaaattcaggcgctgactcaatttcttctctcggttccgattttacttcgccggcggtgaaactaaacggcgaccatccgacgctaagagcgtcctttaatagaccgtaaattaccatatcttcggaatcgtcgacttttagtggtaaatctccccatggttcagttaaacaggggattagacgactgaagcttgaattccggcgatacaccggaaaatctaccgggaaagtcatcggtagtaactgttgatccattttgcttttgatttttgttttttt

SEQ ID NO: 8952 - DNA, 967 bp, Solanum tuberosum
  misc_feature (81)..(81): n is a, c, g, or t
  misc_feature (96)..(96): n is a, c, g, or t
  misc_feature (101)..(102): n is a, c, g, or t
  misc_feature (116)..(116): n is a, c, g, or t
  Predicted polypeptide sequence is orthologous to G1006, G22, G28
ctcatacaaagactttcaaaaactcataatgtatcaattaccatttctacagagttagctccgacttttttccctggcagnaattccctggtgtanttgcnncggagttcaaagtntcaggtaggtctccatgcccagtgtttaaacccgaatccatgggtgtgaactatgcctgttaaaaagtttaaccgatttcccgaaagcataattgggtaattttatggggctttctaacaagggaggccttcagttatcggattggaacgcccgtcaaattttaacggtcagttggaaagttaaaacccgagcccgaagggaggagattgagccagctatgagtacttctgtttctccggcgacagagactgcggcggctccatcggctctgcaacctaaaggaaggcattacaggggcgttagacaaaggccatggggaacaatttgcagcggaaataagagatccagctaaaaacggtgcacgggtttggcttggaacttacgagtcggccgaggaagctgcgctcgcttatgatatagcagcttttaggatgcgcggtactaaggctctattgaatttcccgcatagaatcggtttaaatgagccggagccggttagagtgacggttaagagacgattacctgaaccggctagttcatttggtatcatcagcctcggaaagtggctcgctgaagaggaggagcaccggtgtagcggctaagcaagccggaattagacagttcagagccgtgggacagatgttattcaagttggtttgccaaatggaacaattttccaagtttgggcgaagcaggctatttggttcaggtttaacactattgggagctaaaagaaaccttccaagtcgtggcgcaaggggcctttggtttcacgccttttgaaaggttggtgccagacaaaaatttggcacattccacttcccaccttgtggttgaggaaagttgggac

SEQ ID NO: 8953 - DNA, 785 bp, Solanum tuberosum
  Predicted polypeptide sequence is orthologous to G1006, G22, G28
caactaaaaaaaatcattttctcttacaatcatgcaaggaaaaatatccttagatattgaacaaaattttcttgatacaatgcaatatctcttcaatgatcctgattttccccaaatattatcagaaattcaaactcctagacaatactcaactacttctgatcatcaaaacgcgatatttcctatagcgcaaaattttgttcaagataatatcccgatattacaagagatagaagaaaataaggagtcaacaacacctttggagcataggccgaaaaaatataaaggagtgagaagaaggccatggggaaaatacgcggcggaaataagggaccccgagagaaaagggtgccggctttggctaggtacatatgagacacctgaggatgcagcattagcttatgatagaaccgcgtttaagttacgtggttctagagctgtattgaattttcctcacttgattgaatctaatgtaacggagattaatagagtgaggccgaggagacgtcctcgttctccggagttttcatcttcttcttctcctcctcctcctcgttacgtaggagataataataatgagagtaataataacaatactgataggccgagttcaaagagaagaaatgttgaggctaattaatagcttagctacggtaaacaatttggatggtccaaatattatggagagatgttgacgtctaattattatttgcatgaattaattacaaggtcatcatgaaaagtttcgtgagttacttcttgttctttattaaaatacactatgt

SEQ ID NO: 8954 - DNA, 844 bp, Solanum tuberosum
  misc_feature (106)..(106): n is a, c, g, or t
  Predicted polypeptide sequence is orthologous to G1033
ggctgcagaatcggcaacgatggcgaagagcccttggtattctctctctccttcatatagagcctttcccactcacaactcaacacacacaaagcaacgcaccaanatccacacaaacgaataatatctctctgtttctacgctctctaaggtttcatcatgaaaggagctaaatcaaaggctaaagctgatacaagcttggtgtaaggaagaagctactgagagtaagaaagcgaagaacgcttgctaaggatccaaacaagcctaagaggcctccaagtgccttttcttcgcttttcatggaggagttcaggaagacctacaaggagaagcacccaaacaacaaatctgttgctgttgttggcaaagctggtggagacaagtggaaacagttgtcagatgaagagaaagcaccttaccaagccaaggctgagaagaggaaggctgagtaccaaaagaacatggatgcatataacaaaaaactggctgctggtgattgctggatggattgagggaatctgacaagtccaagtctgaggtacatgatgatgatgaggacgatgatggaagtgaagaggaggatgatgattaaacaatcaggtaaggcttgtttgaaaattcacgaaaattggtgggagaaaggttcattgtaggaaattgggtattcaagaccttacctttttataaatagatgcctcttttttacatattttgttaagattgtacacatgggggtaagtgtgggcccgaaaagtgaattcagattacttggctttgaaagctcaagtaggttatgtaattccccataatgtgggggtgatgaagaatcagttggggaaaaaaa

SEQ ID NO: 8955 - DNA, 804 bp, Solanum tuberosum
  Predicted polypeptide sequence is orthologous to G1033
tttttttttttttttcgcaacaataagctacacaattatagaaatagactaatcaaaagagaccaattgcctaaaaagttgcattatcattaagcaacaccagcatcagaataaaaagtacataagccactgagctttaaagatagctctgatctaattcatctttttcccatacctaagaaaccccaaaataaacccaaaaaagagcaagtatttaacggggaaaagtaaggagtcatcatatagagaaatatctaaggtattacacagcttccccaccaatttactcctccattagcacttcagtcatcatcctcttcttcctcatcgcttccatcttcctcatcaacctcagactttgacttgtcagattcctcatcttcctcagcctcaccagcctgttttctgttgtaagcatccataagcttctcgtaatcagcctttcgtttctcagccttagcaatgtaaggagctttctcagcatcagtcaagtgtttccacttgtcaccaccggccttgccaacagcagcaacggatttgttgcctggatgcttttccttgtactgcttcctgaagtcctccatgaaaacgaagaaggcacttgctggcctcttaggcttgtttggatccttggcagcattcttctcctttttagtctgggcagcgctcttcttcacaccgagcttgttatcagctttccccttggatttacctcctttcatgataaaaaacttctagggttgagagagaaaaaacaaagcgatattttttgccctttgagatgaaatgtgtatcgtgtgtgtg

SEQ ID NO: 8956 - DNA, 951 bp, Solanum tuberosum
  Predicted polypeptide sequence is orthologous to G1048
caatagtaagtcgggccctagtttcttcacccccacaatctccgtcgaactggcgatggtcgataacttcgatgatatcatcaactgggacgatgtagatcacatcttccacaacgttctagacaatccccacgatgatgatcaattcactcttcatgattcctccccacagacattccagcagatcgagcagcttcttatgaacgatgacgatgtcggtcttgtctcttttgaagacgctgatcctcaatttgctgccgactttctctctaacgtcctcgtcgattcccctcttcactccgatcattctcactctcctgctgaacaagccattggattcaccgattccaaggtttctagtggatccgacgccgatcaggacaaactcaagtcaccttctgatggggacgacgaactaaacaaccatgaccccgtcgataagaagcgcaagaggcaattgaggaacagagatgcagctgtgaggtcacgagagaggaagaagttgtacgttagggatcttgagttgaagagtagatactttgaatcagaatgcaaaaggctggggtttgttctccagtgctgtcttgctgaaaatcaagctttacgcttctctttgcagaatagcagtgctaatggtgtttctatgaccaagcaggagtctgccgtgctcttgttggaatccctgctgttgggttccctgctttggttcctgggcatcacaagcctgctcattctacccagccacacctggtcagttccagaagaaaatcagggaagcagaaaccacgggcttctccttccaataaaggaaggaaaaaagactagtcggattttgttgttcctgtccttcatgatgggcaaaagatgcaaagcttcaagatcgaggatgaagttcacccccattccttgggaggtgtgatgtgactcgttgtgatcaaatccattccctta

SEQ ID NO: 8957 - DNA, 838 bp, Solanum tuberosum
  misc_feature (783)..(783): n is a, c, g, or t
  Predicted polypeptide sequence is orthologous to G1053
ctccttttcccatttgcttactctgtttttgagtttttctccttctgttgttctgtttcttgtttttctcctcttttttagcccttttgatttctgggttcttagtctttgtggctaaaatccattaaagatccaatcttttttcaccaattctgctccttttaacctctgatttctgggtttttgctgaaacccattatagatccaacctttcctgttctgggtttttaatctttcttgttgaaacccattaaagatctaaccttttctgttctgggttttcaatctttgtggctaaaatccattaaagatccaatcttttctccattttctgctccttttaagctctgttttctgtgtttttactctttcttgctgaaacccattaaagatctgtgaaaaagaaaaaagctaatgctaaatagaaacatttattgatgtaccagattcatgtctccagttcttagtgaaatccttcgttctggttatataatcagttcatcacttagacgcagaactcatcttgttcaatctttctctgtttctttcctctactggttttatactttctcagaataataataataataatcttcatccatagtttttcaaattttgctagcttaccttaaaacttaaaattagtacttttttcaccttgtgtacataacaaaatggctacttctagtggtaattcatctcagattccgaacaattcaggttgtgatgaagttttaatggtggttgatgacaaggaacaagaaagagaatgcaatcgaatcnggaatcagcaagcagatcaagacttgagaaaacagaaacatttggatgatttgga

SEQ ID NO: 8958 - DNA, 950 bp, Solanum tuberosum
  Predicted polypeptide sequence is orthologous to G1062
ggcagaattccatcaatggagagggtgaaaggaagagaaagtggggtaatggggaagaagttgatgatgtgagctttgatgggtgcacattgagttatgattcagatgatcttactgaaaatgttactaataaggtggatgatagtgttaagaatggtggaaattgctcgaatgcaactagcaccgtcaccggtgggaatcagaaaggaaagaaaaagggactgccggctaagaatttgatggcagaacgacgacgtaggaagaagctaaacgataggctttacatgttgaggtctgttgtaccaaggattagcaagatggacagggcttcaatcttaggggatgcaattgagtacttaaaggagctcctacagaaaatcaatgacctgcataatgaactggagtccacgccgcctagctcctcattgacccaaacaacaagcttctatcctctaacaccaactggaccagctctgccaggccgcatcaaggaagaactctatccgagttcatttgcaagcccactgtctagcccgactggacaacctgcaagggtaaaaaatctttaaccaacagtaatgtttcatccagaagaaacttatcataatacaaacatatgtttctagttagatgtgtatacatatacattgattgcattgagcactattacggtgttcttcatggtggtaaagtctaaaagtcatcatgttattggtttgagatgatgtaatgcagattttgttttacttttaggttgaagtaaaggcaagagatggaagagctgtgaatatccatatgttttgcagccgcagaccaggcctcttactctcaacaatgagggcactcgacaacctcgaactggacatccaaacagctgttatcagctgctttcatgggtttgccttagatatctttagagctgagcaatgcaaagaaggtcaagactttca

SEQ ID NO: 8959 - DNA, 714 bp, Solanum tuberosum
  Predicted polypeptide sequence is orthologous to G1076
aaagaaagttctccataaagaacattaattaagatgacaaatttcagaattcatagagttacaagaccccaaaataacatacaagacaaaagaaaaaaaaaaactcaaaatctctagaacaaagatggtacactaattttgctgacctttttgattcaagaatccccatatttcatcattgatccaaattagcttccatttcatatcatcagtatgaacaagctcgaattctatttcccttttcaagatttgcactaaactccaaaaggtgggcgaagacctgaattccccacccacccatcaacagaagcagatccaggatttaaatagttaggcatatttaacggtagattaaaaaatggaagcccaggattagacgggtccggaaaagggttattattaacaaccccatcaccaccaccaccaccatcggagccttgtgtattaccatcttcctctaaaggcaatctttcataagcaacattagtaaaagatgaagctataacaataactggtccagcagccatcaactcacctaccacacttcctccaacaacttgtccttgtccaccagccaaaaatatagtcaaacttgttgcccctggtggtgctggtggtggtaaaaacgaaccactaagtgacaaaatctcgaatcgaccatttaatgtaacgaccgatgaagaactaatattaccagtattattattattacca

SEQ ID NO: 8960 - DNA, 1040 bp, Solanum tuberosum
  Predicted polypeptide sequence is orthologous to G1076
cttctctgtatactccactcagttctctctttacttttctattcgttcctagggtttgaaatttcttgtgttcattttgcttttccataaaatatattttcacgttcaagaattatatatatacatattttctactcatggtcattaattaatttcccgttattattaatcatatcatacttgattatagcttagttttctgttcactacttttgttaattgtatatatgtcatcgttatcgtctatggctggtttgagacttagagttccgcttctcatcatcgttttctccctcatacatctccacatatcctcaagatgacgaaatcaagccggaacaacactcaattttccgatgatgatgacaacgaacaacaacaacaacgattataataacaatagccccggggtagcacgtagaccaagaggtcgtcccgcagggtccaaaaacaagcctaagcctcccgtgataataacacgggagagcgctaacgcgctccgtgcgcatattttagaagtgagtagcggacatgacgtttgcgaatccgttgcgacttatgggagaaaaaggcaaagaggaattggtatactaagtgggagcggtacggtgaataacgtcaccatacgtgcagccacaggctgccggtactgtggtgacgttacatggaagatttgagatattatctttagtctggatctttcttaccacgaccgttccccccggggtcaccaggttaacgattatttagctggttggtcaacgtccagtcgtaggaggaaacgttgtgggtgcgctaattgcatcggggcccgggtcactgtaactagcattcttccatttactaattgttgtttatgaagatttgcctttggatgacacatgagtcattccaaatgacgcagaccaagacaaagtggtcactttggggaacccctatattggatacacttttttaattgcgcttaaacatggcaactgcggtccactcacactggcaacaggggtcagaactgatggaaatccacaaaaggacccaat

SEQ ID NO: 8961 - DNA, 635 bp, Solanum tuberosum
  Predicted polypeptide sequence is orthologous to G1078
aaggcttcgagtgttaggagcattgaaaggaagtattacaattcttactccatggttggcattggacttcctgatgtgggacctgataatggtaatgttttagatgcacgggaccctcttgctgagaaaaaggctgagcttgcagctagccaacggcgtgtggaagatgagatggtgaagcattctaaagcagtggaggtaaccagagcaatgactctgaacaacattcagacagggcttccgggagttttccaagctatgaccagcttttcttccttaatgacagaggcccttgaggctgtatgcacccgttcttattctattaagtaggaaacaacttacagataactgaatactagtacttattttctttttttttctttggctattcttactttcgttctgggcaaggatgaaagagaaagggcgcatttttggtcataggctcctttcagctagttggcttttccccttgattttttgctatgttgtagatatgtggaattttttcagttttgtacttttatctagtggtgggaagaggaatattttctgtatgtatagcaaattatttgcattattgcattgaggtcaacattctcagcagatgaataaatgtattccccttctaagtg

SEQ ID NO: 8962 - DNA, 726 bp, Solanum tuberosum
  Predicted polypeptide sequence is orthologous to G1084
tttttttttttttttgaaactaatatatatatatatatagatatatcaaggcacctctatatagctttctattccttctgtgttctgcataatcagtagcccagattggttaaggcacctctatggctcaagttactcaacatataatttacattgcattccttcctacctaacctaatatttttaatgtaaattacactgcattttgtggctgtttgatattctcacaattctttaccaaatcagtatatccatcagctgaagctatggcaaactctgtcagtgagctcagagcaactgacattcctgcacatagcactctaatggcaacctcagccatcttttctgctgtcattatgtcctcatcaagctgtccaacttccacgatattcatgttcccatcagattctccgccgagactctttgacccaccagaagtccggcgggaatcttcctttagttgttgtgcatagagtgagcctactcctgctgcaaaaaaatctagtccttcaagcactggtgtctcctggatggagtctaataacctggaccactggatgcaaatgctgaatattggtggagctcccgtggaacaacgaggagagaagggaaatttcgatgtgtcagaatctgaacgagcacagggcaaaagacagtttgctaaaagcatgccaggtatgatcgttgaaaaacgatccaggactcgaaacagggtctccaatttcc

SEQ ID NO: 8963 - DNA, 968 bp, Solanum tuberosum
  Predicted polypeptide sequence is orthologous to G1133, G1137
agaactgaatgccctactctactctgatgatgataatgattattccgaggatgatgaagaaacaagcactggtcactcgcctagtactatgaccactcatgatctgcgagagtggtttgacggaaggggtgaagaagttgctagttctgctgggccgattaaaaggcataaactactagatggtagcttcaatgcaccagagctcagggatactgcaacctctgcaaaagcctatacatgctccgacttagaggatgatgcacaatccagttgtggcaatggtttcgaacaagattcaggagcaccagattctccatctggaaaaaagaggcaaagacaagacaaaatccgcgaggacaattaagcattttgcaggaaataaattcccccgggagggggaaaagggaaaagactccgatgggttggtttatttgattgaaagcaatcccaattaactttgagatcccctggaagatgaaaaggccaagtccccttaaggaactttgattcttcttttgagctttcagcttgcccacttggtcatcatattattgaggttactaaatgggtatttctttcttgtaagctttctcgccttgggtcgagaaggtacgtatatagagggttttaaaattaaataaagcctgaattagagtttaaatggtggtatggcaaatgttgtgggctgatcagaatacaccataaaacaaaccagattggagaatcctttttagagtctttattccatcatttcttgtttggggaaccttggctatggctttgaaaatccagtggtcatgtcttctctttagattacggagggaacacttcttgtcactacttccataaagggttggtacattcatgagtttatatcttgacccccaagagaaaaaaagttgattctggccttgggaaatgtttttagctttgcccacataatggttcgtcgttggttgaacgacata

SEQ ID NO: 8964 - DNA, 963 bp, Solanum tuberosum
  Predicted polypeptide sequence is orthologous to G1134, G2555
tagaaaaaaaaaaagttaacttttgctagaaaaaattcaccgatgcaacgtggaactgccggtgccggaggaggtggactttcccgtttccgttcagctccggcgacatggttagaagcactacttgagtccgacactgagaacgaagttattcttaacccttcttctcccattttacacactcccaaaaaaccaccacctcacccatcaactccgaagcttccggagcttaaactggaaactggcggagctactaggttcactggcgatccgggtctgtttgaatccggtggtagtagcaattttctcaggcagaacagttctccggcggagtttctttcacatataagctctgatggttacttctcaaactatggaattccgtccagtttggactatctttctccatccgttgatgtttcgcagtccgctaagcgaacccgagacggtgattccgaaagttcgcccagaaaattagcatcccagttgaagggagagtcaagtgggaagttacatggttctggtggatcgctggatgctgaaatggagaatctcatggatgatttggtgccttgtaaggttcgagcaaagcgtggctgtgctacccatcctcgcagcatagcggagcgggttcgtcgaacgcgtataagtgacagaattaggaagcttcaggaactggtgccaaatatggacaaacaaaccaacacagccgacatgttggaagaagcagtcgaatacgtgaagtttctgcagaggcagattcaggaacttacggagcatcagaagaaatgcacgtgctcaatgaaagatcaataatgagaagaagagagctccactagagtatataggcaatagttttgttagttgcatgcagtttagaaatggtaattcactcctctatatcctattcttcttcatgtgtagatattaatggaaattttgcagagctttgctactttagaa

SEQ ID NO: 8965 - DNA, 1011 bp, Solanum tuberosum
  Predicted polypeptide sequence is orthologous to G1140
cttcagctcacaacttcagatctcttctccatttcttgcaaatttcagggtgaagaaagaaaatggtgagacaaaaaatccagatcaagaagatagacaatttgacagcaagacaagtgacattttcaaagagaagaagagggctttttaagaaagctcaagagctttcaactctttgtgatgctgatattggactcattgttttctctgctactggaaaactttttgagtattcaagctccagtatgatgcaactgattgagaaacacaagatgcagtcagaaagggatagtatggataatccagaacagctgcattcttctaaccttctgagcgagaagaaaacccatgcaatgctaagcagggactttgtggagaagaatcgggagttaaggcaactacatggagaagagctgcaaggacttggcttggatgatttaatgaaattggagaaattagtcgagggaggaataagtcgtgtcctcagaattaagggtgacaagtttatgaaagagatcagttccctcaagaaaaaggaagctcaactccaggaagagaattcacagttgaaacagcaatcacaagcaagattgaatgaagaagggcaaaatgtaattgagcaaggacattcagcagactccatcaccaacaatcgcagcttagtcaatagtcatcaggactacaatgactctgatacaagcctcaagttatgcttggcttttccttaatgagctcgatcaacatgaaaatgggtgatatatagttactgaaacaagggcgagtaatttgctatttatattatgcatcataatatagtgaaatgtataaaattgattagattggttgaccatcgagtttctcgagaaccgaggggtcaacggtctaatcagaaggtcgtgttgatatttagctaggtgctatgtttcagatctatttagagaatccacgtaaatatattaggtagtagttttttagcagtaatttctttgataaaaaaaaaaaaaaaaaaaa

SEQ ID NO: 8966 - DNA, 737 bp, Solanum tuberosum
  Predicted polypeptide sequence is orthologous to G1140
gaaaaaaaaacccctaatggctagagaaaaaattcagatcaagaaaatagataactccacagcaagacaagttacattttcaaagagaagaagaggtttattcaagaaagctgaagaactttctgttctttgtgatgctgatgttgctcttatcattttctcttctactggcaaattatttgactattctagctcaagcatgaaacaaattcttgagaggcgtgatttgcattccaaaaatttggaaaaattggatcaaccatcacttgaacttcagcttgtagagaatagcaattactccagactaagcaaggaaatttccgaaagaagtcatcgattaaggcaaatgaggggagaagaacttcaaggactaaatattgaagagttgcaacaattggagagatctcttgaaactggattgagccgcgtcatagagagaaagggtgataaaataatgagagagatcaaccaactccaacaaaagggcatgcaactaatggaagaaaacgaaaaattaaggcaacagctgatggagatatctaataataataataataataatggatacaaagagtcagtagtagtagcatttgaatcagaaaatggatttaatagtaataatgaagaaggccaatcatctgaatcagtcacaaattccatgtaactcaactgggcctcctcctccaggatgatgatagttctgatattctctcatattgggctacttactcagctga

SEQ ID NO: 8967 - DNA, 1162 bp, Solanum tuberosum
  Predicted polypeptide sequence is orthologous to G1140
tctctctctctaggtttcaattgggggagctctccaataatatcttccaacataaaaatttaaaaaattcctcttttttttttctttttctcttcaattccaacaagtgaatagtgcttattccatctccaaaattagtttgtaagatttcttgaaggtctgaagaaagataatagttgtcatctaataacacggcttctcaacagatggcaagggagaagataaaaataaagaagatagataatataacagcaagacaagtgacattttcaaagaggagaagagggctttttaagaaagctgaagagctttctgttctttgtgatgctgatgttgctcttatcattttctctgctactgggaagctatttgattttgctagcaccagcatgaaggatattcttggaaagtataagttgcagtcagctagccttgagaaagttgacgaaccttcccttgatttacagctagagaatagcctcaacatgagattaagcaagcaggtagctgataaaactcgtgagctcaggcagatgagaggtgaggaacttgaaggattgagtttagaagaattacaacaaattgagaaaagacttgaagctggtttcaaccgtgtgcttgagattaagggtacacgaattatggatgaaattaccaaccttcaaagaaagggtgctgagctgatggaagaaaacaaacaattgaaacacaaaatggaaattatgaagaaagggaagttccccttactgactgacatggtgatggaagaaggccaatcatctgagtctataattacaaccaataatcctgatcaagatgactcctcaaatgcatctttgaagttaggcggtactactgcagttgaagatgaatgctcaattacatctttaaagttagggctaccattcagctagcaaactcaaatggtgagcttttgttgaagattgtactaataataatttttggatgaaaacaatgaagtggcataatatagggtgcctttcttttggaaaaatataacgttctactatgtattatatgtatgtgcacaacttggcccagcgcataatgcagatttattaaccatctcattttggctcttgtgaggggatttctataatataatctgtgagtttacgtgaaaaaaaaaaaaaaaaaaaaa

SEQ ID NO: 8968 - DNA, 800 bp, Solanum tuberosum
  Predicted polypeptide sequence is orthologous to G1146
gccacaacagggaggatatggtggccgtggtagtggaggagctccaccacgtggaatggcccctcagcagtcatatggtggacagcctgaatactatcagcaaggcagagggactcagcagcatcaacaacgaggtggaggaccaccccagcaacatggtggcataggtggccgtggagcaccttctggtgggccttctaggccaccaattcccgagctgcaccaagcaaccacacagactcaacatcaagctgtaatgactactcagcccataccttatggaagaccagctgacacatccatggaagtgggttcctcatctgagccccctgagatgtcaactctgcaagtgacacaacagttccagcaactggcggtgcagccagaagcagctgcaacccaaacaattccacctgtgtctagcaaatcactaaggtttccgctgcgtccagggaagggaaagtttggtcagagttgcatagtgaaagccaatcacttctttgcggagctacctgacaaagacttgcaccagtatgatgtcaccattactcctgaagtatcttcacgcggtgtcaaccgtgctgtcatggcacagctggtgcttctttaccaagaatctcatcttggaaagagacttccagcttatgatggaaggaaaagtctatacactgcagggccccttccatttgttcaaaagagttcaaaatcactcttactgatgatgatgatgggcctggtggtgccaggagggaaagggaatttccaagtgtgatcaaatttgcttcccgtgctgatctcat

SEQ ID NO: 8969 - DNA, 540 bp, Solanum tuberosum
  Predicted polypeptide sequence is orthologous to G1146
ggagggacaacgatacaccaaaaggttgagtgagaagcaaattacttctcttttgaaggtcacatgccaaagaccaagagatcgtgagaactcaattttgcagactgttcaacacaatgattataatgaagacccatatgcaaaggagtttggaatcaaaatcagtgaaaaacaagcatctgtggaagcccgtgtgttgcctgctccttggctaaaatatcatgagacggggaaggagaaggattgtctgcctcaagttgggcagtggaatatgatgaataagaaaatgataaatgggatgaccgttagccgttgggcatgcatcaacttttcacgaagtgtccaagagagtgttgctcgtggcttttgtaacgaactggctcagatgtgtcaagtatctggaatggagttcaatccggaaccaataattccaatatacatggccaggccagatcaagtagagaaagccttgaagcatgtatatcattcatgcgtaaacaagctaaaaggaaaagaacttgagcttctattggtcattct

SEQ ID NO: 8970 - DNA, 964 bp, Solanum tuberosum
  Predicted polypeptide sequence is orthologous to G1146
caatgtgtggaatatctggaatgaacttcaatccgaatcctgttctgcctcctacaagtgcacgccctgatcaggttgagagagtcttgaaaactcgatttcatgatgccatgacaaagctgcagccgctatcgaaggagctcgatctcctggtcgttatcttgccagacaataatggatctctttatggtgacctgaaacgaatttgtgagactgagcttggagttgtctcacagtgctgtttgacaaaacatgtatttaagatgagcaaacagtatctagccaatgtagcactgaaaattaatgtgaaggtgggaggaagaaacactgtgctagttgatgcaatatctaggcgaattcccctagtcagcgaccgtcctacaatcatttttggtgcagatgtcacccatccccaccctggagaggactcgagcccatccattgctgcggtggttgcttctcaagattggcctgagattacaaagtatgctggtctagtttctgctcaagcccatcggcaagagcttattcaggatctgtacacgactaggcaagatcctgttaaagggactgtgtctggcggcatgattaaggacttacttatctccttccgaagagctactgggcaaaaacctcagagaatcattttctacagggatggtgttagtgaagggcaattttatcaagttcttctttatgaacttgatgcgatccgcaaggcatgtgcatcattggagccaaattatcagcctccagttacatttgttgtggttcagaaacgacatcataccagactttttgccaataaccaccgtgacagaaatgcagttgaccggagcgggaacattatacctggtactgttgttgactcgaagatttgccacccaacagagtttgatttctatctttgtagtcatgctggcatacagggtacgagtcgtccagctcattaccatgttctatg

SEQ ID NO: 8971 - DNA, 968 bp, Solanum tuberosum
  Predicted polypeptide sequence is orthologous to G1146
gtgaaactgatcttggcattgtctcgcaatgctgcttgacaaaacatgtgtttaagatgagcaagcagtatttagccaatgtgtcccttaagattaatgtgaaagttggaggaagaaacaccgtgcttgttgatgcgatctctaggcgaattccccttgtcagcgaccgcccaactattatttttggtgcagatgtcacccatccccaccctggggaggattctagtccgtccattgctgcggtggttgcttctcaagattggcctgagattactaagtatgctggtctggtttctgctcaagctcataggcaggagcttatacaagatctgtacaagacttggcaagatccaactagaggaactgtgactggtggcatgataaaggaattgcttatttctttccgtcgagcgactggacagaagcctcagagaataatattctaccgagatggtgttagtgagggacagttttatcaagtgcttctttttgaacttgatgcaatccgcaaggcctgtgcatctttagaacccaactatcagcccccagttacgtttgtcgtggttcaaaagcgtcaccacacaaggttgtttgccaacaaccaccgtgatagaaatgctgttgatcggagtgggaacattttgcctggtactgtggttgattcaaagatctgccaccctactgagtttgatttctatctctgtagccatgccggcatacagggtactagccggccagcacattatcatgtcttgtgggatgagaacaatttctctgctgacgggctgcagtctttgaccaacaacctttgttatacatatgctaggtgtactcgttccgtctccattgttcctccagcctattatgcacatttggcagctttccgtgctcgtttttacatggaaccagagacatctgatagtgaatctgtcacaagtggagctgctccgtacaagaggtggtgtagg

SEQ ID NO: 8972 - DNA, 723 bp, Solanum tuberosum
  misc_feature (702)..(702): n is a, c, g, or t
  Predicted polypeptide sequence is orthologous to G1146
cgtactatcacagggcagaggacccagcagtatcacgagggggaggagatcccagcgtcgtggtggtatagggggccgtggggcaccttctggtggctcttctaggccaccagttcccgagctgcaccaagcaactgagactccacatcagcccgtaccatatggaagaccagcagaaacatactcagaggctggctcctcatctcagccacctgaaccaatgacacatcaagttactcagcagttccagcaacttgcatgtgcaaccagaagcaggtgcaccccaagcaataccacctgtatctagcaagtcaatgaggtttccacttcggcctggaaagggtagtaatggcactagatgcattgttaaagccaatcacttctttgccgagttacctgacaaagacttgcaccagtatgatgtttcaattaccccagaagtagcttcccgaggtgtcaaccgcgctgtcatggagcagctggtaaagctttacagagagtcccatcttgggaagaggcttccagcctatgacggaagaaaaagtctgtacaccgcagggcccctcccttttgttcaaaaagattttaaaatcacacttcttgatgatgatgatggacctggtggtgctaggcgagaaagggagtttaaagttgtgatcaaactggctgctcgtgctgatcttcatcacttagggatgttcnacaagggaggcaggctgatgc

SEQ ID NO: 8973 - DNA, 847 bp, Solanum tuberosum
  Predicted polypeptide sequence is orthologous to G1146
caagatttgtacaagacatggcatgatcctgcacgtggaacagttagtggtggcatgataagggatctccttatatccttcagaaaggccacaggccaaaagccacaaaggataatcttttatcgggatggagtgagtgaagggcaattttaccaagtactgcttttcgagttagatgcaattaggaaggcttgtgcatctctagagccaaattaccaaccgccagtaacttttatcgtggtacagaaacggcatcacacccgactatttgctaataatcacaaggacaggagcagcattgataggagtggaaacatattgcctggtactgtggttgatacaaaaatctgtcatccaacagaattcgacttctatctttgtagccacgctggcattcagggtacaagccggcctgcacattaccatgttctgtgggatgaaaacaatttcacagcagacggaatccagtccttgaccaacaatctctgctatacatacgcaaggtgcacgcgttctgtctctgtggttcctccagcatattatgcacatttagctgcatttcgagccagattctacatggaaccagacatgccggaaaataattcaggcagccctcatcaaggcagcagcaaggctatacgagagatgggtgttcgaccgttgcccgcgcttaaagaaaatgtgaagagagtaatgttcattgttaggaagaagaataaacaagggagtagcaaatgtaacaaataggtaggggttcagaccacatgcatctttctttgtatatgtatgtatgtgatcatcctaggttaatttcatgttagtttaaatgatggtaaagcggctttgt

SEQ ID NO: 8974 - DNA, 838 bp, Solanum tuberosum
  Predicted polypeptide sequence is orthologous to G1146
cttcttcttattactctttttctctctctcgttaacaatgtcggaacgtggacgaggacgtcgcggtggttctccttatggtggtggcagaggcggtggaagaacacctccttatggtggcggtaaagcgacggtcgaacacctccttatggtggcggcagaggcggtggtcgaacacctccttccgatggtcgtggcagaggatatccgtctcccggtggtcgtggtcgaggaacttattccagtggcggatcatcgagttacagtgcttctcctagttacaatgctcctccgagttacaatcctcctccgatatatcatcatcaacaaccgtcaatggcggtttcatcgatgactcgggaggttgaacaaaagctttcgcttcaaccttccacatctgcaaatcctcctgctgggcctcagcctgtgcaacagtcgtcaccgcctgttgctaccatccctgcgcatctagcgggaccgtcgacttcgacgcagccgccaaggccgccaccggtatcatctaaaaacatgcggcctcctcctagaccggattacggaaccatcgggcgaaggtgcctagttaaggcgaatcactttctcgttcaggttgctgatcgagatgtacatcactatgatgttacaatcactcctgaggttctgtcaaagaaagtgtgccgactgataatcaaacagctggttgagagctataaactttcacacttgggtggacggcgtttggcatatgatggtcgaaagagtgcttacactgctggtgcgctcccattcgctcccaagaatttgttatcctgtttgctgatgataattggtggagcaagga

SEQ ID NO: 8975 - DNA, 913 bp, Solanum tuberosum
  Predicted polypeptide sequence is orthologous to G1146
tgtgtattttcctgcttatatattaaaggcacatatataggcatataagccaccaacagaaaaaaaggtcaaaggaaataagtaaaatataattgaacatttactgtctgttgtgaccataacttcgacacacaacatgcagttgcaaaaagcatgaccatgatccacagatcaatttaaaaaataaatagattgatagtttaatttataacttaatttaaaagaagatttctactgaattcagtgatcgatgatcagtgaatttttcagcagtaaaacatgacctccgacacattttcatgaatgttaggaagtggcctgaattgtgcagctgcttgctccctggttgctgctcctccctcaccaccttcattagctgctcttacatccacgtcattctccatgtaatagcgtgcacgaaaggcagctagatgtgcatagtaggcaggtggcactaaggaaactgatcgtgtacaccttacgtatgtgtagcacaggtggttcgttacattctgaatggcatctgcggtgaaattgttctcatcatacagtacatggtaatgtacaggacgactggtacccttgatcccagcgtggctacataagtaaaaatcaaactcaggtgggtggcatatcctggtgtctaccacagtacctggcaaaatgtttccactcctgtctatcaaactacgatcatcgtgattggaagggaatagacgtgtatgatgtcgcttctgcactaccacaaaggtaactggtggcatataattattttccagggcaacacatgccttgcggattgcatccatttcttccaattaaaacctggattgaatttgtcctttcgctgactccatctctatagaaggattattctataagcgctttcgtttagtcactttgtaaaacggct

SEQ ID NO: 8976 - DNA, 770 bp, Solanum tuberosum
  Predicted polypeptide sequence is orthologous to G1198, G1806, G558
taacaagatttgatgattctgctgtcttattttagctttttggcaaagcttgagccttttgctatagacccttttcgtctcttgaactaagatactacatctgatttttgttccaatttcaattgattacccacaaagttggctatagtccatgatggctgatatcagtcctagtacatcaacagatgccgatactgaagataagaacaggttcctaaatcaacaactgtgtgccgtagcttctgatggaagtgacagaccgaaagatcaaaagacactccgtagacttgctcaaaatcgtgaagctgctcgaaaaagccgtctaaggaaaaaggcatatgttcaacagttggagagcagcaggatgaagctgacacaactagaacaggagcttcaacgagctcggcaacagggaatatttatttcaggttcaggagatcaatcgcagtcgatgagtggaaatggagctttggcatttgatgtagaatatgcccgatggttggaagagcagaaccgacgaattaatgagttaaggggagctgttaattctcatgctggtgatgctgaacttcgcataatagtcgatggaatcttggcacactatgatgacatattcaggataaaggcggatgcggcaaaggctgacgtttttcacatattgtcgggcatgtggaaaactcctgcagaaagatgcttcttgtggcttggtggattccgttcatctgaactcctcaagctactcattaatcaagttggagccttttacccga

SEQ ID NO: 8977 - DNA, 1477 bp, Solanum tuberosum
  Predicted polypeptide sequence is orthologous to G1198, G1806, G558
gtttgggtatatcaagaagtgtaaatattaggatttttctaccattaatttgattcaaaattgaatcttgataagattttctttatcttctttcacacaaaattgaattcatttgggtttttcggttgagctgagattttgctgttggccttaaaagtccgtacaaatgaattattcaacatacactcagtttgttgcctcaagaaggatgggcatatgtgagccgatccatcaaatgggcatgtgggatgatttcaatgctagttgtccgagtacatcggcaaccatgattctagaagttgagaaatgcctagaggaccagatacctattatagacaaaagattagacattgagacagaagatacttcgcatggaacagtagggacttctaatagatatgaagcggaaacaagtaaacccattgagaaggtacttagacgtcttgcacaaaaccgcgaggctgctcgtaaaagccgtttgcggaagaaggcctatgttcagcagttagaaaatagtaaattgaagctgattcaattggaacaagaactagatcgggccagaaaacagggtctgtatgtaggtgctggtttagatgctagccagctaagttactctggaactgctagctcaggaactgctgtatttgatacagagtatggtcagtgggtggaagagcaaaatagacaaacaaatgatttaaggaatgctctgcatcattctcaaattagtgaagcggaattacgcattatcgttgatggttgcctgaaccactactttgagctcttccgcgttaaggctacggctgctaaagctgatgtcctatatatcatgtctggcatgtggaagacatcagcagaacgcttttttatgtggattggggggtttcggccatccgaacttctaaaggttctcacaccacatcttgagctcttgacagaacaacaactccgggaggtttgtaacctcaggcaatcgtgtcagcaagcagaagatgccctgtcacaaggaatggtaaaacttcatcagattcttggtgaggctgttgcagctggccgattaggtgaagggaattattctcttccgcagatggggcctgccattgagaagttggaagctcttgttaggttcgtaaatcaggcagatcatctccgccaagaaacacttcaacagatgtcccgcatcctgaatacgcaccaagcagctcagggcttacttgccttgggggagtactttgaacagcttcgtgttttaagctcacactgggctacccgtcttcatgagcctgcctaatgatgcaatagaagatcccttagtacaccattcgacgagttttgccttcagaaattatactatgtaagctaaaatttagctcttgtttatgtcaataaagctctcaatatgaatgtaggacattaaactagttgtacaaagggtttccgagagtctattgtggcttatgtttccgagcaacttttg

SEQ ID NO: 8978 - DNA, 1466 bp, Solanum tuberosum
  Predicted polypeptide sequence is orthologous to G1198, G1806, G558
ggaattttgattttcaagattccattcaatttttcttctatgggtgtttagaaggatttaggcttttagagttttgaagtggggaaaaaaaggtttcttgaagactttgctgttgttggctttaagtccaaaggcaatgaattcttcaacatatactcaatttgttgcctctaaaaggatgggtatatgtgacccaatccatcagattggcatgtggggagatttcaaaggtagcagtttcccagataccttgattcttgaagtcgagaattgcctagagaacgagatgcctattatggagaaaagactagagaatgagatagaggaaccatcacaagtgactgttggaatgtctaacagatatgaacctgaaacaactaaacgtattgataaggtgcgtagacgccttgcacaaaaccgcgaggctgctcgtaaaagtcgtttacggaagaaggcctatgtccagcagttggaaaatagtaaactgaagctgcttcagttggaacaagaactagaacgtaatagacaacagggtctgtatgtaggtgatggtttagatgctagtcagataggttgctctggaaccgcaaattcaggaatagcttcttttgaaatggagtacggccattgggtggaagagcaagatagacaaacagatgatttaaggaatgctctgaactcccaaatgggtgaaatagaattgcgcattcttgtcgagagttgcttgaatcactattttgatctctttcgcttgaaagctacagccgcaaatgctgatgttctctaccttatgtctggcacatggaagacatcagctgagcgtttcttcttgtggattgggggatttcgcccctccgaacttctaaaggttctcacgccacatgtggaaccattgtcagatcaacaaatccaggaggttagcaacctcacccagtcttgtcagcaggcagaagatgcgttgtcccaaggaatggtaaaactccatcagattcttgctgaggctgttgcagctggtacactaggcgaaggaattatccttccacagatgaccgctaccattgagaagttggaagctctagttagatttgtaaatcaggcagatcatcttcgccaagaaacccttctacagatgtcctgcatactggctgcacaccaatcagctcagggtctccttgccttaggagagtactttaaacgtcttcgtgctcttagctcactttgggctggtcgtctttctgaaccggcttaaagaagtaagaaacaaccattatatatgctacctggggttttcaactttgccaatcaaagctgtgtgaggtaaaatctgcctcgtgttgctcgtaaaaactatgagttggcgctcattcagacactacaaatctgtatataagttctgctatgctgtaactggaacttggaaattgcgtttattttcttttcacattggttttgatgattgtaaatca

SEQ ID NO: 8979 - DNA, 975 bp, Solanum tuberosum
  Predicted polypeptide sequence is orthologous to G1198, G1806, G558
ggatcggggtcaatggggcgatcaataagacctatggcctaggcttgtgacctccattgcactttggaggggtgcttgcctaaggtcggcccaagtggtcgagcctacgtcataatttgttacagcgggggcctgcgttcgcgcggcccctgcccaaatccttggcggagacattagctaacggatctcctgctactgaagggtcatcaggagatgtagctaattatatgggtcagatggcaatggctatggggaaattagggactcttgaaggttttctccgtcaggtaactctatttttgctgctgcttcctattctttgtttgtttaaattgtttacaatagataagctgcaaatgctcgttcagttgtttgaacatgtggaagtcgggggcaagcaaatgttgttctggaggtctttgtaactgcaaccagcatgcattgcccacagaatcttcagaatgtcttgtttgtattggtctttggacaaaaagtctggatactttgtcctcttgtatgtcctttaatgaggtcataaaataactgaagggttatgttcgccaacacattcttaaatcaacaattgtccttctgtctcatacttgtaactctcttgtgaattatatgattcaagacagccagtcatgttcagagatttctggtttgttatattagttttatgtcgtctctggaggcaaaatacgtgaagctaaaagtcattgcatctttctgactcttttaacaggcggacaacctgcgtcaacaaacattgcaacaaatgcatcgcatattgacaaccagacaatcagcccgtgctctacttgcaataagtgaatacttctcacgtcttcgagctctcagctctctttggcttgccagaccacgagagcaataagtatgacatgcatcgcaatactctactgaaactcggatatactacttcgatacactggccagtatatgagatccagctaa

SEQ ID NO: 8980 - DNA, 980 bp, Solanum tuberosum
  Predicted polypeptide sequence is orthologous to G1198, G1806, G558
gtttagcacaaaatagagaagcagcaagaaaaagcagactaagaaaaaaggcttatgtacaacaactagaaacaagtaggataagacttgctcaactagaacaagaacttcaaagggctagatctcaggggattttcatgggaggtggtgctactggtcccaatatcagctctggtgcgtcgatgtttgacatggaatattcaaaatggttagatgatgatcagagacaaatatgtgagctacgtacagcattgcaagcacatttaggagatggtgaacttagaataattgttgatgcttatattgctcattatgatcacatttttttactcaaaggagttgctgccaaatccgatttctttcacctcctcactggtatttgggcatctcctgccgagcgcgggttcctttggcttggcggttttaggccctctgaccttatcaagatgttgattgcacaattggaccctttaacacaacaacaaattgttggaatttatagtctccaacaatcatcacaacaggctgaagaagcactttcacaagccttagaacaattaaaacaatctttaattgaaattctagccactggttctgtcaatgatggcatgcatcatatggctattgcattgggaaaacttgccaatctcgaaagcttcgtttatcaggctgataacttgaggcagcaaacgatacaccaattgcacagaatattgacaattagacaagcagcaaggtgtttcatgatgattggtgaatattatggtcgattaagagccttaagttccctatgggcatcacgtcctagagagactatgatggcagatgacaactcttgtcaaacaacaagtgagttgcaaatgatacaagcatcacaacaccatttctcaaatatgagatgataattattcatttctgatatctctataatatatattaattaatattactcttttatctgtaaatgtataaatcatttt

SEQ ID NO: 8981 - DNA, 994 bp, Solanum tuberosum
  Predicted polypeptide sequence is orthologous to G1198, G1806, G558
cccttcttctttgtataattccataattcaattttaattttcttgaaaaactccaatttgcagaagagtttctttgtacttatgaacagtctatgaacatgagttctacatcaactcaatttgcccccacaagaaggatgggcatattcgaaccgttccaccatatgagtatgtgggaagacgcgtttagaggtgacattatgcccagtgttggtgcgtgtatggtcacaccggcaaatgacagggcagatgacaagtcgggatatacttctagtgaccaacttataccctctggctctgaggataatcaagcaggaaagagtgtttcagacaaggtacagcggcgtctagcacagaatcgtgaagctgcacgtaaaagccgtatgaggaaaaaggcttatgttcagcagctcgaaaaaagtaatttgaagctagcacaacttgaaatggaacttgagagagctcgacagcaaggactgtacattttaggttcaaatggtaatatgggcctaagttcaacaattaatccaggaatagctgcatttgaaatggaatatagtctctgggttgaagagcaacaaaaaaagaacgtagagttgaggaacatattgcaatcccatgtaagcgaagtggagctccagttgctggtagaaaccgtcttaaaccactactacaatctcttccgaatgaaagctgatgctgcaaaagctgatgtgttttacttgatatctgggatgtggagaacttcggtggaacgctttttcctctggattggaggattcaagccatctgaactcataaatatcgtgatgccacaacttgagccattgtcagatcagcagatcgtgaaaatctgtaatctgcgacactgttgtcagcaagctgaggatgctctcactcagggaatggataaacttcagcagactctggcacagaacatcctaactatgaccactggaacgggaaagtacagttctcagatggtttctagtat

SEQ ID NO: 8982 - DNA, 844 bp, Solanum tuberosum
  Predicted polypeptide sequence is orthologous to G1198, G1806, G558
cattcacacaactttcccaaaagtggagcaaaagctctagtataatagtcatgggctgagctcacagaacatttagctgaatggatgcaatgggtgatcgggaaggccctaggcttgtgagctccactgcactttggaggggtgaccgccggccagcacaagtcgtccaagcatcgcagttggagcaaaactttcagcgagcacctcaacagggcgaaagtgatgccgttctgcagggcccttaccatttgatatagaatatagtctatggttggaagaacacaccaaacacatcaatgaattgaggattgctgtcaattcacatgcacgtgatcctgaactgcgaagtattgtggatagtgtcattgcacattacgatgatgtctttagggtgaaaggaaatgcagccaaggcggacgtattccatgtcttgtcagggatgtggaaaacccctgccgagcggtgttttatgtggattggtggcttccgcccctcggaacttcttaagggcctgtagcatttgatgcagaatatagtcgatggttggaagaacacaccaaacacatcaatgaattgaggactgctgtcaattcacatgcaagtgatcctgaactgcgaagtatggtggatagtgtcattgcacattatgatgaggtctataggatgaaagcaaatgcagccaagggtaacatagagcatctcttgtcaggaatgtggaaaacccctgctgagcggtgttctatgtggattggtgacttccgcccctccttactgcttaagcttctagtcattcaggtggagcctctgaccgaccaacagataattggcattgtcaacttgcagc

SEQ ID NO: 8983 - DNA, 755 bp, Solanum tuberosum
  Predicted polypeptide sequence is orthologous to G1198, G1806, G558
atgagaattttttttccattaacaaacaacaaacatcaattgcaaccaacagccagaaggatgatacttgtacatacaatgaacaacgattaactaaggaccatcttcgaataggtaactaacacacctagtacaagaaaatagctaagactagataatagtatacagataactaattgtgctcaagatatctcgaggcaatgtgagtcgagatagtacacgagtactatacgtttgtcattgtgtgattccgagtgaaagacttttgaaagttgtgaactactatataatgacttatcttcacaatttcaaaggtgtaggaaatgactatgaataggaggaaccttgtagggatgagtacggcgtactagagttggtctttggggcgtgctaaccacaacgagctgagtgctcgaagccttgacatgtaatcacttatgacaaggagggctcgagcagcttgacgagtagtcaagattcgatgcaattgttgcaaagttcgttgtcgcagaagatcagcctgatgaaggaagctctcgagagtggcaagctgcctcattgcaattgccatttgccccatatagtcagctacatttcctgagccagtagggccgagagacgtagatgaaagtgtatcaacgagtaattgttgcagggcttccataccttgtgatagggcgtcctcggcttgctgagaagactgttgcaagttacatatgcctatgagctgctgttctgtaaacggttcaagatgg

SEQ ID NO: 8984 - DNA, 701 bp, Solanum tuberosum
  Predicted polypeptide sequence is orthologous to G1246
ttcgctataaatagcaaattgttaatccatttgaaagaggtttgctagacacatttagaacaattctagctccatcaaaccttccatgattagcaaaaaccaaattcaagattcttgattttggtaacaaagaattcacaacaaaaaccaaatttcaagattcttgattttccaatgatttccatttatgagctagtgcatcaacaacaccattaaagctaccaaaattggaacttaccacatcaatgccaacacccaaactctcagcaccagcagctgtaacagggccatgagcagccaccaccattcttggacatctcctcctcaccattgaccaatccaatccaaattcctccaaactcttcaacaaaccctccacttctccagtactagtaaacacaattgcatcaaatccacactcttcttcactctttgtcaccacatccaccgcacatttcgcccctgcccatcgcgtctcatacgcgtctaatctcactggaatccacccccttttcgataaatcctcaaggaatttcggcacaacaggtggttcattcaacccaatcactaaaggaactgggcacaacacttttcttccttgacccaatcctaatgcctccactaacccagatggggtttgcattgaaggaaccaaactcgaattctttcagggtttcacacatttttcgaatgattctcga

SEQ ID NO: 8985 - DNA, 844 bp, Solanum tuberosum
  Predicted polypeptide sequence is orthologous to G1266
aatcccttctaattatagctatggttccaactcctcaaagtgatctacctcttaatgagaatgactcacaagagatggtattatatgaagttcttaatgaagctaatgctctaaacatcccttatttaccccaaagaaatcaattacttccaagaaatactaataatcttcgtccgtcacagtgcataggcaagaaatacagaggcgtacgacgtcgtccgtggggaaaatacgctgccgaaattcgcgattcggctagacacggtgcgagagtatggctaggtacgtttgaaactgctgaagaagctgcgttagcttatgatagggcggcttttagaatgcgaggtgctaaggcactacttaattttccatctgaaatagtgactgcctctgtttcagtagaaaaattaagtttgtgctcaaatagttacactaccaataataattcaaattcaagttcgaatgaagtttcaagtggaacgagtgatgcatttgaatcaaaaatttccaaggagttttctcaagatgttaaaacagagctgtgcatggagaatttcttggtgctctaagcgaataatgtgttggcaagtagggaatatctctatctatgtattcaggtgtacgaatcaattgaactactaaaatttcgctgttgtacttatattatgggcttctctattctcttatttccttttttgaattgtttgcagcgatgcacgctataatcttgtgtaaaaagattgcttaggatacttagtatgtttataagttgtaatagacacattctattttctagttttttttcttctcaaaattcaaaatcaacggaatattatatgtaaaa

SEQ ID NO: 8986 - DNA, 798 bp, Solanum tuberosum
  Predicted polypeptide sequence is orthologous to G1272
gtttctttctcttttgtcgtacattagggtttcacctcttgactctgtttcttcatccgccatttttgagctttagattgtggtaatggctgaagaagagaatggtggatccacagaggctctgccccctcctccccctgttccacttgatttctctccagcacaagctgaaccagagccggtgaagaaaaaggttttacgtgttcccatggcgagacgtggccttggaagcaagggacaaaagatcccgatccttaccaatcactttaaagtgaacgtgtctaatgttgatggacacttctttcattacagtgttgccctattttatgaggatggtcgacctgtcgagggaaaaggaattggcagaaaagttttggatagagtgcatgaaacatatgatacagaattggccgggaaggattttgcatatgatggggagaagagtttgttcaccattggttcactacctagaaataaattagagttcacggttgtactagatgacataacatctaatcggaacaacgggaccaatggcaactccagccctggcagacatggaagccctcctaatgaaactgataggaaaagattaaggcggccgtaccaatctaaaacttataaggtggagattagcttcgctgccaagattccaatgcaggcgattgcaaatgctttgcgaggtcaagagtctgagaactctcaagaagccttgcgagttttggatataattttaaagcagcatgctgcaaaacaggggttgtttacttgtttcggcatccttttttcatatgaccc

SEQ ID NO: 8987 - DNA, 950 bp, Solanum tuberosum
  Predicted polypeptide sequence is orthologous to G1272
agacgagccccactaatcaagagtacaagattactggattgagtgaccgaccttgtcgtgaacaactatttaccctgaagcagaaaggaaaagatgcagatggtgaggtccaaacaactgaagttactgtgtttgattactttgtcaaccaccgcaacatagagttgcgttattctgctgatttaccctgcataaatgttgggaaaccaaaacgtcccacctatttcccgattgagctctgttctttggtgtcgttgcaaagatacacaaaatccttgtccacattccagaggtcttcactagtggagaaatcaaggcaaaagcctcaggagaggatgcaagtcttaagcaatgctctcaaaatcaaccaatatgatgctgagccccttcttcgttcctgtggaatatcgattagcaataacttcactcagattgaaggacgtgttcttcctcccccaaagctgaagacaggtggtgatgactttgtccctcgtaatggcagatggaatttcaataataagagactagttgatcccacgaagatagaacgctgggccgttgtcaatttttctgcacgctgtaacatacaagggctagtcagtgatctgatcaaatgtggaaaacagaaaggaattgtggtggaagacccatttgatgtttttgaggaatctccacaagtcaggagggctcccccactcgttagagtcgagaagatgtttgagcaggtccaatccaagcttcccggggcacctaaattcctgctatgtctgcttcctgagaggaaaaactgtgatgtatacggaccatggaagcgaaagaatcttgctgagtatggcattgttacccagtgtatagctcccacaagagtcaatgatcaatatatcaccaatgtgctcctgaaaataaacgcaaagcttggaggtttaattctatgttaactgttgaacatt

SEQ ID NO: 8988 - DNA, 964 bp, Solanum tuberosum
  misc_feature (707)..(707): n is a, c, g, or t
  Predicted polypeptide sequence is orthologous to G1272
ttagaagattgtggtaatggctgaagagagaatggtggatcacagaggctctgcccctcttcccctgttcatttgattctctcagacagttgaacaaagcgtgagaaaaggttaacgttgtccaatggaagaattggcctaggaggcaaggaacaaagaatcccgattcttaacaattaacttaaggttgacggttgttctattgtggattgaccccctccttcacataccagtgtttggcctatatataatagaggatgtctcaacccgtgtcaagggaaaaggaatcggcgcaaaagttcctgaatagaagttgcttgaaccattatgattcccagaatttggccgggaaggattttggcttatgatgggaaggagcaagttggtccaccatatggttcattacctaagaattacattaaaacttccacggttgtcttagaatgacttaccttctaatcggaacaaccggaaccattggcaacttccagccctggcaggacatgaaaggccctcttaattgaaacttgataaggacaaaagataagggcggccgaaccattctaaaatttacaatggtggagataagcttcgttgccaagattccaatgcaggcgattgcaaatgcttaacgaggtcaagagtctgagaactctcaagaagcctgcgagtttttggcatatacttttaaggcagcatgcttgcanaacagggttgttacttgttcggcaatccttattccataatgacgcaagaactttgcctgatgtttggacgtggtgttacttggttgcccagggtacatttcgagtttcgaacacccaggaggggattggtccttgagctttgacgttttctaccagatgataattcacgcctgggctgggtggacctctgatacgagcacaattggagagatccctctcacttgatgggggacgaggagctttttgaaaactgagat

SEQ ID NO: 8989 - DNA, 722 bp, Solanum tuberosum
  Predicted polypeptide sequence is orthologous to G1274, G1275
ttcttcctataaatataaataattgtacataaatagaacaacatacaatatttcttataaaattaataaaagtcttgattattctcctcaagaagatcaataggaagaagatgactcattcaaaaagttgtttgctggcttttcattgcagtaaatgataaagggactttcatgattgtgttttccttcatatgtagtcatcaaatatcttgaatcatttccatctctttctacctttttctttactttgcaatctccacttgaacacttgtagtaattccttagatttatgttggttttcactttctttttcccatatttcctccatttgtatccatcatccaaggtctcaagttgtgtctttgttctaaaagcaattgcatgtttttcacctttcttttctttctcaatccccatgcttgaattttcatgattcatgtgtacatgtgttggtgtggcatcaaatgaactagctgatgatgagtttccactagtactataggtactagtacttatctcttgtttcatgaagagattttctgaaaaaattgaagcattattgtagctattatttgagtaattggaataatattcttgatcaccatcaactaacaaatcaagaaataaagtgtcataatcttgatacttattattattactattgttatggccataatcttgattcatgttgatgagaggatcatgaaagcaaaagaataggg

SEQ ID NO: 8990 - DNA, 742 bp, Solanum tuberosum
  Predicted polypeptide sequence is orthologous to G1274, G1275
tttctatcttttctttcccttcacaatggaaaattttccatatagctcatcaaaccctaaccctaatttcatcgatgcatcggagaattttgagctctcagattataattatctctttcttgatgatggatcaaatgacgattttttgtcacaaaatgaaattgttcaaagtgtttccgatagtagtggatcatattcaaataatcccactccaacaagtcataacataaaatgtatgaaaggtgtaaagaaggtggatgcaaagtctagggttgcatttagatttagatcagagttggaggtgttggatgatggatttaaatggaggaaatatggcaaaaagatggtcaagaatagttcaaatccaaggaattactacaaatgttcaagtggaggatgcaatgtgaagaaaagagtagaaagggacaatgaagattcaagctatgtcattactacttatgaagggattcacaaccatgagagtccttatgtgtttcactacacacaattccctcccaacaatattgcccttcacaatctttgcctttagaaccttttaaacgtgtcagtaaatttcagttatatatttgtataatggtaggttctaatagaccactttgatcatatgataaagtgtttctattaaacattttcgacttatgttttaaaaaaatgtgtgcacgtgttttcaagtgcccgatatatagataagttaatcacataaaatatgtctctttctttg

SEQ ID NO: 8991 - DNA, 343 bp, Solanum tuberosum
  Predicted polypeptide sequence is orthologous to G1274, G1275
aatcatgtagaggcggattcagaatttgaattgaattttcatcgtcgaggagggaagagagtagaaagagatcatggacatgattcaacctgtatgattactacatatgaaggcaaacacaaccatgaaagttgttcctctatcatatgcagccatgaaatgcccactgaatttcctcaatgaatggactttgaaaacaacttcataatttccataaaaagcaatcgggatccctttgtaattttcttgtacaaatataacataggacattatattatatacatacgtttaattatttcatcaattatatcgtgtgacatgtaaaaaaaaaaaaaaaaaaaaa

SEQ ID NO: 8992 - DNA, 955 bp, Solanum tuberosum
  Predicted polypeptide sequence is orthologous to G1274, G1275
gttatttctctccaaacacaatgaactccaccttcctagaaacaaacattcctcatatagaaaaccctaatttcacctttccctttctttactcacacatgactaatcaagattgtacttacaattttcaagatacttttcttgatcaagattttaaattttcttcatttcttgatcatcttcttgttgattatgttcctacctataacaactccaataatactcctcttttagaaattaatccctccatgcatgaaataagtagtagtagtagtgccaatagtgcaagttctaccacttccttttatgcaccaccaccaaatattaatcacttgaaagaaaaatccaaagtggggattataaagaaagagatgataaaaaagaatgaaagacatgttattgcttttagcacaaagactcaacttgagattttggatgatggatataaatggagaaagtatggcaagaagaaggtgaaaagtaacacaaattatttgaggaattactacaagtgttcaattcgaggatgcgaggttaagaagagagtagaaagagatggacatgattcaagctatttgattacaacatatgaaggtaaacacaatcatgaaatcaactcctttatcatttacaatcatgtagaggcggactcagaatttgaattgaattttcatcgtcgaggagggaagagagtagaaggagatcatggacatgattcaagctgtgtgatttactacttatgaaggcaaacacaaccatggaaagttgtttcctctattcatttgcaggccatgaaaatgcccactgaatttcctcaatgaaatggacttggaaaccacttccttattcccttaaaagcaatcgggaatccttggaatttcttgtccaaatttaccttggcaattttttttttcacccgttattattcccatataccggtcctttaaaaaaaaaa

SEQ ID NO: 8993 - DNA, 461 bp, Solanum tuberosum
  Predicted polypeptide sequence is orthologous to G1274, G1275
tttttttttttttttttttatataaaactctttaaatatagcattatacagtataaatcctgttggaagcaggaaaagagtacatgccaactgaaatgttctaattgatttcattttaagttacagatagacgcctccatctgactccagtcaagctggaacaggttaggagatccaatttactggcctgatttagctaagctacagtactcatagtaactttgaactgatctcttcttcatcgatcagaacggggatggaccttgatggttgtggacaccctcgtaggtggttatcacataccgagaatcctctttgtctcgttcaactctcttcttcaccggacaaccttccacggagcacctatagtaattcctgtaagttgatacacaaaacatgctcatgtgagttataataagtagttatcatacaagtttccataagctgctatagagcaaaag

SEQ ID NO: 8994 - DNA, 615 bp, Solanum tuberosum
  Predicted polypeptide sequence is orthologous to G1305
aggctcattgtccgtccaaaagtattgtagggtttcatcgtccccttcacagacctcaaacttccttcattacttctacacgcgatgcctttcctacccagttcaatttcagattcaacaatgttttgagtgtacatctaaggcagagactactacctatatcaaaatcaagcaccaatccttcaggaggaccagagaaaagcaaggatgcatcaagcccaccattagccaccattttggctggtgtcttagtcttttgtgtcgtctgttggatcgtaggatctattgtaatctggctcataagtctcataactaatgtcccgccatcaaaataaaaccagagtgtgcattgtagtttgtttgcgctttgatcactagctagacaaagccatcttttgattgcagcctaaatagtgatgctttcctttatgttaccaagtgtgagattaatactgagttgctaattatttctaacaatgctgaaacatttgtggagtttctggttagctcaaatggcatgatacttcagttagagcataccaggaagtatcactcattctgttttcatcgtaaatttcaaggttttttcgttgttgttaagtttctgaataagag

SEQ ID NO: 8995 - DNA, 859 bp, Solanum tuberosum
  misc_feature (572)..(572): n is a, c, g, or t
  Predicted polypeptide sequence is orthologous to G1324, G2893
tattagtagtagctaagaaaaaaaaaaatggtgcaagaagaaataatgagaagaggtccatggacagaagaagaagatgtgcagcttttattttatgttaaattatttggagatcgacgatgggattttcttgctaaagtttcaggtttgaaactaaggtgattggcgggagacaaattataaaacaaaaaatacatcatagtatatatgcataatattagtacaaacaaatagtcttctcttttatcccaaataacagttaagtttctaatctcttctttaattacttttaattttactctattttaattttttatatatatagttgtctgtgatgtatttatgtttatatctgtttagggttgaccagaacaggtaagagttgtaggttacgttgggtcaattctttgaatcctgatctcaaacatggcaagatgactccgtcaagaagaacgtcttgttcttgaacttcagtccaaatggggaaactaccatggtcccgaatttgcccgaaaaataccatggcgtactgatacacgccacttccgcacttcctggacaacccatatgangcacgcaagtccacgacccgacgcacaaagtctcctaatttctaccatactttcatcatcttcttacttccttcaagtcactccccgaagaacactcgcacgaaacttctaacgatcaccggtggcatccaggtccttgccagttgcaggtgcacaacaattcacgtgatcaaaaccaccttggcacccaggttccgaccagtttaactccaccatggcttcaacacccgcgcaccccactcacgggcctttccatttgcacgcaacacatctggagtcacaaccca

SEQ ID NO: 8996 - DNA, 317 bp, Solanum tuberosum
  Predicted polypeptide sequence is orthologous to G1324
gtttatttgattaatttggttttaatttcttcaaaatttcttctttttttcgggtttatggattccgagcagaaaaagtggaatccatggttgaggagaagtgaaatgatggggaagaaggctagctgagaaggggaaagggtaaaattggaattacagcgcccattgtatagggatagtcaagcttggcaaggagttggaattacttcatcttaattactacttcattatcaatcaagtgtaaacatcttaataaaaataaacatatttgtatttaattcagacttcaaaaaaaaaaaaaaaaaaaaaaaaaaaaa

SEQ ID NO: 8997 - DNA, 634 bp, Solanum tuberosum
  Predicted polypeptide sequence is orthologous to G1335
cacacactctagaagggttttagggtttcgtttttgtgaggtaaaaaaatggcggatgagagttgtgagaggctgacgggaatcgtcaagtggtttagtgaccagaaaggttttgggttcatcactccctccgatggctctgaagatctgtttgttcatcagtcaggcatcagatctgaagggttccgtagcctagctgaaggtgaggaggttgagtatcagattgagtctggttcagatggcagggctaaagcttgtgacgttactggacctgatggagcgtctgttaaaggaggctctcgtagcggtggaggtggaggaggaggtcgtgatggaggtggctacggtggaggccgaggaggtagccgtggttatggaggtggtgacagtggctacggaggtggtagccgaggttatggaggaggcggtggtggctacggaggcggtggaggtggttacggaggcggtggtggaggtagcggcggcggcggctgcttcaagtgtggagaatctggacatttcgctagagagtgtccacaggatggcggcagtggcggaggcggtggaagcaggtattctggtggtggaggcggaggaggtaggtactccggcggcggtggaggtggtggtggcg

SEQ ID NO: 8998 - DNA, 872 bp, Solanum tuberosum
  misc_feature (478)..(478): n is a, c, g, or t
  misc_feature (497)..(497): n is a, c, g, or t
  misc_feature (607)..(607): n is a, c, g, or t
  misc_feature (616)..(616): n is a, c, g, or t
  Predicted polypeptide sequence is orthologous to G1335
gctttccaaaacatgtatgtggacatgtacagagagtattcattgacgcaccaacaaaactacaactccccattacaaaaagcatgatactactaactatcaaccagtacaaaataagataaaacaagcaaacactagagataatccagactaacagtaacaataagtaccgtaaacataacaacttgaaaatagcaaaatacaaaaacacagagatcacgatcaatgaccgccgcttgtgcactcgcgggcgaaatgaccttcttctccacacttgtagcagccaccgccaccaccacctccaccgccgccggagtacctacctcctccgcctccaccaccagaatacctgcttccaccgcctccgccactgccgccatcctgtggacactctctagcgaaatgtccagattctccacacttgaagcagccgccgccgccgctacctccaccaccgcctccgtaaccacctccaccngctccgtagccaccaccgnctcctccataacctcggctaccacctccgtagccactgtcaccacctccataaccacggctacctcctcggcctccaccgtagccacctccatcacgacctcctcctccnactccaccngtacgagagcctcctttaacagacgctccatcaggtccagtaacgtcacaagctttagccctgccatctgaaccagactcaatctgatactcaactcctcacttcagctaagctacggaaccttcagatctgatgcctgactgatgaacaaaacagatcttcagaaggcatcggagggagtgatgaacccaaaactttctggtcactaaaccacttgacgattccccgtagccttcttaaaatctcatacgcattt

SEQ ID NO: 8999 - DNA, 530 bp, Solanum tuberosum
  Predicted polypeptide sequence is orthologous to G1335
tgctcttcttatggaccaagagtatcaaagaagtctagtgaattctagttcaattaacttaggacctaggcaattgaaggcacagtcatgtacagtaataggaattcaaactctcacactggttcaagcacattcaaaggaggaggttctggtaatatctcaggtgcaagtggaagttacaacagtagtggtgcaagctcatctggtagttacaagaataagaggtgtttgttgcaatgtgatcattgtggttgcaagggtcactctaaggaacaatgctacaaaattgttggatatccaactgattttaaggcaaagaggaaaggccagaccactggagcttatgctaatcaggttgatacacctctctgttgacactcaattttggccctccacgatatgaattaatcatcgagtttcttaaattccaaacgatttgaaataattagttcttataaagttcaaagtattttttttaagttactttaaattaattttatcatttttataatttttaagtaaaaaaaaaa

SEQ ID NO: 9000 - DNA, 980 bp, Solanum tuberosum
  Predicted polypeptide sequence is orthologous to G1335
ccaaagggaacacatactaagggtttttagggtttctgtttgtgaggtgaaaaaatggcggatgagggagaacaaaggtgccagggaatcgtcaagtggttcagtaacgagaagtgctttgggttcataactcctaaagatggttctagcgatctctttgttcaccagtccggaatcagatctgagggtttccgtagcctgtctgatggtgaggaagtagagtacgtgattgagtccggcaatgatggccgtagcaaggctgttgatgtcaccggtcctgatggagcaccggtctctggaggatctggcggcggcggaggtggccgagatggtggttatggtggtagccgaggtggaagccgtggatacggtgatggagacagttggctacggtggaggcggtggctatggaggaggaggcggtggttacggcggtggaagaggtggtggaggaggcggctgctatcagtgtggtgaatcaggccactttgctcgggaatgtacccagagtgaaggcggtggcggtggttggtggtcgatactccggaggtggtggccgaggaggcggagcgccggggcggtggtggtggtggacggaggtggtggttgctacaaatgtggagaggacggccattttgcccgtgaatgcaccagtggtggtcagtggatcgtggctttgtagccctgctatggtttatccgtttacggttctgtttttagggtaccctatcttggtatgttggttgcgggagtgctataattggggtttttaaatattccttggctcctttatgtaggttccaattttacatttttgaaggctttaaaggtatgtggggaaggtccttaatatttggccgaatgatgcaaatgtgattactcctcttgttaccaagttaacacacataacattggcgttccgaggcacatattcaatttataagcccgatggtaaatttctctcctttagagaaaaaaaa

SEQ ID NO: 9001 - DNA, 890 bp, Solanum tuberosum
  Predicted polypeptide sequence is orthologous to G1335
tttttttttttaaaccgtaggcacgtaaagtttttatcttaaaaggtcgaaaccacaaagaaagattacctaaaagaactcaaaaaaagaaagacgaaaagagatgataatgcaagactaatttacaaggaaagagcaacgaaatgtcactcctcaaaacaaggacgacaagacttgtagtgcactctcgtccaggaacagtgacgcataatttaagccccatgcgaccactgtacagagaggcaaaacgcaagccctcaagaagctctcaaaagcagaacatgagccgtgatgagccactaagagaagacatctaaacctgtacaggacaactttatgcgctcaaaaaggttcatcaaaaaccaccgacgtgttgccttggagtattcccgtatcttcctgatgtcatgttattggtagcaggtgcattgcttacacctgggcaatctcttgcccaatgtccatactgatggcatttataacactcaccaccaccaccactgctcatccctgaagttgccctattgccaaaaccacctccatatgcctggctctgaccactcatcatgcttggacagtttgaagcactatgacctgttccaccacaactattacagctcatatacatgcctgtaaagagccagtcggagcatttttgtgttccagtaggctgatttccatatggaccttgccgatttccctgcagtccactttctctgttgacactgcctgcagtagagccagggcggagcgaactgtgaggcagtaagctgattcccatattggacctttgccgatttccgtgcagtccactaatctctgctgaataaccggtattggttgccaccattaaatttgcaacaggggctcattgggttctttgcgtttaa

SEQ ID NO: 9002 - DNA, 303 bp, Solanum tuberosum
  Predicted polypeptide sequence is orthologous to G1341
aaaattgatttttttttttattttactaaaaaataaacataaagagggtgaatagaacaaaccctttgaccagatcaacaagctgtggatagagctctgactcccttaatttgatgatttcagctgatgtagtttcaatagcttgggcagcaaccatcatttgtgattccaacttttctacttctttcttggctttctctgttttcacataatcagccctcttcatctctagtttcctagcatgacctccccttttctcatgctccaactttaatgcctcagcatgcttgacctcaagataga

SEQ ID NO: 9003 - DNA, 488 bp, Solanum tuberosum
  Predicted polypeptide sequence is orthologous to G1341
aaaagaggtcagatcaaagctcaaatttttgagagcttagtcgaaaccgtaacctctttgttttcccctaaaatactattaggggaaacttccggcggcggtggagatgaatctgacggtaattctaccgtcaccacttcggtgggctccatcagtcctccaccgccgccgccgccgccaacggcatgaataagttcagacgaacttattcatggcttgaagtttgttcaaatttgtgtgaatttgtgatcgccttttttaatcagatgtaagataaaagaagaaaaaaagaggcaattagtgtttgcttgatttttaatttggagttgtgagattctgtaatttttaaagtcagatctgaacttctgtataattattgttatgtgtggatttactctttttgagttgtaattctctctaattatgtaataatctcctacgttttagatggagaaaacaaaaaaaaaacaaacaaaaaaaaaaaaaaa

SEQ ID NO: 9004 - DNA, 929 bp, Solanum tuberosum
  misc_feature (834)..(834): n is a, c, g, or t
  Predicted polypeptide sequence is orthologous to G1361
ctttttcttcctcttctcttttcttttctctctttgtactggtttcaacacagcagcacaaaaacagtactccattttcatctaaacagaagagaattagaaactacaaaaaaaaaaaatcaatcaaattaaattagggatcgatgttagtagaaatatggcatggtgcagtcaatcaacagttctcccaataatatcatcatcagatcaggaaaataatgttattatgatcaattcaaaaactagattcataacttgtccttcatgtggacacaacatacagcttcaacatcagaggggaatactacatgatttgcctagtctaccagctggagtgaagtttgatccatcagatggagagatacttgaacatttagaagcaaaagtcctttcagatacccataaaattcatccccttattgatgatttcattttgaccattgatggacaaaatggtatttgctacactcatccacagaaattaccaggagtgagcaaggatggtcaagtgcgtcatttctttcatcgtccatcaaaagcatacacgacggggactagaaaacgtcgaaaggtacacactgaaattgatggtggtgaaacaagatggcacaagacaggtaaaacaaggccagtttacataagtggagttctcaaaggttacaacgaaaattttggtactttatacaaattatggtaggcaaagaaagcctgagaaaacaaattgcgtaatgcaccaatatcacttaggtgaaaatgaacgaagaaaaagatggagattagttgtttcaaaagtttctaccaaaaaaacctagacttgtggatcattacacatanaaaaaccacttggatcacagcaacaatattattattaaccctgttctttaaaacaacgaatttcggcgaatattataatcctgaatctttcaatt

SEQ ID NO: 9005 - DNA, 607 bp, Solanum tuberosum
  Predicted polypeptide sequence is orthologous to G1364, G481, G482, G485
ggagaagagaaagactttgaatggtgatgatatttgttgggctttgggaagtttaggttttgatgattatgttgagccattgaagaggtatttgcacaagcatagagagttagaaggtgaaagaattaatcaaagtaaaggtgttggtcttggaaataatattgaagataatcaaagggaaagagatgatgaattaacacaaaggggatctacaattccattcaaaatcaccattatggatcgtaagggggaaaacaattttctccctacaagaccttattaggcttcttcttcttcttcttcttcttcttttctctgtttaaccgttcagtatctggaatttactagtctgagtaatttggatttgctccatgtgaagttcattaaagggaagcgctatttatcaagagtttctggtccagacgaattgtcatgaaaaaaacttgggttgagttttacgtctatcttttaggcttcttcttcttctctcttttatctttgggtttaaccatcttgtgtgtgaaacatactgaccctattaatctggattctcgctgcatagggttggagaaatgtttcctctattggaaggtgtctattctttata

SEQ ID NO: 9006 - DNA, 741 bp, Solanum tuberosum
  Predicted polypeptide sequence is orthologous to G1364, G481, G482, G485
ttctattctgaagcctccaccaccacaattaccatatacttttggccgccatcgagtcagaatttaaagtttataatattctgaaacttcctctaccaccacaactaccacctattttggctcgctatcgagtcaaaatttgaagtttatatattctatctccgtccttgaccagaacctccaccaccggaaccaccaccaccacccccacccatatgattatatgacccatgactaccatacatttgatgaccaccttgaggatgatacatcattgaaccacccataccaccatacataccaccaccaccaccgttatacccacctccagaactaactccaccaccacctccggccatatctccaccacccccatctttctcccctgtacgacccatagtagttttttccccttccatttctctatacttggccaagtaaatcttcaatggctcaacatactcttcgaatcctaaagtcgtcatagcccaaagcaaatcatcaccgttaatcgtcttcctcttctctctctgacacttatccgatgcttctccggtaatgaaactgataaattccgatacacactcttgaactgtttccttagcatcctttgaaattttcgcgttcgccggtaaagctttcttcattattctgctcacgttagctatcggaaggaacctgtcttgctcccttggtgatccttcactgttcgcgttggtgtgacctcctgattcgttgtct

SEQ ID NO: 9007 - DNA, 916 bp, Solanum tuberosum
  Predicted polypeptide sequence is orthologous to G1364, G481, G482, G485
ctccaacatactgtttgttattagtttcataaaaaaaatccaattaccttagaaatttatctccatttttttgttcttaaagcttgtgtgtactgtcataggcagatcaagatagggacaagactgcgtacacaccactctcgtagaattgcatttagtatgttattgtttgtcagactatttttcatataacagagtaaggttgtgtatacattaggctctccaaatccacttgtgagattattcagggtaagttgttgttcttgtagttctccacaaagtattatctgagcaaagggtatatcgaaaaaagtctctctatcttcacaagatagtggttttatatttgatcaccaagatttaaggatttcgatggcggattcggacaatgaatcaggaggacacagagagaacagcaacattgagagttcactaagagaacaagacaggttccttccaatagcaaatgtaagcagaataatgaagaaagctttaccagctaacgcgaaaatctcaaaagatgctaaggaggtagttcaagaatgtgtttctgaattcatcagttttatcacaggggaagcatcagataagtgtcaaagagaaaagagaaagacaatcaatggtgatgatttgttgtgggcaatgacaactcttggttttgaagaatacattgagccactcaagatttatttgcagagatttagggatttagaagggcaaaaaagtggtgtttctggagagaaagataatggtggatcagtgaatataggtggttatgttgaggactatcatggcatgatgatgatggggaatcaacatcatcaaagacacgggtatggtaccggagtatataatcatcagacgggggagaatgctgcaggggttggtacaggagggtcgcgatttcctgatggtg

SEQ ID NO: 9008 - DNA, 924 bp, Solanum tuberosum
  Predicted polypeptide sequence is orthologous to G1364, G481, G482, G485
caaaatccaaaactctgcctcatctcagtcgtctccctttctcccttcttctccaacgtccgatcttccagttccctccatccccaggtatggcggatggtcaaggttcgtctaggtcaccggcgagtccgaacggaggtggtagtcatgagagtggtggggaccagagtccgaggtctaacgtacgtgaacaggacaggtttttaccgatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaagaaagactattaatggtgacgatttgctatgggcaatggcaactcttgggtttgaagattatattgaaccactcaaggtgtatcttgctcgatacagagagatggagggtgacacaaagggaacgtcaaaggctgctgatggctctactaaaagagatgggatgcaacatggtcctaattcacagcttgcacatcaaggttcatactcacaaggaatgaattatgggaactctcagggtcagcatatgatggtcccgatgcaagggacagagtaaaaatccgatcttcgttctgtttgagaagacggtggacttaaaaacatattctatatatagatcttctgctgtaacctctgttatcatgggtttatttattctaggtgctctctagtgaggtgccatggtcatattttaaaacgtttgtaaaatttaggagattgtttcacgaaattattatgggaccatggattgtttggtagtaataattgcaacggggcgggccgggtaaccccaattcggcctattaggtggaggtcgtattaaggcgcggctccactgggccggccgt

SEQ ID NO: 9009 - DNA, 830 bp, Solanum tuberosum
  Predicted polypeptide sequence is orthologous to G1364, G481, G482, G485
ggacagataccttccgatagcgaacatcggtcgtatcatgaaaaaaggattgcctgctaatgctaagatagctaaggaagctaaagatactgttcaggaatgtgtttctgagttcatcagcttcatcactagcgaggcaagtgacaagtgtcaaaaagagaagagaaagacaattaatggagatgatttggtatggtctttgaccaccttaggatttgaggactacattgagccactaaaggcctatttgattaggtacagagagatggaggtatgcattgcttccccgcatcaatgatatagagttgctttttgtctttacctctgatatgtcactagctatgccttggggattgtttctaatgtcagggagacaccaagggatcttctagggctggagatacgtctgctagaaacgatatagttggaggtcagctcagtccaactacacagtttgtctatgatgggtctttttcccaaggcttcgactatgggaactcccaaatgtgaatttctaaaattacaacggtgctgatgcgagtatcttctgccttccgttcatgttgatctatgtactaagccattcaatggttgctgataatatatgtttgaaagctctaggaaccgaaagtatgctgcaaatcttgaatttagccatacaacaaaacactttattttctgaacttctcttccagtactttgatgctctgtacatgtaacatgtgaattggattttattgttgtaaactgagagcaatcttctttttctgcaaaacttggtaagttctataggtgagtgaccttaactttctgtatgaagttggttttaa

SEQ ID NO: 9010 - DNA, 338 bp, Solanum tuberosum
  Predicted polypeptide sequence is orthologous to G1364, G481, G482, G485
cacgaacataaaacacaaacaaattaaagatcaacacaaaataagacaaaagtgtagaggagcccttttttgtttgtttgtttgtttggtactgttgatgcctgtgttgggctccaaatttacaactctgtttctatagagaagaaatttggggattgggcttccgaccatggcccattaagcgcaaagctcacgacttgtttgcctccaagcccacatgaggaatcaatgtactcaaggcccaaattagatcgtcacctccaacattcataaaatattctttttctaaatagatatctcacagagtttattacaagtaaaaaaaaaaaaaaaaaaaa

SEQ ID NO: 9011 - DNA, 1072 bp, Solanum tuberosum
  misc_feature (748)..(748): n is a, c, g, or t
  Predicted polypeptide sequence is orthologous to G1364, G481, G482, G485
ctgccgttggatctatgtgtatagcgcagaaaagctcagcatccattttccgccaaattcctttctcaagcaaaaactaacaaaatattctcttggatcaacctctacctacgatcatccataaagttagggttccggtacactgagaatggcggagccggcaagtccaggaggcggcggcggaagccatgagagtggcggtgacccgagtcctcagtccaacttgcgagaacaggataggtacctaccgatcgctaatattggacgcataatgaaaaaggcattgcctgctaatggaaagatcgcaaaggattctaaggacactgttcaggaatgtgtatctgagttcatcagttttattactagcgaagctagtgacaagtgtcagaaagagaagagaaagacgatcaacgggagatgattatactattcagccctgggctacccttgggattttgaggaactacatttgaacccacttgaaagggtctaattttgaactcgaataacagaggagatggacgggaagatgcccaaagggaatcttggcaaggggtttgggtgaattgcatccttggttagcacaaaagacgtgtagttgggaaacgtcaaggtttgggggtccaaataacgcaaggtccaatggttattggaagggttgcctctttggccccaaagggttttaggaccttattggaaacttccccaagttattggattatttcacgaattggaaccaaaggaactntttgggatttgctttacgcaaaaagaaaggggttgtgattaacgtttgcaaacagagtggttaagagcccttttggctgggtacacaagaatgtgcaggacaaggggtgtctcctttctatggacggaacccccggggtgtgaacacgtgggtctaagcagcgccaagtggttatgaggggacctattaaacaccgctataagagggagctccccttacgtaagatttttgtggcgcagaaaaatatttttcgggttgggcgagataaccttggagtttaaaaatctctctttcccgggcctggtaaaaacccgaggggggttt

SEQ ID NO: 9012 - DNA, 864 bp, Solanum tuberosum
  Predicted polypeptide sequence is orthologous to G1364, G481, G482, G485
tcattcattacatccgaaagatacataatcagcaaacctataaattcaactacaatacttaacacatactaatttataaaagcaataaaatatgttaatttaaaaagaaaaaaagaaaagaaaaataaacataacctaaaaataaggtgtatgcaatatgttgagaaaacaaagtacataatatttttttcaaaaataaaataaaaataaactaccattcaaccccatgaagattagctttagatgtcaaattctcaccataattttgtgaaaaattcccattattatagctctgaataaattcaggccttgctaatgagaattttggtaaccattattattatcattataactagtacccaataatattatttgtactagttataattggttcatgtgaagtttcatcatttctagccatgatattttttttccccttcactttctctatacttatttagataaccttttaagggtccaacataattttcaaaccctaatgttgtcatagcccataaaaggtcatctccattgatggtcttcctcttctctctttgacatttatccgatgcttcgcccgtgatgaagctaatgaactcagacacacattcttgaacggtttctttggcttctttggagattttcgcgttggctgggagagatttcttcatgattctactaacattagctatagggaggaacttgtctagttctttagagaagttatcggatgtgttgcccgataacgggctttcaaccgggctagttagggttttttttccgtcatgatgataatgataatgatgatgaacgtcgaaagaaattaaagaggagatgtgtaaggggttttgtttggtttgggga

SEQ ID NO: 9013 - DNA, 452 bp, Solanum tuberosum
  Predicted polypeptide sequence is orthologous to G137, G145
ggcaggaacatgcattgacgagcacagaacctgaacatttgtgatggaggagcaataatctgcatggcagccaaatgcacagatgtgggctacgggcgcaaacaatcaaaatcagggcgatggtttctttcatcctttggattgtgaacctactttgcaaattgggtatcagaatgatccaataacagtaggatcggcaggtccgatgtgaataactacatggtggtggttgccttgaaagctcatgattctgatcataacattattattattataaatatgctcaatggttttcctatcatcataaaccattgaatctctcctaattaatttctgtatgttgtttgagaaagcgcttcatcctggactaaacggaggaatccataagacaatcccattattgttagtaaatcataaactagacttccttgaagaaagaaaaaaaaaaaaaa

SEQ ID NO: 9014 - DNA, 499 bp, Solanum tuberosum
  Predicted polypeptide sequence is orthologous to G137, G145
tagtggatcccgcgctgcagtctttcatatggcaggaacatgcattgaacgaagccaacagaaccctgaaacaaaggttgatggaaggaagccaactaaatctgcagtggcagccaaatgcacaagatgtgggctacggccggcaaacaactcaaaatcagggcgatggcttctttcatcctttggattgtgaacctactttgcaaattgggtatcagaatgatccaataacagtaggaggagcaggtccgagtgtgaataactacatggctggctggttgccttgaaagctcatgattctgatcataacattattattattataaatatgctcaatggttttcctatcatcataaacattgaatctctcctaattaatttctgtatgttgtttgagaaagcgcttcatcctggactaaacggaggaatccataagacaatcccattattgttagtaaatcataaactagacttccttgaaaaaaaaaaaaaaaaaaaa

SEQ ID NO: 9015 - DNA, 851 bp, Solanum tuberosum
  Predicted polypeptide sequence is orthologous to G1382
aaacaacacattcaggatgtatatcaattgaaaattacagaaaatacattagccaagtgcactcatcataattacagaaaatatgatacattgaaaagttcatcataattcctagaaaatgtcattgatctgtattcatgggagaaagatattggaggtcgacatttgctccgtcatccatttcctaatatactctaggtatatgtacacaaagaacactaggtgaagatgttttatacagcataacgcgacgagtcctagaagtatttatacttcaactagagatatctttgtaatccaccaagatgcaggaaaaaatatagatggtggcttcttattgttacgctcttatacttgatggtagagactattcaagggccaagaagtatctttccatagttttggagagactgagtagaaggttgtaaaggcaaagtttcgaaactaggtccctgaacacgattatctatagctccaaatcggctcatgccactatgtacaataccatagcgcgctgcaactgcagctggctgtactagcatcataccagaacgtgaaacttgaacttggtgatggagggtgtgaagttgcccgttgttcccattatccagacgatatccagtaccaacgcctagatccagactaagtgagttggtctctcctgccctgatccttgaactgccggttacaggtgaggatcccgtcatttcatggttattattttttgcagcaggtacatcgtggttatgttttccttcatatgtggtgataacagctttgggatcatgagaagccctctccacgtgtttcctgacagggcatccagcactggtgcacttgtaatagctcct

SEQ ID NO: 9016 - DNA, 836 bp, Solanum tuberosum
  Predicted polypeptide sequence is orthologous to G1382
ctgaatcgtcaatggaagactctcactctcagcagcagcagctgcactctacttccgagcaacaactcagagatggaacaacctcctccggcggtttccgtcacaacgccgccggatcgaacggcggtgctaagtacaagctcatgactcctgctatgcttccgatctctaggtccgcctgtatcaccatacctcccggtctcagtccttcctccttcctcgaatctcctgttctcctttctaacatcaaagctgagccatctccgactacaggttccttctccaaatttcaaacagtgcaaggctctggtggggctgctgcattcttattgacaagaggttatgctagtggcaatacatacattgaaagaaaagcaagctgctttgagtacaaatatgccggtggatctagttctgcatcaggatcattagcaactgaacatgtgatttctacaggtctcaaccaacaacaaaatgagccactgaaagaagttcaagatcaaagtcatcctcaattgttagtaccttcatctctagctaaacacgagatggaaacatcaaaagaactgagtttatctgcacctattaatgttgatgcttcaacaaaagaagagagtctatatgaacctattaacgttgatgccatgaatccgagagatcaatctagtgcaagcatgcaaagtatcacatgctgatcataaagatgcgtcatcagtaacatctgatagatcatcagatgatgggtataactgggcgaaagtatggccagaaacttgttaaagaagtgaatattcgagaagctattacaattgtcctttcccaactgtgaatgaaaa

SEQ ID NO: 9017 - DNA, 466 bp, Solanum tuberosum
  misc_feature (31)..(31): n is a, c, g, or t
  Predicted polypeptide sequence is orthologous to G140
agtgatcccccggcctgaggtgatgccaggnagtcatcaagctatcatgagcttgtgcctccactcagcaattcgatactcgaaactatctacaagttaatggatttcaaaccaacaaccattaccctagacaagaccaaccccctattcaactagtctaatgtgcttgagagatggtcttctttctgatgtgatctacatataatccacaaaagaagactactattaagcttgaagattattggaactgaagatgatcaacttaagtatgtataccatattatattaattacttgttgcatgagctaagactcttgaatattgtatgttcattaagtggacatgtatttatttgcttggtgtacttccttttcaggcagtaaactatgaagaattatgcttgtcatattaagttcataactgtttttctgtccaaaaaaaaaaaaaaccacacacacacaaacac

SEQ ID NO: 9018 - DNA, 447 bp, Solanum tuberosum
  Predicted polypeptide sequence is orthologous to G140
gagcaaatgaacttgatgcctggaggcggcggaggtggaggaggaggatctgatcaataccatcatcagccaaattatgaagatgctcgcaataacttcctgcctgtaaatctcctggaaccaaatccccattactctcgtcgcgacgatggtgaccaaactcctctccagcttgtctgataatcatggagcaggttttctgaaatttggggtcgaagctcttccttcatcttcagaaatgtgtactacaatttttaacctatagtgttgtaaatcataatcataattattgccactgagatttaaactgtttattttcaagcaatattagtcagtattctgttaattaaggaatgaaaaatcttgtttgttatattatgactacttctatatacttttacaggcttctataaataaaaaaactattgaactaaaaaaaaaaaaaag

SEQ ID NO: 9019 - DNA, 853 bp, Solanum tuberosum
  misc_feature (342)..(342): n is a, c, g, or t
  Predicted polypeptide sequence is orthologous to G140, G146
ggaaaaagaacaatactccaaaaaagtccattaaattatctatcattcgaagaatgggagagggaaagtggaattgaagagaatagagaatcaaacaaacaggcaagttaccttctccaagagaagaaatggtttacttaaaaaagcttatgaactctctattctatgtgatgctgaagttgcccttcttcttttctctccttccggcaaaccttaccatttcgcgagtcatgacatcgaaaggactattttaaggtacaagaatgaagttggattgtcccaaaatagcgaccaaggcctcagagctatggaggtttggagaacaaagattgatgacatgancagaacaatagatgaacttgaagccagaaataagcatttggctggagaggagttatcaagtcttggcatgaaagaattgaagcaattggagcgtcaactcagaattggggttgaacgcattcgatctaaaaagcataaaatccttcatgaggagaacatccatcttcaaaagcaaataatgttgtctgaaatagaagggagttcaaggattcttgattcagatgcaagtgagttactttctaagggacaaagaataatatatgatttatagatcttcaatcatatggtcgtgtaaagagcctaccttaagtgaacgtatacttagtatatattataaaatagtgtgtacggtatatttaaagatgataatcctttcgtgtggtctgaatgtacttatttattgtctagaaatttttattccaagtcaatgttgaatttaagacaaggacacacaaaaatgtactatgttgatattataactttgaatttagcaacaaaaaagaaaaaaact

SEQ ID NO: 9020 - DNA, 907 bp, Solanum tuberosum
  Predicted polypeptide sequence is orthologous to G140, G146
ttttttttttttaaaaacaacatacttattatggttttattattgatatttaaatgggcattggttgtgtttcatctgttgagtttaagttctgaaacagaacaaaaattagttacagacatctctataacacagtgcattagaaaaagcagttggaagaactactgagcaccgactcctatcgatgaactcaacgaggagccattaaactaatttcaatagtttccagtactgctagttctatcaacaaagaataattgcaaaaattgataaaaatagaaagaaaaaaaaatatgcccttttctttattgtcttttttagggtttttgatcctttgaaccaattttgtttttcttctatatatcatctagatctgaaaactcaaaaaccaatattttcttgatttttcacttgtagaatcttgatttttttttttcaatttgtaacaaaaaatacacaatggtgagaggaaaaactgagttgaacaagaattgaaaatgcaacaagtagacaagtgaccttctcaaaaagaagaagtgggcttctaaaaaaagcatttgagctttcagttttatgtgatgctgaagttgctcttatgtattttctccaaaaggaaagctttatgagttctcaagttccagtacaaacaagacaatagaacgctattcagaagactgacaagagccctgggaagactccaacaggaaatttaacttgatcaattaaccacttgagcatttcgacaggcaggaaggttgccacacattgaactagaaaagcttgaatttcttggaagaactcctagaagaaaagtttttaagggacatgggtcctaaattccttcccactttgggattgaactcttcaccgggtttcgaacgacccgtgggaacacaaagtttaagca

SEQ ID NO: 9021 - DNA, 970 bp, Solanum tuberosum
  Predicted polypeptide sequence is orthologous to G1419, G43
cattcctcttcaattccattttaaaattctaaaagaatgggttctccacaagagacttgtacttcacttgatttgattaggcaacatcttcttgatgattttgctttcatggaaaactattcccaaagttgtggtgaatctgtggacaagagttgtttctcttttgaaacaactcaaagttcaaatcttgatgatatatcaagcttctttagtgctagttcaaaaacagagtatgatggttttttcgaatttaaggcaaaaccacatgttatgagctcgaaacagagtaacttcaaagaacgcaagccatctctgaacgttgcgatacccgcgaaacctgttgtggtacagaaagtggaagttgagagtgaaaagaagcattacaggggagttaggcagaggccttggggaaagtttgcagcggagattcgtgacccaaatagaaaggggactcgggtttggttaggaaccttcgacactgcggtggatgcggccaaggcatatgacagggcggcgtttaagcttagaggcagtaaagcaatactgaatttcccacttgaagttgctaactttaagcaacaaaatcatgatgatgagattaaaacatcagggagtaaaagggtgagagaaacagagcaattagttatcaacaaggaaaggaaaatagaagaagaaagaatagtcccaacagctgcagctccattaacaccgtcaagttggtcgacgatttgggatgaaaaaggtatctttgaggtgccgccactgtcaccattgtctcagcttgtaatgatataatttgggattatatataagtatttgataaatatgcacctgactataaactaagtctgaggtgaattaggattagaatgatgtgtctttggatcttcaatattttgtaatttcattgattaagcgttatttaatgtaaatacgcaatcaatctaaaatttgttcattttataatatg

SEQ ID NO: 9022 - DNA, 975 bp, Solanum tuberosum
  Predicted polypeptide sequence is orthologous to G1419, G43
gcttcgtttctccacctgagaaggctggtatgaaacctcatctcttcatttcttctctttataacccatcctctacacactctcttttccactcaattttctcttcaactttgaatttgaacataaatagttgacattaattactttctccaacagaaattattttctttgtctgattagaagaagaaaaatgggttcatcaccacaaggaacttgtagctcacttgattccattagggaacatcttcttgatgatgatgttgctttcatggaatattactgctccaacacttgtttctcttttgaaactactcaaacctcaaaaacagattttgatggttttttcgaaattgaggcaaaaccacatgttatcagctcaaattctccgaagcagagtaacttcaaagaacgcaagccatctctgaacgttgcaatacccgcgaaggctgttgttgtagagaaagtggaagttgagagcgagaagaagcattacaggggagttaggcagaggccatgggggaagtttgcagcggagattcgtgacccgaatagaaaggggactcgggtttggttaggaacatttgatactgctgtggatgcggccaaggcatatgacagagcagcgtttaagcttagaggcagcaaagcaatattgaatttcccacttgaagttgctaactttaagcaactccaaaatgatgatgttgagattccacagccggtgagcaataataataaaaggttgagagaaacagaggaattagtaatgaagaaggaagtgaaaatagaagaggaaagagacgttgttactgcgtcaccattaacaccgtcgaattggtcggctatttgggagggtggagatggaaaaggcatttttgaggtgccgccactgtctccacatatggttcccagcttctgatgatcggaaatcgaactactccacaatagtaatttaaattgaaattgtcagtcagt

SEQ ID NO: 9023 - DNA, 907 bp, Solanum tuberosum
  Predicted polypeptide sequence is orthologous to G1419, G43
gatcttctaactttgaatttaaacataaatagttgacattaattactttctccaacagaaattattttctttgtttgattagaagaagaaaaatgggttctccacaagagacttgtacctcacttgattctattagggaacatcttcttgatgatgatgttgctttcatggaatattactgctctaacacttgtttctcttttgaaactactcaaacctcaaaaacagagtttgatggtttttacgaaattgaggcaaaaccacatgttatgagctcaaattctccgaagcagagtaacttcaaagaacgcaagccatctctgaacgttgcaatacccgcgaaggctgttgttgtagagaaagtggaagttgagagtgagaagaagcattacaggggagttagacgaaggccatgggggaagtttgcggcggagattcgtgacccgaatagaaaggggactcgggtttggttaggaacatttgatacagctgtggatgcggcgaaggcatatgacagggcagcgtttaagcttagaggcagcaaagcaatattgaatttcccacttgaagttgcaaactttaagcaactccaaaatgatgatgatgttgagattaaaacagagatgaagtcatcaggcagtaaaagggtgagagaaacagaggaattagtaatgaagaaggaagtgaaaatagaagaggaaagagacgttgttactgcgtcaccattaacaccgtcgaattggtcggctatttgggagggtggagatggaaaaggcatttttgaggtgccgccactgtctccacatatggttcccagcttctgatgatcggaaatcgaactactccacaatagtaatttaatttgaaatgtcagtattgggtagatgaaggataaatatatggcacc

SEQ ID NO: 9024 - DNA, 868 bp, Solanum tuberosum
  misc_feature (734)..(734): n is a, c, g, or t
  Predicted polypeptide sequence is orthologous to G1419, G43
ccaacaaaatctcatttttttcaaattctactttttaaaaatggattcttcttcactagatatgataaggcgacatcttcttgatgatgttgttttcatggaaaattattgttcctcttcttcatcatcagaaacaagtagtaccctttattctcaaacctcattgaattcggaatctttagaatcattaacctctgagatcaaacttgaaagcaatttctctttttatcctgatttcatcaatacagctcaaagtttaaatcttgaatctgcctctcgtttgttcgataactcaacaattgaattccaagctaaaccccaaaagaaaagaagtttcaatgatcgaaaaccttcgttaaacatttcaattccttctgtcaagaaaacagaggaaccaaaaacaggggaagtaaaaacagagtactctgttcagaaaatggtggaaaattcggagaaaaagcgatacagaggagtgagacaaaggccatgggggaaatttgcagcggagattcgtgatccaactagaaaggggacacgggtttggttaggaacattcggtactgcaatcgatgcagctttggcatatgacagagcagcatttaggctcagagggagtaaaagcaatcatgaatttcccacttgaagtaacgcaatttcaaaggcaagaaaatcctgagatttgacgaaacaatgtaggtaagtttgaattttgacatacgaaattctttgctggngcaaaaacggggttaacacgacggacaaacattggcgcacatgaattgacccgaagtttggtggtcgaaacaaaacgaagttgaaacacaagaaccaacattgtcgtagcaacttcccatttaacacaccttca

SEQ ID NO: 9025 - DNA, 1007 bp, Solanum tuberosum
  Predicted polypeptide sequence is orthologous to G1419, G43
attcatctttcttctttcagtttagtctatactttttcctatacttgtcgatctcgatggaatatgttgatgaatttttagctttagagaaaatcagaactcatcttctcggagaatttcaccgaaaactttgaaatttggggcggaattaacgagtagtaagtgtactgatactgtgatggagagttgtaattctgaatctgctagttctgattctcttccatttgattttttcttcgatattgaagctgatttatttcaatttggagctggagtttctaattctagctccgaatcagctaattcggtgcataatcgaacagattttgttaaaattgaatcggagccgtcgatttcgagctctgattatgaggagaatcagagcaaatgctttcagtttaaatcggaacctcaagtattcatcgatcttacttctccgaaatcgagtagcgttagtgatcggaaaccttcactgaaaattgatttacctccggtgaagaaatatgaatggatcgattttggtaattcggctcactcgaatccgattgtttcggttcccgtgaaacagataaggaaagctgaagagaagaggaattacagaggagtgcgacagcggccatggggaaagtatgcggcggagatccgagatccgagacgccgtggttctagagtttggcttggaacatttgatacagcaattgaagcggcgaaggcttatgataaagctgcatttacgatgcgaggaagtaaagcgatactgaattttcccttggaggtagggaagactctgtcgtatcaagctccgccgttggaagcggcgtgaagcggggagagatcggggaacctgaaaaagaagtttgaaaatgtaggaaggattggcattaagcgccagttgaattcgtttgacccatgtacggaaggttactcctcatatacctttctcactgtgtcggtatcatatgaggtttatgatattcttgttttttttattatttccaaaaaaaaag

SEQ ID NO: 9026 - DNA, 1130 bp, Solanum tuberosum
  Predicted polypeptide sequence is orthologous to G1419, G43
tttttttttttttttttggttggaaaaacaaactctattaattataatgtaatggagtttaatacatcacttaaagaggattaagtaagtaattaacatactttcatgcaaattacaaattaatcatctccaccaattccatcttgttctctcttctccttttccggccaatattcgccggagcaccagattttccggcatccaacggaaaattcagaatagcttttcttcctctcatcttaaagctgcacaatcataagctctagcagcatccatatcagtatcaaaagtacccaacaaatcctcgatccttttctacttggatctcttatctccgccgcaaatttcccccatggccttctccttacccctctgtaattcttcttcttattattgtcttcattagaaccggcggagctgtcggaaactggactgaggatggtatctgaatcaattttgaattcggggaaatcggagtggagattgaagtaacgggaaattggggagttgggttcatttgggtatgaggaattgggtgaatctgaaagggaattggatgtagatggctctgttttttactgaagtgaaaacaggggagatgtcggaggaggaggagattttgatcggaaaaacaagaattgagactgttgatgaatgattctgtagtgtgacatcttcgaggagatgttgtcatgatcctatgtgtaacctcctcttgtgtccgtcatatagcgagatattgcgaaaaattgcacgggaaagtgttgggtctcaagtctccaatagtcctgaacaaatttgggatgaaggtgtgtcccccggccaatacctggcacgccgggggatccataatctaaacggcgcaccgggggagcccaacctttggtccttaaggagggtaataggccgctgcggtacaagggacaagcgcccggggaaaggttccccacaaatcccaaataaaccggaactaaaggaaagcgggcggtgcaagagggacacacaccatatatgcttcccacgccgttccatggacgacgcgtagataacagcaggcggaaggtggataggccccccccaaaacgggtcgtgcagaacccaggagtcgagacgaatacagcagccagcac

SEQ ID NO: 9027 - DNA, 681 bp, Solanum tuberosum
  Predicted polypeptide sequence is orthologous to G1421, G1750, G440
gccgccctaaccccaccgtcttcgccaccgcagctgttcgccgccggtagcttttcacggcagtaaagtcttaggtaccccgagagctccccaactcttctatatgctcagatactaaagatctatgaagccacagagagagattcagaaaatcagaattactggtttgtctgagagcttttgagtttcttttcaagctatggcctccaaggatgaacataaggaaaatgaggcagtcgaggaaccctcagaaattcccagagatgaaaaatcgatcaacccagtgggtgaaagttctgttgtcttgccgcgtgttgtgcgtatttacatgccagacagtgacgccacagactcatctagtgacgaggaggaaaagcttcaaggagagaagtccaagagacatgaaaggacgtgtataaaggaaatcatcattgagaatggaaagaccagggtcatttccaagaagacgtccaaagagaagaaagatataaagctgttccaagaaaatgcgaagaagtacaaaggagttagacaacggagatggggcaaatgggcagcagagatccgagacacaaaaaacaaaactcgactttggctgggcacttttgacactgctgaagaagctgctttggcttatgattaggcagccattgaaaatcagagcatgacctctaggggaga

SEQ ID NO: 9028 - DNA, 976 bp, Solanum tuberosum
  Predicted polypeptide sequence is orthologous to G1421, G1750, G440
tgtctctctaaaatccccacactcatgtttctctctcttaataatcagcatctcactgtttttcaccattcaaaaaggactaaaaacatcatcaccttattcaaccatttggattcattactgttttttttctctcttataaactctttggtacttactctattttgtagttcgatttctttttttaatcgtctcaggctttgttgttctccgtgtgtgggactgactgtgggtgtgtttctccttttataatctcatcttttaatgttttgggtcttttttttgtcagtgaatcatcgtgttttaagcttctctttgacggttccattgctcgttctcatcttttaagagtgctacttttagtggtgtcactctcaaaagcacctttcttggctcttttttctccattctttctaatcggtttggcttagcagtgaaaaatagctaattcaggtttattcgatggatcatcatttgttgtgtccgatcaaatacaccgagcaccggaatgttatcaggaaagttactaaaccatctttggtgaaatcaaaaaaattcccagaagccacaaaatcctctcagttcaatccctctgttccgaggactgttcggatttctgtgacagacccagacgcaacggattcttctagtgatgaagaagacatgctttttggacggcgacgggtgaaaaaatacatcaatgaaatcagtattgaaaccgccgtcaagtgtgaagttagcattcctaacagtggcaatggcaaaacggtgaataaaagagcaccggagcctcttcagactaagcagaagccaatgaaagttcaacctcctcaatcggctggcgctgttaggaagttccgcggtgtgcgtcaacggccgtggggcaaatgggccgctgagatcagagacccggctcgccgtgttcggctttggttgggaactacgacactgctgaagaagctgctatggtttatga

SEQ ID NO: 9029 - DNA, 931 bp, Solanum tuberosum
  Predicted polypeptide sequence is orthologous to G1421, G1750, G440
ttttggtataccatgacggaaaattcagttccgttgattaaattcactcaacacatagtaactacaaacaagcatgttttttctgagcacagtgaaaaatccaattcagagttacagagagttgtgaggattatacttacagatgccgatgctacagattcttccgatgatgaaggccggaatactgtacggagagtgaagaggcacgtgacggagatcaacctcatgccgtctcccaaatcgatcggcgacagaaaacgaagatcggtttcgccggattctgacgtcactcgtcggaaaaagtttagaggcgttcgtcaaaggccgtggggtcgttgggcagcagagattcgggacccgacccgtggaaaacgggtgtggttgggaacttatgataccccagaagaagcagcaatcgtttacgataaagctgcagttaagctcaaaggtcctgacgccgttaccaattttccggtatcaacaacggcggaggtaacggtaacggtaacggaaactgaaacggagtctgttgccgacggtggagataaaagcgaaaacgacgtcgctttgtcacccacctcagtcctctgtaacgatgattttgcgccgtttgataatctagggttctgcgaagtggacgcttttggtttcgacgttgattcacttttccggctgccggattttgctatgacggagaaatactacggcgaagaattcggcgagtttgactttgacgattttgcccttgaagctcgatagtgtacgaggggctatttcatctatttttgcaaatgggttcacactggttagttgactggtgacgtggtatttttggcgggaatatatatagtgattagcagtctctattcatacgaagactttgtgagagatttttgtttttatttttctgttaattgtggtgaacattgta

SEQ ID NO: 9030 - DNA, 574 bp, Solanum tuberosum
  Predicted polypeptide sequence is orthologous to G1421, G1750, G440
ttttttttttttttttttttaagaacatcccagtaagttgggaactaaccaagtttaacactaatgataatgtacagcaaaatagtaaagcagtttcaaatccctggcatcatctgtgggtaaagatgatggctaaaacaagtagatctcccccttcagaagcggatgcagctttagtttaaccgttaacaggttcaaatgaacctagaattcttcacatggtacatagatgtatatgtgaaaaactactaaaagttcaacagatattaacttttgaacctcataatttcaaaggtgcaatggatccgcctatggaaggttgaaccaatcaagtttaactaacctatggatccgccttctgtctttttagtggtggcacgatgaagttgatcttgatggggttgtttttcttcgctggtggcttgaggatgtttgtcagagcattggcacctcttatttcaatggctgccttgtcatatgccaaagcagcttctaaagcagtgtcaaaagttcccaaccaaagccgagttttctttcttgtatctcgaatctctgctgcccacttgccccattt

SEQ ID NO: 9031 - DNA, 985 bp, Solanum tuberosum
  Predicted polypeptide sequence is orthologous to G1435
attcgccggatatcttctggtgaccggaataaaatttagtagttacaaaatattgttaccatgggtgaagaagtgaacctaaccgactatgaatacagcggtggtaacgatgacagacttctctgggaggttggacttcccgacgtcgatgatctcacgccgttgactctgcagttgattccctcggaactcgctgctgcgttcagaatatcgccggaattgtcaaagacgatgaccgatgtaaatcgtgcttcgcagaatacgttttcttctctccagagatggcactcacaggatatggcttcgatgaataactcatatttcaagccgtttagctatgagaggactagagaagagactgttactgaaagagatgaaacggatctgataagagagggatccgacccgaggaagctccgacgggttgaatccggaggcactgaggaggctgattcatctctgtgtaacgagaattttgcggatgattcgtctgctaagactccgaagcgacccagacttgtttggacgccgcagttacacaagcgttttattgaagtggtggcgcacttaggtatcaaaggggctgtgccgaaaacaattatgcagcttatgaatgtggaaggattgacgagagagaacgtagcaagtcatttacagaaatacagattgtatacgaagagaatgcagccgaacgagggtccttcttcgtctgatcatttgtttacttccacaccggcggcagagagtatgcgtgagtccagtgagggtggtcacctgcgcaatactaatggccacatggcagcgccaactctgatgccgtaccaaccacaaatggtgccgatgccaatgatgggaatgccaaatggaggacatgtagttatgcctgttggttacgggggtggaccgccacttgggtttcatcatcactataatatggtgcagcagcgggactggtctggaaataattttggttactgtcatcctg

SEQ ID NO: 9032 - DNA, 945 bp, Solanum tuberosum
  Predicted polypeptide sequence is orthologous to G1435
atgggtgaagaagtgaacctaaccgactatgaatacagcggtggtaacgatgacagacttctctgggaggttggacttcccgacgtcgatgatctcacgccgttgactctgcagttgattccctcggaactcgctgctgcgttcagaatatcgccggaattgtcaaagacgatgaccgatgtaaatcgtgcttcgcagaatacgttttcttctctccagagatggcactcacaggatatggcttcgatgaataactcatatttcaagccgtttagctatgagaggactagagaagagactgttactgaaagagatgaaacggatctgataagagagggatccgacccgaggaagctccgacgggttgaatccggaggcactgaggaggctgattcatctctgtgtaacgagaattttgcggatgattcgtctgctaagactccgaagcgacccagacttgtttggacgccgcagttacacaagcgttttattgaagtggtggcgcacttaggtatcaaaggggctgtgccgaaaacaattatgcagcttatgaatgtggaaggattgacgagagagaacgtagcaagtcatttacagaaatacagattgtatacgaagagaatgcagccgaacgagggtccttcttcgtctgatcatttgtttacttccacaccggcggcagagagtatgcgtgagtccagtgagggtggtcacctgcgcaatactaatggccacatggcagcgccaactctgatgccgtaccaaccacaaatggtgccgatgccaatgatgggaatgccaaatggaggacatgtagttatgcctgttggttacgggggtggaccgccacttgggtttcatcatcactataatatggtgcagcagcgggactggtctggaaataattttggttactatcatcctgttgcttctaatgataagtag

SEQ ID NO: 9033 - DNA, 705 bp, Solanum tuberosum
  Predicted polypeptide sequence is orthologous to G1451
ggagttgtgtattttcctcaagggcatagtgagcaggttgctgcctcaaccaacaaggaagtagatgctcatatccctaattatcctggtttaccgcctcaactaatttgtcagcttcacaacctgacaatgcatgcagatgttgagactgatgaagtatatgctcaaatgacattgcagccactaagtccacaagagcaaaaggacgtgtgcctgctaccagcagaacttggcatcccgagtaaacaaccaaccaactatttctgcaaaactttgacggcaagtgacaccagtactcatggtggattctctgtccctcgccgagcagcagaaaaagttttccctcctcttgattactctcagcagccaccctgtcaagagttgatagcaaaagatctccatgggaatgaatggaaattccggcatatttttcgcggacaaccgaagaggcatctattgacaaccggatggagtgtgtttgtgagtgcaaagagacttgttgcaggcgatgcagtcatctttatctggaacgaaaacaatcaattgcttttggggattcgacgtgctaatcgtcctcaaactgtcatgccttcttcagtcttgtcaagtgatagcatgcacattgggtctcctagctgcagcggctcatgcagctgcaactaatagccgctttacaatattttataatccagggcccagccatca

SEQ ID NO: 9034 - DNA, 756 bp, Solanum tuberosum
  Predicted polypeptide sequence is orthologous to G1451
actcacaaaagtttaactgcattaacaagtttacaactcaagattcttagtctaaatcacatatgtcctgagcctcagtacagtgattaagattataactaatacaaatagcattgtaatacaaatgacagatggggattaagtctttactttactacataaagaacagtgtcttagaaacgagaccggattaactaggccgagctcttggtaagcagagaattggtgaaccacacttggtttatcaaacgatgacaacaatcagtactcgagtgatcctatagatgaaagtccggacatgaaatcttgaccatcagcactattattactgctcatcctttcaggtggaccgcgatttagggatccaacctcctcccccagtttctgcacatcctcgggtgaaagaattttgatataccaaacattattgacaaattcctcccatggatcatctccaaggagaaggacatcattctccctgtcaacaaatacaagctgccagcctgatctttgagggtcttcaagaaacccttcgatcccgaacatctgtcccagttcctgtcgtagctcatgatagctattgaatcgagtgatatccaatgacctcccaagggacgctgatttgtaaaccttgacaaatgtacgggggcgcagtttgtgcatcaacttgccctacattatgcaacatgtcagaaagatcttgcacataaccatacaaagaattcggaaaatcagaagtccctagtggcttagagg

SEQ ID NO: 9035 - DNA, 804 bp, Solanum tuberosum
  Predicted polypeptide sequence is orthologous to G1451
tctattcttaattacaacaggtcgaaaaaacattgcttcagctagtaacactatttgtacagatgtctcttgaggtagttccacagaaataacaacaataaacattaaataatttacattgaaaactatctggtttacaaggttcaaatgagacttgaccccattactttataggtagaagagatacatgacaaaataacattgatagaacaaggtacaaagaattgctgatattagcagctacatggtacatttaccttagggatcacttagttgttcttgttcattagtagtttatgttgctcaaactcgtcaaaattgccaacgagtgtgtcgtatcctcctccaaaagtagtgcattttcagaggatccaacacaggtgcaataacattttgagtgtgtccaagcaacataaattagtagtcaagtgaccccaaggggattccgttcataatattacacgagtggttccggttcatgaaatcatcgcagccattgccattgctagtgatcctctgcgttttgccagcacttggtaagtcgaggccctctttgcccatctgctgcacttcaagtggagagagtatcttgatgtaccaaacactgttcacaaactcactgcagcaagacagattagttaaaaatgtgataactaaaaggtttaacaaatacgcaatagcattgacagagtaacggttcaaaaaaaatctacattggtgtgtatacagtaaaataagcatacttgaaaatgtgtaagtgggaaatatgatgatataaaacgatagagttgatatctttaagta

SEQ ID NO: 9036 - DNA, 914 bp, Solanum tuberosum
  Predicted polypeptide sequence is orthologous to G1451
ggcttttcagaaaaccacttaatatctcaggcgcagatgcttcagcagcaattgcagcgccgtcaaaattttaatgatcaacagcaattgctgcagccacagcttcagcagcaccaagaagtgaactcgcagtttcaacatcaacagcaaactaagaccatttccggtctctctcagatggcttcagccacgcatccccatctttctcatttgcaagtcctaagttcaactggttccccgcaaaccttttctgatatactgggtaaccatgtcaatgcatctagtaattctaatatgcaaagtctgttgagttcattttcccgtgatggagcatctactgtcctgaacatgcatgaaactcaccctctagtgtcttcgtcctcatcatcaaagcgaattgctctagaatctcagctcccttctcgggttactccatttgtggtgtcccagcctgaggatgtgatagcgcacaatactaaggtctcagatctttcctctttgctgccaccttttcctggcagagaatcgttttctgattatagaggagtagaagatagccaaagcaatgcactctatggatttacagactctttgaacatactgcagaccggtatgtccaacatgaagggtagtagtggtgataatggatctttatctattccttatgctacctctaccttcacaagtactgtgggcaatgagtatccccttaactcagacatgactgcttcaagttgtgtagatgaatcaggtttcttgcagtcctccgaaaatggggaccaagcaaacccaactaatagaatctttgtgaagggtcaaaaatcagggtcctttggacggtcactcgatatctccaaatttagcagctatcacgaacttcgaagtgagcttgctcgcatgtttgggctagaagg

SEQ ID NO: 9037 - DNA, 965 bp, Solanum tuberosum
  Predicted polypeptide sequence is orthologous to G1451
gctgaaacagcaagtaatgcagtttcagcagcctgtccaatatctccaacatgcaagtactgataattccattctgcaacagcaggaaacaatgcagcaagcagttcatcagcatatgctgcctgctcaaacccaaatgctgtcagagaacctgcaaaggcaatcacagcagcaatccaataatcagtcggaggaacaggctcatcaacacgtttaccaagaagcatttcaaatcccacacgatcagctccagcagaggcaaccatcaagtgtttcctctccatttttgaaagtagattttacagatttgaactcaaagttttcagcatctgttactcctttgggcgtgcaaaatatgctaggttcgttgtgttctgaaggaagtggtaattcattgaatatcaacagaactggtcagtctgtaatcgttgagcagccaccccaacagtcctggatgtcaaaatttacgcagtcacaactaaatacgtgctccaactcttcaccactcccaacatatgggaaagatagatccaattctcgggaaaattgtaacttggattcccagaatcaagtgctttttggtgctaatgttgattcttcagggcatctccttccgaccacagtgtctaatgttactactacatgtgctgatatgtccacaatgccacttggggcttcgggatatcagaattctttatatggttatgtgcaagactcttctgagttgttgcacaatgcaggacaaattgatccaccaaatgcaacccatacatttgtcaaggtttacaaatcggggtgtgttgggaggtcactggatatcgcccagttccacagctatcatgagctgcgacgggaattggggcagatgttcggtattgaggggttccttgaagaccctcaaagatcaggctggcagcttgtatttgttgacagggagaatgatatccttctccttggagacgacc

SEQ ID NO: 9038 - DNA, 625 bp, Solanum tuberosum
  Predicted polypeptide sequence is orthologous to G1451
ctatcatctgtttatgttttctcactttgcctgcaggacattctaagcggcatcttcttactactggctggagtgtgtttgttagtgccaaaaggcttgttgctggagattctgttcttttcatttggtactgtttagccaggctctattgacactactgtacatcagtcacatattattgcatgacagtttcctccaggtttttcctgatatagtcggttctgtgcaggaatgagaaaaatcagctccttctgggaattcggcgtgcaattcgaccccagactgtgatgccatcatcagttctatctagtgatagcatgcacatcggattacttgctgctgctgctcatgctgctgctactaatagctgtttcactgtcttttttaacccaaggtagtacggaacagtactccccccttgtgttttcatttatagctattaccttttttgctgttttcttctcacgtgcttcttgcgttagggctagcccatctgagtttgttataccactttcaaaatacatcaaagctgtatatcacacatgcatttctgttggaatgcgctttcggatgctatttgaaactgaagaatcaagtgttcgaagatacatgggaacaatttact

SEQ ID NO: 9039 - DNA, 1088 bp, Solanum tuberosum
  Predicted polypeptide sequence is orthologous to G1451
gcaaggaccacatctactgaatcttcagtcttttggtggcatgctcccctggatgcaacaaagagttgatccaacaatgctccgaaatgatcttaaccagcagtatcaagctatgctggctagcggtttgcaaaattttgggagcggagatctgatgaaacagcaactgatgcagtttccgcagcccgtccaatatgttcagcatgcaggcagtcttaatcctctcctgcagcagcagcaacaacaacaagcaatgcagcagacaattcatcagcatatgttgcctgcacaaactcaagataaccttcaaaggcaacaacagcaacacgttagcaatcagacagaggagcaatctcatcatcattcttaccaggaagaataccaaataccaaacagccagctccagcagaagcaaccatcaaatgttccttctccatcattctcaaagccagatatagcagatccaagctccaagttctcggcatccattgctccatcaggcatgccaacagcgctgggttctttatgttcggaaggaactagtaactttttgaatttcaatatacttggtcagcagcctgtgatcatggagcagcagcagcagcagaaatcttggatggcaaaatttgcgcattcacaattgaacacgggctccaattcaccctcactctctggatatgggaaagatacttccaattcacaggaaacatgtagtctaggatgcccagaatcagtctctttttggtgctatgttgattcttcagggcttctcctcccgacaactgtgtctaaacgtcggctactacatcaatttgatgtctgatatatccttctatggccaactagggaaacttcctgggatttcccgatattcctttggtaatgggttaatgtgccagaaattcctttcttgacatgttggaaacaatggtaggggcaaggttggatgcacaaaactggcgccccggtaacatttggttaagggtttaaaaatttcacggtcccttgggaggtcaatgggatatcacacgcaataaataatttagagatcacggaacgtggacaacatttctggatctaaggggttt

SEQ ID NO: 9040 - DNA, 907 bp, Solanum tuberosum
  Predicted polypeptide sequence is orthologous to G1451
atcaggtcgaccttggtcgggtggggtataaagagaccaaccagcacaccttctctctcttcaaaagccttatcactgatagtgatatcatgaagttgagctcagcttagattctgtcaacttattgaattgaaggaaaagggaatcatcacaatttaatggaagtattggagaaagagaaaagtagctgaaaggttttttataggattttttggttaatgcatgtggagattgtgagggagcatattcataatgtggaagaggtggtatatcttgaggataagagtgatgaattggtggaattgcttagggtttcacttggttttgagagttataattgagggctttgtgtaattgagtggataattacagggaagggtgttgttatagtactataattttcttcagatttttaagagaagtggctttaaatatatatatatgaagctttcaacttcaggaatgggtcagcaagctcatgaaggagtagagaaaaagtgtttgaactcagagctatggcatgcgtgtgctggtcctctggtgtgcctaccaacagtcggatgtcgtgttgtttactttcctcagggtcatagtgaacaggtagctgcaacaactaataaagaagttgatgcacatatacccaattacccaaatttgtcgccacagttgatctgtcaactccacaatgtcacaatgcatgcagatgttgaaacagacgaagtatatgcacaaatgactttgcagcccttgacgcagaaagaaacaaaaaggatacataatcttcctgtggagtttggatccctaacagcaggttataactaattttgtaagaaggctgacttgggagtgatactagcccggcatggggggttctctgtgcctccgcgtgggtctgcgagaaaaagtt

SEQ ID NO: 9041 - DNA, 693 bp, Solanum tuberosum
  Predicted polypeptide sequence is orthologous to G1451
tttttttgtatacttgtcaaaagtagaagtgcaataactaaattttaacacttccgagattcttagtttaaatcacgtctcatcttgtgccgtacagtgaattatactaacttgaacaacaggattacaatgaaaactacaccatacaaatgggagacgccttaagtccctattactgctagatccaaacgcaaaatacagcatacaattgggagatggaccaattagacgaaagctaaagaagccagattacgaggcatgtaatttgaatttctgaccctcgagaagattgagaatcagaattagtcctcttctttaaaacattacaacaatcagtactctagcgatcctagagatggcattccagaaataagatcttgatcatcagcactagtgctactcatcctttcaaccgctccatggttcagggattcagcctcttcctttcccagcttctgcacatcttcgggtgaaaggatttttatataccagacattattgacgaacacctcccatgggtcgtctccaaggagaaggatatcattctccctgtcaacaaatacaagctgccagcctgatctttgagggtctttaaggaacccctcaataccgaacatctgccccaattcccgtcgcagttcatgatagctgtgaaaactgagtgatatccagtgaccttcaacacaccctgat

SEQ ID NO: 9042 - DNA, 552 bp, Solanum tuberosum
  Predicted polypeptide sequence is orthologous to G1478
caaaaaattaaagatgtgtagtggaagaagagagggtgaagaagaaactacctcaatttcgtattgcaaagggccattgaaagagggagaatccataattaggtctacaatttcttgtgcgctctgtagttcagaggcctctgtttattgtgaagctgataatgcttttctttgccggaaatgcgatagatcggttcacggagctaatttcttggctcagagacatataaggtgccttctttgcagcgtttgccggaaaacaacgtggcggtttctgatcggaacttcgtcggagctgattttgccgacgattgccggtttggaacagagaaacagaaggagaagtgcagattctgagacgatggactacagaacgacgccgcaagagcttttcctgtttatttgatatttaattatgtttagatttttttttgtttaattccattattggatgatgcatttaatttaaattaattaagtgtacatactttgtatgtattacgttaattaataataaaaatatagtactaaaataaaaaaaaaaaaaaaaaa

SEQ ID NO: 9043 - DNA, 1029 bp, Solanum tuberosum
  Predicted polypeptide sequence is orthologous to G1480
gatcattattgcaattttagagagatactacgcattagagagagaaactaacaaaagtttaacaaaaaaaaacaacaattcacaataatggtggcggagagctggagcacgacggcgaaacgctgcgatgcctgcaaagcgacgccgtccacggtgttctgcaaggcggacatggcttttctctgcttaacttgcgactccaaaatccacgcagcgaacaagctcgcgtctaggcacgcgcgcgtttgggtctgcgaagtgtgcgagcacgcgccggcgagcgtcacgtgtaaagccgacgccgccgcactctgcgtcacctgcgaccaggacatccacgccgccaatcccttagctcgacgccacgagcggatccccgtagttccattctacgactccgcctccgccagatctcctcgtggtgctggtgcggatgaaaatgatccacaccagcacgaggacgagactgaggaagaagaagcggaagcggagtcatggctgctccaaacgccgaacagtaatactcaaggaattgagtataaatcggcggaatatttgtttagcgatgtggatccgtatgtggaaatggatgtaattgcagatcagaaaacatgtacgactactatggatattgctcataatcaagaggagtataaagaagattgtgttgtacctcatgtacaaaacaataagaatgagatccaattacaaggcccagttgttgatggatacccaacttatgaaatggatttttctggtggatctaaacctttcatgtacaacttcacaactcaatccattagccaaagtgtctcttcatcatctatggaagttggagttgtgcctgaccataacacaacgacagatgtatcaaacacatttgttagaaactccgccattgacggactacctaacccggtttcgagtttggacagagaaagcagagtattaaggtatagagagaagagaaagaatcgaaaattcgagaagactatacgatatgctttctagaaaagctatgctgagact

SEQ ID NO: 9044 - DNA, 400 bp, Solanum tuberosum
  Predicted polypeptide sequence is orthologous to G1480
cctcgtgccggttttgcgatacagagagaagaaaaaaaacagaaaattcgagaaaactattcgttatgcttcaagaaaagcttatgctgaaacaaggccaagaattaaaggtcgatttgctaaaagaacagacggcggcgccggcgccggcgagtttgatgacgttgacgggattttctccggcgccgaattcattgcggctgactcacgatacggcgtcgttccttcgtttttaacttaatttaattattattaaaaaggacatatagttttatttctatttttagtttataagttgtatttccaaaaattccaattacccgaaaatatccaaatgggtattgggttttttatgtactaatggaagggtactttggtaactaaaaaaaaaaaaaaaaaa

SEQ ID NO: 9045 - DNA, 1009 bp, Solanum tuberosum
  Predicted polypeptide sequence is orthologous to G1480
gattctctcacttaaaaacagagaaaactaaccgaaacaatgggaacggagaattggagtttgacggcgaagctatgtgactcatgcaaaacgacgccggcgacggtgttctgccgggcagattcagcgtttctctgcttaggatgcgactgcaaaatccacgcagcgaacaagctagcgtctaggcacgcgcgtgtctgggtttgtgaagtgtgtgagcaagccccggcgagtttcacgtgtaaggcggacgctgctgctctctgcgttacgtgtgaccgtgatattcattctgcaaatccgttagctcgtcggcatgagcggtttccggtagttcctttctatgactccgccgtcgcgaaatctgacggcggtggtgatgccgatgctgatgctgctgatgatgagaagtactttgatagtactagtgaaaatccttctcaaccggaggaagaagctgaagcagcgtcgtggatacttccgataccgaaagaaggaactgatcagtataaatctgctgattacttgtttaatgatatggattcgtatttagatatagatctaatgtcatgtgagcaaaaaccgcatattattcatcatcaacagcatcaacacggccattacagctccgacggagtttttgccggtacagaacaacaacaacgaaacgagtactcatttaccagcgtccagtcgttgattggatttcctaccttacgaaatccaattttactggaatctaaaccttttacatgtacaatttcaccctcttcaatccattaaccaaaagtgtttcattccatcattctccttggacttccgaatttgtacccgaaccacagtgccattaacggaatgtatcaaaaccacctttgttgtattaaactcattctgcccggacaccgcacccggcacccgaaactgtaccaaaatgcattcccggttaaaaccggaaaaccaggttactgaatatacgaacaaaaggacaattcaaagtttcaaaaaacat

SEQ ID NO: 9046 - DNA, 702 bp, Solanum tuberosum
  Predicted polypeptide sequence is orthologous to G1488
gggcaaagctcgcagcaagcgctcacgcgccgctccctgtgactggtcctcacgcctccagctgctcttatcccctgccacatcatcatcagagagcaacaacatctcgcctccatctgctaacaacactactttcgccacggccaaagccaccaaagcgccgtcgaagaagcgagagagtgtggaaacgccgggacggaaatgcctgcactgtgcttctgataagacaccacagtggcgcacagggccattaggtccaaaaactctgtgcaatgcatgtggagttaggtacaagtcaggtaggcttgtgccggagtatcgaccggcgtctagcccgacttttatctcagcgaggcactcgaattctcatcggaaagttctggagctccggaggcaaaaggatctccagagacaccaagcacatcaccagcatcaattgcttagtcaacccacaattttcggtgtatcaaatggtggtgatgaattcctgcttcatcatcaccaaaattgtggtccaaatttcaggcacctcatctagtatcagtcacctagtgtaggggataactactttgcacttttctcgttttaaaaaagtttgaattaacaatcccattttcctaattccatctagttttagaaagttgaaaatatcaggatatcaagatataggagcaaaaaataaaatgttcctagcaatcctag

SEQ ID NO: 9047 - DNA, 611 bp, Solanum tuberosum
  Predicted polypeptide sequence is orthologous to G1488
cttttctcagcttccgattctccttataaagaattagtctcaaacctaccgttactttgcgttttacactccaccattcttacactacacaccaacaacttcttcttcttttttctaacaatggaagcatcggatttattccttagcggctttttctcacatgccggagacgaacaaattccgaataacatcaacaacaacatcaattataataactgtaacaatttttctgtggatgatcttttggttatccctaaggaagatgaagttatggccgacgcatttttcaacagtattacaggaaattctgctgattcttccaccgttaccgtcgttgacagctgtaattcctctgtttctggtggagatggacaatttaacggcaacctcagcggccgcagcttcaccgatgctcccttccctaacagcgaactctgcgttccgtttgatgacttggctgagcttgaatggctctcaaattttgtggaggaatcattctcaagtgacgacgttcaaaacctgcagttcatccctgtagcaaacattaattcctccaccatctccaccgacagttcctcctccgcaaccacattttccacaggacctaactc

SEQ ID NO: 9048 - DNA, 738 bp, Solanum tuberosum
  Predicted polypeptide sequence is orthologous to G1494, G789
gggaagatcgggtagtagttatgcaagagcatgcaatcaatctacagcgaccaatagccagggccacaaaaggaagagtagagacggtgaagaaccagaatgccagagtaaagctgatgagctagaatcagctggaggaaacaaggcagcccaaaaatctggaactgcccgaaggagccgtgctgcagaagtgcataatctctctgaaaggagacggagggatagaatcaatgagaaaatgaaggccttgcaagagcttcttcctcactctactaagacagacaaagcatcaatgttggatgaggctattgaatacttgaagtcacttcagatgcaactgcagatgatgtggatgggaagtggcatggcatcaatgatgtttcctggtgtccaacactacatgtccagaatgggaatggggatgggtccgccttcggtgccttccatgcacaatgctatgcatttagctaggcttcctttggttgatccagcaataatccctttgacacaagctgctcctaataatcaaggcgctgcaatgtgccagaattcaatgttgaatcaagttaactatcaacgccatttgcagaatcccaattttccagatcaatatgctagttacatggggttccatccacttcaaggcacttctcagcctataaacatttttgggcttaggttcacatacagcacagcgaagtcagcatccaactaatagtaatgcacccgccactttga

SEQ ID NO: 9049 - DNA, 624 bp, Solanum tuberosum
  Predicted polypeptide sequence is orthologous to G15
tgcttgtcaaaggctgactatatactgggtgggactgaaaaacttttccaaaagctgttttcttccttatgatcacataataaagagaaagaaaagttctttatcatcaatttgtatggttcactaaaactgtcaattttgatgttcataggcacacaagaagaagcagcagaggcttatgatgttgctgcaatcaaattcaggggtgtaaatgctgtgacaaactttgacatatcgcgatatgacgttgaaaagatcatggctagtaatactctgcctgctggtgaattagctaggagaactaaagaacgagagccaattgaatacaacaacaacaacaatgacataggaggtgttggtggtcacaagaatgaggaatgtgttgacaacaacaacaatgggaatatcacagattggaacaatggtgttatatcaaacatctaatccttcagtaggattgaattatcgcaaccctacatcattctccatggcattacaagatttgattggcattgattcgatgactaattcaaataaccatcatgccacaattcttgatcatgaacagaacaagattggtaaccactttttcaaatgcgtccatctttggtaactagtcttggt

SEQ ID NO: 9050 - DNA, 948 bp, Solanum tuberosum
  Predicted polypeptide sequence is orthologous to G1506
gatgcgcaatccaatatatggggattcaacggtgccttcaaggaagagaacctgtttcaatcgtccaaagccatcttcagtagaaaagctcactaaagacctatataccatcttacatgaacaacaaagttcatacttgtctgcatcctctgaggaggagttgctttttgagagtgacaagtctatggtttctgttgagataggacatggaagtgtactaatgcggcatcctagtacaataggtagagaagaagaatcggaagccagctctctttccgttgacaacaagcaccgttctgtcagtgatgcttattcacgattgactacccctcctgtaaatattagtaagggtgtcaattcaccaaatatggataccgagagaatcaagaaacctactggtccggctatagaacaagaccagattaaaagaaacaaggatcaccttgataaactacaaattcttggacatcataattcaccccttcgctatatagacctgaaggatgtacttaattatgaagaattcacaagtcatttgtcaagtgatgaacagcagcaactactgaagtacttaccacctgttgattcttttgcgcctccagatagtcttagaagcgtgttcgagagctctcaattcgaggagaacctgtgttccttccagaaacttctcgcagaaggtgtttttgataactcattttcaggagtgacattagaagattgtagaaacttgaagagatttatattgtgctatttaacaaagtcaaagtggatgcaacaatataatttactcaaggacaaaaaatgtaagaatagtagcagtggctctgaagttgcccgagagccaaatgttgttggcacatgtcattcagctaatgtgaagaaaccacgggaggggcatatctcaagtgttcaggtgcaaagacgacaatgaagagccccaaaaggggt

SEQ ID NO: 9051 - DNA, 642 bp, Solanum tuberosum
  Predicted polypeptide sequence is orthologous to G1506
aggaggggcaccatccaaagtatgcaggtgcaaagaaagcaatgaagagccccaagagggtggtgatgaaaagtagctatgagcagaaggaattagtagacaacaatagctcttgcttcagtccgaaatgcctatttcccttgccttctaatagttctcctgagctggattctttccatgttgcaaatgaccaggacgtgctactggatgtgccatccaacagctcctttgcgcaggcagaactcctccgaccaacatctaattttgctgcacaagcaagcaccagtagcagctctgtgtatccacatcttgtacgtccctagtggtagtatcatagtttgcattttcatagggcatctagaagctacttcagccaaaccagatgattgtgtctgcatgttcctcaccaatcatgtggtgatttgctgaaagagttggatgttgtgctgtttatgtttcccctttgagctatactaacaaaattttggatttagctgatggatatggttgtttaccctctttttttctttctgtaacgatagacaaacattgtataatatagctggaaatgtggggaagatggtaatgtccagcacttgtatgcagtaaagtttttcaacttaaattggggacagctttcta

SEQ ID NO: 9052 - DNA, 853 bp, Solanum tuberosum
  Predicted polypeptide sequence is orthologous to G1506
agaagtggtgtcttcaatttaagttaaaaacttcagtgcatacaaaaatctctagacatcaccacctctgcattttcagctatattgtacaatttgtcaacctatacaaaaggatgaaaaacaagcataatatccatccgctaaatccaaaatttcgtttaatattaggttacctgcaaaaaggcaaaaggcaaccatctgaatcccttcgcggaactttctatatttggtatgtgatatgcagagacagtaatgtggtttggcccaataaggttgtaaatacgctacagacagaaagccaagtgtgatagtgttgtgtttctaggggtggatgaggtgtgggtatatggagctactgcttgtgcttgcttgagctgcaaaacttgctgttggtaggaggagttctgcctgagggaaggagctgttggatggcacatccagcagcaagtcctgatcagaactttcatttgtaaaacggaaggaattttcagatggcaatgcgaaaaggctttttggactgaagcaagagctatcattctccaggatttccttctgttcgtagctgtttttcatcgccaccctcttggggctcttcattgttgtgtttacccctaaatattttggatgttgcccatcgcgtggtctcttcatgttcactgaatgacctgtgccaaaaacattgcgccctccagcaaacttcagaactactgctactatttttacattttcatgtccttaaagaagattaacttgtttccacccacttttgacttcattaaaatagcacaaacataaacctcttcaggtttcctacattcttctactgtcacccaaataatgagttatcaaaaac

SEQ ID NO: 9053 - DNA, 735 bp, Solanum tuberosum
  Predicted polypeptide sequence is orthologous to G1535
gacctttcccttatttcaagagaagaccttctggatgcatcattcaagacatgcccaatggatactccagggttacatgggttgaacatgctgaggtggaggaaaatccagtgaatcaaatattcaatcactttgtaactagtggagtggcatttggagcacaaagatggttatcaatcttgcaaagacaatgtgaaaggcttgctagtcttatggctagaaatatatctgaccttggagtgataccatctccagaagcacgaaagagcttgatgaatttggcacaaaggatgatcaagacattttgtatgaacattagtacttgttgtggtcaatcatggacagctctttctgattctcctgatgatactgttagaatcactactagaaaagttacggaaccaggacaacctaatggactaattcttagcgcggtttcaacttcttggcttccatataatcatttccaggtctttgatctcttgagagatgaacgtcgaagagctcagttggatgtactttcaaatgggaactcattacatgaagtggctcatattgcaaatggttcacatccagggaattgcatctctcttcttcgaattaatgtggctagcaattcatcccaaagtgtagagctaatgctacaagagagttgcacggatgattcaggcagcctggtggtctacactactgtagacgtggatgcgatccagctagccatgaaacgggaggacc

SEQ ID NO: 9054 - DNA, 829 bp, Solanum tuberosum
  Predicted polypeptide sequence is orthologous to G1538
atcttgctacttgctagctagatagtcaaatactagtaaccctaattaccacactagtctagaaaaaagcaaggaaaaaaagatatatttacatacattagtacgttatatatagtggggttacttatctacaaatagaattatgggatcctaaaattagaaattaatcacatgataattttataattatatcaaatatataggttcacccaatctaatccttgaacataattattctcttgtgcatagaacacattatccaatgcctccattccaaattcccctagaaatggtgcttccattgagaaagatgaagcacttggacttgtgtaattactcgataccccatcacatcgctctaataatagcctttttatctccttctctgattcattcaattgttccttcaacttcaatacctcagtttcaagacgacacttctcaacaacattgttgtcatgttgagatttcaacttggaatattcctcctctagcttcttgctcttccaacgagccctcctgttctggaaccacaccgcaacttgtctagggtcgagccctagctccgcggctagcttgtcctttctctctgactcaagtttgtgctcgtcctcaaaacttttgctcagaaattaacttgttcttcactcaacttcctcttcctcatcatcatcatctgatcactcccactcccttctcctaattggttttcttacgtcttcttctccgcggctttgactctccttgttgtggtacaaggtggggtgtaatatcaggatagtactgggaaatgagtatcatattgtcatcttctataatctgatggtta

SEQ ID NO: 9055 - DNA, 869 bp, Solanum tuberosum
  Predicted polypeptide sequence is orthologous to G1538
aaacaccttattctctacatccctctagcttttataataactaaaactaaaagtcctcactgctgtactctttctcacatttatccactttcatttttgcatcagaaagcaaaaaagtaacatgaataatgatgatcaaatgttacacatttctcagtactattctggtatctatactcaacagttaactcaacaaggagagggtaaaccgaagaggagaagaaagaagaacaaaggagatgatttaaacggggcgatgatgatgatgatgaggaagaggaaactaagtgacgaacaagtgaatttgctcgaacaaagttttggacatgaacacaaattggagtcggagaggaaagacaaacttgcctcggagctaggtctagacccgaggcaagtaactgtgtggttccaaaacagaagggctcgatggaagagcaagaagttagaggaagaatactctaagttgaagaatgaacatgagactaatattgttgacaaatgtcgtcttgaaaatgaggtattgaagctaaaggaacagatgtgtgaagcggagaaggagatacaatggctattgacagagcgatccgaaggcgtttcgatcaatagcccaacaacttcatcactctcaatggaagcagcatggatcctccttttctaggggaagttagggtttgatagtagttttaatgggccctatgtccatgaagggattcggacatggggttaaataaaccttgtaccaataattgacattatcatattgtgaacctaaatcactagcttaagtaggtaactcatccacggtgtggtataccttaaactgatcctttctccctttgacttattaaagctgtacttactaatactcg

SEQ ID NO: 9056 - DNA, 846 bp, Solanum tuberosum
  Predicted polypeptide sequence is orthologous to G1538
ttcattttctacatcaagaagcaaaagcaataacaagagagatctaggagggaagggattatgtcaagtagcaaggttgatgatcaaatggaactcatctctcacttctatcctcatatttacgcccaattagcacaagaacaagtctctttaggagagaagatggaaccgcgaaggagaaggaagaagaacaaagttgaagggagaaacaacactagtgaagttgtgatgaggaagaggaagttgcttagtgaagaccaagttaatcttcttgaacgaagttttggggacgagcaaaaactaggagatggagaggaaggccaagcttgcttctgagcttggccttgatcctcatcaagtcgcggtgtggttccaaaacaggagggctagatggaagaacaagaaaatcgaggaggaatactccaagctaaagactcaacatgagactaccatcattgagaaatatcgtcttgaaactgaggtgttgaagatgaaagagcaattgtgtgaagcagaaatggagatacaaaagcttttattggaacgtaaaagtgatatttcaagcaataataacccaatttcatcaatattctcaatggagcagcaacattttgatcttggggagtttggaatggaggggcaattaatggatgataatatgttctttgttgctgataaatcaaagtacttatataactctttgggataattagaatgggtttaaaatttataatcctatatgtatgatattcatgatcatccatatgtataaagttttaaatgtagaaatatgtacatttctttctttttgtaacttgctttgtggttaaaaaaaaaaaaaaaaaa

SEQ ID NO: 9057 - DNA, 711 bp, Solanum tuberosum
  Predicted polypeptide sequence is orthologous to G154, G1797
agcttcacttctattctatacttagcctcattgatataacttgcaaacataaaacttgtcagtttttaccaattttgagatatggtgagagggaaaacacagatgaggcgtatagagaacgccacaagcaggcaagttactttctcaaagcgaagaaatggtttgctcaaaaaagcttttgaactttctgttctatgtgatgctgaagttggattgattattttttctccaagaggaaaactatatgaattcgctagctccagcacgcaggagataatagagcgatataagaggcatactaaagacagagttcaacctgaaaaccaagctgggggacaacatctacagcatatgcagcatgaagcagcaaatttaatgaagaagatagagttccttgaaacatcgaaaaggaaattcttgggagaaggtcttcagtcatgtacccttcaagaagtacaacagatagaaaaacagttggagaggagtgtcagcaccatccgggcacgaaagcttcaagtttttaaggaacaagttgagcgactaaaagaaaaggagaaaatccttgctgctgaaaatgcaaaactgagggagaagtttggtggtcttcaacagagagaaacaccaagtgtagagaaggaaggagaagctctttgtacagatggtagcgaaaaatcagatgttgagactgaattggtttataggaccacccgg

SEQ ID NO: 9058 - DNA, 876 bp, Solanum tuberosum
  Predicted polypeptide sequence is orthologous to G154, G1797
gatgcgcgggagaaagaaagaccaaacacttcagcctaacgggaatgagcaacgacaaaatgagaagatgaggtgcctcgggcaccctatttagaaagaagggtcaaaggttttgggcatgtagctttccccgtctccccttcgtcgggcggtgcttgtgtggagggtgcgccatactctttgggaatagggactataactaatgcaattacagcatgcagaagataattgagagataccgtgcacgtgcaagagaaataatgacggtggacaaaagcactgaactcgagcactacatggagaacttgaagcatgaaacagctaacatggcaaagaagatagagatccttgaagtttccaaacggaagctaatggggcaaggattagggtcatgttcaatggatgaactagaagacatcgacagccaactggagaggaccctcaaaattatcagggctagaaagactcaattgttcatagacgaaatagaacgtctaaacgcaaaggagagactattgctccaacaaaatgcaagtttacgtgaaaagtgcgggcttaggccaatgctattagagtcagcacccacacctgcacccgtaccagcaccaccaccaacaccaccagctcaagcgaaagaaagaggaaattgtagccaaagtacaaagagttgggaagtggagactgaattgtttattggcattcctcaaatgcgctgcttatagtagctcggttagtggctgagctagcattttttcatcaaaggaatttaaaatctgaagaagtaagcacacaaagaaggcaaaaggggttcaaagtctactctatatacattaaaagataaattttaacaatgtaattttcactgaaggaaaatca

SEQ ID NO: 9059 - DNA, 794 bp, Solanum tuberosum
  Predicted polypeptide sequence is orthologous to G154, G1797
ttttttttttttttttttttaaaaaaaaaaactatattaaagtaatttagtttttttattacaaccctataaattataattacagtactggtaatataaaacttgaaacaccagcaattttcacaattaaagtgatgtaggtggtgtgtttaaattaggacaatatgaattttttctagtctctggaagtccaataaagagctctgtctcaacttccattatttgtctttcaacatctttctctacttgaggaaatggtgtcaaagtcaatggtagcacctcacaccttttcctcaagtctgcatttttcttcaatagaattttttcctcttccttcagttgagcaatctgttccttgaataacagattctttcttgccctaatgttgcttaaacttttttccaactgttcttctacctgttgaagttcatccaaggtggaagattctagaccatgtcctaaaagctttctcttagagtcttcaagaaattcaagctttctagtcatggttgcaacttcctctttcaaatgctcagtggttagttgatcagttaattttctgttgagtcttcccaggctcttgtcattcttctgatagcgttctattgtcttgtttgtactggaacttgagaactcataaagctttccttttggagaaaataccataagagcaacttcagcatcacataaaactgaaagctcaaatgcttttttagaagcccacttcttcttttgagaacgtcacttgtctaccttgttgcttttcaattctttcaactccatttttcctctca

SEQ ID NO: 9060 - DNA, 848 bp, Solanum tuberosum
  Predicted polypeptide sequence is orthologous to G157, G1759, G1842, G1843, G1844
tttttttttttttttttttttttttttttttttttatggactaactgtcacccttacttttgatataacctctaatttacatagtcattgcattacatacaagttatcgagacgctgcagcagcatctctttatttatccttacacagtttttcagtgtttcaaccataccaagacaacatacaagagaagactacatagtagcacaccctagttagatgcagcagatataacctcggcaggacatatcccacggcaagaggagtggctgctctgctatattttgggaaggctgttatttatatcttgagcttctatctgatatgtgatgccttcagtgtgtttagactctagagaaaattcagggtcaccctctgttgtccacaatccatatgggttggtgcaatgttatttaaattcattgccatctcattttcttctctgttctttatggtacctatctcatcctccagaactttgttttcttctatcagctgcttttccttgtcatgaagattcttaattgattcaatcaacaagtgtgtctttctaaatctggtttgtgtcagagcagtctcgacttggttttccaaatggacaagatcagtaatgctcagatcatcaacatcaggctccttgatttgttttctaccgtctgtagcagttcttccattctccatgaaactttgcagggggggcccgggtaccccaaattcggaccttataagttgagtcggtaattaacggcgcgcttccaattgggccgtccggttattacaaaaccgtcgtgaacctggcgaaacaacacttggcgggtaaccccaaattaattcggcctctggcagaaaa

SEQ ID NO: 9061 - DNA, 753 bp, Solanum tuberosum
  Predicted polypeptide sequence is orthologous to G157, G1759, G1842, G1843, G1844
ataaaactcatagcactttatgaaattcgtgaaagtgaaatggaagatggaggtacaaagcttcttatatacggccattttcatttgtgagaattagttagggtttgggagtttgaagaaatgggaaggaagaaagtggaaataaagcgaattgaagataagagcagtaggcaagcaactttctccaaacgaagaaatggactcatgaagaaagccaaacagctctctattctctgcgatgttgatgtcgccgtcctcgtcttctccagccgtggacgcctctttgaattctccagtaccaacagtctgacaggagttattcaccaatataacacccacatgaaagcagaagataaggtctctgcagaagtcgatgacacagaggaatcaaaatatgcaagtttcatgagaatggaagaactgctacagacggtagaaaagcaactcaaggagcctgatgttgatgatctcagcattactgatcttgtccatttggaaaaccaagtcgagactgctctgacacaaaccagatttagaaagacacacttgttgattgaatcaattaagaatcttcatgacaaggaaaagcagctgatagaagaaaacaaagttctggaggatgagataggtaccataaagaacagagaagaaaatgagatggcaatgacatctaaataacattgcaccaagccatatggattgtggacaacagagggtgaccctgaatttcctctagagtcttaacacactgaa

SEQ ID NO: 9062 - DNA, 814 bp, Solanum tuberosum
  Predicted polypeptide sequence is orthologous to G157, G1759, G1842, G1843, G1844
gaacccaagagatttagttggagtgaagagagtaaaacaacaaaaatggttactctgtaacaacacacacaaaaaatagagctgggtaggagtaacggcgatcatactagaaacttctagacatctgaaatctgtggattagggcttttctccggcgaaaaaatggggcgaaggaaggtagaaattaagcgaattcaagacaaaaactgtagcaagttgctttttgtaaacggaggaaaggtctattgaagaaagctaaagaaatttccgttctctgtgatgtcgatgttgcggttgttatcatctccaatcgtggcagactccatgaattctccagcaataacagtctgacagaaacacttcaacgatatgaaagccacgtcgaagcagaaaaagagagctctgcagaaatccaggtgccagagcactctatatactcagggttcacaacaatgggagaactgctacaaacaacagaaaggcaactcgaggaaactaatgatgatgtctcggtgtgactgaccttatccatttggagaacgaacttcaaactgcttcggaatacaagtcagatctagaaagacacatttgttgcttgaatctgctaaggtcttcatgagaaggaaaaactgctgcaagagaaaataaacatctggaggacaatatagctagtatcaagaaaaacagagaagtgaatgagatgtctatggatttcgccgacttttcagcagcgccatataatttgtggaccacagaaatgacgctaaatttctctataatgcattgtacgtgtcaaataatcctttgtaaaggc

SEQ ID NO: 9063 - DNA, 943 bp, Solanum tuberosum
  Predicted polypeptide sequence is orthologous to G1634
gatctcctatacatctagaaagattggaaaattaaacagatagaactttctttttatgatgatgattttaggtcagatcattttggagagtttatcggaaataatctttctgtcttgactcttgagggataaggtcttcgtaaacactatcatcatcagactcgacttatatgttattattgtattcagtcatctatatggtcttaattcattcaatcattgtctattgttcagttaaggtttatagaattgatcaagaaatactcctcgcgattctgatccagagtatgttcctatccaccgagaagattatagtcttttaagtttcaagaaaattgaggattcttgatttggatatggaaactttatatccaacttcttttgtaccaaattcaaattggattatgcaacagagtaagagtaatacagaatggactaaagaagagaacaagagatttgaaagtgctcttgcaatatacgacgagactacaccaaatcgatggtctaaagtagcagaaatcatccctgggaaatcagttcttgatgtgataatgcagtataaagaattagttgcagatgttagtgacatagaagctggattacccccaaatacgaggcgtgatttcacgtcttcttttgcgttggaatttgttgatcattgtaagattcaaacgtttagtaagagaggcaagtcttatgatcacaaaagaaagaaaggtgtaccatggacagaggaagaacacaggcgatttttaatggggttagagaagtatggtaaaggagattggagaaacatatcgaggaatttcgtgatctctaaaactccaacacaagtggctagtcatgctcagaagtactacttgaggcaactttccagggagaaagagaggaagagacctagcatccacgacatcaccaccgtccatctaacaaacgatgagtt

SEQ ID NO: 9064 - DNA, 880 bp, Solanum tuberosum
  Predicted polypeptide sequence is orthologous to G1635
atttcttggaatattggagcttaatacggattgaatttgaaggtgactgttgatatttctgggttttgggaactgaagagaattgattgggtaaaaactggtttcttctattttaggggaaagtaaaaactttggcagcagttgttagtgattttggctcaaggagtactgatttgattcagcagaaatgactataggggatcaaagtgagtcggacacgatacttccaagtaggaatagaatgtcagttgatgtgggagctccttctccaaggagcatccagatggaagagcaagttattccaggagaagaatatgctcctaagataagaaaaccatacaccatttcaaagcaaagagagaggtggtcagaggaagagcacaaaaagttccttgaagcattaaagcttcatggtagggcatggcgacgtatagaagagcatgtgggaaccaaaactgcagttcagattagaagccatgctcagaagttcttttcaaaggttgttcgtgaatcgagtaatggtgatgcaagctctgtgaaatccattgagatcccacctcctcggcctaaaagaaagccaatgcacccttatccacggaaaatggtaactccacttaaaagtggaaccctggcttcagagaaattgaataggtctggttcacctgatctctatctctccgagccagagaatcagtctcctacctctgtgttgtctgcctttggttcagatgcatttggcacggtggattcaactagcccagtgagcagtcatcacctgttcatcagctgtcgctgagaattctgggtgatcttggttactttccttgaaaccattcccgcttttcatctgtacaaggaagagcaaatctttcaccctggc

SEQ ID NO: 9065 - DNA, 1012 bp, Solanum tuberosum
  Predicted polypeptide sequence is orthologous to G1646, G715
gattgaaattatcgctcagaaaaaaaaccatggcaaaccactctgacgaggcggcagcgaatgcagaggcggcggcggcgactgctcagccgactgtgaacgatcatctcctccagcagcagctgttttgggcagctcagcttcaagagatcaaacagataagagattttagggtccacagtcttcccatttcccgagtcaagaagatcatgaaatcggacaaggatgtccatatgatttctgctgaagcgcctattctgattgctaaggcatgtgagctctttattcaggagctcacccatcgttcctggcttaacgcccaggaataccagcgtcggactctgaaaaagaccgacttcatcacggtgcttagggagactgaactctttgatttccttgtggacgccatttctatggatgagaccgaggaagaagttactggttttgtgcctggcatgctgggcaacataccaagtcgtatcccgtactgttactcaccaatgggacctcctgctccaccaatgggacctcctgctccatcaatgggaccacctgctccaccccggggaatcatgggaaggcgtgctatgccttgggttgcaccctcagtgcacgtcccgcctccgttgtacccgcggcagtccggttggcatgctgctggcggtaatccctatgctacaggagggagcagtggacagggtaacggtgatcctcaaagttaaagatcatgttctctgttgatccaaatgctcagtggcactggcacaatggaagctcttagtcactaatgctgcaggtcctgtcaactatggatgcttcttattgctactgtctatgggtactggctcaacagtaaaactacttttaatcaaatgcttccatgttgtttcattcatggcttcatttggattgctgtaactgtcaatctgcccgtgtttctctagggaagaaagactagtcaagaaagattttgaggagataacaacagaagcatttgctcctgctacagcaa

SEQ ID NO: 9066 - DNA, 1049 bp, Solanum tuberosum
  Predicted polypeptide sequence is orthologous to G1646, G715
ctgttaatacaggaaaaattgcccctttgttccttaaaacatggaaaacagccctcagcaatcggcggcgaatgcagcggcggcggctgcagcggctcagtccgctgggtattccgactcagccaccctctacccacccattctccctttcagcaaacagcagcagcagtttacagaatgtttttgggacccttaaccaaacggcccagggaaaaattcgaaaccaggttaaaccggaattttaaagaaacccaattcaaacctttcccctttgcccggaaattctagaaaaattcattgaaaaagcttgaacaaagaatgttccgttaattgaatcttccggcttgaaaccacccatatttggttttgcccaaagggccaattgttgagccttttccaattccttggaaacctcaaccttattccgtttcccttggcctttcaccgccttgagggaaaaacaaagcgaacgggactctgcagaagaatgacatcggctgcggcgattacgcggactgacattttcgatttccttgttgacattgttccgagggatgagatcaaggaagagggtgctggtcttgggcctggcatggtgggttccacagcaagtggtgttccgtactattatccaccaatgggacagcctgctccacctggggtgatgatgggaaggcctgctatgcctggggttgatccttcaatgtacgtccagcctccgccaccaccatcgcaggcgtggcagtccgtttggcaggctgctgaggataattcttatgctggtggaggcagcaatggacagggtaaaccttgatggttaaagttaaaatccatgtatgttgttgatccagatgccttagtagcagaacggaagctattattaccaatgctacaggtcctctcacatgtgaatgcaccttattaccattgtccacgataactgattaactgctatgacttaatcctttagccgtttgtagtaaaaacctgtgtgtactttatccacaatgcttataatgtctcggttttcacagtattataaaccttac

SEQ ID NO: 9067 - DNA, 916 bp, Solanum tuberosum
  Predicted polypeptide sequence is orthologous to G1646, G715
ttttttttttttagcaacccaaaaggatattaaagagtaaaatccaggaatacacaaaagtcaagttttatacagacaaagattcaagtcggttacagttaaacagtatccatggacagaagccataaaaggtggattcacatttgagagaagaaattacatttcactatcataaccattagtttcacatgtgctgttaagcctccaaaccggcagcagcgagatcttttaaatttggccatcaaggttaccctgtccactgctacctccactagcataggaattatcgtctccagtctgccacacagattgccacgcctgtgatgggcggagggtgcacatacattgacggatcaaccccaggaacagcaggcctaccaagcatcaccccacccggagccgggctggcccatcggagggtaatagttacggcacaccactagcagtagaacccacaatttccgggtccaagcacaacaccctcatcctttaatctcatccctagaaacgatgtcaaccagaaaatcaaaaatatcagtacgagtaatcgccgcagcgatgtcattcttcctgtagagtccctgcgcttgtttttcctcaggcgtgaagccaagaacggatggtgagctccaggaatgaaacagttcacaggctttcgcaaacagaaccggagcttcagcagagatcatacgaacatcttcatcagttttcatgatctttttgatacgagcaaggggaaggttgggtgggttttcgaacatcatttgacttgctccgatttcttgaacgcttgttaaagtccaaaaacatctgaaagctgtggctgttgttgttgaaacgacaggtggtatggagtctggcggggatattgtggtgaactgagcggcgttgccgttgtgactggcgcgggggggct

SEQ ID NO: 9068 - DNA, 691 bp, Solanum tuberosum
  Predicted polypeptide sequence is orthologous to G1660
ggctgcttaggtctcacttttaatatagtatagatagtttttttcccattattaactaatataatcatactttaagtgctagctttgtaaagaaagaaaataactctgagcatgtatctcattttgttacatgacaaaaaagtaatcttgcattacaaatatatatcgtatttgaatctacttcctaactgaattattgttcaactttgcaggttcaggagatgtcaaatgattttacattcacgaatgaagtcatgcaactagcttgattgtttatcaatttgaaattatattttttcctttcagattttcaattgctcattctacacatatttgaatagagtattatatactccattttaggaagtctattaattcacatgagacacacgtgcaacacatgtgtccagaaactagtatttactatatgcatggaacttaagctttatggtgcctttacgtgcttgattcatgatcgtccacagtaaattgttgaaatatgatgaatttttggatgcaagatgataaacgattgtatatttttgcagtaaatctgagccgtcatgattcgtctgtttctatacatagtgcaactgttatcccccaccatcgactgcaaggtcagtctcgatgagagaatgggcatggaaatgactccaattgcaagccaggaaccttccaggacggacac

SEQ ID NO: 9069 - DNA, 976 bp, Solanum tuberosum
  Predicted polypeptide sequence is orthologous to G1660
gtccgggccccccccaatggttgaattggaggaccattcattacccatcaaagtcacaattggccactggagaatggctgaacttctacttccattgatcaacaattacatgtaaagtggccaaccagttgagtttgtacaagagcttcaagcatacacaaaggcagtctccaacttcacaatactagcttagtggaaaagcaaaaaatatacagagcatttgatagtgatttgaagctcttcagaagcaccagcgacagcaggagaatgagcgcggtaaacggccagttttacgaatgtattctgcttgcttctctatttttacagcatgtttgtttctcctggcttctgctgctgccagcttctcttcggctttgtatctcaccgcagctagcttgttcattagcttgtcttgtgttcgtgccttcatcttttccacctccacctcagttttcctcatctcagcttctgtctttgcttgttgatgattttcccatgcttgtatcttgatttcttctcgtttaaacctggctaagtactttgctttctctgcatcctcccaagcagctgcacgtgtctcagtgacagtggtatttgggttggtcttgcttatcagttttcagcaagctggatgcatttctatcctcgccatctttgctagcccaggcagcaatattcattttaccaagtttagttccaagtgccatgatttctcttcgagttttcatctgtaattcctggtcagacaacttcattttgcatgagcattccaaattatcatttggaaggacgaaaaaggagaggaaggctggtgcagctcccgggagttgatggccgagaagaagttggggctgcgagtaaggtgtagttgctctcacaaggtggtccaagttcctggaaaagttccctggctcagcaattggagtcaattcccgctgcaccattatctcttcagtgagaacgaacttgccaagtt

SEQ ID NO: 9070 - DNA, 716 bp, Solanum tuberosum
  Predicted polypeptide sequence is orthologous to G1760
gctttgatttcatttctaaagccctcaacaattaatccaaatccaagtaaaaccctagatgggaaggggaaagatagtgatccgaaggatcgataactcaacgaacaggcaagttactttctcaaagagaaggaatggattgttgaagaaagctaaggagctcgcgattctttgcgatgctgaagttggattgattattttctctagtactggaaagctctatgagttttctaacaccagcatgaaatcagttattgaacgatacaccaaaacgaaggacgattgtcagcaattgcacaatccagtgtcagaactcaagctgtggcagagggaggcagagatcttgcggcaacaactacaggatctgcaagggaatcaacggcaattattgggagaggaggtaagtggtttgggcgtaaaagaactaacagatctggagaatcaactggaaatgagcttaaagggaatccgtatgaaaaaggagcaaatattgaaggatgaaattcaagagctaactcgaaaggggagcataatacatcaagaaaatttggaactctacaagaaggcatatggtacaagagatgctcatgcagtgaatggaaacatcaactatatatatccgtatcgctttacagtgagtagagaagttcaggcccccatccatctgcagctaagccagcctgagacacaaaattttgagaatgcagtaggaacat

SEQ ID NO: 9071 - DNA, 679 bp, Solanum tuberosum
  Predicted polypeptide sequence is orthologous to G1760
ctccttttgtcttctccatcaacagcaactttttttttcccttttcctcgaaaaattcctccactgatttgttcttctgcttcttctcgtgaattcaatttctctgagagagagagagagtgtgtgtgagatcggcgatggggagaggaaagatagtgataaggaggatcgataattcgacgagcaggcaagtgacgttctcgaagaggagaaatggattgttgaagaaggcgaaggagctagcgattctgtgcgatgcggaggccggagtcattatcttctccagtactggaaaactctatgaatattcaaacaccagttttggcaaagggaagcggcaatgctgaggcaacaactacagaacttgcaagagaatcaccgacaaatgatgggtgaagagctttctggtctgagcgtcaaagatttgcagaacttggagaaccaactggaaacgagtctccatggtgttcgtgtaagaaaggacgaaattctgattgatgagatacaagagctaaaccgaaaagggaaacctcattcatcaggaaaacatggactatataagcacgtaaacctaattcgtgaagaaattatgacttgtgtagcaggtatcatgtacatcactaaaagttcacatgttcagatcattgtttctatacagtgaagaggaacatatctctag

SEQ ID NO: 9072 - DNA, 569 bp, Solanum tuberosum
  Predicted polypeptide sequence is orthologous to G1760
tttttttttttttttttttttttaagtccaagactaataactataggcatgaattacaaatatatgaacaacttagtgtcgcccctttagaagaggttcattgacaaagaaaagtatggcttagaacattgatgacgacactaataacacgcattacgcgaggcgaagcggtcaacacgttttgagcctcatttcaggacttaagcgtgcatttgataatacgggtctttaataatttaaacatatgtttgtgagttggaacacttggtcgagaagagaggctaatggcataatgtgcatattctccactaatgcagtgacagcctcaattttgtagttcctggcatttcatagtgttgtagctgtggttggcttagctggagatgaagaggtgtgagagggtcctcgttgacgcttaaactgtttgaactcatggcatttctactcactgcatttgcttctctagttccataaaccttcttatacaattccatattttcttgacgaacaaggtctagtttcttataaagttccttgttcccttgatggctgaagtctctctttcggtt

SEQ ID NO: 9073 - DNA, 470 bp, Solanum tuberosum
  Predicted polypeptide sequence is orthologous to G1760
ctctcttctctctctctctctctgtagaatcagtctactatcaaaatctctcaaattatagcatttaatcgagaagagatgggtcgaggaaaaatagtgatacaaagaattgataatacaacaagcaggcaagttactttctcgaagagaagaaatggacttctcaaaaaggctaaagagcttgcaattctttgcgatgctcaagttggactcattgttttctcaagcaccggaaaactctatgaatttgccaacaacagcatgaggtctacaattgatagatacaacaagataaaggaggagaataataacatgaatcccatgtcagaggtcaaggtaacctgatttttgttttgtttccacaagtgtatgatatccttttggatgtccttgtatatatatatggataatatgctgattttattcatgctattctaaaacccttttaattaaaaaaaaaaaaaaaaaaa

SEQ ID NO: 9074 - DNA, 954 bp, Solanum tuberosum
  Predicted polypeptide sequence is orthologous to G1767
ctccacttgagttgatccttttgctttgaacccatccaacaaaatcactaaaggtactactagtcttgtacatttattctttttaactttgatgtggcaagagagatacgtaccccccctttttgttaaatggatactttgtttagattagttacccttcaacaacaacaacaacaacaacaatctgatcaatactcttttaactccagcagaacttcaagcagctctagatcttctaacaaacaaaatactacttataattatcatccacatcataataatcaagacgaagaatgcttcaactttttcatggatgaagatgatttctcttcttcttcttctaaacacaacacgaactatcctcctcctcattacaatcaatatcaacaaatttccaacactcccacaccgacaactacaagcagtaccccgacacatcaatctcaatctcatcatcactatgatcatcagttctccccagcacgtgacttaaatctcgaattcgcttcctcattttctggaaaatgggcgacggacattcttctagaaacttctcgtgccatagccgataagaacagtacacgtgtccaacaactcatgtggatgttgaatgagctgagttcgccatatggagataccgaacaaaaattggcttcttattttcttcaagcattatttagccgtatgacggattctggcgaacgatgttatcgtacgttgttatccgcttcggataaaacatgttcgttcgagtcaacgaggaaattagttttgaaatttcaggaagttagcccttggacgacttttggtcacgttgcatccaatggtgcaattatggaagcgttagaaggtgagtcaaagttgcatataattgatattagcaacacttattgtactcaatggcctactttactagaagcactagcaacccgcaccgacgaaacaccgcatctc

SEQ ID NO: 9075 - DNA, 426 bp, Solanum tuberosum
  Predicted polypeptide sequence is orthologous to G1781
ctggaggtgaacaatgaagaagaaacaaaggaggtaattttagagctctctatgcgtgtggtgttattgaatcaggtaattgtggctgaattgagttgggggaaaaaggcaaaggaaaaggttgatttgttggaacaaatgaagtttggggaagaaggcctgtaggagaatatacactgttgtatgaaaaatttggcttctgatcatgttgttgtgattggttctgctttggaacatttagcttttcaccttctaattctctatatttgttaagatattgtttaagagggagaacgtaatcttcaaacccgagaattgtgatggcccatataatgtcatcaccattgattgtctttctcttctcacgctggcatttatcagatgcttctccagtaacaaagcttataaattctgatacacaaaaag

SEQ ID NO: 9076 - DNA, 586 bp, Solanum tuberosum
  Predicted polypeptide sequence is orthologous to G1789
atgtctcccccttcttgttcttcttgttcaattcattactaaaatggccacaaattgttacaacaaaacaaaacaagaagtttgaagaggcaattgttatgtatgacaaagacaataatggtgaaaaatggcataatatagctagatatgttggtggaaaatctgttgaagaagttagaaggcattatgatcttttgataaaagatattactcaaattgaaaatgatcaagtccctttgcctaattataggactacttctgatcaaaccaatgctagaggttatgctaatgaacaaaggcttctgaagaatttaaaactacagtgagcagaaatttggactcataagtcaacaacagtcaaagacatatttatccaaatgtgtcagtttataaaattccaaaaatttggaatctttaattaattgtaaattcatgtttaattaagtgtttcttatcttatgtattaattaaattattgttgcccaattaagagataagaaaaatgtgtacgtaactaaatgtttttcagctttaaatgtacctttatttctgcataagttatcatcctataatatataaatttgag

SEQ ID NO: 9077 - DNA, 491 bp, Solanum tuberosum
  Predicted polypeptide sequence is orthologous to G1789
ttcacgtttcatacttataaaaaaaaaatgacatcaaattcactcactgcttggactccaatagaaaacaagaaattcgagcaggcactcgcggtctacgacaaggacacatctgatcgctggcaaaacattgctagatacgttggtgggaaatcagttgaagaagttaaacatcactatgctatccttgtagaggatcttaagcacattgaatctggtgacgttccattcccaaaatacaagtcaggtcgttagtctattacaggcgtacgaggtataataccagtcaaagtcaaagatatgtggacgaattacatacgtggaaagacatatttttctctcaagattatgaatacactaagctattattttcttcttagatctagtgagatgtgttagtgttatcattgtataaccctgattattatcgtttcgaattaacgagcataatataattttatggacgctacgtaaaaaaaaaaaaaaaaaaa

SEQ ID NO: 9078 - DNA, 962 bp, Solanum tuberosum
  Predicted polypeptide sequence is orthologous to G1804
aaatgaaggagaatacatagtatcttctttggttttgttctttgttcttcttcttgcaccaaaagaaaaaaaaaaactttgttttctaattttaagtttggttttttttttggttttgatgacatgttcttgagagacttaaaatcttggtggagctgaaaaaaataatcaagaaaaaggtcccttgttaaagatccgaaccgtagttaggaaaaaagttaataacatgggagtaccagagtcagagatggtgtcacaaagtgaggttcaatcaccattgcaaccagaccaaaaccagaacaagaacaacccgttcccgtccctcggtcgacaagcgtcgatttactccctcacgcttgatgaattccaacacactgtttgcgagagtgggaagaattttgggtcgatgaacatggatgaatttcttaacagcatttggactgctgaagaaaaccaagcccacgcccatgcccatgcccacgtgcacgctcagcctcactgccaggctgcaagtactggggaagcaactagcgcgccacgttttgcattagcacagggcaatgtttcgttggagaaagctattgttgagcagccaagcttgccaagacagggctcacttacgcttcctgcaccattgtgtagtaaaactgtagatgaagtttggtcagaaattcataagacccaacaagagcagcaacagaacaacgggtgcagcatacagaacaccggtaacggaagttccactcaacgacagactacattcggtgagatgacgctcgaggatttcttggttaaagcaggggtcgtgcgcgaacagggcaattcagcccctgcacctcctcagcagcaatcatatatgatgtatccaaacagtgcaaatcccactatggccactatggctcggcctgttatcggcctcggtggagtcacggggcggtgttggcatcggtgtcgccattccc

SEQ ID NO: 9079 - DNA, 878 bp, Solanum tuberosum
  Predicted polypeptide sequence is orthologous to G1808
cacccccctttagaagcgattttccggccatgttgtccacttttccggccactactctgtccactgatggcctttttccctatttatttccggcttttgatggcgggttcactccttgggaatgtatagaaccggcttttctattcccacaagaaatggaagaagaagaaccggttgtttcacccaaggaatccccacctcctgaaccggttattttaaactccgattcaggttctgatgactccaaaccgaattctgttcactctagttccggttcagatgacccgaaccggaataataacacgaaccgctgtcctgacgagaggaagcggcagcgcacgacatcgaaccgtgacatagatgagaggaagcgtcgacgtatggtatcgaaccgggaatcagcgaggcggtcccgcatgcgaaagcaaaagcatctggagaacctgcggaaccaagcgaaccggcttaaagtagggaaccgggaaataatgaaccggttacggttaattacttaccagtgccaagtggtccagtgtgagaacgagcgggtcaggaccgaatcggctatccttcggcaaagacttgagggtatacgtcaaatattgatcacccggcaacttgagcagcaatttaattcttattctgcatgggcatgcaataatatggaacaaagacctcattaattaatcacttggacctataataaatcatcattaaacgtgcttcttcctctaattagcaccactatataactatcagatgaaatgaagtcacaagaggattttctctctctcactctctatttcttgtaaattaaattaaaaggtgcgtataatagtggtaaagagatatagtaatatgtattgtagctactagct

SEQ ID NO: 9080 - DNA, 747 bp, Solanum tuberosum
  Predicted polypeptide sequence is orthologous to G1821
tggaaagcttggtgtttgtttgatttgaaggattttgcgtcaaaataagtacaagtcacaagcaatcactagttaaatactaaaaatagagaggtagcaaaataaacaaacagccaattggagacaccatttggctcacttagttcaaaagaaacattcctaaacattgcaaattaagtttcaacaacatcataattccttcagcagaaaacgtgatcactctttaccctcatttgcaagagaatcaacttcattatccacagtagacactgtagactgagaagttcttccatttgatgcatcctcttgcgtaaaaccgtcacccattggtggtggatgattcatatcaaaattagaagccagatgattgggcatgatgctgcagcctgaagctggatcaaccataggacgcttcaacaacaaaggctcctgtttcagggatccacccacaccaccattaacctcacgatagcgatgcaagtacaatgccaagggtttgatgtagtcatcaaaaccaaaatcattcaaggcagaaagcacattttcagccatgatgatcttgtgctgctcacgctggcaattatcgttggcttggcctgttacaaagcttataaactcagagacacactcttggatggacactttggattcattggataccttggcatggggaagaaggatcttgcgcatgattatgaccacgcttcctattggcatgaatgggtctttctcctgaatggggcattc

SEQ ID NO: 9081 - DNA, 885 bp, Solanum tuberosum
  Predicted polypeptide sequence is orthologous to G1850
ccagttttgttcggcagcttaatacttacggattcagaaaagttgtacctgatcgatgggaattcgcaaatgactgtttccgtaggggtgagaaaggactacttcgtgacattcaacgccggaaaatctcatcggcatgtaccgtcgtgagtgcggttgttgcaccagcagtagcggtgaatgcagcacaagcggtgacggtagcggtagcaccggctgtgaggatggtttcttcgtcgaattccggtgatgaacaggtgttatcatccaactcatcaccggcagctacggcagcggcgatgttaaggaccaccacgtgtacgacgacgcaggaacttatagaggagaacgagcggttgagaaaggagaacgcgcaactgaatcaggaattgaatcggttgagaagtttatgcaataacgtatacaatctgatgtccaattactcggtgaatccggcggatataccggcaagaataccggaaggacgagctctggaattgcttgacagcggcggtgcagccttcacagcggcggaggaagatataagcccacggttgtttggtgtatcaattggggtaaagcgcgtgaagagaagcaacgaagaagaatctgatacagttgaggatcaggatcaagtacaaccgcatggatcagacatggaatcagagccgttggattcaggaagcgctcatcatgatgatcaaccatggatctatcgattagatttagggtgatgatttgtcactcagaacaagtcagtcccttgtaggtggggtccacagaagcacttgggtgttgatgaacaacacgtgtacaatggaagattgttggttgtttctggtggtttctagaagaagtgagaaattgagtccaatggtttttaga

SEQ ID NO: 9082 - DNA, 1142 bp, Solanum tuberosum
  misc_feature (610)..(610): n is a, c, g, or t
  Predicted polypeptide sequence is orthologous to G1850
tcgaattttccaattatcttcccatctctccttgttcctacccaccccacacccacgcacctctatgtggcgccggaaacttctagaatcaccgaaaattccgacggtcgtctttctcggaactctgtagttttggctccagatctgcgagaatagaatcatcgatcttcactcaagtgataagaagatatgactccacagccaatagaccggaacggaggagagacgacggccggtgaaacgcagaggtccgtgccgacaccgtttttaacaaagacctaccagctcatcgaggatcaatctattgacgacgtgatctcttggaatgaagacggatctactttcatcgtgtggaatccggcggagtttgctaaagatttgcttcctaaatattttaaacataataatttttctagcttcgttaggcagctcaacacctatggatttcggaaagtcgtacctgatcgatgggaattcgcaaacgacagcttccggagaggtgaaagaagtcacttaattgatatccagcgtcgaaaggttgtgacagcgattgctactccttccgctgctgcaacagcggtggcgattgtggctgcgccaccacctccgnctgctcaacctccggtgacggtatctacctcggattcctgtgaagagcaagttatatcatcaaactcatctgcagggagcacagcggagcttttaggagaaaacgaaacgggtaagattggagaatttacaggtcaacaaagagttgaacagtatgaagaagcctctgcggcaatatatacggtatgatgtctaattacgcacaagctttcagcagggtaatcaacgccggggaagtattccgccgggtttaacccctgtcgcggtccgacggacgtccttgtaatcacagggtaggcggaaaagaacggaaagcctgtgaaccggggaaaatttcgctttcgaaggataacgcttagaagggaaaaaagacgactttcgttattttcgttcgcacgcagtgacaaatttttatacaccgcttcttcaaaacaggtatataaacacctgtgttcgggggaacacacgcttattttgtgtaacccactatataaatattcccacgactggggggaacaacactcctttaaaaa

SEQ ID NO: 9083 - DNA, 736 bp, Solanum tuberosum
  Predicted polypeptide sequence is orthologous to G1863, G2334
gaggatgctacacaggtacggaatggctcctgatgcggatgaccacaatttcttgccagtagcttccgcaagtgtgagaggactaggaggtacgggttctaacacagacaacatgtggcgtctgatgccatcacaagttccgtcaaaacccaatctgaaaaatgattcccagctgttgggtagttcacctaatccgtttgagcctgtgatcgaatcaaaacagcaaccccaacattgcttcttcagcagtgacatagattcacctggtacagtaaagcaggagacacagcatccaatgcgttcattctttgacgagtggcctacatccaaagaatcatggtccaatcttgacgagggatctggcaaaaataatttctccaccactcagctgtccatatccattccaaatgctccttctggattctcttcaaggagtgcttcttcccctaaatgatgcttaaggaagctgcggctgcttcaactcttagcagtctctggtgctatgcagaggaatggttgtcctggtgctaaactcccgacatagcagtaaaagcaagacgtgtggatcgactcatcaagttgtaacctctacttgtatgagcttacatgtactttttatattactggtacattcagtccttgcattgtgtttgtagttgtatttcaatttcaatactcttcttaagcaaaaatatatggctttacagacaaatgttgtgcacaagttgccataaaa

SEQ ID NO: 9084 - DNA, 889 bp, Solanum tuberosum
  Predicted polypeptide sequence is orthologous to G1863, G2334
aaaagttcaatcttcacattctgtttgggatgtcgttgaactgaaagctgacttaaacagtacgattataaaaggaaagtgtagttacatccacttgtcatacaaacatagctaatacaatgcaccttcatacatagtatgctttcaatacaaaagatggaaaaaaagtaacacaacaaagagaaaaatcaacagtgccacttgtctaatcaagtgctaacataactagcctctgacgtgctgccacgtggcaagtgatacaaaacgctcgttggcgatgagttggacatcgatgaccttaaagcctcggctagtggtccacccatcgatgccacttggttcgttccccacatggaacgttcaacgttatggactcgagtatcagagttgtgtctgtctcccgtagagagctttaacgagatgtcagacgagggatttccggccatcgaaatggagaggctggtggcagaagccattgaagtagcattttcattttcttcaacttgttgtctaggccaatcatcaaagaaatggcgaaggatttggccattggatttactatcattttgggcttccattggaccttttttctcaattatagattttgaaggcctttgattgagttgaagtagatcaattgaatttgcatgtccagatagagcaaattgaggagtaaccccgccatgacttgccatggcggggttgactttaaggacttcattgccgcccctggctgctcgtggctgcattgcagccacgaggggcggtggttgtggggatttccactggctttcttgaacggttcttaccacgatggacgtggcgttcacagtacttatgtccactcacaacatctctttgacatctccatttcttcccatcagttctt

SEQ ID NO: 9085 - DNA, 833 bp, Solanum tuberosum
  Predicted polypeptide sequence is orthologous to G1863, G2334
aagttacatatttaaccgatcaatcaaaataacagtaaagttcaccaaagtgcacaactttggtatcaactcaaaccaataataaacacaccacacatcccatgcaaatttgtacaggtgatagttagggacatcaataccacaaaagaacaatgaacaacaacacaaccaaggaaaaaaaaaacaataaagtccaaaaaaaaaaacattttttccatgaaagatcaaacaagaacacttgcaaaaatcaagtgctaatatagctggcatcggacgtgctacctcgtgccaattcatgcaacacgctagtaggggacgagttagtcatcgatgaccttaaggcctcggcaagtggcccacccatcgaggccacttggtggtgactcgtcccccatgtagactgttcaacattacttacttgagtccccaaatcatagtcattcccagttgaaagcttcaacgaaaagtcggacaaggggttaccccctcctccaccgggcatcgaaatggacaggctggtggcagcattgtcaccttcttgaagttgttgttgtctaggccaatcatcaaagaaatggcgtaggatttggccactagatgatttaccatcaccaatagatacatctttttggagtacttcttgtggtggacccttaattggcctttgattgagatgaaaaggtgcattagtggaaggtgaatgcccagatagagaaaactgaggagcaccagcagcagcatgtccaagcatttttccaaaggcttgatgatgagaaacagtatggtgggggttttaactggccattgtgtggcaggtgtgggaatttccacag

SEQ ID NO: 9086 - DNA, 695 bp, Solanum tuberosum
  Predicted polypeptide sequence is orthologous to G1888
gaagatccagtgtgatgtgtgtaacaataatgaagcctctgttttttgtgttgctgatgaagctgctctttgtgattcttgtgatcatcgtgttcatcatgctaataaacttgctagcaaacatcaacgtttctctcttattcaaccttcacctaaacaaatacctatttgcgatatctgtcaggaaagaagggcttttttgttttgtcaacaagacagagcaattctatgcagagagtgtgatgtttcaatacacaaagctaatgaacatacacagaaacataatagatttctattaactggtgtcaaaatttcagcgaattcttcgctttatacttcatcagaatcagcaccagcaacttcatgtagtacgaatcaagattctgttacgaatttcaataagtctcaaatttgcacaaaaaagactttgcctgtttctggttctgttcctcaacaagtgtcagtggcagctaatattggggaaaatagttacacaagtagtatatcagagtacttagagatgttacctggatggcatgttgaagaattgctgaattcctctacaattcctactaatggtttctgtaagattggtgataatgatgtgtttccgatttgggatactgagattgagagcacaatgaattcattctcaccagaaaatttaagtatttgggtgcctcaagcacctccac

SEQ ID NO: 9087 - DNA, 872 bp, Solanum tuberosum
  Predicted polypeptide sequence is orthologous to G1888
atcccccggctgcaggtttcctctcacttatagcaacaatcttgatccatcaaaataaaagagaggctataatttaaatttaaatttgaattcaaatgaagattcaatgtgatgtttgtaacaagaaggaagccgttgttttttgtacagcggatgaggctgctctttgtgatgattgtgatcatcgtgtccatcatgttaacaaacttgctagcaaacatcaacgtttttctcttcttcaaccttctcctaaacaagctcctatgtgtgacatatgtcaggaaaggaggggtttcttgttttgtcaacaagacagggctattatgtgtagagagtgtgatattccaatacacaaagcaaatgaacacactcaaaaacacaatagataccttcttactggtatcaaactctcaggcaaactctgatctctactctggctccatcacaattacaatcacaatcaggcaatttcctccggcggatttgtgtgtttcaaatttaaagtctcagaaccccattagtaagcctgttgctgtgtctgtttctgtttcctccacgaatactagcaacactaagggaggagcagtatcatccggttgtgagaatccaggtgacaggttgttcaaacgagcaaagttgggtggatgttaataattaattgtgcaaattctggtgaatgggaggggggaaataacttaaacaaggtagtattatcccgatctttagcagaatgtttgcctggtttggcgcacgttaagaatttcctggaattgttcaactccctaactgtttaatccagcactattgggtgatgacgcaaagtgtcaattgggaaacgaactttaaaatcaattaattctttccaccccaaa

SEQ ID NO: 9088 - DNA, 614 bp, Solanum tuberosum
  Predicted polypeptide sequence is orthologous to G189
cagatcttgatttacttcaacagactgatcaactaatctaattaacaacgatcgagtttacattgattggaaaacccttcatcttttcaggggattaaagaaagctacacaatttttgattcctaagaagactctaaaatgagactacttgtttctgcaacagaaagtgaatgattatgttctccttcatatgtaacaatcagcatagttggatcatccaatgctctttcaacatgtttacgtgctggacaacctcttacactactacacttgtaatatcccctgttcatagcaataataataataatttagaatccaacattattaaacaaattcatgatcaattagctctaaatataccttggatgtggtgatcctttgattggcttctgtccatattttctccatgagtaatcatctggtgggatatctgacagtttcatgcttattgccggtactcgaactaccctcttcagccttaacttccttctcttggaacaatggcatcggccggaggatccactgcacttcccagatacggcattttccgataaactgcactttcgtttcagtgaagaagaagacaatggaggctttccggcagaattagagac

SEQ ID NO: 9089 - DNA, 1132 bp, Solanum tuberosum
  Predicted polypeptide sequence is orthologous to G19
ctttcactcaaaaaaaaaaaggaaaaaattaagagtaacaaaagatgtgtggaggtgccataatctccgattatgagcccgccggaaacttctaccggaaactctctgctcgtgacctgtgggctgagctggaccctatctccgactactggtcctcttcctcctcatcctcaactgtcgaaaacccttattccgctcagtcgccggtgactcactccgtcgataagcctaagaaatcagattccggcaaatctaatcaactcaaaaaaggtaataagactgtgaaggttgagaaggagaagagtactggaccaaggcagagaaagaacaagtacagaggaataaggcagagaccatggggaaaatgggctgctgagattcgcgatcctcagaagggtgtccgtgtttggcttggtacattcaacacagcagaggatgctgccagagcctatgatgaggctgctaagcgcattcgtggtaacaaggccaaactcaacttccctgccccatcaccacctgctaagcgacagtgcactagcactgtcgctgctgatcctccaccagcactactccttgagagttctaacataatatcttataacaattctcctttaatgaacttcggatatgatgttcagagccaaactccctactacccaatggaaatgcccgttgctagtgatgattatgaactcaaggaacagatttccaacttggaatcgttcctggaattggagccagcagattcatctgatcagttttcagggatcgtcgatcctgatcctcttaatgtttttctgatggaggattttgcttcaactcagcatcagttctattgatcctgagttgtttggtgagtgatgagtgactagtttattagcttttggctgtagtagtagtaatagagaaaaaagtacatatgatatgataataataagttgcgtgccttagcctgcaattgtaatagtatcaatgtttgttgtcttgtgttgtttatgctttctaaatcttggatttaccttataatgtttggtcatttggtgtatgtattgtaactatatatggagtactttattactaaaaaaaaaaaaaaaaaaaaaaaaaaaaaaaaaaaaaaaaaaaaaaaaaaaaa

SEQ ID NO: 9090 - DNA, 1138 bp, Solanum tuberosum
  Predicted polypeptide sequence is orthologous to G19
attcggcacgagaccaaaaccaaaaccaagcttctctcttgttataatatatatatatataaaaaaaactcgacctttgtacaaaccatttttcatatctgtatcaatctctttgtttctgccattttgagtaaaagagtttaaatcacactaaaatgtgtggtggtgcaattctttatgatattattcctcgtgaccgccgtttgtcatccaccgacttatggccaagctctgctgatttctggcaaacttcttctttttccaagccaatttccacccaaaatgttcctcccaagcctaaacgagctcaactctctagaggtagtgagcagatgaagaagaggcaaaggaagaatctttacaggggaatccgacaacgtccatggggtaaatgggctgctgaaattcgtgacccgagaaaaagggttagggtctggttaggtactttcaacactgctgaagctgcaagagcttatgatagagaagctcgtaaaatcaggggaaagaaagctaaagttaatttccccaatgaagacgacgaccactactacagtcatccagagccgcctcctttgaacattgtttatgaatcttatgatactactagtacttacaatcaagaatcaaataactgttaccccttccactcaatcgaaaacactgaacctgttatggaattcgcaattgctaacaaaaattcatctgggtctgcttataatggaattgaagatcagaatgtggaaggagaagagcagacggtgaaaaattcaaataacaggatcgtagaggaagaggaaaaaacagaggatgaagtgcagatactttctgatgaactgatggcttatgagtcattgatgaagttctatgaaataccgtatgttgacgggcaatcagtggcggcgacggtgaatccagcggcggacaccgaagtgggcggtggctcgatggagctttggagttttgatgatgttagtcgtctacaaccaagttataatgttagtttgattattgttttgtttaaattgttgcatctttttagtttgctgaattagaactaattgagtttttgtaatttttaatcaattgtgttgaaactatatttttahttcattactctattaaaaaaaaaaaaaaaaaa

SEQ ID NO: 9091 - DNA, 677 bp, Solanum tuberosum
  Predicted polypeptide sequence is orthologous to G194
gtgaaaatggaaagctacaaagacattaaaatggaagatcatcacccaatgtatttcattgacaataacaattttggagttactaaccattcattaatctcagattacaacataaacacatcgtctttgggtttcatggagttattgggttttcatcaagacttttattcatcagcttcagcttttgagttaccaaaagaagaaaactactgtcctgcagtttgtgtatctgaagaagaagaagtaaagccatcatctgtagtgcctgagaaccaaataattagtagtactactgtagctacaggtaacgtattgaatacgccatctacccctaattgctcctccatttcctctgaaggacatggagatgcagatggagaagtagaaaatcatgagcaacaaaacacaaagactaaacaacagttgaaagcgaagaaaacagttagtcagaagaagcagaaagagccgagatttgcgtttatgacaaagagtgaggttgattttcttgaagatggttatagatggagaaaatacggacaaaaagctgttaaaaacagtcctttccccaggaactattatcgctgcacaaatgcaacatgtaatgtaaagaagagagtggagcgatgtttcagtgacccaagcattgtggtgactacctacgaaggaaacatactcat

SEQ ID NO: 9092 - DNA, 989 bp, Solanum tuberosum
  Predicted polypeptide sequence is orthologous to G1944
tgatgcaccatcagattaccatgtggcacctaggaccactgaaaatcccagtcaagtttctggatcagcacctcaaataatgactattgcaccaactccggccaccggtgccggcgccggagcactggcgttagtgaagaagaagagaggtagaccaagaaaatatggaccagatggagttgctgtaccgtctacggcggcagcgctttcgccgaagccgatttcgtcggcggctcctgtgtcgtcgccggtgattgatttctcatcggagaaacgggggaaaatccggccggtcggattagttagtaagcctcatatgcctaagttggaggttgaaaattcaggtgaatgggtctcatgctccgttggtgctaattttacgccccatattatcaccgttaatactggagaggatgtcaccatgaagattatatcattctctcaacaagggcctcgagcaatatgcattctttcagcaaacggtgtaatttcaagtgttacactgcgtcaaccagactcttctggtggcacattgacgtatgaggggaggtttgagatactgtcattgactggatcatttatgccatccgagacaggaggaatgagaaacagatccggaggaatgagcgtttctctagcaagccctgatggacgtgttgttggaggtggagttgcgggtctactagttgctgccggtcctgtccagattgttgtggggagcttccttgctggaaatcaacatgaacaaaagacgaagaaaaacaaattggagcctataacagctgctgttgttcctctatctagtccagatattgaagaaccatataatcagtcttcagcaaaacctactatgcccgcttcctcgattaactggtcatcatcgttggcaactgagtcaagaagtaagacagctgacatcaacataacgttgcctgcataggagtccgtccgtcccttttctattgatctcacatccatttgttgtttaa

SEQ ID NO: 9093 - DNA, 925 bp, Solanum tuberosum
  Predicted polypeptide sequence is orthologous to G1944
caaagtacaaaatgtggcatttaattaagaggatgaatatgcctgttaaaactagacataaaccattaaaacactaagaacctagaccgttgtaaccttcgtaaccaaagcgtcacgaaaacatcataaatctaaaactctacagccaaacaccagaatagcaaaggctatctagaaaactagtttggattactgcacagagacctcaaacaaacatcaaataggaggtgagaaagatcaataggaacctcgttaaagacgcgtagtccttatggtctagtaaaatcacattcaaatttcaccctatgctggaagagttacatttatttcagctggtttattcctagaatcaggggctgaccaattatctacgcggaaagaagaggaagttggtgtagtttgttttactgaggagtgataagggtcttccgtctcgggtagaggaacagcagcaataataggctccggtttgtttttcttggttctctgttcatgttggtctccagcaagaaagctgcctataacaatctgcacaggactggcagctactaatagaccggctactccgcctcctacaacacgcccatcagggctagctagagatacactcattccaccagatctgtttctcattcctccagtttctgatggcataaatgatccagtcaaagacagtatctcaaaccggccctcatacgtcaatgtgccaccagaggagtctggttgacgaagtgtaacacttgaaattacaccatttgctgaaagaatgcatattgctcgaggcccttgttgagagaatgatataaccttcatggtgacatcctctccagtatttacagtaataatatgaggtgtaaaattagcaccaacagagcatgaaacccattcacctggagtttctaaatcaactttaggttgctgatgt

SEQ ID NO: 9094 - DNA, 970 bp, Solanum tuberosum
  Predicted polypeptide sequence is orthologous to G1944
aatttcaccaactctctcaagaaattttgaaagcacaaaaaaaaaaattaaaaaaaaaaaaaattctttccattttcataaaattagtttgttcttttaagttctgttctttcttctgcagtaacagagtatcagttagtcattagatttgcactgcacatggtcagatgatctttctttagatacaattaattctagcatttgcagatttgctgagtttgtacttctcttggtattttgcttgttatatattttagcatttgaaaaaagattgtatttttattagtatttgttattatggggttttgagttcttgaaaaacaaatatatttttgctgttttgggagcgtaagttatttggagttgtcttaagggtttaaggggttttgagttcttgagtacaaaaatctttttgctgtttttggggcttaagttatttggggcttaaggggttttggttattttattattgtgtatatgcatggaggagaaagaaggagttaatagttctggggttacagttaaaggtgatgaagctcctgagagctacagagtggttcccaggagtgaaagtaataatattgagtttagtggatcaattgtagcaacaacacctgtaaatgtgacagaagagacgaagaagaagaggggtagacctaggaaatatggaccagatggtaaaccagccgttgcattatcaccaatgccaatatcagcttcaattcctcttgctggagatttttcagcttggaaaaacagtggaagtcgccccgttgattcctttaagaagaagaacaagtttgaggtcgaaactccaggggaggagatggcatactctgtcggtgcaaattttacaccgcatgtgatcactgttaatactggtgaggatgtcaacatgaaaataatttcatttgctcaaacaggatctagagctatttgtgtgctggctgcaaatggtgcaatttcaaat

SEQ ID NO: 9095 - DNA, 963 bp, Solanum tuberosum
  Predicted polypeptide sequence is orthologous to G1944
tggtgacaaaaagaaaagaggaagaccaagaaaatatgatgctgatggaaatttaacacctcaatatataaaagctgctgctgcagcagctgctaaagcagcagctgcagtaggaagtggtggtggcggtgtcgtcggcggagctgtcacttcacctggaggtggtggagtgacatcgccgccgactggttttactataacgtcgccggtactttcttccggtggcttttcttcatctaaaagaggacgtggaaggcctactggtgctggtaacttgcaattaattgcttctttgggtgaactgtttgctcacactgctggaggtgattttatgcctcatgtggttactgttcatactggagaggatgtggcaggaaaggtatattcttttgtgcagaagggttcaagagggatctgtgttctgtctgcaaatggtgctgtttcgaatgttacgattcgtcagcctggttcttctggaggtctattgacatatgagatggtggttggaagtttcatgccaaacgcttttaaaacacacaacaaaaggaagcatcatcagatcgaaccaagaatgcctccagtcatccacagctctccggacccggtttcaatgataagacctgtctcacaagcaccaccggcgagcaacattactcagactcagacatctcaaataccaatccacaaccacggtgaagctgacaacagcacgagcaacaaagacatgccgaattccacctctacagacacttctgactgtaatggatctgaaccaacattcgagcagagatcatatccagatattaacgtgtctatacctatggagtaaagtaaagctcgacgaatcgaaccaaaacttgactatagttcttttctgcttagctgattccttgttttgtgcttgtctgtgctgattgtaattttgaggaatcattagggactgctttattagaaacttttttt

SEQ ID NO: 9096 - DNA, 888 bp, Solanum tuberosum
  Predicted polypeptide sequence is orthologous to G1944
atttctttctctcttttttttcttcttttttcagtttgtaaaattttgatctgtgacatagaaaagtttgcaaagcattaatagctgctgaaaaaaatggagtcaagggaagctatgaatgctggagttacagtgatagctccagaagctccatcaaactatcatatggcatcaagaacagaatctactccgttaccacccggaacattggctgtgattacccctccggtagctactgcctttacaattagctcagagaagaagaaaaggggacgtcctaggaagtatgggcctgatggggcagttgcaaggacaatttcacctatgcctatttcagcatcggcgccaccaacctccggcaacttcttgtcggagaaagtgagtgttgcccgtcctgcttcggagaaaaagcctcgaaacaaagttggggctgaaaatttaggtgaatggatttcatgttccacaggtggcaactttttgcctcacatgatcacagttgaagctggtgaggatgttaccatgaagataatctcattttctcagcaagggcctcgagctatttgcattatttctgctgttggtttgatatcaaatgtcactctacgccagccaaattcatcaggggggaactttaacttatgagggtcgatttgaaatcctttctttgtctggatcctttactccaacagagtttgggggttctcgtactactagcaaaaccggaggaatgagcatttctttggcaagtcctgatggtcgtgtagtcggaggtacacttgcaggactgctaatagctgctagtcccgtccaaggttgtaatgggaagttttctaaccaaagcacttaccaagaagggccaaggccaaagaaaacaggaaaggcagaaac

SEQ ID NO: 9097 - DNA, 246 bp, Solanum tuberosum
  Predicted polypeptide sequence is orthologous to G1950
gctctctccgtaacgaagatgctcgttctctccttcacgtcgccgtctcttccggacacactgaggtctttcaatctcacctcaatttcagttttttaagggcttccgagccccctttggcgaaaaattatattgtaaatacaacgtcaaaattatttattatgtatatatagtagatattgaatctcgtctgtgtatttagttcttcatgtttttgaacacctttatgcaaatactggttcggct

SEQ ID NO: 9098 - DNA, 653 bp, Solanum tuberosum
  Predicted polypeptide sequence is orthologous to G1950
gttgagagaggatttgttgatattgcatgggcacttgtagatgctgctgctgatccttcaattccggacgaaaactctctcacaccacttcataaagctgttaaactgcgcaatcacgacatggtggataccttactatcggtcaacaccgaaactgaagaatggaccaaagttaacgccaaaacaagcgaaggtgccactccactttattttgcttgccaccttggtgatatccgcttggtgaaatctctggtggagtttggagcaaatgtcaaccttgcttccaatgagggggtgactccactacatcgtgctgttgctggtggtcacttagaggtggtacagtttctcatagagaatagtgcaaatgtgtctgctgaagactctgcccgccgcacttctgttcatcttgctatccaagcaggatccaacgaaattctttctgctttacttaaacacaaacctcgcatcgagggtgattcccctttgatgactggccttctaaaacgcgctaaacagcgtcaatttgccgcaatcgttcagttagttcatgaatactgtggtttagaccaataacacgttcatttcaaaataccgaaacttgtacattatcaacccgagaaatttgtaataaacattgccattttttgtcc

SEQ ID NO: 9099 - DNA, 716 bp, Solanum tuberosum
  Predicted polypeptide sequence is orthologous to G1950
gctactaacactctaccgtccgtacaaatcccggcgaaaatggaatcggaaaaatcctcagctcaaatcaaagacaaagatttgttcaaagctgctgaatctggtgattcatcgctcttcaaatcacttcccgaagaacagctcctcaaatccctctctctccgtaatgaagatgctcgttctctccttcacgtcgccgtctcttctggacacactgaggtggtgaagatacttgcagctgctgatccctcagtgagtggtataaatagtggtgatgaagaaggttgggtgccgttgcactctgcagcaagcagtggtaatgtggaaattgtggagattttgcttagcagaggggctgatgtaaatctgaaaaatgatggtggccgcactgctcttcattatgctgctagcaagggtcgagcgaaaatagctgaacttttgatttcacatggtgctaagatcaatgcaaaagacaaggtaggatgcaccccattgcatcgtgcagctagcactgggaactctcagctgtgcgaactattaattgaggaaggcgctgaagttgatgaagttgacaaggcaggggaaacacctttgatgactgctgttgtatgtggcaataaagaagtagctttgctcctcataagacatggagcagatgttgacgttgaggacaagaagggtacactggtcttggtcgagcttctaatgatctctcg

SEQ ID NO: 9100 - DNA, 881 bp, Solanum tuberosum
  Predicted polypeptide sequence is orthologous to G2
aaaagtattcctagtaaaatatttggcttctctatgattgctccacctaataataataataacgacgataacttatcgtcggagagtgaaccgccggttacccggcagttttttccggttgatgagtcggaaatcggaagtggcaattttaatgatagatcttgtagatttccaagggcccattgggctggtgtaaaattctaccaaccggagccatcgacagcagtattgggaaagggtagtgagttgtcgcaggtgcaggtgcaggtgcagccaatgaaaaaaaagccggcgtggtccaaggtctagaagctcacagtaccgtggtgttactttttatcggagaactggccgctgggaatcacatatatgggattgtggaaagcaagtttatttaggtggatttgatacagcacatgctgctgctcgtgcgtatgatagggcagcaataaagtttcgtggagtggaggcggacataaactttaacctggaagattatgaggaagatttaaaacagatgaagaatctaacgaaggaagaatttgttcatgtactgcggaggcaaagtactggttttccgaggggaagttctaagtatagaggggtgacattgcacaaatgtggtagatgggaagctagaatgggccaattattgggcaaaaagtacgtttatttgggactctttgatactgaaaatgaagctgccagggcttatgataaagctgccatcaactgtaatggcaaggatgcagtcactaacttcgatccttgcatttatgaaaatgaacttaattcatctgaatctagtaataaagcagcagatcacagccttgatttaagcttaggtagctcgagctcaaagcaaaagagccgagaaatgg

SEQ ID NO: 9101 - DNA, 893 bp, Solanum tuberosum
  Predicted polypeptide sequence is orthologous to G2
gaaacaagtttatttaggtggatttgatacagcacatgcagcagcgcgtgcatatgatagggcagcaatcaagttccggggagcggaggcggacataaactttaccttggaggattacgaaggtgacttaaaacagatgagcaatttaaccaaggaagaatttgtgcatgtactaaggagacaaagtactggttttccaagaggaagttccaagtatagaggagtcactttgcataaatgtggtagatgggaagctagaatgggacaattcttaggcaaaaagtatgtttatttaggcctatttgatactgaagttgaagctgccagatcttatgataaagctgctatcaagtgtaatggaaaagatgcagttaccaactttgatcctagcatttatgaaaatgaagttaactcaaccgaatgtagtgataatgcagcggaccacaatcttgacttaagcttaggaggttcaagccaagaaatgggggacaataggggtcaaaattcttcatctaatttgcaattggatgtccattggggccaccaagggtcatcaaggcttaataagccacgtagccaaatcaattttgatggccaaaaaagaagtggatataatgagactgaaacattgcaactcttgagccaaacgcaccttaattcgtcaggcagagtgcaaccaaatattaatgaaatgcaaaagtttggcgaatttattagagatggtgaaacacatatggttcaagcctatccccggcaattcaattcatatcaagttcagacttcgagcaacaataatgtaggccaaattggggcaacaagtaattctcaagaatggcaccctaattatgagataattacaactgctgcagcatcatcaggattcccccagcaga

SEQ ID NO: 9102 - DNA, 939 bp, Solanum tuberosum
  Predicted polypeptide sequence is orthologous to G20
gatctctcactctgcttcaaatgctgctctgattctctgtttactagagtttcagcttcattaatattctttctgctccaggactgtgttgcttatggcttccccttcctctgagcctactgccaagactgagggtagcagtggcaatgatgctggtggtggagaaacatcagaagctatggggcatatagggactgatcaactgttattatatagaggactgaagaaagcaaaaaaagaaaggggttatacagccaaggagcgcataagcaaaatgcccccatgtactgcagggaagcgcagctccatctatcgcggtgtcactaggcatagatggactggtcgttatgaagctcatctttgggataaaagtacctggaatcaaaaccaaaataagaaaggaaagcaagtttatttaggagcatatgatgatgaggaggctgcagcaagagcatatgatcttgccgctttgaaatattggggtcctggaactctcattaatttcccagtgacagattacacaagggacctcgaagagatgcaaaatgtctcaagagaggattatcttgcatcattaagaagaaagagtggtggtttctccagagggatatctaaatatcgtccgctatccagtcgatgggatctgcaattcggtcgtgtgcctggagctgattactttaacagcctgcactatggtgataatgccacagtggacaatgagtacatcggtggtttctgcatggatagaaagattgacttgtcaagttacatcaagtggtggggaggtaataaagctcgtcaaacagattcccatctgaaaatgtcggaggaaacaaaggttggctgtcctggagatattgataatgagcttagggcttcagaattatcaattcagcaaactgaaccatatgagatgctccgttttgggtgtgtaccaag

SEQ ID NO: 9103 - DNA, 798 bp, Solanum tuberosum
  misc_feature (523)..(523): n is a, c, g, or t
  Predicted polypeptide sequence is orthologous to G2011
ttccagaaaaccatacaagaatcaaaaaaaaaaaaaaaaaaattaaaaaaattaaaatggagcttcaagagaaaaactccaccgactttacacagttgttttcaggagatatttcttggtttgtatgtcggcgttacctatataaacctcccttaaacccccttttaccggcttattatcaaacacccttttcgaaattttcaatcttttgatccaaaaaaactataaagtttcaatctttgatccataaaaccacaaatctctttgtatcatatgaacccatttgataaaaaacaagaatctgatactaatacaaaaaccccctttttgactgaaatggactctgaatttgctgcgttttcaccaatttcactcccttttgctgacccatcttctccttttatcaattttggatcttttgccactcctttgagccaacacccagttggagatggagatggagatggagaaggagaaggaggagaaattgaacagccagctgaggaaggattgggtgtgccanaccctatggagtgtttacatgggatacaaattccgccatttttgtcaaagactttcgatttggttgaggaccctttattggattcgattatttcttggggtagaaatggagaaagctttgtagtttgggatccaagtggagttttcaagattggttcttcctaggaatctcaagcacagcaatttctccagcttggtccgacaggttaatacatatgtggggtataaattttagcacacttggcaattttcttcggctactgtgttaaactctct

SEQ ID NO: 9104 - DNA, 820 bp, Solanum tuberosum
  Predicted polypeptide sequence is orthologous to G2011
ttttttttttttcttttcagtcgaaagtaattatcaactaaaatatttataatcactcattcaatattatgtcccatcaactaaatgatggctagtatcccaatggcacactgaaggcccaagggtactctttcctaaaaactatcattcttgggctggttggcatggctttcagactgaccaaaaggagacccatcagctggccacttatcaaccccagaacttccagctgcctgcaagggatctatatcccacaaatctgacaaaccagagctaacaccgaagtctgggacatagctgctaaaactatcccataactcggcgccagcacttggcatgccagcactggcttcaaaacccatactccaaagttcctcgtctttcaccatacttccaatatctggtgaggaaaatcctgaaatgtttttttccttccccatctcctctggaaaagaggcaaagtactcaggcataacttctaattgaggactagctacattcttccctttgaaatgagagccttcggggttaaagaatgaagctcctcctatttcccgatctgaacaattaaaaagttcatgtgctactgtcagtccctcagatgcaacagtaccaccttcaaaaggcatggcttccactcctaaaccagtttctgggagttgttgatccacaactggattgaatctgggttctcaaaccatgctgcaagggtcttgaaagtcagacctgaccttgactatctgccctttccatggaagaacgaccccactccatcccggaccatgtggctgatgttaacaaatttccttcattgttcttg

SEQ ID NO: 9105 - DNA, 778 bp, Solanum tuberosum
  Predicted polypeptide sequence is orthologous to G2057
cttttttccaatgggttcttcaacctcaggtaactcttcagctatgcagttccacagcttccaagaaccccatatgttgtcaagaaccaatagccagaaccaagatttgagtctctctttacagtttcaagatcctattttgcttcaccaccaaaaccagcaagctcaacaccataaccaaactaaccatagggaacaagagcaagtgcaggttcaagcaccagcccacttcacaggaaacaccccacttgggtttgacacctctggctggtctatgcatcagagacttggttcttggagtgacagtagagacactggccctggtggtagtggtggagcagtaacaggacctggtgggtacttgttcaattcgccaccagcaccggcgctgctgcagcagctattcggccaaaatcagtttttttctcagaggggaccccttcagtccagtaacacatcttcggttcgagcatggatggacccatcaactatagcaattgcctcaggtgatccaagtcatcaccatcaagctgttttgccaatgtatccatcaacaattcctggttatggatttgcctctgaagtaggcgaattctctgggtttcgtattcctgctcgaatccaaggtgaagaagaggagcacgatggcatttccgataagccatcctctgcttcctctgattctcgccattgaattagctccaaaaatttgatctttctcaaaatccctgacagggatatgctctacttgaatgcaattggacattacagaagtgat

SEQ ID NO: 9106 - DNA, 879 bp, Solanum tuberosum
  Predicted polypeptide sequence is orthologous to G206
tttgctcataattcaggcaattctaacatcaactcattagatcttgtaaaaagatcatcccaaaaccgaattatcattaaagctacaattaatctggtaattatcctccattaatgacaaatcaagataattgtcatcgaccggtgcccatactacctcggaccaaatatcgtcagcaacttctaacaaattatccgacattatttgatttctcgattcagaactcgttgcaattgtgtttgaatatgaatattcacttgatgatgatgttgatgatgatgaacttggttgttgctgaatctcggtgtttattttaggacttgatatttcggaattattatccttagaattgttggcctcctccaaatgtatgtccacatttgaattttcgggctccgattgtatatctggaatttcttgaggctgagattcattcatttttttcttgagacgagtatgccaaatattttttatttcattatctgttcttccgggtaatcttgctgcaatagcagaccaactgtttccaagaacttgatgcaactttataatggtatcttcttcttgatgagtaaaattgccctcttttcaggtccctgagagtttgaggccccatattagctgttggaaccccaaattttcggtccatagtttctccgaaaatgaaactgtagttgtgcccaagttgaaaaccatctgcagatatggacattgccatggacatggcttctgagctgctcattgatacaaaaatgatacagcgaaaaacatattgcaagattaaagggagagttgctcattgagcagggaaagtatcggtgtgtcttaggaaacaagcaagtgctttcttcaacaaggtaggccattgctatttctggg

SEQ ID NO: 9107 - DNA, 753 bp, Solanum tuberosum
  Predicted polypeptide sequence is orthologous to G2071
cacgaggcaactgtggaatttgcatcacccttgcaattaggagggagcccattgacaaggcctcccatgtctaatccgtctgcaaatactagtagtgtcatgcagggtggtgttatgaccatgccagtaaaaggagcatcccctggaaatattgatacatcttctctttcaccttcaccttatgcatgtggtgaaggtggaagaggaaggagatcatgcacctcttttgaaaaagttgttgagagaaggcgtaagaggatgataaagaacagggagtctgcggccagatcaagggatcggaaacaggcatatactttagagttggaagctgaagtggcaaagcttaaagaaattaagcaagagttgcagaagaaacaggctgaatttatcgagaagcagaaaaaacaggtatagacttctttcgtgctgtcaatatcttgtatgaattatgatctacttattcatgggactagatgcagggatattgtaaattaaacaatctaagcaatagaattagcaaatgaaataagggcagaaagtagataatttactaatagcaaaatgattaaagcttcagatggttgttccatcaattgcctaagtgaatggagtagctgtacaacttttctatagaagtcatcagctggtaagacgtgataacttcgcgaaagagactgtctgtgtaagtgatttgttatgcccaagttgttgactataggtcaaatgatgttttcataactaaattttgggggt

SEQ ID NO: 9108 - DNA, 954 bp, Solanum tuberosum
  Predicted polypeptide sequence is orthologous to G2071
gatctaaatcagcgaagaagaaggagacgacacgctgctgctctttccttgctgctcccttccatttcttctgcacatacaaggatattcaaataccctttgagttctagtatcatgggatcttacatgaatttcaagaacgatgctgacacgccacagctggagagcaacggggggaagtcaattggtaatggtgatttccctttggctaggcaatcttcgatatactcgttgacgtttgatgagcttcaaactacatttagtggccttggaaaagattttggatcaataaatatggaggaactgttgaaaagcatttggacagctgaagagtctcaagctgtgacatcttctactggtggagaaggagatgggaatgcacctgtaggaaatctacagaggcaaggttctttgacattacctcggacacttagtcagaaaactgttgatgaagtatggagaaactttcaaaaagaaactacggtatgtaccaaagacggaagtgacactgggaaatcaaactttgggcagaggcagtctaccttgggagaaatgacattggaggagtttctagtgaaagcaggtgtagttagagaagatatgcaatctacttcaaactcaagtggtattacatttaacaatggtttaagtcaacagaacaacaacaatggtttcaacatagcatttcagcaaccaactcaaaacactggactgttaattaatcaaattgcaggcaataaaatgttgaatgtggttggtcccacagcctcacagcaacaacaacctcagaagcaacagcctcttttccccaagcaaacaacagtggcatttgcatctcctatgcagttatcaaacaatggtcacctggttagccctcgaacaagggctcctgctggtggaatgtccagtccttctgtaaatgctaatatgtctcgaggcggagtatggagatga

SEQ ID NO: 9109 - DNA, 844 bp, Solanum tuberosum
  Predicted polypeptide sequence is orthologous to G21
tagaaagaaaagaaaagaaaagaaaaataaaatcacaatggaagatcataatgaattctccatctctagttctactacaacttcatcatttacaagttgttgttctaataacaattgtttaagttctacttcaacttcttctacttcatctaattgtttccatgagagcattgcaaaaacctcaccaaatgatcattacaagtgcaaatccaagaaaagttcaaaaaaaattcaagatgggaatgaggaggaggatgataacaagaaaatcagacgaaaaaatgaaggtgttgttgatgaaaaacatccgacttatagaggagttcgtaagaggaattggggaaaatgggtgtccgaaattagacaaccaaggaaaaaatcaagaatttggctagggacttatcccacagctgaaatggcagctcgagctcatgatgttgcggctttagccatcaaaggggattcggcttaccttaatttccctcatttagccgatcaactccctcgacccgcttccacttcccctaaagacatccaagccgcagccgccaaagctgcagccgccaacatatttctagaggagaaaagccaattaaccgagctgcatagctcgcattcctcgactaatttagcctcgcaagaattactgaattctccatcaatggatcacgatgaccccttttttcgatctaccggatcttaccatcgataggagtggaccaaaacgaccggtaccagtacccaatttcgacgtggcagctggttggagccgatagcgggatgtttcgggcttgatgagccgtattgtgggagtgctattagacgagaattacaagtgtacatg

SEQ ID NO: 9110 - DNA, 816 bp, Solanum tuberosum
  Predicted polypeptide sequence is orthologous to G2107
gaaaataaattccacaaactctttatattgactatgtcctccccacttattcaatatgaaaatggtgaaaaaataagaatatattagttatagtttattaattctaaatctagaaagacagaaaatatattgaacattctgagtatagatgatataggtgctggtaattagatgaacttgttcacttgtttcattcaaataattactacacatgtatacatttgtaccatcgtaggaaactaataaaatctcctaaatatatccttatttatatagaataattccataaagacatataagtgtgcacatcagctaattccacataatgatctccgatctctaaacattggggaggaggtagcatgagtccttctgccatgttcgcaattaatcctggcatgtaaaagagcgcttcctcatccatgaacaaactactctcctccttcataaaaaacgtgttttctagcgtttcaggagtagtgctacattctcctgaaacttcttccgactctggtcggaagatttctgcagcctcagcggctgccttttgaatatccttggagttagaggaagccggaataggcaacctccaagccgaatcagcgaaattcaagcaagcagaacggcctcttaatgctaaagctgccacgtcatgagctatagctgccatttctactgtgggggaagtaccaagccaaatccttgatttcttatttggttctctaacttcacaaacccattttccagaattccctcatctgactcccctgtatactggatgtcgagtttctcgaaacttcttccctgcagctggct

SEQ ID NO: 9111 - DNA, 922 bp, Solanum tuberosum
  Predicted polypeptide sequence is orthologous to G2144
tactctttctgctaaactatggctatcagtggcttggcctcgacgcgctcggacatgaacatatggtagcttctcgccgccgtcttctgaggtatcgttagctgattttttccccttttttgtagtttcttttacctgaatttcgcataaattgttcatcaaactgaaattagtatcatttatcggaaaattatactatttatacatggttaacactattctttaggtatatatgatagataaatgaaaattctggctccgacactaaattgggtgttgaaattacctttttctcgcgttcctttctctttgttgatttctgattgactagtggattggaagtcgccggagatgaattgtggttaaattcggaatctatgggttcttgcttgacgaacagtgatttcgacccggaatttgaaagggttgaattggactccggggagttaccggcggcggcgaagacggagaacttagaagctctgtcgatcaaagcgatatctgaaggaaaaatcggaggaggaggataacgatagtgaggttcactgatagcgagcttatctgatgtcattttgtcagcttccggtgactgaaccaaaagctccaccgcttgattcggtggaagcccaagtaaagcagtgaaagaacttccaccttccgacgtaacagacaagatttcctcaccaaattgatgaaacccagttcctatttctcccattctagctccgcaattctcggatctagcttctcctgcttcaattgactctatcagatgatccatttcacagaaaaatcaaacccaactatgatacaacacagctaacccaattccagaatgagactcaacaagacaacctcaagctcaatttctacagtttctcgaatttcgtttatgcggcgaactccaactgaaacttttaaa

SEQ ID NO: 9112 - DNA, 328 bp, Solanum tuberosum
  Predicted polypeptide sequence is orthologous to G2145
cacatgtgatattggcggagtcaatttggattcttctttcacattttcgagtggtcaaacccaatatcttcttcaaatcaattcgttgaaaaggaggcttatatttgtgtccaacacctgcaacagtagcagaaatgagctcaaggagatgccccttcaattcctttccattcagttcatcactttatttgtcaattcgcaattgtcgttaactctttggtattttactaacttacatgaatcctcaatggccaaatgcaggttttcaatgactgtgacttttatataactatatatctaatttactcgaaaaaaaaaaaaaaaaaaa

SEQ ID NO: 9113 - DNA, 814 bp, Solanum tuberosum
  Predicted polypeptide sequence is orthologous to G2147
ttaaattccatcaagaaaacatggtttactcttcttcctatcttccattgctattattcactcttttccaattaattgtaattcaaaaccatttgttttgcaaagctgatcctactgatggtttcactcccatatctattagccaaagcaatttcgaaattcaaaagccttatgatgtgcctgtgaatcaaaggtattccttcattgatggagtacacaaattttgggtttacaagactgacaagcctcacactacatctagccaaacaaaaccccgttgtgaaattcgtataacggggaatgattattcatcaggtattcgacaatttgagggatatttctatgtgccaagtggttcatctggtgtctcaataatgcaagtatttggagcatcaccatcatccacaactttaatgctaagagtttatgatggaactctctattactatagagaaaaagttattgaatcaaatatttataatagatggatcagactaaatgtgattcatgatgttggtgcaagtaaattaaaggtttatattaatggaaatctcaagcatgaaccatccggaagaggtggagaccatcattatttcaaatttggagtttatacacaagataatgagtctgatcgaatggagtctcgttggagagggattaagcttttcaagaaataaacatctatcacttgtagtgtcttaacatgatcgagcggactagctctatatggatcatgaaacttatgtaatttcatttaattagaaatatgatgtattaagacaaaataatcatccctctagggttatgatcatga

SEQ ID NO: 9114 - DNA, 977 bp, Solanum tuberosum
  Predicted polypeptide sequence is orthologous to G2157
cttttagagagagaaaaacagtacattagataacttcttgtgaatttttctctctaggttagtgagaattttaggtgaatagagtgaagaacaagaaaaaaaaaatggctaatcgatggtgggatggaaatacagcaatgaatccaatggtttcatcaagtaacaatccagaagaagaagaaaaatcaaacaaactccgccccggaaaagagcaagagttcatgaatacaatcaccaccaccaccaacagtagtgaaaacccaaatgaaatgagtcaggaaggagaagaaaatatacagagtcctgaaggtctgttctcctctggaccgtccagctctatgcgtagagctggacggcgacccagaggaagacctatgggctcaaaaaacaagcccaaaccaccaatagtggtaactaaagatgccccaaattccctcaaaagtcacgttttggaaattaaatccggaagcgatataatagaaagcatagccgctttcgcgaatcgccgcagctgcggcgtatccgttttgagcggcagcggtattgtaacgaatgttacgttacgccagccggccgcggtgaccgtggccgggggcgtaattacgcttcacgggaggtttgagattttgtctttatccggcgcgtttttacccgcgccgaatagtccagttggagcaactggactaactgtgtacttggctggtagccaaggacaagttgttggtggaaatgttgtgggtgaattaatagcatctggaccagttattgtaattgctgcatcttttacaaatgcaacatttgaaaggttaccaatagtggagaatgatgaagaagaagaggagaataatgtaaatgaagggatgcaaatgcaattacctacagcttcaggggttggtaatgtaaattctgattattttgcagttgatcatccatctccttctacttctatgcctatgtacaatttagccactaatgtt

SEQ ID NO: 9115 - DNA, 938 bp, Solanum tuberosum
  Predicted polypeptide sequence is orthologous to G217
gatggatatgcataataatgctaaactggggcaatttaattcaaaaaaagaattgctttctggtttgaaaagccttcctcagcccaagaatgagtaccagatagtcgtccaacaacctcctgaagaaaatgaagaaccagaagagaagatcgaagaagacatgtctgataggattgccagggagaaggctgaagaagaagcaaagcgacaggcattactccgtaaaaggtcaaaagtattgcaaagggagctccctagacctcccattgcttctctagaactaataaagagttccttaatgagagctgatgaagacaagagctcctttgttcctcctacactaattgagcaggctgataaaatgattagaaaggaacttgtgtccttgctagaacatgataataccaagtaccctctagatgagaagccagagaaggagaagaaaaagggggtcaagcgaaaaattgttgctgaacctgctattgaggattttgaggaagatgaattaaaagaggctgatggattgatcaaggatgaagctcactttcttcgtgtggcaatgggacatgagagtgaatctcttgatgaatttgtcgaagtacacaaaacaactttgaatgatatcatgtactttcctacccggaatgcttatggtctctcaagtgttgctggaaacatggaaaagctggctgctttgcagaatgagtttgagaatgtgaagaagaaaatggatgatgatactaagaaagcaacaaaacttgagcaaaagatcaaagttcttactaatggatatcagatacgagctggaaaactttggtcacagatagagtcaacctttaagaaaatggacactgcagggacagagcttgaatgcttccgagcattacaaaaacaagagcagctagcagcatcccacaggatcaaacatatgtggggaa

SEQ ID NO: 9116 - DNA, 462 bp, Solanum tuberosum
  Predicted polypeptide sequence is orthologous to G2215
aaatcaaaacaatactaggtgacttgggggtttcccagtcgtggagctatggtgagatttttttagtaaacaagataggtgatcgattgaaaaggggaagcaaattatttttcctagtattcctatcttttaagaaacctccacgaaggacatagaaaaagaaaaaaaaataatatgtccggatctgaaaaaatatttgcaattggaagctcgattttcatggtcaagaaacggaagcagtcttcttgtgattcattttggaacggaagaaattctttcactatacgaatcaagcttcgaatttcggaaagttttcttggtggccattgtagaaagctgcttctttgcaattttgctatgaagaagatataattattagagaattttactaattaattagaaattaataagtgtaaaatatagctaacaaaagaaaagttaattaaaaaaaaaaaaaaaaaa

SEQ ID NO: 9117 - DNA, 434 bp, Solanum tuberosum
  Predicted polypeptide sequence is orthologous to G2215
ggagatagagagagaaagtacaaaattgaccttccactctgtggatctagggtttcacaatacacagttgagccaccgcatcgtcatctacaccgccgtactacaactactatctgaaaaatcatctaaaccctacttttaatcttctcttaatcatcatcttctataaagaaaccctaaaattttcattcttttttgggtatttttttgggtaaatctgaatgaaatttgataaacgatgacgtttgattggttgatttgataaagatttgataagatctgacttttttttttctgtttcgattggattttaagcataatttctagatcgatctatattgcgatgagaaactgaaagggaaaaggatagaaattgtttttttttgaattttttgtgattacagagaaaaaacgcaaaaaaaaaaaaaaaaaaa

SEQ ID NO: 9118 - DNA, 734 bp, Solanum tuberosum
  Predicted polypeptide sequence is orthologous to G2226
cactgtcccaatttggatcctatgaatctccttcaacacatcaacccttaaaaaaagaaaaatttctcttccaaaatcttgtaaatcctattttctcttgtcaatattacaaaaaataataattgtaaacaaaaagtttcaagttttcatattattagatccagtatattgagctctttcaaaagtttttgaagatataatcatcatttcaacataaggttccgatccattatgggcctctcacaatatccaactccggcagatgcaggagtacttggtgtgattctagtaaacacagccatatccatctccattatcaaggagatactccgatcgatccttcgtgtgattggcatccgtatcgcatcatgggaagactattctgttgaaggacccttggactcacttgaatgccgtggaagcccaccagagtcatacatggaggagttcagaaaccgaacacctgcatttcgttatgactcgctatgtatctctaaccaccctgaacaagaatgctctgtgtgcctgacaaaattcgagcctgatgcaggggtaaacagtctctcatgcggtcacgttttccataagctgtgtctaagagaagtggctcaagtattggcatgtaacttggtcctcctttgcagaaattacttgatgtctccaacaaagaaagaggacgatacgtgtccgaatgtggagattaaacgtttaacggtgccacttcatcccatttg

SEQ ID NO: 9119 - DNA, 508 bp, Solanum tuberosum
  Predicted polypeptide sequence is orthologous to G2226
tttttttttttttttttttggagaggacgaaaagcattaataagctacaggactacaccatgtactataatgtacaagtttttggtcacacgaaagagacccgtcactctgaagaggacgcaaagttttacaaacacaacaagcgtacaggactaaatcatgtacaacaagggtattaaggttttgtgtggtcacacgaaagagacccggtcactcatggagaggacgcaaagcatcacaaatatgacaagctaacaaactacatcacatcaaagatcaatgcatccacatactcaggctgtacacaactaatgctgtaaagtgataccatcatcaaatggatgaagtggcaccgtaaaacgtttaatctcacatcggacacgtatcggcctcttcttgtagagacatcaggtaatttctgcaaagaggcacaagttacatgccaatacctaggccacttctctagacacaagcttatggaaaacgtgaccgcattgagagactgttt

SEQ ID NO: 9120 - DNA, 923 bp, Solanum tuberosum
  misc_feature (137)..(137): n is a, c, g, or t
  misc_feature (429)..(429): n is a, c, g, or t
  misc_feature (721)..(721): n is a, c, g, or t
  Predicted polypeptide sequence is orthologous to G2226
ggatgaaaagaaaaaaagactatttttttatgcagttcttggatggtccagttcactcagctattccagaagttgttgctagtagaaaatctcttagtttcagcctagattccaatccagtatgggcctctcacagntatccaactccagcagatgcaggagtgctctgtgttattctagtgaacacagccatatccatctccattgtcaaggagatggtccgatcgatccttcatgtgattggcatccatattgcatcatgggacgattattccatcgaaaggtccttggaatcctttgaatgtcgcagaaaaccatctagagatcatatatggaggaattcagaaaacatatacctctggaatcgggatgagtatcacaactcgggtactcttatacactgcgtgagaaacgagagcgccgcgctgnctcgacaggaggatttgagagcccatgtcgtgagataaaacacactctcatgtggggcaccgtgtttcaccaagacactcgtgctgagaacagggggcccctactcgggacgtagacaaagtggcacacctgcgaggagagaacactgatgtgtccccaaaaggcgcgaagaaacatgtgccatcgtcgaggtgggagagaccatcgaccgcgcgtgacactacgatacaaacctctgtcgggaggagacatgcgcgtgcgaagacaccaacaaatgtacgagccacacgcngctacatagcaaaacagcaggggaagcgacactgcccagaaaccggagataacatgcagacagacacggcgccgttaatgcagtggcgggcgctccccacagaaggagggcgctactgtggggcgacaatgacatcacaatccgggcgcctaatataacgcaaggaaagcgcggagggtttctccacacagaaaaaaaaaac

SEQ ID NO: 9121 - DNA, 652 bp, Solanum tuberosum
  Predicted polypeptide sequence is orthologous to G2226
gcatcatgggaagaatattctattgaaggccccttggacccatttgagtgtcgtgggagcccctcgggatcatacatggaggagttccgaagcagaacccctgctgttcgttacgattcattgtgtatatctaatcaccctacacaagaatgcccggtatgtctggcagatttcaaccatgacgcggagataaaccacctctcatgtggccatgtttttcataagctctgtctcgagaaatggctaaagaattggaatgtcacctgccctctctgcaggaattacattatgcctaaagaaggtgaggaagatacttgtccgatgtgaattttgtagtttgtcaggctactccttctgtttgagatgttctgatgtacagcttagttgggtaaaagttttatagatgactgcctgatcgttgagacggcataattctgtaatcttttatgctgtaatactctgcgtcctatcatagtgacgggtctctttgttgcgaccaagaatccatacattgttgtacatatgttatgaaattgccacttcctgatgttttccatctctggcttagctagcaaccttataagggaacattttaatgcttgattgatatggtgaaatgtcacatattcctaaaaaaaaaaaaaacaaacag

SEQ ID NO: 9122 - DNA, 628 bp, Solanum tuberosum
  Predicted polypeptide sequence is orthologous to G2239
ggaatagtagatagagagagaaacatgtattttcattttgagccattagccacctttacagctaccgccaccgctattttcttaatttccactatcaaattccgttggttccgtcccgacaattatttgccgccgccgttcaaagtcctcgtcgaggaaatcggttactgttactgtgccgtgtgcctcgacgaggttagcggtggcgacacgtgtcgacaactgcccaagtgcggccacgcattccacgcgatgtgcgtggacgcgtggctagagtgcaattggacgtgcccaatctgcagaaggcaagttactgatgaacttccggagagacaaggtcaaaacaccctgttttcttttgttatttcacgctgtgaagaatttgtggctaagattaatactcgtgctgaagaattcatgatcgttttgttcgagaccgctgttttaggccatctttgaattttattaattgtaattaagtgtgtattcattgatcaaaatttttcatctttgtccttttttttccctttcttaaaggaactttttgatcggaatatgtataattgttagttttagccgcctctctgtacgtattaggtaaggaaatgaagaattatacgtattgctc

SEQ ID NO: 9123 - DNA, 866 bp, Solanum tuberosum
  Predicted polypeptide sequence is orthologous to G2239
cggcggttctcaaactccctgaggtggaaccctcgccggcttcagctccaactctgggtgatttcattgatgagcctcttgaaaagaatggtggtgccatggtgaaaatccaccggtccgatttaggttccggttcagaccactccatccttttgttagatctagaacccctgttgcttccatctccggtgccggttctgtatccttttctggagcttatatctcttggcaaggtgcctccaaagcttttagcccggttcaatagtgcacggttcattacctctttccgaacgccctccggtaatctgagagtgtaccggtctaaattctcaccaggtagtactagtgaatgaccggttgaatgtgatctgaatttgctgaatatccttggcctcatggaaattgatctcggtggttgaatcggcacgttgaaactcaagtttctctttactcctgatttaactgaaccgccttcttcttgcttgggaacccggttcggcacgttgaagctcaaattccgcttcaccgtcgatttaacagaaccttcttcttgttgctgttgctgtacttgttcactttgttcgtcgtcgctcgctatgcgaattgaaacttcatcgttttgctgttgctgttgctgttgctgttcagttcccggttcatctgggatcacctgaggaacttgaaccggcggttcatccggttgagggttgagatcagcacggcaaacagggcaagtatcatgtgattccaaccaagcatcaatacactcgggatgaaaaacgtgatcacactttggaattaaacgcagcgtttcatcatcttcaaattcattcaaacaaacagcacactccaaagctcctttacca

SEQ ID NO: 9124 - DNA, 909 bp, Solanum tuberosum
  Predicted polypeptide sequence is orthologous to G2239
tgagtttcaacgcggcgaaccggccgccgaggtctttttctgtgaagagaccaaagatgttcagcaaattcaggtcacattcgaccggtcactcattagtggtaccaggggagaatttagacaggtacactcttagattgccggagaaggtgaggaaagatgtaatggaccgggctctactaaaccggacaaggagctgcgcagtcacgctaccaagacacggtagcaccacaagagggtacagagccggtccgggagagggaagcaacagaggtacaaggtcattcaagagaattgaccggttcgacccggaagcaaaatcagaccggtggtttctcaagattgcaccaccattctttaccagaggttcatcaatgaagtcaccaaaagtaagagctgataacgaagaagcatccacatcccgtagtaatgtgaaagtagcagtaaaaatgccgtccttcaaatgcctggagccgaaaggtgatgaaccgggtttattggcaaatgactcggctcgatctccggtttaaagaatgtggtaatttctgactcgggtttaattaagcgtggcggaaagggaaaactttttgttcgccggcaaatgtggagaacgcgtggtcgatgctaatgggctgggcccaccaacctttgaaacttccgctattgactttaatgcacatatatataatgtcaaaagttgaattcaaggtttttgatttctagaatattctttaaaatgttgattaacttttattatttaaaaaacaaataattttcaactttgggtttatatggggtgatgagatggtgttcaatagtgtgtgtttatctagatggatgacgtaataccctaaacacaatgtaattatactatgtgtgttactttgttcttgattgatagagatatga

SEQ ID NO: 9125 - DNA, 471 bp, Solanum tuberosum
  Predicted polypeptide sequence is orthologous to G225, G682
acaaggagttgtttggtacgaagatgagacaaatagactaaacgatcggttaggggttgtttggtagatgggcgctcttcaaggcttacttggtatcgggaatggaatagataaagcatttgaggccaaaaaggaagagagctcgaagcttgaattttcccaagatgaggaaatccttattactaaaatgttcaacttggttggtgagaggtggtcattaattgctggaagaattccagggagaactgcagaagaaattgagaagtattggaactcaagaaattccaccagccaataaatattttcttcttgctatatatagagctacaaaagcagaaaatatttattatcatttccttccttattatttatttgagatggttttgtagaacaatatgaaaaaaagaagaactgaacattggattggaataaatatactgtgatttagagcggaaaaaaaaaaaaaaaaaa

SEQ ID NO: 9126 - DNA, 1022 bp, Solanum tuberosum
  Predicted polypeptide sequence is orthologous to G227, G242
atcaatattcatcttctatctccattttcaaaaaaaaattacactattttttctgaaatggatttttttaacagatgttcaacttcatcttcttcttccgaatcatcttcatcagaatcttcgctttctggtaaaaaccctaataaatctgaaagaataaaggggccatggagcgctgaagaagataagattttaacgaaacttgttgagcgttacggagctcggaattggtctttgattagtaaatacataaaaggtaggtccggcaaatcctgccggctccggtggtgtaatcagttaagtcctaatgttgaacaccggccattttctccggcggaggatgaagctattttagctgctcatgctaaatatgggaaccgatgggcaaccattgcccgattacttccgggtcggactgataatgcggttaaaaatcactggaattcgacattaaagaggcgttatcagcaattaattcagcagcaaaatcagaacccgattgggttttctgatctgaaaattaatgggtcaggatccggatccggatctggattcgggtcgtgtatggagtatttaaatgctgatgagagtccaaaaggcaatagcaataataataataataataattacgctgttacgaataattgtagcggtgaatttgatgatccgatgacgactttgtcacttgcgccgccgggaatgggcggagatgagttgccggagaagaaaacggagagttttccggagggattttgggatgtggtgagaggtgttattgctagagaagtgagagaatatgttgcttctacggggtttcctaattgaaaaacaaaaagaaaaaaaatgtttattatattaatttgtcaattttaaagttgggcttttaagctttgataatcacttttgattgttgataagtatgcttataaattgattaattacatgttaaatatgttttggaagcttaaaaaaaaaaaaaaaaaaaaaaaaaaaaaaaaaaaaaaaaaaaaaaaaaaaaaaaa

SEQ ID NO: 9127 - DNA, 1239 bp, Solanum tuberosum
  Predicted polypeptide sequence is orthologous to G227, G242
cggatcaaaggtccatggagtcctgaagaggacgagttgttgcagacgcttgttgagaaacatggacctagaaactggactttaataagcaaatcggttccgcgtcgatctggtaaatcctgtcgtctccggtggtgtaaccagctttccccgcaagtggagcatcgtgcttttactcctgaagaagatgatactatcatcagggctcatgcgaagtatggtaacaaatgggcgactattgcccgtttgttatcgggtcggactgataacgctattaagaaccactggaactctactcttaaacgtaagtgtccttccatgtccgaagatttaagctttgaaactcctcaaccgcctttgaaaagatcgtctagtgttggtccttgtaccaatttttcttctgttatgaatccgggtagtccgtctggatccgacttgagtgattccagtctttcgggttttccccaaccgcttgtttatagacctgttccccgtaccggcgggattttccctcttcctcctccggttaagcagatcgaaattcctccatctgtacccgacccacccacatctctctgtctttccttacccggatccggatctattgaaaaaccaacccagtcccctaaatcaccaccactaccaccgcctcctttgccggtggttgataaaccgattcccccatctgcagccgtcatgggtcatcttcctcgatccaatcaaagttatgatttttgtgctgctcccaaatcaggagagaaacagttttttactccggagttcttatcagttctgcaagatatgattagaaaggaagtgaagagttacatgtctgggtttgaacaaaatggtatctgcatgcagactgatgcaataaggaatgcagtcattaagcgtattggcatcagcaagattgagtaatccatctatgattacagttgaactgttctatagtcatcaacaatggctgccgctgctcagcgaaatgacaccggagaagaaacaatggaagatcggagcagtcttcctcccccacccctttttttttttttttttattgcttaattacttccgtagaattccaatcaaaaaaataattttgcagtaatgtacagatgagcgagaggatgagagaagaaaactaaatttgaaaatgccgaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 9128 - DNA, 1297 bp, Solanum tuberosum
  Predicted polypeptide sequence is orthologous to G227, G242
gcgagttctaagagagatatggatcgggttaaaggtccatggagccctgaagaagatgagcttttacagcaacttgttcagaaacatggccccagaaattggtctctaataagcaaatcgattcctgggagatccggcaaatcttgccggttgcggtggtgtaatcagttatctccacaggtggagcatcgggcttttacgcctgaagaagatgagactattattcgggcccatgcccgattcggtaacaaatgggctactatagcccgacttcttaatgggaggactgataacgctattaagaatcactggaactctaccttgaagaggaagtgttcatcgcttagtgccgatgaagggaacgaactcgccgatcaaatttttgaaaatcagcagccgccgttgaagagatctgttagtgccggatccgctatgccggtttcgggttttcatttcagtccaggtagcccatcgggttcggatagtgattcgagtcttcatgttacgtcgtcgtctcaatctcatgtgtttaagcctgttgctagaaccggcggcgtattcccgcagtcgatcgatatctcatctccgcctgttgatcctcccacctccctaagcctttcgcttcctggtgttgacttggctgagttctctaatcgttcggccgattcgactcagtcgaaaaatccttttcagttgctgcttccaccgatgcagattcccccaccgccgccaccaccaccaccaccgccgccgcaggcaacgacggtacctttcgaacgagtttctgcaattcaacagtctcttcagaaccctgatttcgggaagaacgcaggaggagaacagccagacaaggtatttgtgccgtttagccaggagttgttaggggtgatgcaggagatgataaagacggaggtgaggaactatatgatgggagttgaacaaaagcagcagtttcagcagcagcagcagcattatcaacaacaaccgcagcagtttcagcaacaaaaccatcaattgccaagtggtttagggcttggattgtgtatgcaacaagcttctgatggattcagggatagagctgctaatcgcatgagactaagcaaattcgattagtgaaacggagaaagaaaccgcctttgtttcattctctctttgtttttagggcacatgttgttagctctttaagcttcaactgtggaatcgtcaaaagaagaaaatagttttcggtggagtattgtacagggcgagggagagtttataaaatcatgttccattgaaaaaaaaaaaaaaaaaaaaa

SEQ ID NO: 9129 - DNA, 829 bp, Solanum tuberosum
  misc_feature (406)..(406): n is a, c, g, or t
  Predicted polypeptide sequence is orthologous to G2291
tcaaaaagctgaaccattcttcttctctacacaaaaacctctttattacccaaatgaaccaaatcataatttctccattgacaacactaattattccctcgacccattttgggataattactctgtttctgctaatgaaaatgaaaatgaaaaatcccctgttctagaaggaattgctgctgttgttggagaacatgttcttttcggttataataacaatgaaaacaagaatgatgatccaaattcagcagtttcaattctgaaacgcacgtgtcctgcagaaaagaggaataataataataataatgttccatcagtggagaaaagttacagaggagtgagaaagaggccgtgggggagatggtcagcggaaattcgcgaacgtatagggcggtgcaaacactgngctgggtacattcgacacgccggaggaggcggcgcgtgcgtacgacgcggcggcgaggtggttgagaggttcaaaagctcggaacaaatttccaaattcctccgattgttcctctggctacttcaccaaacatcgaacgtcatccatcttccaattccgcctccgtggaaattggaaccattggaaacatggaaaacaggaaaaaggacccattgttcgcctattaatcaaaagaaaatgctcagtggtaacttcaactgcgcatttatttagctctaatgaatttaacaaaaaagttagtgttactgtggagcttgatctcaagctcggattcgagaggaagtagactcaactgctataacgaaacaactacttcctattattaatgtttagttttgtatcgtaaaaaaaaaaaaaaaaaaa

SEQ ID NO: 9130 - DNA, 751 bp, Solanum tuberosum
  Predicted polypeptide sequence is orthologous to G2344, G929
ggaaggaaattcaacagaaaacaccagaaattaaagctgcttattggttttctatacacgaagctcttcccgaaaggtttgttactttggagattctgtggcaagcagcgtcatgacgtcctcgcttcattatcattcagatggtagtgagaatgaacagtcagaaaatcaatcagaggctcacagcgagtcttcatcccctgcagctggaatgtctgtccctggcactgtaacaccaaatatgcactatgttatgcccaatctacttggcaatggaaattctatgatacaggctcaaacagcttatccatatccagacccatactataggagcatcttcgcaccgtacgatgcacagccttatcctccacaaccttatccagcacaaccaatggttcacgttcagctaatgggaattcaacaagcgggtgttcctttgccatcagatgcgatagacgaacctgtttttgttaatgcaaaacagtatcatggcatcttgaggcgtcgacaatctcgcgcgaaagctgattcagaaaagaaacttctgaaagctagaaagccttacttgcatgaatcacgccatttgcatgcattgaaaagagctagaggatgtggggggtcgtttcctgacagcgaaggaaactgataatcagcagaaacaggatgaatctggtgataaatcacacgtcaacattaatctcgagtctggaaaagacaaggttgcttcttcagagatgcctcttgattatgc

SEQ ID NO: 9131 - DNA, 917 bp, Solanum tuberosum
  Predicted polypeptide sequence is orthologous to G2344, G929
aatcaataatatctcataaatcggagctggttcttgtggcgaagtggaaagtccaatgtttcaaaaatcggatggtgattccaagagagaaggcaaacatgtagaatttatgcctccaagcatgggtgaaaatttaagagcagcaaatcaatttgaactaatggcaccctcctcaattgcatttaaatcatacccctattcagaagtaccacaatattctggtggcaatgttactattgcttgtggtgaacctatggtaaatcaaaatatggagagatcatcagcagttcatcataatggaagaatgattttgccagttgaagtgaaagaggagccaatgtatgtaaatgcaaaacaataccatggaattcttagacgaaggcaacttcgtgctaaggctgtgttgcaacaaaaagtggtcaaatctcgaaagctgtatctccatatgcatgtacatatatagtttgagtcaaaagtaatgggaccggttgaacgcgcagagacgacagccttatcttcacgaatcgcgtcaccgacacgcgatgaggagagctagagatggtggaggtagatttctcaacacaaagaagaagacccaatctactactacaactaataacaacactactccaagtagtaaaggcaaaagttcaatggattctgattcttctccaaattacctactcaattatgaacatgaaattggatcatccaatcatagtaattctgttgaaggatttcagttccaatctggaatacatgatactacagaaaatcttcaattgggttgtcattatcagtggaacctcaatgacaacaaccattgcaattgcatgcactcggaacatttctgaagagagtcgctctgcaagacgtctagtagtcttctgagtcactctgcaagatgtctagtagtc

SEQ ID NO: 9132 - DNA, 1025 bp, Solanum tuberosum
  misc_feature (948)..(948): n is a, c, g, or t
  Predicted polypeptide sequence is orthologous to G2344, G929
ttttttttttttttaaataggggacactcctttattaccaagatactaataaagagaagagaatgtaattgacctgcactgctgctaacttattatcttcctaataactatgaagaaaaaaacacttttacatgctacacctaatgaccattaccttcagtgtctattaaagtctcagcgaaagaaacagctaaaagtaattacaatcggaaaacgataaatctaaaaaaccaaactcagaaagaagactgagaacagcatcttggaattacacatccagctgctagctttgcaacaccataattcaagaagcattttctgaagaagtaacctcaattttgttggagtcagtattggcgtttgccttcgacttatcatcagattcatccttttcctttgcagtcataaatcgaccaccacaccctctagctcttctcagggcatgcaaatgccgagattcatgcaagtagggcttcctagcttttagaagtttattttctgattcagcttttgcacgagattgtcggcgcctcaagatgccatgatactgttttgcattaacgaaaacaggttcttccgcaaacatctgatggtaagaggaacaccagcttgttgaattcccatcaactgaagtcgaaccattgactgtgctggataaggttgtgcgtcatagggtgcaaaaatgctcctgttagttaaggatctggataagggtaagctgttttgcgccattgcatctggcatttctaagttgaagaaccgtatcacagtacttgcatgttcttggtgggcacagtcccaggaacagacattcagttgccaggggattgaagatcgggtttgccttctctgactgctttgtggttgttcattctcgcaatttatctgacaggatcatgtcatggagggacgttctgatgcttgctttgttcacaaactccccaaatncgagaaggacttgattatgcaattgccactttccttgaaagccttagtgtacacacaatggatacggggctctgtgg

SEQ ID NO: 9133 - DNA, 868 bp, Solanum tuberosum
  Predicted polypeptide sequence is orthologous to G237
gataatgttgaaccatcgatttagatttcgagcaccaagttatgaaattttactgttctccattccaattgatcctggagttccacttcatatgtggaagtggaaatttgagaagacatcaacacacctccaaagaatgaagaaggtatcatcgactgtgaaaagtcctacattgccgtgtcagatgaaggaacatggaatgtcccttgataacccaggtaaagattttacaataatcttattacacttatgtgaatactctgacatttgttaactcaattagacgttattggttcatgcatgagtatttttgaaaatagagtaatgcacctattgtttcaattgctctctggtgatttctgaaaacagagtactttctcccaaatttctttatttaattctttataggatcttcactgggtacctttcaaccaccagatggaatcacatcagcaatttttctttcgcagatcgacaatgaaaccattgtaagattagcttaagttaatgaatgaatagtttcctctgcttcaatctaaatggtttctggtacgatgaatttttcggtacttgcctttgcatgtggattgtttgatgatattgaaggaaagaacatggcatttgattttgggttaatgcttttttgggcagattgtagcgacagcagaaacaaaaaactatgagaaattgtcttataatctttgaaatgcttcctttctaagattatggaaagacgtttgagaaatttaggactgatattgctattatttcagctactggtttctttaatctagcttctgcacaggtgagttctacaatactctttaattggttagcttgtgatttttgaaagttttcactgatgaaa

SEQ ID NO: 9134 - DNA, 963 bp, Solanum tuberosum
  Predicted polypeptide sequence is orthologous to G2394
atctgattcttcagctacagtggaaaaactgcttagacttctcctataaagctgctgcagtccctgaattaactgggtgattgtgaagagcagaagaatttttcattctggtgaactcatacttgcactgcttaagacttttgcatcccatgtttcctatacttatctctcagtcagtggacttagatggccatttcctcattggggctacaccggaaaagccaaactaaccagtttcaattattaatggagcaagcagataaccgtagcaacaatgagcatgttattgacataactactagcaacgatgcatcctcatctagcaacccccatgatagaccagttaataatgtgcttcatgtccaagctgaacatcccccatcaacaagcacaacagtgcccgtctcccaacatgcattttcttctgctaatagatccaacttgaggaactcatcatttgctcgaagaggaaatgggcgccgccatcggagtcctctgaattccgtgctctggatatccattgaactagtcttgacaatgagccaaataattgcagcaatcgcggtgttggccatatcaagggatgagcacccacgagctcctctatcccaatggatagttggttatgcatctgggtgtgtagcaatcctccctcttctctactggcgttttcttcatagaaaccaaaattcagatcaggattcatctcagcagccacagatttcttcccaggttgaactcccggccagaccttcctcaagtacaaggagttcagaaggagaaggtcgtcagacaactgctacagcttctacaggtggtcaaagtaatgaattactgagcagaagggtaaaggcatttgttgagtacttcaaaatggcattagattgtttttttgcagtgtggtttgtggtttggcatgtatggatatttggtggacactcctcttcctctgaggctccaact

SEQ ID NO: 9135 - DNA, 824 bp, Solanum tuberosum
  Predicted polypeptide sequence is orthologous to G2394
caagacgccacagatagctcgttttctactaactgactgagcaatcttaccacctcacatgttttgcaacagaaattgtatataaatctagtaaagctaacaacatttagcccaaaagaaatcagaagagtgatggaagaaaatgaaatatatatatgaaggtaactactattcctttaaaaagcatctctatactagcatgtgggcagagtggcaacttaaaacgcggaactctgacgcaaacttgcagttgcttcggtaagagagctcaaaagggtctcacccacctcagctttgcaaaggggacatgagttgttgattttcagccacttatccacacagtccttgtggaagaaatgagaacagggtaactccctcagctcatcattgttcacatactttgccaagcaaatgcaacatgccgcatcttctcctgaaatcacacgctccttgtctgttcctgcagccacaaccccaccttcagcagcctctttgttgccacttttgtttttctttaccttaaatttataggtcggaagagcattaattgattctggtgtggcgcctttgttttgagtcagatcttctcggaagcccatgactgaaataatgcaggggaggcagcagcagattgttgcacatagaataaatggcatggcatacccgatacagctaaaggtcagaaatactatacacaacctgtacaagttgggagcctcaaagcgaagcaggagtgtccaccaaaatatccatacattggcaaccaaaaaccacactgcaaaaaaacaatctaatgccattttgaagtactcaacaaatgcctt

SEQ ID NO: 9136 - DNA, 907 bp, Solanum tuberosum
  misc_feature (720)..(720): n is a, c, g, or t
  Predicted polypeptide sequence is orthologous to G2394
ttttttttttttataacaaagtagaaactaaaatttgtgataacaagcatctctagtgtaatctcaaaagcaacatctgaggagaatggtgtgtacggagccttacccttaaatgtatttatacagagagagagggagagaagtaattggtgtgctatgtctgcttagatgatggacacttcaaaaatatcgcccggtttagatcttccaaaagctatgcattttttgaagatccaacacgagtgcaactaacatttttttggaagttctaagtaacatagctggtgaggcatgaaatgagagtatcaacaatggaattacctcttctttcaagcttgttatggattcttggtatgaactacaactatacaaactgaaattcatgtggtaaaaacagcagtagcagtagcagtagcagaagaagtaacagtcagttgggatatactctccgtggctccccatgcaacaagctagccgcgatgatctctgtttcgaccataagaaggtggtttctgcatcaccttaggattgttggagggattcctcttctacagaaggtagatctctgttcttggcatcaatttcagatttgcagagggggcaagtcgcattaatcttcagccatttatctacacattgtgtatggaagaaatgcgagcaaggcaattccctcagttggtcattgtcctcatattttgttaagcaaatacaacataccgnatcttcgcctgatatggcacgttccttctctgtgccctgcagctacacaaccaccttcctccctctcctagatttttactttcatttactgcgcagttcccatcttgtctttgaagcgctgctactttgaagtgtctgggaaagagccgttgatgggactccttgctgtgggatccttcttcactcc

SEQ ID NO: 9137 - DNA, 840 bp, Solanum tuberosum
  misc_feature (607)..(607): n is a, c, g, or t
  Predicted polypeptide sequence is orthologous to G241
tttttttttctctaaatctcgttcttcctttagctaattagtcctccactaagtaaaagaaaagtttaaaataacctcaaaattaaaatatcctagctaatggtcccaacttggaattttttttattttttttgggtccactctaaataatactagtcaagattaaacaaacaagaaatttcaaacttgccaactccaaaaattcctaaaaaaaacctattagctagaaataccactaattaatctcaaatttacataataatcaaaatagacccctcaaaattctggtaattctggcaaatcccctgtctttatgaaaacattgtaccaaaagtccatgtcctcctccatttttgaactagtagtaaatatgtccacattttcttccctcacttgtatttcttgatcatgaccaacaaccatattattctccgttgataatttgtctgtccagaaactctcatcgatcttgggaaaatactccgatgacgatgactctattttttcttcctttataatcaccatttgattatcatcaacaactaatgtcacacttgacatttcactagatgaaagttgtggtgagttgggggcaattttaatgtgntgttagtacttgtactattagtactaaaatcagaattattggaggattcagaaggtgtaggaccctttgtggaaacatgattaatcatggagtgtctttggaatttgagaacgctgataatcttcagcttttcttaagctggtgtgcaaagtttttattcattatctgtcgcctggtatctcctgctatgccgacatctatgcagatttcatgaagtgatatggctctctctt

SEQ ID NO: 9138 - DNA, 702 bp, Solanum tuberosum
  Predicted polypeptide sequence is orthologous to G2457
ctcgattttcttctccggcaagcgcagtcggcgaaccactggaggtagccgcctctctctccagtcgtctttccccttcgccttctcttcttcccccccgtctcctctttctcctcgtctgtccagcggccagcgaggacgagcatcccgcagccgcctggacaacaacaacaaagacattgttgttcaggccagtgaccggctaacatcggcgcctccagccggcgaagcccctttgccacttctctattctttccggcgaggatgagcgacaaaacgaggcagcagtagccgccggcaaatgacaccaacagtgctccgataaacagccggtgagaaccagccgattagcgaacctctttctccctctcctccctttcttggggaagtccggcaactggtgaagccaccagcgaaagagcagtagcagccgacgacaaccagcagctctggaccagcgaaaaaagctcctggcagtggctacgaaatcaacaacaacgataagatgctcactacaaggttccgaccaaggaccaaaatggaaaaaaagtgaccgggtgtgtaacattgagttctagtttgaagagttgccagggatggaattccggacgggatttagttctatttacattcgtatttgtcatatttgtataattttattcagtcatgtaatagttgtattagctcttctaactctccata

SEQ ID NO: 9139 - DNA, 864 bp, Solanum tuberosum
  Predicted polypeptide sequence is orthologous to G2457
taaacatgtcgtcaagctacattgattctactaattctgagcaactttgctatatcccttgcaatttttgcaatattgttcttgtggtgagtgttccatgcagcaacttgcttgatatagtgacagttcgatgtggacattgcacaaatttgtggtccgttaatatggctgctgcatttcactccaattcttggcaaaatcatcatcaatatcttcatcatcagtttagaaaactacactaaattctcctcatgatcaatacaagataaattgtggttcatcatccatcacaaacaattctactcatgagcagaggattgtaaatcgacctccggaaaagggcaacgaggaccttctgcataataaatcagttcataaaagaggagattcagaggatcaaaggtctaataatccagatatcgctcatagggaaagcatttagtactgctgctaaaaaattgggcacacttccctcacattcaatttgggctcaatgtgggagactgacaaatcaagctaaaactttggtgctaggtgagaacaaagaaaaacttataatgcatagagtttgcattgccaaaaataaaagacctttcaccttctaagagtattaattctctacatgttgtatgctgaaattattgaagacaagtgtgattttatttgttctaatttataagtacttataaattgtgtaatatacttggaaattatctgaaagcttccttttgtattggtctaacaagaacaagacaaaacaactcggaggggggggcccgggtaccccaattcgcccttataatgagtccgtattacggcgcgctcaatgggcgtcgttaacaaacgtctgaactgggaaaaacc

SEQ ID NO: 9140 - DNA, 980 bp, Solanum tuberosum
  Predicted polypeptide sequence is orthologous to G255, G664
gcaggattgtcaagatgtggaaagagttgcagattgagatggataaattatttaaggcctgatctcaaaagagggaattttactgaagaagaagatgaattgataatcaaacttcatagtttgcttggaaacaaatggtcagttatagctggaagattacctggaagaactgataacgaaatcaagaactattggaatacacatattaaacgaaaactcatcagtcgtggcattgatcctcaaactcaccgtccactcaacaccaccgccactaactcccacaccaccaccatcaccaccgcagtcaaaaccaccaccaccaccaccaccaaaaacatcaacatggatttcacaaacaacgttgaccaaaaacaacccactattatgattgccacgtcatcgtcatatgatgaaacaaaatgccacagtggtactactgaggaaacaaagccactagaaattattattccgaaaataccctcacaagttatgataaatcttgaactttcaattgggttgccattacatagtcatcatatttcatcaccagagtcaacggcctcatacaacttcttgaccaccgcagcaccgccgccaaccgggccgttacctgcggcggagacggtggcgaaaacggtttgtttgtgttggcaaattggatatcaaggtggtggtggtggtcagtggtgtggcaaatgcaaaaacacaaatggaatttacagatattgctgacctggcttttttggatattatttaagtaccttagtattaaattttttttcttaaatattactttaccattttgtgataagtgaatattttgggttttgggttttaggtttagatattaattttttttgcttttgcattttttgccttctaaatgtaatcatctactcacaaacttttgtagtacattggttgcaacaacttaccatggtatgaattggaatatgtatttaatttatcatttttagtct

SEQ ID NO: 9141 - DNA, 783 bp, Solanum tuberosum
  Predicted polypeptide sequence is orthologous to G255, G664
gccggacttctccgctgcggtaaaagttgccgtctccgctggattaattacttgagaactgaccttaaacgcgggtaattttaactgaaaaaaaaagattaacttcattaatcaaattcaaagcctttctgggtaacaaatggtcactttattagccgggaaagatttaccagggaagaacagaataaccgagataaaaaatttactggaatacacattataagaaggaagctttttgagtcgggggcattgatcctacgacacacaggcccgttaacgagcccggtacaacgcaaaaaatcacaacaatttcatttgcaggtggagatcataaaactaaagatattgaagaagatcataataagatgataaatgtcaaagctgaatctgggctaagtcaattagaagatgaaattagtagcagtccatttccagaacagtgtcctgatttaaatcttgagctcagaattagccctccttctctacaaaattaccaacatagcccctcgaggtgttttgcatgcagtttgggtatacaaaatagtaaagattgcaattgcagtaaaaataatatgggtaatattgcaagttataattttttaggattaaagagtaatggtgttttggactatagaactttggaaactaagtgaatttttattataaatctttttttcccttgtgtatttgggttaaaaaagaagaagagagaattgtgaaagatatcgctattagtttaagttcttttcgaattttctcttatttgtaaaatttgaaagtatt

SEQ ID NO: 9142 - DNA, 880 bp, Solanum tuberosum
  Predicted polypeptide sequence is orthologous to G2550
catattctctgcaagcttttattctcatattcaaatacaaaattacaatatatgtatatcaattgaggattctatctctagactaacattcacaatgtcctcactattatacagatggattatccaatagtatatttacataattggtaacccacttctcgttgatacaataagtggaaaaaagtcttataaccaatatatgaaagatatcatttttttacactacaaaatcggatagaagatgaggacctgagaacctttcttgctggtttactggatcgatatagtagtactcacctttaccaatgtccatatgagtagaatccgtcttctcgtcctgtcttaactgtggcctaccagacattggctgctggtccatttgactgttttgcagacgcagagcgagtgatacttgattgcccattatgtcaccaaacatggaaggatggtatgtattgacagcaccaatgatgcttccatcactagtcggtttaggaccaaagccgtgagcaataggaatttgttcgctctgcaacttacttgatccacaatcaatcctctcatgttcataaacaccgtcttggaagctaaatttggttgtaaatgaattgttgtgtacattagtaacattattacgtgactcgtcagatggatcgagatgactgcagttagcagctggagtagtaaagctttccggaatctcttctcctgtgttttcagctattgacttctctttggagtctaccggtactcgttctggtgaaactccggaacctgcttctgccacaccaaactcttccttgtacatatcttcaatcatgggcttccaaagacgcactcgagcatttatgaaccagtttgccacctgacttctggtaaa

SEQ ID NO: 9143 - DNA, 825 bp, Solanum tuberosum
  Predicted polypeptide sequence is orthologous to G2552
aaaactcccgtttagttgggatcatgagtactaaacaacaagttaaatgataaaaacaaattaaatctaagaaatgattagtttaatcatatgcatgtatgtgaacgacaacgcaccattgctagaacacgtggttttaatttaaaagttacaaacgatcatcgatgctcaatgacatttgtcatgctttgataagttcaatattttggaaagttacaatgacgtgacattagaccaaaggagatgtctcgaagtcaaatccttgattaagaaaagcactagctatccatagcttcaaattgccaaagtttatgtccacctcatgacattctctcacattaagagtaaaggtgaaaatgtaatcattggtagaagtagccaagttggaagtttgaacattgaatccagtgagagactcaagagctttgaaaagagaagctgcaatttgtcgccctttgttgcaaattaatctcacgtaaaatcctttttcttctacttgattaatgtccatctttgttatcctcttgattgttggataatagcttgtgaaattcattttcttggcattttgaaatagtccactttgattaattgatgactcaaactctgctatttctacttttagtttcttggctctcgtttgcagtccttgtacgtataatattgcatctcctatgatggaggctttatccatctttgtgatattaggaactaaggatcgcaaagcgtaaagcttttccttcatttctcctctccctttgcgctcggaaatcaaagtctcgacgggtcagtcctcgtgcctttgggtggtggagtcattttggg

SEQ ID NO: 9144 - DNA, 1095 bp, Solanum tuberosum
  Predicted polypeptide sequence is orthologous to G2574
tgcgttgctactttttagctaatggccacaattgttacttcttggttttgtaggttcaaagatgtgccgaagacatgtcaatattgatcaccacatatgaaggaacacacaaccatactcttcctctttcagccaccgcaatggcttcaaccacctcagcggccgctagcatgctgttatccggttcatctagttcatcagacccaaacccacaagtaactgccaccaccaccaccacccctacttccactacttctgccaatatcaacggactcaacttctatctctctgatacctcaaaacataataaatcgccatattactttcctaatacatccatctcaacatccgcacctaattccctccctacaataacactcgatttgacttccacttcgtcctcgtcctccttctccttatctcatctaaacagaatgagtcacaattttccaactagatataattacaataacaataattcctccacaaacctcaattttagctcagtacttgaatccaattcccttcccatttcttggaccaataattatccaaatcaagcctataacaaaaataaccaaaattttggttcacttacattttcatcaagatcaagtcaagataacattttccaatcatatttacaaaaaaatactacacaatcttctttaccaccagagacaattgcagccgcaaccaaagcaatacatcagacccaaatttcactctgcattagctacagtcttacatcaaatctttggaaattctgggaattgaaataaatctagccatgttacggagccattccaattttgtcaggtctccattagctcaaatccgaattaaggttcggctcagttttaattaaccaaccctttttaattcgcgaataatattatagttccagcgccggaatatagcaggcggtttcgggcaattttcttcatgcccattcgaggtataggggaatacctcagggagggccgacacaaattttcgttcgccgagagcattgccgtgggaaacctttggagatttgtcaccccgcgaactcttgtgccgaagtgatcacgtttgggggtgtgaaaaaaaaaa

SEQ ID NO: 9145 - DNA, 782 bp, Solanum tuberosum
  Predicted polypeptide sequence is orthologous to G258
cggcatttgggtgaaaagtttagttttaacctcaagagtggttcgggagggtagttggattatttgaccttgtttttggaaatttgacgattccattgagtctggaataactattctaatggagtagcatgtccagtttattttgataggaccccgaacgattcctaggggttcattcggaggctttttatttgagtttgagttgctggcagttttcttcgcaggtcattttttaccttcgtgatcgcgatgtgtcttcttcgtggcccataggctcgcgtccgcgataagctcccttttcccttgcggacaaagtgtctcgcgatcacaatgtttcttccgcgtctttcacgattgcgatgagtaaaattcacttagaatgaactcaaattcgggatttctcgcaaaaatcccattttcaaacccttggagctttgggaggcgattgttaagtgattcttggtgaattctaggttaggttgaggatcgtttcggttagcacgtggttgattatttgctccggtagagttgtttgggtgaatttcagccttgagaatacttttgaaagaaagaaacaagaattattagcttctcaaagtgcatcagctgtggaaggagaaactaatttagctggtcaaccttctcaattaacagaaatggatatctgggtgcaagctgttggtggaaagaaaaaggaaagagttaaaggtcttggctccctcgggtcgatctgtaaaggcgtcatctaaatcacatcagctttatcgagagaaattgatgag

SEQ ID NO: 9146 - DNA, 542 bp, Solanum tuberosum
  Predicted polypeptide sequence is orthologous to G259
cgcccttctactcttctccacttcatcataattaatatcattcattttctttcattttattaaaacaccttttctttttgctttttagtaactcgaacttataatttatgtacttatcatctgagcagacccttctcgtctaagttgaacgtagtcttttgaatgggggaattagaggatgaatgtgaaaggaatttgttagagtatgtaaggaaggcatcaacatcaccattcttgctaaaaacatacatgttggtggaggatccggcgacggacgacgtcatttcttggaattccgatggatcggcgtttatagtccggcaaccggcggagtttgctagagatttgcttccaacgcttttcaaacatagcaacttttctagctttgtccggcaacttaatacctatgtatgtttactatctccctcccaccctaaaaaaagttaacgtgtcgatattttatacgatcagatcacttataagattattatcttatttatttgcttggtaaagagaatgaaaataaaaaaaaaaaaaaaaaa

SEQ ID NO: 9147 - DNA, 933 bp, Solanum tuberosum
  misc_feature (70)..(70): n is a, c, g, or t
  misc_feature (787)..(787): n is a, c, g, or t
  misc_feature (795)..(795): n is a, c, g, or t
  Predicted polypeptide sequence is orthologous to G2604
agtggatccccggcatgcagtgttatacggcacgaggcaaatgtgcagtagatgaaccagtaacaaatcnatgaaacagtaaagatggaagcagctgctctgttagaagtttttgaagcagtaggcttttgagatctcaggagaggactacctctgttagcttcacaatgccagttccgcttgctccatatcctacaccaccaacaccatttacaccacctgctaacggtacgcagagccagcttgtgtgctctggatgcagaaatcttttactctatccagttggagcaacatctgtttgctgtgcagtttgcaatgcagtaacagcagtaccacctccgggcactgagatggctcagttggtttgcggaggctgccacacattactcatgtacattcgtggagcaacaagcgtgcaatgttcgtgctgtcacacagtcaatttagctatggaagcaaatcaggtagcacatgtgaattgtggcaactgccgcatgctgctgatgtaccaatatggagcacgatcagtgaaatgtgcagtgtgcaattttgtgacatcggtaggggtttcaacgagcacagctgagcaaaagtttaacagctaactttaaagcagctgagccagtgctagaaacttctatgtctaaagttgtcgtgttatgtgtcagcggcattgcagctgcatcaaccggaggaaatttctacttgctactagtataggagctattacagagctttttttcccctcgtgcatctgtaatagaataagcagttttgcaggttgagncttacaanaagggtattgtatataatgggtattggcgtttggaaagtctagttgaaaagaatcctggatagcaaagactcttttcagcctaaccatattatgcgttcactcttggggattgccttaatacgacgtttcaaacatgt

SEQ ID NO: 9148 - DNA, 769 bp, Solanum tuberosum
  misc_feature (709)..(709): n is a, c, g, or t
  Predicted polypeptide sequence is orthologous to G261
catatatcagtgtgtacagtgaacaaacattttaacaatcaagaacgtctgagctactgaacgcgtagagcagcaactattacctcataggaatctacccgagctctggtaaaccattcttaagggccaggaggaattagtttaaatgctaacagatcgagaaccatacaagatatccgcaaccatgacatatccagaatcagtatagacagtattacacacgtcgtgtgtttctactgatagcatgaaacaactgaatacccttatgtaacatggacaggcaacgccggaaaggatataactacataaaacatgaaattgtgccagactagcattactactgatcgactctatcattcactatatcatgtcatgcctgccacattacattctctctgctggagtaagatgtcccaactgttctgtaaggctaattacagtcttcctgttccaccaaaatttcccatcctcaactgtcttggattcacttattttgctctccatatcttccctttccggctttacatcagtagaaccagggttctcagtaaggaattgttcccagaatacatcatttactcctgttggcacattattactagcagtctctactcggttttctggcggagtaacatcaggagtagtgtttccattaggctcagagttcatgtcaatatcagaaaacttagatccaacatcaacagttagntgtgggtaagatatagcagggctaatcggcacaactgatagattcatccaagtctattga

SEQ ID NO: 9149 - DNA, 800 bp, Solanum tuberosum
  Predicted polypeptide sequence is orthologous to G2632
ggttcactctactctctcttctgcctcttcccttctaactgaacattgtacgaagaactaaacttactagaactagagaagcatgcaatcagagtccaaaagtgcaaattgtgaggaagctagaacatataatgttccgaattccaccctagaaccttggtggaatactgctggcaataatcctgtttctcttggattgatgcggggaagtgcatcagattcaccaccacccgaacaagctgtggatggccgatcacaatctgatggtggatccaacgaggaagatgatgatgctcctgaaaaatcacaaaggaccatacctatgcattcagatgggagttatgctcaagtagatcagaatttacagccaattgcgtcaaccattcctccaaaggatgatgggagcataacacaacccccacagcttgaacttgttgcacactccatggcatgtgctccaaatctgtatgttgacccatactatggtggaatactggcaccttttggtcagcctatggtcccttctcatgtacttgatatgcatcatccgaggatgcctttgcctcatgaaatggctcaagagcctgtttatgtcaatgccaagcagtatcatggtattctgcggcgaagagagtcacgtgcgaaagcagaacttgaaaagaagctgataaaagggagaaagccatatcttcacgagtcgagacatcagcatgccttgaaaagggcagagcttctggagggcgttttgcgaaaaagtcagatgctggtacttcgaggggagagggtctgggtctgctgtt

SEQ ID NO: 9150 - DNA, 920 bp, Solanum tuberosum
  Predicted polypeptide sequence is orthologous to G2632
agcttaagcatatgtatgtaataaatacaagctaaatttgtgagtttttcttgaaagggggttttctttaactgctgtcatccccagaaaaagaaagctggagactgggctacgaattacctcacaatcaactacccaaatgcagccatggtggcagggttatggtgataatactatgcctttggcaagtgagaatgccgttgcacaggggaagtctgaaggtggcaatgaggaaaaagaaacaaaggcgctagccctggaatctggatcagatggaaataatgagcaattcaagcagcacctcaagcattttgctcccacaactgctgccatcctggctgagcagcagaaggaactcacaggtcattcagctatgttggcgtcatatccatatccagatatgcagtatggcggaatgatgacttatggggcacctgtacatcctcacttatttgaaattcatcatgcccgaatgcctttgcctcttgatatggaagaggaacctgtctatgtgaacgcgaaacagtaccatggaatattaaggcgaagacaaataagagctaaagcagagcttgaaaggaaagctattaaagcgagaaagccatatttgcatgaatctcggcatcagcacgctatgagaagggcaaggggatctggaggccgctttctgaatactaaaaagggcaatgacatggactgtacaccagaggagaccaaaaattatggggcaaccattccaactcactctggcaactcgtcaggttccgggagttctgatcaagggggaaaggaaggatctacagttcaagacatgcacaaaggacacagccacagtttcgcaactggcaatggccatggttcatctgtgtattttgcccagagcactggaagtgagcaagggaatggccactacggtcgcg

SEQ ID NO: 9151 - DNA, 769 bp, Solanum tuberosum
  Predicted polypeptide sequence is orthologous to G2632
aatgcatcagattcatcatcattggaacaatctgtggatggccaatcacagtctgatggtggaatcaagtgaggaagatgatgatgctcctgaaaaatcgcaaagtatcgtacctttgcatgcagatgggagttatgggaaagcggatcagaattttcagccagctgctccagccatacctccaagaacttgatggaagcctagcacaagccccagcagctggaacttgtggggcactctattgcttgtgctccaaacccatatgttgatccatactatggcgggatgatgacagcctttggccagcctttggttcctcctcatgtacttgatatgcactatgcaaggatgcccttgccacaagaaatggctcaagaacccagtttatgtaaatgctaagcagtatcgaacgatcctgcagcgaagacagtcacgtgctaaagcagaacttgaaaagaagcagataaagggtagaaagccatatcttcacgagtctcgacatcagcatgcactgaggagggtaagggcctcggaggacgttttgccaaaaagacagaatgcttctaagggtactggttctgtgagttcatcgggttctgaacctttgcagttcaatgctgctgatattcaaaagaggcatgaacatggaacgttggcccgagcttcagcagtctttattccacatggttagccagttatgcgcaatcaaaagtagcttttcaggaatcgaaagatgagtaccagtctgctgaacgcacggaacgagttt

SEQ ID NO: 9152 - DNA, 991 bp, Solanum tuberosum
  Predicted polypeptide sequence is orthologous to G264
gtcgtccctcgcccggcgtgtttctcttagttcaataaaatggatgtgatttcggcggcggtggcggccggcggcggtggaggtccggcgccgttcttgttgaagacatatgagatggtggatgattcgcatactgatgacatcgtatcatggactcagactggtcacagctttgtcgtctggaatcctccagaattcgctcgaattcttcttcctacttatttcaaacacaacaatttctccagtttcattcgacagctcaatacttacggcttccggaagattgatccagaaagatgggaatttgccaatgaggaattcttgaaggaccagaagcatctacttaagaacattcatcgtaaaaaacccattcacagtcatagtcaccctccgggttccacagttgatcccagaaagagctgcatttgaggaagagattgataaacttacacgtgagaagtctgggctcgagactaatgtctccaggttcagaccaggcacatctgctggcaaaactccaggtagaagaactaactggggcgggttggcagtatagagcaaaggccggagagtttacttgacctttgttggagaaagccattccaaatctcgactttggttgagcgtcttggtcaagaaactcgcagtccctggatatctcttgccatttaggttaagaaagaaggagattgtctccaattcgacagggactccacccagtccccaggaaagtatgttccgttggaacaaccattgcacggtcttagagttgaagtgtgggggaaccttttctcattcgaagaaactttctttccatgaatatagagttccacaggacttgaaattgttccacccttgcttgggtcgtcccggatactttacacggtcggtggtttcattgcgcgagcaccgccacaagtttcggctaattaagaaatgtcgtcgaaggacccctctggtcattggggaaatttcctttcaagggatggtc

SEQ ID NO: 9153 - DNA, 938 bp, Solanum tuberosum
  Predicted polypeptide sequence is orthologous to G2655
cgagaattctagtgtttgtgcctttgcttgaaacttccaatctaaagttaggtttctttggaacaaacatatttatttctcttcttcatctcctattgtttgtcctctttttttctttcttagcctttcaaacaacttttcttgtctatatatgttatgaaaataaagtaaaagagaaaaaaagggtatttggggtcaataaaaaaaaaatggcattagaaacagtgatttacaatcaagaaacatttgggtacggttgcaaagagtactacaacaataatttgggtaactttaattataattatgagttggatttattacaaggcgaaggaggaggtggagaaatgagttttacaaatttgttggatcataataatcgggaagaatcttcatcatcgccaccagaactaatgtacaacaacaatgcgagagagtacaacatttgggacccaaattcttcgatagaagatcatcagctgtttatagaagggtcaccggcggctgaaattccggcggcggcggtcagatctgccgccacctccggccgccggaaaagaagacggacgagaagttgtaaaaacaaggaggaattggagaaccaaagaatgactcacattgcggtggaacggaaccggcgtaaacagatgaatgagtatcttgctgttattcgatctctaatgccaccttcgtatgttcaaaggggtgaccaagcatcaataattggaggagccataaactttgtgaaggagctagaacaccatcttcaaaccctagaagcacaaaagagaagccattctcaaaaacaagaacactcagataatcatggctcatcatcaagtccactatttgctgattacttcgcgtttccgcagtactcaactcattccaagagtacatctccggcagcaccagcatctactgctgccggatcatgtgac

SEQ ID NO: 9154 - DNA, 722 bp, Solanum tuberosum
  Predicted polypeptide sequence is orthologous to G268
agagctaagtaacaaaagattacttgtaaggttagaaataaatacaaattaaattcaaagtaagcaaattgctcaattatttacagtttttttttaaaaaaagatttctctccagaaacattgaggctttttcaattttgtattaaaccatctatcttctttaaaaataagtgttgtatcaaaacatataactaatgcgggatgctttgtgcactgagctgctcttttttattataaacgtttttccccaatcaaaagcttccaattggaatgaggtccctcgctgctatcatatttaaatgacacccatcctaaggcttgtgcaatttctacgagctcttcgataacaggtgtggtgtcgcgaatataaactcgtcccccgggtctaaaaattctgtctatttcaagcatgatagctgtcacattgcatctgtttttttcgactgaaaaaagagcagctgcgtggactaaatcatacgttcttggataagtatcaaatggctcacaccagtcatgcatgactccaatgaaaccccggtcatatagaacaggcagtgtattaggaccactaacgggaacaacattcataacccagcaatcgaagttgaaatcatgcaacgcagctgcaaaccccccatatacagctctcatgtccagcacgtttcgtaggtttaacgtttcccaacggaaagcaccaatatatccttttattacggcatacc

SEQ ID NO: 9155 - DNA, 973 bp, Solanum tuberosum
  Predicted polypeptide sequence is orthologous to G268
actataactctgcaatttctcgttttgcttatcaattttcagatgatttgattctgttaacttcattgtcgaagaagaaggagacaacaatgaagggagatgcattcaaatctactacagtaatcaaagttttagcctttgcattactctctatagcttttttttacttcggcaaacactggtctgatggatctcaacagcttgttttcttcaattcacgtcaagattcagcttctctcacaaacccaacaaacccctcttctcaatttgtttcaatttcccctaatttcaacaaatctgttgatttatcctccataattaatgacaccaccgtttctgataagccactggaaaaaacgccgtcggtggaggttgttttatctcctccaccgccaccaccgtcaccgcctccggcggttcagaagatgggggtgttggatgagaatggggtgatgaatgataattttgaagtaggggaatttgatccggaagttgtggataattggggtgttgggaatgagacggatgtagaggtaggtgatggggttaagagatttagggttaagaagtttgggttgtgtcctgatagtatgagagagtatattccatgtttggataatgtagaagcaattagtaagctgaaatcaactgagagaggggagaaatttgagcggcattgtcctgaaaaaggtaaaggattgaattgcttggttcctccaccaagaggttatcgagctccgattacatggcctaaaagtcgcgatgaggtttggttcagcaatgttcctcacgcacgtctagctgaggataaggggggtcaaaattggatattgatagacaaggacaagttcaagtttcctggaggtggcacccagttcattcatggagctgatcagtacttggatcagatggaaaagatgctccctgaaattgcattttggcgtcatgtccgagttgctttagatattggctg

SEQ ID NO: 9156 - DNA, 805 bp, Solanum tuberosum
  Predicted polypeptide sequence is orthologous to G268
aaatatattaatatatgttgcatagtttcttttttctgttctacagtttctggatttattgttaagatttctcagctcaagtaaacagcaaaacttatgactaaaagaaccccctcatagtcacagaacaatcaatggaaacaaatacaacactgagctataccatatgtcttcgatcgtgtgaagctataccatcttctgctgtacattttatatggctacatggttcaaacaacagccctggatctttctgccaatgttagcaagcattcgatctttcaggtccaattaacgtagaaacatgagttttgatgtgtccgtggagtgttggcttctccattcttatcatctgttaggctcgtaaaaggtgtttgtcacctgtcaatatcttgtaactagcatgaggaccctcagatgtgtctctcacagttacatgccaacccatggctttcccaatatcttgaagttcatccatgacagcaacagaatcacggatgtacgctcgtccacctggcctcaatatccggtccatttcaagcatgattgtggacatgttgcatcttttttgttcaatggagaagagaccatttgcgtgcaataagtcgtaggttcttgggtaagtatcaaatggttcacaccagtcatgcatgactccaagtagtccacgatcaaaaatgacaggtaaggtatttttaccactaacagagacaacattcagaacccagcaatccagttgattttcaatcattgctgctgcaaatcctccaaaaccagctctcatatccatcacatttctaagttttaa

SEQ ID NO: 9157 - DNA, 810 bp, Solanum tuberosum
  Predicted polypeptide sequence is orthologous to G268
ctaccgtcacgtttacgcctcccccaaaagtccattgtttcaatgccatgtaaaaccagcaaagaatttcttcagaaataactcaaccccacaaacccttttgtgaattccaacttcagttcttgaattttcgtttattttggtggtggagggaggaacaatgaaagggatgagcactagtttctcaggttcagaaaataatattgtttcacttacaaagactccagctttcgtcaaaatcatcggtttttcttttctatgtctttcccttctcatcattctcagaagtttttcatcagatatcactactgtctctaaccccacaaccccttctctaaaatttcctatgtctttcacttccgcacccactgccggtgacaatccatctccgccgccgtcggcggcggcagctgttccagagctccgacagccggggatggagaggacgggtattgttgatgagaatggggcaatgatgaatgagtttgtggtgggggagtttgatgaggaggtgatagacagtgtggtggatgagaagaatgggaatgatgagaatggaggaggagttttgaggggtaaaatagggaaatttaaagtttgtgatgagagtatgagggattatattccttgtttggataatatggagggaagtttggaaaggcattgccctccaaaaggaaaaggattggattgtttggtgccatggcctaaaggttacaaactaaggataacatggccaaagagcagggatgagatatggttatccaatgtggcccgtacaccctttgccaaaggaaaagcaggcaataa

SEQ ID NO: 9158 - DNA, 590 bp, Solanum tuberosum
  Predicted polypeptide sequence is orthologous to G2699
tgcccttcaatggccttataaataacactatttgatgcacaaaatccaaatctatgccatgggatgagatccacataccctgctagctcagtcacactcattaatctcctttcaagattactacctccatgaagatttgtggcattaggacaaaccctagaagcccttgaaattaatgccctaaggaaccatgatgtgagtctttgatttggatctccattagaagaagccaaattgttgagcacccacatgacttgttgagccaaagtaacatcattgttctctaaggcacttgcacaatgaagtaatagtttttccaaacatgctccatcaaggttcccaatgcatccttgtagtgctcctgctagagaactttgagagttgttgaaaaaactagggttttggaggggaatggttgtgaagttcattgaaacttgactctactataatgctaaacacaataaaatggaagcaaggaccaacttgaatctgaactacgattgatcagatgaagtcttcaccgaatagaatttcccttttcgtgatgaagtgatgtatgttatatgtgaaggataaataaattttgtaag

SEQ ID NO: 9159 - DNA, 775 bp, Solanum tuberosum
  Predicted polypeptide sequence is orthologous to G2699
gcagaaatctcacctttaattttctctctctctctgcctctgataaagaagatgcagtgctattaatccgttttgtagcctttgtaaagctttttcttatgagaagtccttattcatgccaaccagtctctcttttgcctcaattttgactttaacagctgatcgacgagatatatatatatatattgagattttctccaccagtcattttactctttaaacaaaaaagttgaacagtcaattattgttgattcatttccagaatattgcaaaaagttctctctgcactgctattagccactagcaaaccaataatggatcgcttcccaataatattgttcaggtaccactactactagtctagtctttttctcttgtcttctctacttatttctcaaaaaaaaaaagttcatttggaaatacttttctctaattccttcctctcatgatgcaatttactgagagtttacctccacaagtttcatcattttcaagtttgatgatgaataagaatagtaatactaataataatcagatccaacacgcgcgcccatggcctggttttcacacatcgaagaatttgggaaacattggggatactaattgcatggaacagttgttagtccattgcgccaatgccatcgacagcaatgacgcaactttagcacaacaaatattgtgggtccttaataacattgccccctcctgatggtgactcgaacccacgcctaacttgtggattcctccgaagccctattcttcgtgctgcgaaaat

SEQ ID NO: 9160 - DNA, 753 bp, Solanum tuberosum
  misc_feature (735)..(735): n is a, c, g, or t
  Predicted polypeptide sequence is orthologous to G2699
atttgatcgagataaaataaaacaaaagttaatagctaagtcaaatgaaattaattaactaaagaggaacccaagcagtagcaaacacaacactatgtcctttccatgtaagcacaagatcttcttcatccctctttagcccccacccagctgcatgctcatccaacatgttcttcacttccgtaactccctcttcactaaatccactgctcctgaaatttgcatttctcatccgttgcacccactgactcttcggctccagcctttctagtcgttgtataccctcctgagctatcacattctcaatcttccagcaaatatccgcttcgtaccactgcctttgcttgctccctcgcggaagaaatgtatccactgtatcataaggtatccataaataattaaacgcggatcttaatctgcacacgagattattagaagtaaaatccgcgtcttcatctactagcacaacaatcgttgggtccaaattccgaatggccttaagaaacatggcacggaacgaattggaaagaaccgttgtttcctctggtatgtaatgaagcatcatgtgacagtttattactagtgcttcgcccattatcaggacgtattagattttggacacgtagctgttcgaatacattcgaaaaaccatctgatgaacttgaaggaatactctaaattccatcatgacatttcgtgaaccttgcgaaatttaccaatttaagcacctaaatnctttcgtaaggaaagatc

SEQ ID NO: 9161 - DNA, 1018 bp, Solanum tuberosum
  Predicted polypeptide sequence is orthologous to G2719
ataacaataagcagagaagatgaatgaaaagacggagcagaacggttacgccgccgccggcgacggcgatggcggcgacggaggatgtactttggttgatgccggtgatgcgatgttgcacggaggaagaggaagtacagttagtagtggaagagtcaaagagccctggtcgccggaggaagatggaatactgactgaacttgttaataagttcggtgcaaggaattggagtatgatagcgcaagggattgcaggtcgttctgggaaatcgtgccgacttcggtggtgtaatcagcttgatccggtgcttaaacgcaagccttttactgatgaagaagaccacattataattaatgcgcatgccgtccatggaaataaatgggccgcaattgcaaaattgctccctggtagaacagacaatgcaattaagaaccactggaactctacactaaggcgtcgatttgcagggctatggagggttaaaccagtatgcagcatgatgttagatgatagtagcatttacaaagccagggcattatctgaagaaactatgtcacgtgaagatgttaaccaaattaagcccctcgaaatgcaagaagttagtcgtactgagtgcatgaccagccagtctgaagacaaagatcaaatatatgggacgtgtggtattcctgagaaaactccacacttcgcttttgaaagaagtcgtcctacatctatgggaaacagtgatccacctgcttctcatccaactgagaaaattggcgcatttaatgtttataacccttctgtaacttcaagaatagtgccaatgcaggggcctctgatccacacattctcaccagactttgatatatgcaaacttcttgaaggtgtatctggtgaaaccatagttcctcaggggtgtggccatggatgctgtgcagctaccaccaagagcacctccaaaagttcattgttgggtcccgagtttgttgattacgaggaacatcctcctctcctcagccatgagttagcttct

SEQ ID NO: 9162 - DNA, 751 bp, Solanum tuberosum
  Predicted polypeptide sequence is orthologous to G274
ggagatcatttaaggaattgttggaatattttcatgccattgggctgcaatggcgggcaaaaactcaggggataataggactaggacttctgtatcaatatttataatagctggtctatgctgcttcttctatttacttggagcatggcaaagaagtggttttgggaaaggagatagtatagcagtggctgtcaccaagactgctggtgagaattgcgatatactaccaaatctcaattttgaaactcgtcacgctggcgaagcaggcggtactgatgagtcagaagaagtcgaggaactcaagccatgtgatcctcagtacactgattatacaccatgtcaagatcaaaagcgtgctatgactttcccaagggaaaatatgaactaccgagaaaggcattgtccacctcaagaagagaagttacattgccttattccagcgcctaagggatatgttaccccgtttccgtggccaaaaagtcgggattatgttccctatgccaatgctccatataagagcttgactgttgagaaggccattcagaactgggttcaatatgagggtaacgtgtttagattcccaggaggagggacacaattccctcaaggagcagataagtatattgatcagcttgcttcagttgtcccaatcgaaaagggacagttcggactgctttggacactggttgtggggttgcaaagttgggtgcttatctttggaaaagaatgtcatagcaatgtcatttgcccc

SEQ ID NO: 9163 - DNA, 736 bp, Solanum tuberosum
  Predicted polypeptide sequence is orthologous to G274
ggttgatagagttcttcgacctggtggctactgggtgctttctggccctccgatcaattggaagactaattacaaggcctggcaacgtcccatggaggaccttcaggaagaacaaaggaaaattgaagagattgccaaacttctttgctgggagaagaaatctgagaagggtgagactgctatttggcagaaaaggatggatgccgactcatgccgttctacacaagaagattctgaagctacactttgtaaatcgacagatccagatgatgtctggtacaacaaaatggaaacatgcataacaccaagcaaaggcaatggtgatgatgaaggtctaagaccattccctgagagactttttgctgttcctccaagaattgctaatggactagtttctggagtctccgttgaggcatatctggaagacagcaagaaatggaagaagcatgttagtgcttataagaaaagtaacaaactcatcgacacaggaaggtaccgtaatatcatggacatgaattctggacttggaggttttgctgctgctcttcaatctcccaagttgtgggttatgaatgttatgcctacgatagccaagaaaaataccttggggagtcatatatgaaacgtggaacttattggaatttatcatgaactggtgcgactttgaaggcattctcttagaaatggaccgtattttgcggccagaaggagctgttattctgagagatgacggtaa

SEQ ID NO: 9164 - DNA, 767 bp, Solanum tuberosum
  Predicted polypeptide sequence is orthologous to G274
tccccaacccacccccagcccccaccaccgcaaaaaaaaaaaacatgtaaaacaactgagagttgtaaagagagacacagagagttgtaaatttgatgtatatacttgtagatatcattggaaaaaaacaaattaggggttttgcagtgttttctgttcttgatttaatttgaaactcatatctgagttggggacttacaaagcaaaataaagcaggaaagccagtaaaaggaagtgttggaaaaaaatttcatgccattgcaatggcaaacaaaagcttgggggacaataggaccaggacttctgtgtcaatatttattgtagccggtctctgttgcttcttctatttgcttggatcatggcagagaagtggcgttgggaagggagatagtatagctctggcagtcaccaagagtggtgagaactgcaatatcctaccaaatctcaattttgagactcgtcatggtggccaagcaggtagtattgatgattcaggaacagaagtcaaaaaatttaagccatgtcgtcctcgttacactgatcatacaccatgtcaagatcaaaagcgtgctatgcacttcccaagggaaaatatgatctatcgagaaaggcattgtccgcctccagaaaagaagttgcattgccttattccagcacctaaggggtatgtcaccccatttccatggccaaagagtcgggattatgttccatatgcgaatgccccctataagagcttgacggtcgagaaggccattcagaactggatt

SEQ ID NO: 9165 - DNA, 944 bp, Solanum tuberosum
  Predicted polypeptide sequence is orthologous to G2747
ctagtttatgaggatactctttctttcaccctagctatctagttccagttcctctcacactaataactactggacgcaattacttttttcccatcacatcttctctaattagatctatgctgggtcctagatcatgaatttcttcgatcaaggaggtacacgccaattttctcattcttcttcttccagccagaagattatagttcctgatttctcttatcagcaaagaagcaccactaataatggtgaagatagtactgatctcgtgatgaatatggatcttgaccctgcagatgaagttggtgaaagtaatacgattgagcgagaacacatgttcgataaggtagtcactcccagtgacgtcggcaagctcaatcggttagtcatccccaaacagcacgctgaaaagtattttcctctggattcctctaccaacgagaaaggcctccttctcaatttcgaagacaggaatggaaagccttggcgcttcagatattcctattggaatagcagtcaaagctatgtaatgaccaaaggttggagccgcttcgtcaaggagaagaagctcgatgctggggatattgtctcatttcagcgtggagtaggtgaattgggcaaggatcgtctcttcatcgactggaggcgccgtccagacgcccccgaccatctccactacacccacttcactaatcatcatctccataataacttgtaccgctctaatattcagtacccagctgctgctgcttggaatcgtcctctctttttgcagcctcctcctcctcctgaccattcacatttacaatattccctggaacctgcagctggcagcatgtctcatcatcatcaacaacaatctcacggatccagtcctaattattactacgacactttgtatttcaacaacagccgtacaaccgtggtaaatggaaacccttgtccga

SEQ ID NO: 9166 - DNA, 1021 bp, Solanum tuberosum
  Predicted polypeptide sequence is orthologous to G2766
atcccctcaccccacccacccacctctctctctattaagttctcaacctccaaatcttaacaatccaattcaaaacaattctcaaatgtatccatcatcaacatcttcttcatcacaaggttcaatgagccacaccagcaccaccgctggcggcggcggcggtctcactcgctacggttcagctccgggatcatttttaactacagcagttgaatccatcgttaacgcgaaggaacaatcgaatttacagaggtcaattggtttcaacgacttaacaatcggcggcggcggcggaggtttgccgacgacttcaaccacgccgttggttcgacatagtagctcaccggcgaggtttcttaatcaacttgctactgctgcaggtgatactgtttcaatggggagaggaagctataactcaaaaggcggtggagatagtggccggggaataacaaggctgaactctcagctcagcttcactaggcaagaagctctctctcaaatagcagaggaaaatgaggatattgaagggaccagtatagccaatggccacagaaagtcaacacattcttatgccagtgcaagtggtttcgcaatgggttcttgggaagataacaactctataatgttctctgtcacacctagcaaacgagccaagcagattagcaatgacatggtcaatgggctcgatgatggggaaactcagtttcagtttggcttgtctcagacagcactagaaatggcatctatggatagattgctgcacatccccgaggattctgttccttgcaaaattcgtgccaagcgtggttgtgctactcatcctcgcagcattgcagaaagggaaagaagaaccagaattagtgggaaactaaagaagttacaagatcttgttccaaacatggacaagcaaacgagctacgctgacatgctggatctagcagtgcagcacattcgaaaccctttcagatcaggttcagaatctgaatacagaacttgaaaactgcaaatgtggatgtaagaa

SEQ ID NO: 9167 - DNA, 749 bp, Solanum tuberosum
  Predicted polypeptide sequence is orthologous to G2774
gaaacttggctagtatttgttttggtgattatttaagcaataagccattggtggactttaaaccaagtctcaaaactttgaatttggcacaacataagaagaatattgggctacaacaaccttatataagcaagtctaggggtacaatatcaacatgcaacacattgaagagaagcaatggaagatcacaagaatataatccaagtgctggaaaaaagaggaaattagaagataatttagagactaattcaaaaaggcaaaagaatgaaaattctgcagttacatctaccaagacacaagttcctaaagtgaagcttgcagacaaaattactgctctccaacaaattgtctctccatttggaaagactgataccgcatccgttttgtgggaaacaatcaactatgttagatttcttacaagagcaaatacagctactgagccatgccctaacatgaagaaccaatacatgcaaagaaaaggtaattgggggaggatttgatagaacaaagaagttgattttaagggagcaaaggacttttgttatagttcccattttcatggtacccccttcaatatatcatgagaactaattaattggatcttgattatttaaatcccatcaatatatgaaggatgtttggtatacagatacattaacgtatttaagttatataatattattgtcgtccagtgttacgaaactttttcattcacttcattgaatcccggaccatcatacactagatat

SEQ ID NO: 9168 - DNA, 924 bp, Solanum tuberosum
  Predicted polypeptide sequence is orthologous to G2789
ccaaaccctcaccaaaagagaaggaaagaagatcaacaaacaaattaaaggattgtagtatggttgattcacctatttctcctgaattctttttggtttctcacttcattactttccctttccaactcttttttggtgaaggttagaactaattccatcaatttcatagctagaaagtaaattcaaatacaaggttatattagatggatcaattaacagctcatggccgtcctcttccacctccttttcacacaagagatcttcagttacagaataacaatcctcacctccacggccagttccatcacatacagcagcagcagaaaactgaagacgagcaacaaagcggacacagaaatcagaaacgagatcgcgacgataacttcagtttaaatcctgatcaatccggttcgatggatagcaaaggaaacactataggaggagatggcggtggagaagtcagtagaagaccaagaggaagaccagctggttcaaaaaacaaaccaaaaccaccaatcattatcactcgtgatagcgctaacgctttgagatctcatgttatggaaatcgctagtggttgtgatatacaagaaagtatctcaaacttcgccaccagaagacaacgcggtgtttgcatattaagtgggagcggaactgttacaaacgttacaattagacaacccacgtctccgggtgcggtggtaactctacatggaagatttgaaatcttatctctttccggttcatacttaccaccgccagctccgccagccgcatcagggctgacgatatacttggccggaggacaaggccaagtagttggcggtagcgttgtcgggccgttgaatgcttcagggccggtggtgataatggcggcttcgtttgggaatgcagcatatgaaaggcttccacttgaggacgaaa

SEQ ID NO: 9169 - DNA, 912 bp, Solanum tuberosum
  Predicted polypeptide sequence is orthologous to G2791
tttctaaaaacaagtcatcaatattaatatgactataaataattccataatagtataaaacgagaaatataaaatcaaattgattctaaataaaaacagtgagtcacattgggataggaggactaactcaagtcccgccattgcccatcgtagctgactgaacagtggaagctgacaaggtaggagaagacggtccaccgccggtctcaccaccgccgttgatagcggagcctccgccgagtagtagtgggttgttgggtttcatggagtgacacgtggaggtggaaatagcagtggctaaggaaattggcataaggcataagccttttccttgaagatactgcattgctgatcccatatcttcttccattagcttagctacctggtgctccgtcatcgtcatgctgctgtcattgtttgcagacgacgtcgttccattactgccaccccgacctccatttccttgtacacaatcacctcctccctcagaggatctatcagcaactaggggagcaacagctgcagcaccacccaatctgctcatactcagaactttgacttggagctggaggaacctgacatagtcgatgatctcatctaacattgaagccttgtctgtcttattggcattaggtaccagctcctgcaaagacttcattctctctgcaattctctctctccgtaatctttcagcaatgctgtgaggatcagttgcttgtcctcttcgagccctaactttctgttgctttggctgcgctccaccagctgaaccactcgccgccggcgtttgattcatcgtcaacgacgccgccggagctccgaaactctgcgcctgagaatggtgaaaatgctgagattgatttgaggtttgaccaagagatccagcgaatccattgtaaagagcttgaactg

SEQ ID NO: 9170 - DNA, 967 bp, Solanum tuberosum
  Predicted polypeptide sequence is orthologous to G2791
tttctctcttctccttttagaaccaaactttcacacacaaagctactgaagaaaaaatttctctcggcaaaatctcagagaggaaaaaaaaaatgcaagccatgaattcacttctaagtcaacaacagcagtcacagatgtcactgcaagaccttcaaagtggcggaaatggcggttctaccggtggtgttggtggtttaggtcaacacaatatgggtcactttcactttgatccgacgtcgtctcacgacgattttctcgaacagattctctcttctgttccttcttcttctccttggcctgacctttccaaatcctgggacccacatcaccatctctcatcgccgccgcataaccctagctccggcgaagatcaacctccttctaatccacttcactcacagttccattacgacgaccaggcttcttctctactagcctcaaagctccgtcagcatcagatcactggcggcggcgcggctgcagctgctaaagcacttatgctacaacagcagcttttgctttctagaacactcgccggaaacggactcaggtctcctaatggagcttccggcgataacggcctcctttccctacctctaaacctcagtaataatggtgaccaaaacgacggcgtcgctaacccggctaatgacaattccgttcaagctcttttcaatggattcaccggatctcttggtcaaacctccaatcaacctcaacattttcatcatcctcagggaggatcgatgcaatcgcagagtttcggagctccggcgatgaaccaaacgccggcagcaagtggttcagctggtggtggtggaggttcaacgccggcagcacaaccaaaacaacaacgagttagagctcgtagaggacaagctactgatcctcacagcatcgctgaaagattacgtagggagagaattgcagagagaatgaaggctttacaggagctggtacccaa

SEQ ID NO: 9171 - DNA, 889 bp, Solanum tuberosum
  Predicted polypeptide sequence is orthologous to G280
ctgtaacaaaaatggctactgaagaagcaagtttaactttgccttcttatcctgatatgataatggaagctataggtgcgttgaatgaagaagaagggtcgaataaatcagcaatatggaggcaaattgaagggactcatgttacactaccaccagggcatggtacactccttgcacatcacttgaatcaaatgaagcaagctgggcaattagttatgttgaagaataactacatgaagccaaacccaaacgcgccaccgcgccgtgggagaggccgtccaccgaagccgaaagcttcggttccggttccggatgggtatcctagaccacgtggaaggccaccgaaggagcgtgttccatacgcgccgattacggtacctatgaagaagacgacgactgaaagtagttctggtggaagtgggaagaaacgtggaaggccaaggaagtatccgatgacggaggagactccggtggcggtgaagccaataggtactccgagaggaagaggaaggccgccgaaggtgaaaactccggtagctgcaactgtaggggcttaattgaagaaagacaaattagtttagggacttgtatggcaaaatatgctaactgttgttttctcttttttatttgaatttaatgtttagtccctgtagttttgtttaattacatttgtaggaagaattgtgtgactggtgagtgaatcagtttgtagagaagaaaggagtcttggtaaaaaagcatgtctgtctgtattgtttggaagtaatccatcggcaaaatgctgtgaaagagctagagttactcattgggaatgtctttgcccaattgttactcccaaattggtcgccatgatcaacccaaagcgaattattcgccttattcaaggctg

SEQ ID NO: 9172 - DNA, 927 bp, Solanum tuberosum
  Predicted polypeptide sequence is orthologous to G280
tactctctctctccatggctactcaaagcttcaaccagttcccttcataccctgagatgatttatgaagcccttgatgaactaaatcaagaagggggtgcaaacaagtcatcaataactaagtacattgaaacaaagtatggagatctgaatgaggaactttcaaagatgctgcctttacatttggacaacatgaagcaaactggagacctgattttcctcaagaacaattacatgaaacctggtccagatgttccagcaaagaggggtcgtggtaggccaccaaaacccaaagctccattgccacctggtgctgttgaatctgttgaatctgcaccaccaaagccaagagggcgcccaagaaaagaccctaatgcaccacctacttccaagaagccaaagccagcacctgttcctggaggtcccaattcaacagatcttggttctactactgggaggcctaggggtagacctaggaaagttaggccacagcctgctcatgatgatgatgatgatgttgaggaaagctgaaaactttaaggcttgttattggagtcgtgctgatggtgatgactctaatgacttagttgtcttattttccccccttttttaggtattagtagtattatcttatgtaatagtttcagtttgagttgccctagtgtgactagggggtcatggtttcaaaactaagactgcgtagaatagactaattgtggtctcagttagagttgtcgttatgggactaggaggtcatggtttacagtgtgcaatagactaattgttgtggtccggttctttcctgaaccccgcacatagtgttagctttagtgcactggtcttttttattagtattgttttcttgcttaatgcccctattagttctagtagatgtgggtataagtttgtaggggattgtgtacttgtg

SEQ ID NO: 9173 - DNA, 840 bp, Solanum tuberosum
  Predicted polypeptide sequence is orthologous to G2802
tcagttcttctctctttttttttcttccaatgtctacaaactcatcagacaaggtagttcaccttgatgaagtgattgtagccatggtgccatttcctgattttagccatctcaatcagctcttcgttcttgctcgtttcatcgcttcccataatatacgagtacacttcctctgccttgctgatcggaaccaagatttgaaacttctcgtccaaggtggtctatgtgcctcaaacatccattttcatgatcttttagtaccttcttctcttgatgctggcaatggtttgccttcgattgttatatttataagaaagctcatcgagcccattagaagaacgtgtattgatatctctacctatgcgaagagattggttataattcatgattccataatgatggagcatataagggatgttcattcattgatcccgaacgtgaagtcttatatgttccacgccatttcagcttttgcaagatactctatgctccgacaaagtattgatcacttagttgttgatgatgatgatgatgatgatgatcatgaaaaaatgatcaaacaaatgcacgatgagtttccgttgttggagagctattgtgggaccatatgcagcaagcactcattagcaaaagaccatgcaatggaaggctcattcacggagaaatccatgaactcgtgccagagaagtcgaaagtaagtacttggatttacttgcacttacaaaagacaacgcagtaatcggcctgttgggtccacttcctatggttggtaaaaatcacgcggactccttagcaacattggacgaaggcttggattggctcccgaaatttccttagaac

SEQ ID NO: 9174 - DNA, 972 bp, Solanum tuberosum
  Predicted polypeptide sequence is orthologous to G2826, G2838, G362
ctatctcatattttatgtataatttccctctccataaaacacacacacacacacactaaaacatacatatattcatacaaaaacacatacacacacaaaaaaactctagttatatatatacatacatatatacaatatggcggaattggagtttcaaagtaagcataataataatcgtacaagcaacggacgtttaaaattattcggtttcaacgtaacggaggatcaagaacaagaggttgaatcgacaaaaacgtcatcaggatcgccggaatctggcagttttccgacctcggacggccggaaatacgagtgtcaatattgttgtagagaatttgcaaattcacaagctttaggtggacatcaaaatgctcataaaaaagaaaggcaacaattgaaacgtgcccaaattcaagctagtagaaatgcatatatgaggaaccctattatatccgctttcgcgccaccatcacacctcctcgctccctcgggaagtgtgatggtgcccacgacctctccgtcgtgggtttacgttccccgccccgcgccaccttttcacgtgtctcatggttgtgtgttcccgaattctacgggggcgcggggtgtagggaacttacaatataccggcagtgtagcggaatctagcttaacgagtgttgggcctcaacaagttaaggcccatagtgctagagttgatgggccgtcattgagtagattttcgggtatggatgctgggcccaattttgatgatgcatttgggttggatttgcatctaagcctttgaattaatttttaattctatccaaaaataggattttgtacatctcagattatttatttatttatttactcaaagattatttttttttccttacatcaattttatgatatttatatctttttcttacattttttttcaattttattgtttgcaaatttagagttcaagttatgtgaaatattaaattcgtt

SEQ ID NO: 9175 - DNA, 321 bp, Solanum tuberosum
  Predicted polypeptide sequence is orthologous to G2826, G2838, G362
agcagtattggtctcctttggttctccattaatttatcgcgaatgcttctcatatgtccacccaaagcttgtccaagtacaaattcttcaccgcaataagagcattcgtgtttcttcgtcttagatttaatcgaatctgaagataagaaagaaggattgtgttactgcaagactggttcacaagtaaattgctcaatataaaagtccttgtttctcaggcaattcagttagctatagagattccttttaatacttgtactgatcctgacttgtcaaatgtcaataatgaaacttcacggataaaaaaaaaaaaaaaaaaaa

SEQ ID NO: 9176 - DNA, 679 bp, Solanum tuberosum
  Predicted polypeptide sequence is orthologous to G2826
atttccacgttcgctccgccatctcacctcctcactccgccgggtactgtggtgtacccggcggggtcaaatccatcgtgggtttatgtaccacgcgctccaccatccttccacgtgtcacatggagggaggggcgtagcgaactttcactataccggcgttataacggagcccaacttaacaagtgttgggcctcaacatgttaaggcccatggtggtagagttgatggaaataatgggccatcattgagtggtttctctagaccggattttgggcccaattatgatgacccgtttggattggatctacatctaagccttgcaccagccgggtcatagaaatatcgtttactagccactcgttttttctaccttatagttatcgtcataaaatttcaaatttcaccgttgaaatttcaggatatttcgatagtctttatagtctttgaaaatcggccaagatttcaaatttcacaagtgaattttttgaatttcaattataagaactgaaaagtggctatttgtgaatttatgtcggctcacggcttggcttggatataatctataggagagtagaattataatttatcctaaaaatgggatcttgtacatgatcaaattatttatttagtttttcaatatatcaaagaaaaaaaaattccttacaaaaaaaaaaaaa

SEQ ID NO: 9177 - DNA, 898 bp, Solanum tuberosum
  misc_feature (31)..(31): n is a, c, g, or t
  misc_feature (57)..(58): n is a, c, g, or t
  Predicted polypeptide sequence is orthologous to G2838
tgggttaaatatttattaatagagacaaatnatactgaggttaggatgtgtcttccnncatcaagaaccaattggtctacatcctgaagggaaaggagtggaattatattggtattttctcttccttaatccactctttggagaatacacaggagagagctttttcaacacggctctgtatttttctctccatttgttggttggcttcaattctaattcaagaaaactgtatcttccctatggtctgttaaattgacctcctccaggtaggataggtcttcagcagggcaatattccttggagagaaggtttgccacctgatattgcttctaccgcctaagaatgtcctggtttcctggtgccccgaaaaatctaaaaaaaagagaagaacaaattgcaaaaccgaaagaatggaagcactgtgttattttggtggctttgttacctgtgtgcagaaaaaagactgatgaggctaaatgttccttcacatgcaaatgtcctgctggtactgttacttctttgaatcgtcccattcccattaaaaaaaaggcaggttaattgaagcttaaatctgtcaaaaggaatgacagatgtcccaaatttactagaatttgaggggaaatgctttcctaacaatcactgatgcaccagccagcgaacaagctttgatatcagaaatcgtcttgattcttcatcggtattgcagtctcataatgcaatccaaaattttccggccccatggacttctttcaatatattgacctgcaaagcagttaaagtttgcccaaccgaacaaattttggaaaactttttcctttgtccaatttggcaaaaatattacctggaggaagtgcttcattagttacagcttcaagtcaatcctgctgcacaagatttg

SEQ ID NO: 9178 - DNA, 828 bp, Solanum tuberosum
  Predicted polypeptide sequence is orthologous to G2885
ttttctggaccatgatagatataatgagaattggcaaacttctctccagcctctgaagttccagtcaacctcctttccgttaaatgaacctttcagcaacagccatttgcctcaagacagagtacgagacaatgatacttcaactggccctcttttgcagaacaaccctgttgatttttcaacctctgccatagtttccgtacctttcgaggcttcaagaggagaaacacaatgccgtgaaagtttagagggtgctgttcagattatgaaccaagcaacctgccaacggtggccagatcagaaccaacattattcccacaattcaaacaatatttttggtaacatgagctctcaagtttctagcaatggtggaatggcctctttacctcatcctatggaccaaaacaatgatatgttctgcacaagggtggagacttctttgaccggcagatcaaatggaggttcttcaatgcacatacacaatcgtgaaagtgaaaaattaactcatgactcgaggacaaagacaaatgaagactacctctttcagacaacaaagcaacaagttggttttcttcctcagggctatggctcccttgatgatcttatgggtgaaatgaaacgggatcaagatggagccatgttaggaggagaattcggatttgatgcttattcacttggttcaggtttatgaggtttttgtaactagcaagttacgaaagagaggatctagctgatatagcaaaatgttatttgctcatttaagagtcttcttaaccaatatattgcatactatggctttttttcattggtctttccagtcggaacgtg

SEQ ID NO: 9179 - DNA, 755 bp, Solanum tuberosum
  misc_feature (195)..(195): n is a, c, g, or t
  Predicted polypeptide sequence is orthologous to G2898
tagaggttgagagttcagataccattgacaacgtcaaagcaaagattcaagacaaggagggtattcccccagaccagcaaagatcaatctctgctctgcttcaacttcaacttcaacttcaacttcaaccaaaagggtaaaatcagcggagaaagtaaaggcacgtagagtgaagcagagcaaacccacatcagncaaaaaaacttagcgccatttcgaacaagaagcctaagaagccccccactgccttcttctatttcttggaggacttccgtaaggaattccaggagcaaaatccaggcgtcaggtcaatgcgagatattgggaaagcttgtggagagaagtggaaaataatgacatatgaggaaaaagtgcattactatgatatagcaacagagaaacgaagagagtttgatagagccatgacgtactttaataagaaaaaggaaggtggagagtttcaagaatatgaagaagactccgattttgatgaatagtattatgcattgtttgtaattctttagtttgagatgttcggtaggaatagtgtgtattttggtattatttctgtacatccaacttatcgatctagtctctcgacttcatgtcttagcacctttgatgactgaacaagcctcctttgcccaaccaaagcagaatccacttggttctcaattatgggttctgtatgtacattattagccttgacagcacttgaaaatagattattccatgcaggttttctgcacaagtgc

SEQ ID NO: 9180 - DNA, 992 bp, Solanum tuberosum
  Predicted polypeptide sequence is orthologous to G2982
aaacaatcttgacattcatgctgatgatgcaggatctcaagggacagctgggaaaaagaaaagagctcagcgtgctactggaggggataagagtggtagaggactcagacagttcagcatgaaagtttgtgagaaagtggaaagcaaaggaagaactacgtataatgaggttgctgatgaacttgtagctgagttttctgatgctaccaatagtgttgcaggcccagatcagaaacaatatgatgagaagaacatcagacgacgagtctacgatgctctgaacgtacttatggctatggatatcatttctaaagataaaaaggaaatacagtggaagggattaccacgcactgatgcaaatgatattgaggagctaaagactgagcgtcttaacttgagaaataggattgaaaagaaagcagcctatttagaagaacttgaagatcaatatgtagggcttcaaaacctcataaaacgcaatgatcagttgtatggctcaggcaatgctcctagtggtggtgtggctttaccgtttattttagtgcagactcgtcctcatgcaacagttgaagtggaaatatcagaagatatgcagctggtgcatttcgacttcaacagcactccgtttgagctacatgacgataattatatcctcaaagcaatgaatttttgcggaagaccaaatgacagtgctgtcccacagaatttatctgctgatggaggtgaaggtccgagttcccgtatggccaacatgtttcagcatcatatcgctcatccatctgtcccaaactcatctggcaagcttccgacctcacctccactccccggaatactaaaggctcgtgtccagcatgagcattagcctgctggcttctttcttgatcgattactgtactcattaacgcatagtatttctgtacattatgtaaagtatatttactggaagcagcctcctctgtttgactaatacttctcttgacgcttgtctcatt

SEQ ID NO: 9181 - DNA, 803 bp, Solanum tuberosum
  Predicted polypeptide sequence is orthologous to G2983
ctagtggatccccggcctgcaggtatccatgtacatgggatcatcatcaagaagcttaagcatgaaggttgcatcaattcacacgtggattcttagagcatgaagctgcttctccttcacttacacttggttgcaaacgtttaagaccacttgctcctaagctcaacacaaccaataatgataccacaaccaccattgttactcctccttttgatcttaagagtttcattaggcctgaaagtagcaatagccctcctaaacttgcttacaatgaagacaagaaagattcctctcaggtggaatctcacccaggaggaacaagatggaatccaacacaagaacagatagggatactggaaatgttgtatagaggtgggatgcgcacacccaacgcgcaacaaatagagcaaatcacagcacaactagggaaatatgggaaaatagaagggaaaaatgtgttctactggtttcaaaaccataaagcccgtgaaagacaaaagcagaagaggaatagtcttggccttagccaaagtccaagaacaccaccacccatagtcactagttcctttgtcatttgacactaggggagaagtagtgagggatgaagatagtccatacaagagaaagtgtagaggatggacatttgaatacctggaggaagaacaaacaacaacaaggatgacgacgcaaattatcaattggtagagaaaatggtgataggacttcttcaactctttcccattgcatccagaaggcatgaccatgatgcatttttacacagaataatctttttctttttactt

SEQ ID NO: 9182 - DNA, 956 bp, Solanum tuberosum
  Predicted polypeptide sequence is orthologous to G2989, G2990
taagaagtttgtcttattgtaatgtttctatatattcttcaatcaccatcatcaatacatagaagagaaaaactcaaccaaccaaaacaaaataccaaaacccccatttacaataaaccttcaaaattttccaattcataatcaccatatccattaattatcatattttcttgcccttcttgtttatttgtagtcattttatttcaaaaaaacacatatttaaacaaacaaaaatggagttaacttgtagtactaaccccacccccacctccaccaaaaccccagattcagaagttgatacccctcctttaattaagcctttatctttcagcaacggcaataatcaccacaatcatcaccacgaactgccgccgtgcacggcggtgatttacaaagaatgtttgaagaatcatgcagcaagtttaggtggacacgccgtagacggttgcggtgagtttatgccttcgccggaatccaccccatcagatcccatttcactaaaatgcgccgcttgtggttgccaccgcaacttccaccgccgtgaaccgtcggacgattcatcaccgccggcccacttcatcgatttccgccaccatattttcccccaaattaagcgattttctccctctccgtcaccgtctctgtccctttctccgccgccgctgccgtcactgttccagccccaacccgttactcctacaggtttaaaatcagagaacccaaatggtagaaagcgatttaggaccaaatttacagcagaacagaaagagaaaatgcattcgttttcggagaaattgggttggaaattgcagaaatgtgatgaaactgctgttgatgaattttgcaatgaaattggagttggaaaaagtgttcttagagtttggatgcacaaataacaaaacactattgggaaaaaaagataccaaagtagtagagatcatagcttcgagaacaaa

SEQ ID NO: 9183 - DNA, 1943 bp, Solanum tuberosum
  Predicted polypeptide sequence is orthologous to G2993
gctattagcaatggcaagtgtgtgcaatagtagttctactactacaactctcaaaactcctttcatttcatccaatacttctttaggttccactcctaagccctctcaacttttcctccatggaaaacgtaacaaaactttcaaagtctcttgcaaagtttctaatagtggtgaccaaaaccaaaacattgaaacgaattctgttgatcgaagaaatgttcttcttggcttaggaggtctttatggtgttgctaatgctataccattagcagcatcggctactcctataccatcccctgatctcaaaacttgtggtagagccaccatatcggatggtccactagtaccctatacttgttgcccccctcctatgccaactaactttgacaccattccatattacaagttcccttctatgactaaactccgtatccgtccccctgctcatgctgttgatgaggagtatattgctaagtataatttggccataagtcgaatgaaagatcttgataagacagaccctttaaaccctcttgggtttaagcaacaagcaaatatacattgtgcttattgtaacggtgcttatataattggtggcaaagagttacaagttcataactcatggcttttcttcccgttccatagatggtacttatacttctacgagagaatattgggaaaactcatcgatgatccaactttcgctttaccatattggaattgggatcatccaaagggcatgcgtttacctcccatgttcgatcgtgaaggaacttctatttacgacgaaaggcgtaatcaacaagtccgtaacggaaccgttatggatcttggttcatttggggacaaggtccaaacaactcaactccagttgatgagcaataatttaacactaatgtaccgtcaaatggtaactaatgctccatgtcctcttttgttcttcggtgcgccttacgttcttgggaataacgtcgaagccccgggaaccattgaaaacatccctcatatacctgtccatatttgggctggtacagtacgtggttcaacatttcctaatggtgatacgtcatacggtgaggatatgggtaatttctactcagctggtttagacccggttttctattgccaccacggcaatgtggaccgtatgtggaatgaatggaaggcaataggaggtaagagaagggatttatcagaaaaagattggttgaactctgagttcttcttttatgatgaaaacaaaaagccttaccgtgtgaaagtccgagactgtttggacgcgaagaaaatggggtacgattacgcaccaatgccaactccatggcgtaacttcaaaccaaaaacaaaggcatcagtagggaaagtgaatacaactacactccccccagtgaacaaggtattcccactcacgaagatggataaagccatttcattttccatcaataggcctgcttcatcgcggactcaacaagagaaaaatgaacaagaggagatgttaacgttcgataacataaaatatgataatagagggtatataaggttcgatgtatttctgaacgtggataacaatgtgaatgcgaatgagcttgataaggcagagttcgcggggagttatactagtttgccacatgttcacagagttggcgagaatgatcataccgcgactgttactttccagctggcgataacagaactgttggaggacattggtttggaagatgaagagactattgcggtgactctggtaccaaagaaaggtggtgaaggtatctccattgaaaatgtggagatcaagcttctggattgttaagtacgttctcaattgaatctgctgagattacaactttgatatgttttttacttttgtttttccatgtaacttttcctgttgaaatcagcttgatgcttgatttccttggagttgttattcactaataaaatca

SEQ ID NO: 9184 - DNA, 912 bp, Solanum tuberosum
  Predicted polypeptide sequence is orthologous to G3032
caaatcagccgcctctcccttcaactccaccgacgatggcgcgtctccgacgagaaccagaggagagggaggccgatctcctctcctcttcgccttctcctcctctcctgtccgccttctcttgctctctctcctcttctccctcacctcgtatcttttttttttctccgggcagcagcaaccggagcagtgctccgaccagcgacagcagcgcctggcgaggttcatgacagcagtagcgactgctccaaacagcaacgtcaacgacgccaccagcagccctagccggacagaaactagcagctaggtgcagtgagcaccagcaatgcagcagcagcctgctcttccctttctctttcatcagtgaacaacagcagcagtcatcggcgccgctccattctctagcgatggatcggcgagaacaaggcaggcgaagccaccggcgaacagtgaggacgaagcaacaacaacgccgaccaaacgaggcagccaccgcctctgctcgcctccaccttccctcttctccggccagtagcatcgagccctggcaaacccccttttaggggatttcgaggtcattaaagatggatctgttacagatccgtcaaggtatgctctttttttttcttagtgtgactgatttcaatgcatgtttccatactgtatgtgaaattatctcaccttaaacatttgccattatttgtgattctttgaaatggttgtaatatgccattatgttatatgatttagtcacttggagtgtattataatatgcttcgaattgctatactgctgaagttttattcatgttaatgtgatatgtgatcaaacttgtatcaaaaacctttgcttaaaatcaaaggtttgtgcttgcttatccccctctttagtgatctgattagtggaccttgt

SEQ ID NO: 9185 - DNA, 508 bp, Solanum tuberosum
  Predicted polypeptide sequence is orthologous to G3060
ataaattttccagcagtctgggttgatataagcaagagaataacacacatcacatatttgttccggattggcaaagttccgactaaactttaaaatccatatcaacactagtagataggttatgatctaaggaacagcaaacatgataaataacgaacccaagagagatatcgagcacattaaggatctcaacaaataaatgcctcaaaaccgagatattctaatggcaaaaacaccttatctactattttcacaaacccaaagaaaaagagataacagccatagggggagatatgctccctaacagtaaaatacagcaaagctcacagacctgacttacgcaattcttctgctccatgtgcaaagtggcacttctctccaaaagtgcacgaactcttggtgaagttctcacaaatttttgttttatagttacttgttacggatgagctggtgttcttcatcgggggtcctgctgatgttgtaacactctgaataagctcacgaacca

SEQ ID NO: 9186 - DNA, 772 bp, Solanum tuberosum
  Predicted polypeptide sequence is orthologous to G3060
gatataaaaagctcttttgacatttctcaattttgaagcccaattattctaaagcggcagtagcaagatcctatctaaggactcacataataaaagtgttttccggtcaccaatacacagatatgaaatacctgggcaaccctcatcctaaacggatatatattacactaatacagcacagacagtatcctttcgacgtttatccttgtactatctcctattggcaagcaatatttttgctaatacacagtatgaatgccatgaaatcaagtcaatggcttctgcaactcactggccccatgagcaaaatggcatttctctccaaatgtgcacaaaccttttgaaaaattcgcacacatctttgttttaagtgggccaggaggatctcgagtaaatggggcagctttcttcagcccgcctgtaggtgtactgatattcgatatgagctcccttaccatggcactcgcctgattaatctgatcaaaggttccttggagttcaacatttcttttgttagtgtccgtttcatgctcctttataaagagcttgacaccagtaacccgacatatgtgttttgagttcacaccactcttccctatgatgtttccagcaagagatgcatctatactaatggtagttgttgcagatgctccaaagtttgtagcagctagaccaggttgggacggttcaaggtagccggagaacccactcggaagacctttggcttggaaatcatcgtacgctggacgcacttgcttcccaatctccatct

SEQ ID NO: 9187 - DNA, 956 bp, Solanum tuberosum
  Predicted polypeptide sequence is orthologous to G3074
ctttccccaaatcttctcctttctctctatctcacttcgagcaatgattgtcttcttctgattcttccaattccagaaagaaatttgttcactagattctctaatttagtatttaaatatccttagattctctcaatttctgaatggacagaatctgatttatcatgaggaagaaacttgatactcgcttccctgcggcccggatcaagaaaattatgcaagccgatgaggatgtcggtaagattgcaatggctgtgcctgttctagtgtcaaaagcattggagttatttttacaagacctttgtgaccggacatatgacataactcttagaagaggagcaaagactgttaattcactgcacttaaagcactgtgtacaaagctacaacgtgtttgactttcttcgggaagttgtcagcaaggttcctgattatggccattctgatgctgctggtgaaatgccaaaaagaaggaaagttgctatagaagaacatcatgacagtgaggatgaatacaaaaagagcaggacggagatgtctcctgttagcagtagtggtaggggaagaggtaggggtagaggaagaggccgtggtcgggtaagccgtgctgataaggagctcgcacgacctgatatgcaacttgaatcctgcacttctgctcagcagagtggtcaacaaaatccaaatcctggaactcagacagagaactgctcagaaccaaaagaatcacctaaacaggattccactgttggtgacaaggaaaactcagttgtaacaactcctaatctgaaggtcgatgtagatgatagtactgataaaccagctgcaccggaaatagcaccctgcaatccatcgccaaggcctgtgaacgagaaagcagaggaaggccctcagtggtccctcgaaatggacagaatggtcatcgaccctgctcatatgtcgcaactgaatacaagt

SEQ ID NO: 9188 - DNA, 590 bp, Solanum tuberosum
  Predicted polypeptide sequence is orthologous to G309
gctgggtcaatggcgagtgaaggcttaacctctgcaggggtttaatctggttcccctgggtttaaatatgtaccagacaagccaaacttgttagtggctttaatcacaaatgaagaaggatatagagtagaagaagaaagatgggtgtcttatgttgagttggcatagtcgcccgctcatcaccacatctgcttggcgtggctatgtcgctaagttttgggattagtcaatgggtgaggttgctctgcagctgtcctggaaaatcctgctactctgagaaggtttctttgtagttgtcctgcatcatccaatacgtagttttatatgttactcatcttttactgtttacaggtacgtcttagatgtatcagacagtccaaattgataacatttgtaagatggttcttttctttgacctcactgttattgagagaatctctgcagtagccattaaatttgataacgtgaagggcacaatcttttcaaaacagtctctttacctccacgagatagggtaaggttttgtgtacactctaccctcccgagaccctgcttatgggactacactagattatttgttgttgttgttg

SEQ ID NO: 9189 - DNA, 918 bp, Solanum tuberosum
  Predicted polypeptide sequence is orthologous to G309
gataatttatccacaagattcaattgaatcatcatatacagatgttttacaaatgcatttctacgaaacttgcccttatctcaaattcgcgcattttactgcaaatcaagcgattcttgaagcgtttacaggttgtaacaaagttcatgtcattgatttcagcttaaaacagggtatgcaatggcctgcacttatgcaagctttaactttacgccccggtggaccgcctgcatttagactcaccggaataggccctccacaaccgagataatacagatgcgttgcaacaagttggatggaagttggctcagttagctgaaacaatcggagttgaattcgaattcaggggatttgttgctaattcattagcagatcttgatgcaactatacttgatataaggccaagtgaaactgaagcagtagctataaactctgtttttgagcttcatcgattgctatcccggccgggagcaatcgaaaaagtgttaaattctattaaacagattaacccgaagatcgttactcttgttgaacaagaagcgaatcataacgcaggggttttcattgatagatttaacgaagctttgcattattactcaaccatgtttgattcgttagaaagctctgggtcttcatcttcggcttcaccaactgggattcttcctcaacctcctgtgaacaatcaggatttggtgatgtcggaggtttatttagggagacagatttgtaacgtggtggcttgtgaaggttcagatcgagttgaacggcatgaaacactgaatcaatggagggttaggatgaactcatctgggttcgatccggttcatctgggttcaaatgcgttcaaacaagcttccatgcttttagctctgttcgccggcggcgatggttacagagtggaggaaaacgatgggtgtc

SEQ ID NO: 9190 - DNA, 616 bp, Solanum tuberosum
  Predicted polypeptide sequence is orthologous to G309
gttcacgagagatgtccatggatacaattatggaagatgaagattcctttgtttctaatacaaatgcaatcatctacgcttcttctgatatttcaggctggactcacagtttgatctcagataacaatattcccaattcatcgtcttctgccaatgtagacgaccgccagcagcagatatcgactgctgctgctgggtgggtggattcggatggattggttatcatcagggtggcatctttccaagctgggtttaaattaattaattattaaggcaaaattggatgaattcaaccaaagaagaatttaggaatatttaaattgtttgattttcagggcactttgcaacaacagactgaaatctcgcggtggatctgaatttagtagcggtttattgctggatactggtaggactgtgaaagaagagactagcgctagttgtcaattcgttgatggcttgtgccgaggcgatccaagagaacaacctaagactagcggatgtacgactcagtgagataagattttatagagactatttggaaatgcttacgttgagcaaggatatagagaactttttttcctatttttatgaacaagataatatgttgctaaaatag

SEQ ID NO: 9191 - DNA, 973 bp, Solanum tuberosum
  Predicted polypeptide sequence is orthologous to G3111
gattcgacatttcaaccacaccattgtcccatttcttctatattgttagatttgatttttagttatgactcgtcctgctagatttctgcttagcaccagctcttcttcaacgccggcggcggagccaccgtcgatggtgacagtggagtctgatttcgttgtaatactagctgcgttgctctgtgcgctgatttgtgtagttggtctcatcgccgtcgcgagatgtgcgtggctccggcgaggaatcggcgccggcgggatcggtggtagtcaaccgtcggcgaataaaggattgaagaagaaagtgttgcaatcgttgcctaaattcacgtacgatccaagcagtacggcgaatggtgcggcgttcacggcggagtgtgcgatttgtctggcggagtacgccgtcggagatgagatccgtgtgctgccgcagtgtggacatattttccatcttcagtgtattgatacttggctgggttcacactcttcatgtccttcttgtcgtcaaattctcgtcgttactcggtgccggaagtgcggtgagctcccggcagtttcctgtaaatccgacggagctacggttacaactccggcggagtctcgttcatgtggtacatctattagctcaaataatttcttggtctaaagtaacaaaaaaaaaaggaaattagcttttaagttatatacgctgacacagtgtaaacgggaaggtaatttacgctatcagtgcagttttacctgtggtaacatatcagttactgtgttgatgcaggttaggggtactcatctagggaagttacatctttgaaatgatctgtgtaaattttcttttaatatagtgaaagatagtctgatgtactaagctcagtcagacctcaacggtcaattataggtagccttaacacaacttaagcaattacgtcgaagtttcattctagaactcaccaagcagtaaaatacgaaatactctctt

SEQ ID NO: 9192 - DNA, 753 bp, Solanum tuberosum
  misc_feature (673)..(673): n is a, c, g, or t
  Predicted polypeptide sequence is orthologous to G3111
caacgttttgtttccctctgttaattaagctccgcactttcctcatgagtaattctgatccttcaccgtcgccgccgtctacaaccaccggaatcggtcaagtcgactccgacttcgtcgtcatcctcgccgctctcctctgtgcgctcatttgcgtcctcggacttgtcgctgttgctcgctgcgcctggatccgacggatctccgccagagcaaccggaaattccgctttttcgtcacctcctgctaataaaggtttgaagaagaaggttctcaagtcgctaccgaagttcagttactcagctgaacacgccgcgaaattctccgaatgtgcaatttgtttagcggaattcgtagtcggagatgaaatccgagtgctaccgcagtgcggccatggatttcatgtaggatgcatcgatacctggttaggctcgcactcgtcatgtccttcttgccgacagattttagtagtgacgagatgtcataagtgcggcgagttgccggtagcaagctcgtcgtcagctcccgtagctgagccggaaagccgattaccggcaaattatcatgtaaatgcatttctaccgtaaaatttaggtaaaaattagtagttaattaggctgtgtgtatatactactcctatattaattaaatctatgtaaacgtatatattcanttcagcctactatattaatatcatcaattagggttacagaaaactactgtttgaatttattaaccaaagattattactgt

SEQ ID NO: 9193 - DNA, 944 bp, Solanum tuberosum
  Predicted polypeptide sequence is orthologous to G328
ggaggattcagcaacaaccatgaagctgcttcatcttcatcttcttcatctgcagtcatatcatctgcattttgagtaaaactcaagaacccataatcctccgtgctttcccttgtgggcccaccaatcatcatagaaccactgccaacggtttcgacagctggaggaccataaagggttcctggaaagtggaatcaagacgaatttagaatttaagtttgatgggttcaatctttaaatgttcttgctacttaatgctatacattttggaattatggttcaaaaatcatatttattgaaatatttgttattttttacatgtaggagtagaatttttgtgtggctacctaaaatggtcataattgggacacggtggtgacggcgcgccaaggggttggcagagtggatgtcagcgtcgcaggaggcacagagtgaggcagcatctgccttgcaaagaaaggctgcaggggcacgtccgcaggcctcgcaaacccacacacggtcgtgacgagaagccaacagatttgctgcatgcatgcggatgtcacaaccggcacacaagaaggtggaatcttccctgcagtaaacgtattttgcttacatggtgcttatgaactaccatttttaggaaaaagtattgcatcagtgctttcctatcctttgagaagtggaccttttattctttatcttcagtgatgggtcatttattgtgctgaaagagaatctgggacaaacactagatgagagagaggccctggaccaaaagagtatgttccaacgaaaggatgaccacagtggaaagcagaaagcagaattgagcttcaattatattgcaccagctcacaatgtcatatacagccactgagcatccagaggtcgttggtaatagtgtttttcctattacttgtggttgcactgagttctttttatttggaaaaggagta

SEQ ID NO: 9194 - DNA, 862 bp, Solanum tuberosum
  misc_feature (159)..(159): n is a, c, g, or t
  Predicted polypeptide sequence is orthologous to G328
gcttccatgaattactggcttatttgacttggattgtttatatcaatggagcattactctttcttttaagatcaaaatcttacacgagggcattgaaaatagaacaaggtgtattggcttattaagcttgtattcttaattgtcagataaaaaacatanttggaagatgtaattaatccttaaatcatcacgtctcaaatacaaaaatcacttacaagcagaattgtgacattacgctagtactatctgaacaaaatcttgcatacaccactatgcatcagagtgcaccaatgttagtgagacctcaattgattccaaaagccaaaggccccaggacccacttgttcaacctccctgttgcttgactccaccagaatcatcagccaccacaagataatgaaacaacttttcctacccattaacttgtctccacgtgtcacctgtggattctctccccacttggtagttgcctagttgtcattttccgtcctttgccccttcacatttcacagtgccccataagtctccagcattcttgctcaacttcactactccaactacaagttttacaacacaaaatagagagcaagaaagaaaagaaaagagaaaccaaaattagtcagtccaatgttgaaaaaagagaagagtggggggtttgatggaagtagcaacaattgggcaagggtgtgtgacagttgccattccgcaacatgtaccgtttactgtcgggcggatccgcctatttgtgtgcggattgtgatgcccgcatacatgcagcaagtctcatggcttctccgccacgaagcgttgtatgggggtttgcgaagccctgcgagccgtgcccctggcagcctttcttttg

SEQ ID NO: 9195 - DNA, 997 bp, Solanum tuberosum
  Predicted polypeptide sequence is orthologous to G351
ctcaactttcttctatcacttttatttctctaatataataataattctctccatgtcgattgaagctttgaagtcacccacggcggcggcgctaccaccgcttgaagagattgatgattcgcataatttggattcatgggctaaaggaaaacgatcgaaacgaccacgtattgaaaatccaccaactccagatcagtatttagcactctgtttactcatgctcgctaacgacgacggtaccggatttgggaaaggaaaaggaaccggttcgattggtgttgttattgaacaacagcaggagaaaaagttgttgaagccggtctttattaaagagaaaacagagcaattattcaagtgtagcgagtgtcctaaagtttttacttcttatcaagcacttggtgggcataaagcaagtcaccgtaaaattaacgttcctgccaccggaaacgatgataacaatccgtcgacgtctacttccacaagcggtaatatctctgctctgaatccgagtggccgttctcacgtgtgctctgtttgtcaaaaggcttttccaactggacaggctttgggtggacacaagcgccgccactacgaaggtaaactcggtggtaacaatcgttatataagcggagaaggccttcagagtggaagcgttgtgactacatcagacggcggcggcgcgtcgactccgattgcgcgtgactttgacctaaacatgcctgcctcgccgggatgccaattggatctgaccattgactgtggaggtagaagtcaacatccgattgaacaagaagtagaaagtcctatgcctgctaagaagccgcgtttatttttcgattgaaaattcttaatagtgattgaattctgtttaagtcaaattagttaattggttttacatgtgatattattttactatatactttttaggaaaaagtaccttttatcattatgtatagagacaaacattaggttattcattttctactagtttctgttg

SEQ ID NO: 9196 - DNA, 1104 bp, Solanum tuberosum
  Predicted polypeptide sequence is orthologous to G351
ctcttccctctctgtttctctttataaacttttatttctaataataattctcgatgccgattgaagctttgaagtcacccacggcggcgctaccaccgcttgaagagattgatgattcgcataatttggattcatgggcaaaaggaaaacgatcgaaacgaccacgtattgataatccaccaactcgagatcagtatttagcactctgtttactcatgctcgctaacgatgacggtaccggatttggaaaaggaaaaggaaaaggaaccggttcgattgatgttgttattgaacaacagcaggagaaaaagttgaagccggtttttattaaagagaaaacagagcaattattcaagtgtagcgagtgtcctaaagtttttacttcttatcaagcacttggtgggcataaagcaagtcaccgtaaaattaacgttactgccaccggagacgatgataacaatccgtcgacgtctacttccacaagcggcggcgttaatatctctgctctgaatccaagtggccgttctcacgtgtgctctatttgtcaaaaggcttttccaactggacaggctttgggtggacacaagcgccgccactacgaaggtaaactcggtggtaacaatcgttatataagcggcggcggttgcggagaaggcgttcatagtggaagcgttgttactacatcagacggcggaagcggcaacggcggcgccgcgtcgactccgattgcgcgtgactttgacctaaacatgcctgccttaccgggatggcaattggatctgaccattgactgtggaggtagaagtcaatttccgattgaacaagaagtggaaagtcctatgcctgctaagaagccgcgtttatttttcgattgaaaattcttaatagtaatttgatgattgaattctgtttaagtcaaattagttaattggttttacatgtgatattattttactatatactttttaagaaaaagtaaaacatttataagtactagagtaccttttatcattatgtatagagacaaaaagtaggttattcattttctactagtttctgctgttcaatataatattcttttttatttaaaaaaaaaaaaaaaaa

SEQ ID NO: 9197 - DNA, 850 bp, Solanum tuberosum
  Predicted polypeptide sequence is orthologous to G351
ttttttttttttttttttttttatattgcacccttctgtgtatactgccattgataatgtatccttgcaatggcaggacagttttctatacatgtattcaattattgagtttcttaaggaaaaaaaaggaacattttaatataacccttttccaaatgcttccgaggatttcaagtgcatcgcccctttactgcaccagtcgcctcagaagcaaaatgcagcacaatgttttcgagtgttgacaagtatgtcctccaaatatgtcagtgcgcggaagtacttttctataatgcaatgttaccaccatcatagtttacatgctgcttaaatttagttcatcctcataagatggttgtttgcggtaagtgttttggatcttatcaagctttaggaggacacaaagctagtcatcgtagtaacagagataaagtctacgaacaatctgtagtcatcacgtcaggtaatgcggttagtggaaggactcatgagtgttccatttgtcacaagacttttccaactggacaagctttgggtggccataagaggcgtcactatgaggggaaagtgacatcatcgtcatcgtcgttgaacggtgtggggtccgtcaacaactttgacttgaacattccggcattgccggaatattggtcgggttttcactccggtgaagatgaggtggaaagtcctcatccagctaagaaattaagacaattattttgagaagttcaattatagttgttacatgtctatttgaggtgggaggacaaaatattagcacaattatttttttggtaaatatagaatacaatctggagaaagtgattattgaatattactcgattcttttatt

SEQ ID NO: 9198 - DNA, 1024 bp, Solanum tuberosum
  misc_feature (725)..(725): n is a, c, g, or t
  Predicted polypeptide sequence is orthologous to G351
ctcaagttttataattataatattcttaacactctctctaaacagacgaataattcaatcaattgagatggcacttgaagctttgaattctccaactggtacttcaagtccgcagacgtttcaatttgagagcaaaggccagcagcagcttcgataccttgagaattggactaaagggaagagatctaagaggtcacggagtatggatcgccagccgactgaagaggaatatttggcgctttgtttgattatgcttgcgcgtagtgatggctctgctaatcaggtacgatctctaccaccgccggtgccagtgatgaaaatccacgcgccgtcggaggagaagatgttgtataagtgttcggtttgtggtaagggatttggatcttatcaagctttaggaggacataaagctagtcaccggaaactcatcgccggcatcagcggcggcggagatgatcagtcaactacctctactactactaacgctaccggaactactagctccggtaacggtagtggaaggactcacgagtgttcgatttgccacaagtgttttcctactggacaagctttgggaggacacaaacggtgtcactaccacggcggtaaccgttaacggaaacgctaaacagtagccgttagcgctagcgtcggagttacgttcgtcggaaggggcgtggggtcaacaatcagccaccgtgaattttgactttgaacatcccggncgtttgcccgaatttctgggcctggaatttgggttcccggcgagggatgaggttaaagaaggtccacatcccggacgaaagaaaattcttccgggttattctcctacattccccaaaaattttggaatttttttctccaaccatttaattgttgactttagattgctaggaatttacgaattgttgtagcacacatttctatgttaatctttcctttcacattgtgggggtgggaggtaaaattttcattcaatcttattttgtttttgggcccatccggtgttagttgaaaatcactg

SEQ ID NO: 9199 - DNA, 936 bp, Solanum tuberosum
  Predicted polypeptide sequence is orthologous to G363
cgacctgttgttacctaagtatcaaatttgccccgcgttttttccggagcagcatgaagccaccaaatttcaatcttgaatctgaagacgagtccgaagtcagcagcagccaagttgcctccaacaattctgcccaagaaatttctcctgatccttacaaggacagcacgaccaattcgtcctgtctgacaaactctctcaatcttcagcaggagtcgaaaccggttacacttgacttgactcttggcttcaacagcggtgctgatcccgagttgaaggaaaatcccgaggctggcagtgaagtagtgcctcatcctccagctgcacaagtatcgaggatattctcgtgcaacttttgtaggcgcaagttttatagttcacaagctttgggaggacatcaaaatgcacataagagggagaggactctagcaaagagggcgatgcggatgggaatgctatcagagaggtacgctagcttggcatcgctcccccttcacggctccccatatcgatctcttggcatcgaagctcatggctccgtgcatcaacgtgcctcacaacaacaagaaaggcatatgcatgctattagaggcggggcaagatttgaacagggctatttcggggtgccagtatacatggaggatgatgacatggagatgttttggcccgggagcttccgtcaagttgacggggtcggtagcaacgtcgtgcttaattcaggtcagaggtccaacataaattttgtaccaatggctccaccacctaaaacacaaccatcattgcctgaccttaatttgaaactgtgacactcttgccattcacatttctatatctatttcgacatcctccttttccgaaaaaagaaaaacgcgatgttacgttgtgttacatctgcgttgtattgtacagggagattgattgaatgtcttagattga

SEQ ID NO: 9200 - DNA, 956 bp, Solanum tuberosum
  Predicted polypeptide sequence is orthologous to G363
acaacttcccctcttcctcttcaacaaaaatatgtatcctaccacaggacgacgttagtgatgcagatgtagttcattgttattttgatcaccaaattctgtatattagtccctccgttgtaacggattataagcgaattaagatggaagcatcatctggaaatgattctgatataactagtcaggttgcttctaacattgagttttctcagtttagtcctgagcccgtgtcacttgacttgtctctcgggtttaattctgttaccgatgaatttgccagccaagattcgataggattttcagtatcaagcacctgtgatgaacgcagcaatgaacttgcagcatcacaaacttcaggggaagcagtagttagaagagttttcacttgcaatttctgcaagcgtaaattctatagttcacaggcacttggcggtcaccagaatgctcataaacgtgagagaacattagctaaacgagctatgagaatgggaatcttttcggaaaggtatggtaatttggctgctctgcctttgcacgggtctactgcccggtccttgggaatcaaagcacattcttcaatgcaccaggggtttccacaagcaatgggatcacttgatttcaggacgagcgcgagatttgaatatgtacaccatcagagtccgtctttatacattgaggatatcgatgaggctgatcacttattatggcctggcagttttcgtcaagtaactaatgttgacatctctcatcatcctactattagttttactggatgttcgaatgtgaattctgtagagtggactccgtctgttgaaaaagacaattcgacaccagatctcacactgaggctctgagcagtagtacttgaatagcgagtcgcttcaatatttggctctcttacgaaaatgtgtgcattttggaatatatatattatatcactaaacggacgataaggg

SEQ ID NO: 9201 - DNA, 1043 bp, Solanum tuberosum
  Predicted polypeptide sequence is orthologous to G363
aacagtttctgtcatgtcacttcttattctctgctacaactttcttgaaattaaaaaaaaggttcttccaaaaagttgaattttgctacaggttcaagaagttttggagttcttctgattatttgtcgaagtgcaataaaactgaaactccgtaggtgaatcaactatcgacgaccatccattgatttaacactccctgttgttttaccaaagtctatatccggacccgacttatctccaagcaacatgaagtctccaaatttcaatcttgaatcagaagacgagtccgaggtcagcaactgccaagtgggttcaaacatatccgtccaagaaattcatcctggtccttcccgtaatcttcagcaggaatcagttcctgttactcttgacttgattcttggcttcaacagcagtgactccgagttgaaagccaacggagaggcgagtgacgaagtagtaccccatcctccaacggcagcattatccagagttttctcgtgcaatttctgcaggcgcaagttttacagctcccaggcgttgggcggacaccagaatgcacataagagcggagaggactttagctaagagagcaatgcggatgggaatgttatcggacaggtacgctagcttagcatcattgccccttcacggggctgcatttcgatctcttgggcgttgaaaggctcatgcttccggaacaacaaaggcatctcggcaacaaggaaaagcctattcatgcagttagaacgggggcgaggaaattgaaaccaaggctattttcgggaatgcccatatatccggggaagcaagaatcaaccggccagaggtcctggcccgggtagccttcccggcaaattaagaagggaattgggcgggtaatgatgggcgtataaatcaagggccaaagtccaacgccttaattttgggacgcgtaagcccccaactagggagaaacccactgtcgcggactcctaaatggcacactgggagacaccctcgggtggccgacaccacacacaacttggggcacaacacacaaaggg

SEQ ID NO: 9202 - DNA, 921 bp, Solanum tuberosum
  Predicted polypeptide sequence is orthologous to G363
caattttattccttgcctctctgatctctagccctttaagagtccatttggtcagtatcttcataaagcctgtctcttcagcaaaattgtgggggagggaagaaaaaaagacttctgcataatttcaacagccagcagaatgagaagtgctgaggatggcagccggggaacttcaatatttgagcaaggtgagtggttgagtttgagattaggaagaaactcaccttcaacatctaaagaatctgagtcacagacaagacctactcctggcaaggttttttcatgtaacttctgcatgaggaagttctacagttcacaggctctgggaggccaccagaatgctcacaagagagaaagaggggcagtgagacagtatcagtcccagaggatgatgacaatgatggctttgcctatcaacaatcccatgttcagatctcttggcatggttcctcacgcacttgtgcatagaacaggtagagatgtaagttcaactgtggcaaggttcagcgaggctagtacaggctttcaaatgacatctcatcccaatccggtagatgaaggatttgaattgaaatggccaggaagttttcgactaaatccacaacaatcagaagaccaggcttcaaatacaaataagattgatctgaatctcaagctgtaattattctactcatctattgcaaatgaaactattttctatcctctcatgtaacagcttcagcttggtgtcatcatcagttacatgaacttgactgtatgatctgcgagacctggtttagagtaaaaagatcctagagaagtaagtggctcttaaatgtcagatttccagttttatcagatgattgatacctaagatgttatattgtactttccaggttcctttttattccctactgaactaaggaacaactttttaaacgt

SEQ ID NO: 9203 - DNA, 681 bp, Solanum tuberosum
  Predicted polypeptide sequence is orthologous to G385
taagaaattgtactctttatcacatgacatcatgaccaaaaatcaaacattacatcctaataaacaacaaattataattcacatatggaaaacaacacaactaagcaaatataggataagtgacatactaagagagaaattcttcaatgatgcgatgttcgtagttgtcgtatgagtgagcttgcttgggaaccaaaattttacttgtaaaggccctaaccgaagtcttcttacaaactcttttctttgtttatcaccagggtgagtgcattatttataaaaccattctatttcactgagtatggcagtgaacgcacatctcttatatggatgtttattcggattaacttgatcatcaccagaattagggacatcaatgatatcacaaataaaatccatctcatttgccagtgttctatgggccgaggacgatatatcaaacaaataattgtggagcgccaccatctgcttgcgatgaaacctatatatatgacatatgaaactatgtgtgtgtgtttagtgctaaatttactgacaaaaatgattgagtgaatctttaagtaaatacttaaaacataattagactgaagaagtttgtttctatatggtcatccacgagaatcattcaaccatatgtcggaaataaaaggtatgcaatgaatttgattgttaggctttaat

SEQ ID NO: 9204 - DNA, 913 bp, Solanum tuberosum
  Predicted polypeptide sequence is orthologous to G385
gtaagctctcatctctcaactctcaactctcaactctcaactctcgtcactcgtcactcgtcagtcgtctctcagttacgacttacaccgctgctcgtctctcaactctcgtctctcgtctctcgtctctcgtctctcgtccgtcatctctaaagtcttaggccagccgctactccttggctcctcgctgagtgctcgcaggtcgcagcccgccactgctcagtgctcgcgactcgaaggttaatgcttctatatagagaatatcaactaggtgagtttggagagcaaaagcaaaattgtatggcatagattgttggagtttcgagagtattgttaagtgttgattgttatttgttatagaagttgatgttgattgttgtattatttgaacagcaacacagccacaaccacaacccacaggtcactgttaattggtaagttgcaagttaaatgttgttgaaatttgaaggcaaaagacaaactgtatggcatagattgttggagtttggagagttgttgagtgttgattgttatagaagtttgttgattgttgtattatttgaacctcaacctgcaacacagccacaacccacatgacactattaattaaatttggttaaaccgaaaaccaaaccgaaattgtaataaccgaaccgaactgaatttatttcagtttggtttggtttcatatttttgccaaccgataaccgaaaaaccaaaccgaaatttacaaaccgaaccgaccgaacgcccagccctacataagccacaaccgtggaccgtgcttagtcaccgtctgcatgttaagggcacaaagttctgtcctgatccccctttaatgctggatgacatgttatctgcagacgagaatgatctgattgagtaccctattttctcacgttatctttatctt

SEQ ID NO: 9205 - DNA, 783 bp, Solanum tuberosum
  Predicted polypeptide sequence is orthologous to G385
ataaaggttcctagccttaagtgcatagaaaagccacctggaaatgtggaacttaatgagattggtatatgcttagacccagaagcgaaatatacggttccctgtccacgaactgggtcatgccatgaattgggacctaggataaagttccgatgataaataaactcttcatttcatttcctattttgttgtgataagtaaattaaatgcaaactcttcaggcgagaagccaaatgttactctagcaggtcacactgtttaatattaggagtaaatttcttgtcaacgcttgaatagcattactcaactaaatgagattttaatatgtttacatctaaaaaaaaaaaaaaaaaagcaacttcattttggatgccagttccaactaagagagtctttgactttcttagggatgaaaattctagaaatgagtgggatattctttcaaatggtggcctagttcaagaaatggcacatattgcaaatggtcgtgattctggtaacagtgtctcactactgcgcgttaatagtggaaattcaagccagaataatatgttgatactccaagagagctgtctagacaccacaggatcctatgttatctacgctccagttgatattgctgcgatgaatgtggtgtcaagtggtggtgatcccgactatgtggctcttttgccttcgggttttgcaatactccccgatggctctagtaatgcttaagaatagtaatgctgctggtggctcggtattgaccggttgcatttcagatactagttgatcctgtcc

SEQ ID NO: 9206 - DNA, 663 bp, Solanum tuberosum
  Predicted polypeptide sequence is orthologous to G4
ggtagaaactgccttttcaccttctcaccggtaccggaaaaagcatgtgtggtggtgccataatctccgattggataccgccgcctcgatcgtcgagccgactcaccgccgaccagttatggggttgctccgatgtgcaaaacaagaagaagaagaacaagaagaggaatccttccaattaccactctaagtccttgagatctgaaaatgtagactttgaagctgattttctggattttaaggatttttctgatgatgaagaagcttattgtttggatatcaaaccctttgctttctctgcttctgaactctctggaacctctgctggatccgaatcattgatatctgttgatgcaaaggaagttgagaaatcttccaagagacagaggaagaatcagtatagggggatcagaaagcgtccatggggtaagtgggcagctgaaatacgtgatccacagaagggggtccgagtttggattggaacttttaatactgcagaagaagctgccagagcttatgatgctgaagctcggagaatcagaggcaataaagctaaagtaaactttcctgatgaagcttcagtgcctgcctcgaggcaagctggtaaggtaaatcctcgaaaggttctttctgatgagagctctaacccagttctatccaaca

SEQ ID NO: 9207 - DNA, 1012 bp, Solanum tuberosum
  Predicted polypeptide sequence is orthologous to G4
agttttgaataaattaatacaatacatattagtcttggtttggagataacgtaaacgcaaacgcaaacttcactcaaatgaagcgttatttacaaaacttagcaagggaagacgtttatgcagcttagtaggcgcctcccattaaagaaggtacatcatcgaagaaccagaggtccatggcgtttccaccatcctgaattgcacttgtattgaggaaggcatcaactgatgcatccccatttccctcaagatatgggatctgcaagaacttcatctgggattcaaaagccgataactcttcagatagcgtgttcacagtgttaccgtcatctgtcaatgaagtgctggaacaggacttcagttttttctctggtctggcatcttcatcaaaatgagtctcattggtttcgagaacttctgacagaacagatgagatctctggagtccttgcacacggttcaccccaaccgaaatcagagcagtcaaaagtgttacttccttcatcagagctgaagtaaacatttgtaccagctgaaggggaaactgaacccagtcccatatctccagcagtaaaacacacattctcatagccgtactgctttgttgctggtttctcttcgaaaaagctgaacgattcatcggatccaccatccaggttattaatataagtcatgtcaggctgaactgtgttcagggtttcctcacgaagtgcctcctggggattttgcttaacaacacgtctagaaacagacactggagcttcatcaggaaagttcaccttagctttcttgcctctgatccttcgggcctcaacatcataagctctggctgcttcctacagcagaattgaaattccaagccagaatcggaaatcctttccttgggatcacgtatttcaggatggccgaataaccccaaggaacgttgtctgaataacccgggactgaatgttctctttctctttgggaggatcttggcagcatcaccagtttggaatcacagatcttcacag

SEQ ID NO: 9208 - DNA, 1043 bp, Solanum tuberosum
  Predicted polypeptide sequence is orthologous to G4
atccatacagcccaattgtttttaagaaaaacttgaaatttaacatctctagtaagtagttaattaaacctaattacctatgcactgctctattgagtgcataatccatggcttaatcatgtttctctgtggatcattcttcttccaccaccagacacacatgaagccttatttacaaaacttaggcatgttgacttaaaagatacctcccattaaagaaggaacatcatcaaaggaccacagatccatagcattttcaccattttgagttgcacttgtgttgaggaagttaccaactgatgcatcccaatttccctccatatatgggagatgaaagaaattcatctggggtgcaaaagcaggaagctcttcagatagcatgttaacggtgtttccatcatcagctacgggattgttggtgcatgatttcagctttttctggggattggcatcttcaacaaattgagcttcattactatcaacagcagctgacagaacagatgatatctccggagtcctggagcatggctctccccaaccaaaatcagagcactcaaaaggagttgcttcctacatcagagttgaagtagatatcaccaccaactgaagggacgaatgaggccaaatcccgtatctgcaagaagcactgcttacatactgctttgtcatgggtttctcttcaaaaaatccgaaaagaatccataatggtccgctgttcattgattgctgagatccggattgaaagttgaatccaggctctcctcaggaaggacctcctgaggattcacccttaacagtgtgtcttgaattgcacagtgctggaactttcatcgggaaaatttacttagactttcttgtctcctgatctcctaaactcataatataagtctgcaactcctctgcagatgaaggtcccagcagaacccgaaccctttcctggctcacggtattcagtcgccctcgtgccaaggtcctgctagttcccctataatggattccctcttaagaatttatcacggttcttgtgaacacacgtttcaaat

SEQ ID NO: 9209 - DNA, 1003 bp, Solanum tuberosum
  Predicted polypeptide sequence is orthologous to G409
acaaaacaacgtatatacagacaaaatcacataatacgccctcgccggaatcttattttcactgtcaccggccgttataactttttttttccagttcggaggtcaaataattaaactccgatctgaagaagtagttattctaactgcttctatttaatctgaaaacgggaaaaacccctgagctgggtaaggtggatttcgtgatgggattttgtatttgtcctttggaaactcctgctagattactgtggagtactagtttcttccgccacaagcttatgctcttctaaaactttgtcaactctctttttcatacacatcccctgctaaaaaaagaactctgttctggagtttattttctcttttctgtttcgccggaaacatataaataatcttctgtgggtaaataggcgatcttccagatcattgaaaatatgggatctgggcatatatttttcgacccgtcgtcgtgtcacggcaacatgctgttccttggcaacggagatcctgttttccgaggaccaagatcgacgatgatgaagatggaggactcctcgaagaggcgacccttctttagctcaccggaggatctatatgacgaggattactacgatgagcagtcaccggagaagaagcgccgtctcactcctgagcaggtgcacttgttggagaagagctttgagacagagaacaagctggagcccgaacgcaagacccagctggccaaaaagctggggctgcagcccaggcaggtggctgtatggttccaaaaccgccgtgccaggtggaagaccaagcagctcgagagggattatgatcagctcaaatcctcttatgactctcttctctctgattttgactccattcgcaaagataacgataagctcaaatctgaaggtgtttcattaatgggaaagttgcaggggaaagtggttggaggagcaggggtaagtgaaaaatctgatgtcctggaggtagatgctatgacagcgacccttcaagt

SEQ ID NO: 9210 - DNA, 835 bp, Solanum tuberosum
  Predicted polypeptide sequence is orthologous to G409
aggaagaaactctttttctctttcacttatttcctctttcatctagttatacatacttattttcttcactcaaatggcactgacccttcttcattgttcctttacttatgacataaccttttttcaaatttcaagattcaatcaagaaaccccatttctcactgcttaaacaaaccccatatagtttttttcacaattcttgcaccctagaaaacttcagggttgaaagtaaaaaagatatggaagttggaagggttattaatgaaagttctaatactgttttggttccaagtgaaaaactttctcattgtctctggatgtccaattcttccccctcttttcatggttctgcatcaatggttaatttcgaagatgttggtcgaggagaagtcactaaagagaggccatttttcccagcaattgacaaagaagaaactagcaatgatgattatgatagttgttatcatcagccagaaaagaagagaagacttttgcctaatcaagtgcaatttcttgagaagagttttgaggtagacaacaagcttgaaccagagaggaaagttcaattggctaatgaacttggcttgcagcctaggcaaattgctatttggtttcaaaataggcgtgctcgatacaagactaaagtacttgagaaggactatgatgttttgaaagctagctttgataaacttaaagttgattatgacacccttttcaaagagaatgaggatttgagaaaatgaggtccttttggtttacacaaaaattgcttaggagggacgaaacgggcaaggaaaactcagaaccaagttgcaacccaatatagtcccaatta

SEQ ID NO: 9211 - DNA, 908 bp, Solanum tuberosum
  Predicted polypeptide sequence is orthologous to G409
ctcatttatagtactcatcacaactttcttagtaacaattcaatagtccaatttttcacttcttgattctcctctaaactcctaataccaaaaaaaattagaaaatagtatggaggtagcaagagtttatgaaggttctaacaattgcttcatacttccaaatgaaattcttcctcctacttctaattgggtatctaactcttcctccattttccatggctctgtatccatggtaaatttcgaccaagatcgagtaccaaagtctaaaatgaggtcatttttagcacaacttgatcaagacgataatagcaacaacgatgacaattacaattatcaccaaagtgaaaagaagagacgattgttaccgaaacaagttgagtatcttgagaaaagtttcgaggtagaaaacaagcttgaacctgaaaggaaagtacaattagctaaagaaactggattgcagcctaggcaagttgctatttggtttcaaaatcgacgtgcccggtgcaagactaaacaacttgagaagaattatgatgtccttaaagctagctttgataaactaaagactcaatatgattgtctcttcaaagagaatgagagcttgagaaatgaggtacatttactcaaagataggttgatcaacagagtaaaagggaaggaaacttcagaacctattaatccacttgatcatgtagaacctcaaaatccttctattggagttgcttcaactttagcaatggtggcgtgcaagcaagaagatacaaaaaagtgatggtcttgattcagacagccgcgttttactgaacggtgattacacttcttttttggaagcctgctgattcttcgaatgttctttccagacagaacactctgatatctctcagaaaatgacctttatgtttccaaaa

SEQ ID NO: 9212 - DNA, 1383 bp, Solanum tuberosum
  Predicted polypeptide sequence is orthologous to G428
gagtttctctcccttttaaaaaagaaaaaaaaaacacaacacccacttcaaatatcaaacaaatttctcatttgattatttctaagtgatttacactactttgtatttttgtttgtttttttttagatatatatatggatgatgaaatgtatggttttcattcaacaagagacgattacgcggataaagctttgatgtcaccggagaatttgatgatgcaaactgagtacaacaatttccacaactataccaactcgtccatcttgacttctaatccgatgatgtttggatccgatgatattcaattatcatcggaacaaactaattctttcagtactatgactcttcaaaataatgataatatttatcaaattagaagtggaaattgtggcggaggcagtggcagtggtggtagcagtaaggatcataatgataataacaataataatgaagattatgatgaagatggttcaaatgttatcaaggctaaaatcgtctcacatccttattatcctaaattactcaacgcttatattgattgccaaaaggttggagcaccagcgggtatagtaaatctgctggaagaaataaggcaacaaactgattttcgtaaaccaaacgctacttctatatgtataggagctgatcctgaacttgatgagtttatggaaacgtattgtgatatattgttgaagtataagtccgatctgtctaggccttttgatgaagcaacaacgttcctcaacaagattgaaatgcaactaggtaatctttgcaaagatgatggtggtgtatcatcagatgaggagttaagttgtggtgaggcagatgcatcaatgagaagtgaggataatgaactcaaagatagactcctacgtaagtttggaagtcatttaagtagtctaaagttggaattttcaaagaaaaagaagaaagggaagctaccaaaagaggcaaggcaaatgttacttgcatggtgggatgatcactttagatggccttaccctacggaggctgataagaattcactagcagaatcaacaggacttgatccaaagcagatcaacaattggtttataaatcaaaggaagagacattggaaaccatcagagaatatgcagttagctgttatggataatctaagctctcagttcttctcatcagatgattgagtttgaatggaaattgtgaaaatactgctcttcatttctctttttattatatataatatataaatagtatatttttgggaaagaaagaagttattttattaatcaaaatctctataaataatggtagagattaattaatgttgaattcttcttgatcatgtaaatattcaatctagctaattgtcaaaattaatgcttacctaaaaaaaaa

SEQ ID NO: 9213 - DNA, 936 bp, Solanum tuberosum
  Predicted polypeptide sequence is orthologous to G428
gggtttaaagaaacgtacttccatatatatacagctaagtatttttaattacaagttgttgttcacatactgtgtaactgtttgatgatggatgaattgagcaaacttcattctgctattgtatgttcacgcagtagacaacaacaacaggctgaggctgaggctgaggatgaggctgggccgacaattattaataacactcatactagttttgctattcatcattatcgtcaattagaagccgctgatcatcaaaataatactaaatccagcaccaatatgtcagatcttattaaagctcagattgcaaatcatcctctttatcctaacttactttctgcttaccttcaatgtcgtaaggttggagcaccgcaaggaatgacatcaattctcgaagaaattagcaaagagaacaacttaatatccagctcatatcacagtagtgaaattggagctgatccagaacttgataagtttatggaatcatattgtgcggtattagtgaaatacaaagaggagctttcaaagccgtttgatgaagctacaagtttcttgaataacataaagtcacagctcagttccctatgcaaagataatttaattacttcaacaagtttcaacaattatacatctgatgaagcaggtggtacctcagaggaggatctaggctgtgaggagatggaagcagcggatagtcctgctaaccgtgaaggcgataatgagctaaaagaaatgctgatgcgcaaatatagtggctatcttagcagtttgagaaaggaatttctgaagaagaggaagaaaggcaagttacctaaggaagcaagaattgtattgctggactggtggaatactcactatcgatggccttatcccacggaagaagagaaaaataggctatcagagatgacagggctagaccagaagcagataaacaac

SEQ ID NO: 9214 - DNA, 685 bp, Solanum tuberosum
  Predicted polypeptide sequence is orthologous to G435
cttgaatttttcataaactttctactatattatattattaatcaaaatgaatttcttgagttctcaaactcgaaaaattcatctaaaatgtcacaagaaaaggctcaaccaagatcaagtgaggctcttagagattagctttagctccaataacaagcttgattccgatagaaaatcccaacttgcccaggaactggggttaccacccaggcaagtcgcaatatggtatcagaacaagcgagcgcgatggaaaagtcaaagcctagaggttgactataagaccttgcaacaaagactagataatgcccttgaggataatgagaagttgaaattggaagttgagaggcttagaaaggagctaaacaaaaatcaagaagtgttgttgggattcaacaccacaactaataattattcatcaatttcaagttcatgtgatgaagttgggagtacttcatgtttgcaacttcatgatcaatccaagcataatcatcttgataaggagttttatgcttgtttaattggtgatgaaggccactttgggacacatcatgatgggcataatttctttgcttcacctttgtcttgataagctacatatgtatatggtaacttattaagtccaaaaaatgaaggatgtttatgacttttatgtgatatgtattgtgtttcttcttcttcttatata

SEQ ID NO: 9215 - DNA, 619 bp, Solanum tuberosum
  Predicted polypeptide sequence is orthologous to G435
ttttttgtacaattgacgaatatgatatttttttctcattagatttcccaaaattctcattcacttcaccaagttgaacaacattttttggtcccttcttccacacctatcataggataaagttcatcaatttgcaaattacaataattaacctcataattatgtacccatttagtactatagctaatcacatcttcacaacatgaactagatagtctaaattccctaatttgcccttgtgcacctgacttcagtccaattaacatttcatttgctttttccaattctccttgaagaatttcagtttctttttcaagttgccttttctcagataatgcattttcaagcttaacttgaagggcattgtagtcattttccatgcactgatttttccatcgcgctctcctattttggtaccaaatcgaaatttgtcgtggtggaacccctaattctcttgccaattgaagttttttctctagatcgagttttttagttgaatcgaaactcgcctctaaaagcctaacttgttcttgatttagccttttgtggtggtgtattgagtatttttgcaagtttgggaatgaaggaactatgcatgtggaaaaatatggatgggaac

SEQ ID NO: 9216 - DNA, 939 bp, Solanum tuberosum
  Predicted polypeptide sequence is orthologous to G450
attacttatattacttttgcattttctctctcatattttttccctttctctctctttttaatatttgcatagtactactactacatattgaagaaaattattgaagaaaaaagagtttgttttttgatggatttgaaagaaactgagttgtgtttgggactacctggtggtggtggtggcggaggaggaggaggtgaattaattcgcgataataataataataataataagattaatgggaaaagagggttttctgagactgttgatttgaagctcaattttcatcaagctaatgatgatatttcttgtgctatggagaataataagatgaagaatagtgttactactactaaagaagttgtttgtaacaaagatccaatcaagccacctgccaaggcacaagttgtgggttggccaccagtgagatcatttaggaagaatgtaatggctcaaaagagcaacactgaagaaagtgagaagactactgttgcatttgtcaaagtttgcatggatggtgcaccttacctacgtaaggttgatttgaaaatgtacaaaagttaccaagaactttctgatgctttggctaagatgtttagctcctttactaatggaaattatgggtcccaaggaatgatagattttatgaatgagagcaaattgatggatctcctcaatagttctgaatatgtgccaacctatgaagataaagatggagattggatgcttgttggagatgtaccttgggagatgtttgttgactcatgcaagcgtttacgcataatgaaaggatcagaagctattggacttgcaccaagagcaatggagaaatgccagagcaggatctaagccaattgatggtgtgccaaaactccatagataatgtttgaagttgaagggtttgtgagattatatattgttgttttcatgtgcttgtatttt

SEQ ID NO: 9217 - DNA, 826 bp, Solanum tuberosum
  Predicted polypeptide sequence is orthologous to G450
aaaaatgtcattggagagagccaaattagcgaacggcttgacggaaaccgataattccggcctcaatttcaatgaaacagagctcactctcggcttacccggagaatcgcggaagcaaatctccggtacaaaacgtggaatctccgacggtatggaattaatcctaggaagctcaacttcaggcgaacgccgccgtgaagatgatcactcgaaaaacgaaatctctaccggaaacaaacctccagcaaaggctcaagtaattggatggccaccggtgagatcatacagaaaaaacgtgatagaaaagtgcaagtacgtgaaggtggcagttgacggagctccttacttgagaaaagtagatctggaaatgtacgatagttaccagaagttgttaaatgctttagaaaacatgtttacctgcctaacaatctgtaattctcaaagtgaaagcaagcttatggaccttacaaatggtgtagaatatgtacctacttacgaagataaagatggagactggatgcttgttggagatgttccatgcgaaaatgtttgttgatacgtgtaagagaattaggttgatgaagagcacggaggctattggattagctccaagaacaccagggagatcgtcgagttcaagctaaattaatctaaagataactgcatgtacagataccaactggcttgggggaataagattaaagaaggtcttgaactagtatctcaacaagcctattccaatgaaacaggctccctctttcatcagatcctcggactacaacatactgggatccttgagcaatcctcaagaaaggggaaaaaactt

SEQ ID NO: 9218 - DNA, 857 bp, Solanum tuberosum
  Predicted polypeptide sequence is orthologous to G450
atctctcttcaatttccataagtaccatagccccatatagtatcattattcattttgtatagtagagaggaaaaagaagtaatggacttgaatctcaaggaaactgagttatgtattggggatgcctggtggtggaggagatcacaactattaagaaaagaggattttctcatactgttgatctcaaactcaacctcgataatccttccatgaacatcaacaatacttcttccaacaaggactctctcaagccaccaactaaggctcaagtggtggggtggccaccagtaagatcattcagaaagaacataatgtctcaaaaaggcaacaataatgtagaaattagtgagaagggagaaaaaacaatagcatttgtgaaggtctccatggatggtgcaccttaccttcgtaaggtagatttacagatgtaccaaaagttaccaacaactctctgattctttgaccaacatgtttagctcctttactatgggtaattatgggtcccaaggaatgatagattttatgaatgagaggaaactgatggatgtcctcaatagttctgactatgtacctacttatgaagataaggatggggactggatgcttgttggagatgtaccttggcagatgtttgttgattcatgcaagcgtctacgcataatgaaaggatcagaacgccatttggacttgcaccaagagccatggagaaatgcaagaacaggagctgagcaaattagttcagcaactcataaattggagactcaaaaaatgttgatcgaagaatgaagcaatcaatttccatggtgtctgtaattaatttgatagttaattagtatataaatatctagataattatc

SEQ ID NO: 9219 - DNA, 746 bp, Solanum tuberosum
  Predicted polypeptide sequence is orthologous to G451
aaaacaactcttcagctttaactcaactcaactactctaagatcaatcgattaacagcagaccgctctctaaattatgggaatttacgagaaggatctcaatgatcttgaggcaactgaactaagattaggtttgcctgggataatagatgaatcttcaacatcaactagtactgctaaaaatagcagaaaaagaccttcatctattgtaaatgaaaatgaacaacaagactcacctcctccaccaaaagcacaagttgttggttggccaccagttcgatcttacaggaaaaatcatgtgtctaaactatcagaatctgataatagttcctcagggatgtacttaaaagttagcatggatggagcaccttacttgaggaaaattgatcttaaggtttacaaaagttaccaagagctactcaaggctttacaaaacatgttcaagtgcactattggagtgtactcagaaagagaaggatataatggatctgattatgcaccaacatatgaagacaaggatggtgattggatgcttgttggtgatgtaccatgggagatgtttatcagttcttgcaaaaggcttagaattataaaaggatctgaagctaaaggtttagcatgtctataaaaacatggaaatatatatatacatacatgcaaatctactagggatgaaaaagtttcagttttgtaacactatctgatcttcgatcaattttatgggatatatagatctagatctacttg

SEQ ID NO: 9220 - DNA, 726 bp, Solanum tuberosum
  Predicted polypeptide sequence is orthologous to G451
gcatagaactttagattattattccatttgagaaccaacaaagagatgtgttaaaaccccaaagccaaataagaaggaagaaagaaagaacttcaagatagattaagaagaacaaaggaaaaaactcatttcatttgagaatactgtgtctgtctatacaattgcttccagagcaaatacattcttcatatgctattatcacactgcaggatctataaaaaccaccatggtttctaagcctgcacaacatataggaataagagtttcattttttaccccttcaaaacaaaactgctctttcttctgtttttcacttcccaatcagtgtaaaacaaacttccagcttcttgcaattcgacaacccaagctcaaaaagacccccttcccttttttttccctgagaagaattcataatcttcttctcaaactccacatcctaaccctcttgcttctgatcctttcattatccttagcctcttacatgatgataagaacatttcaaaaggaacatctccaacaagcatcaagtcaccatctttatcttcataagcaggagcaaattcagaccctttatacccttccctttctgaatattcacctatactcagcttgaacattttctctaatgcctttaacagttctggataacccttgcacaatttcagatcaatttttctaagataggggctccatccatactgactttacatacatcccacactcagc

SEQ ID NO: 9221 - DNA, 971 bp, Solanum tuberosum
  misc_feature (859)..(859): n is a, c, g, or t
  Predicted polypeptide sequence is orthologous to G451
gaaactagcattttcttcaccggaaatatttcagctttcatcggaaactcaccgtcgtagatcatatcatcaaatttgaagaaatggaaatggctggaacagagctaagattaggcctacctggaacagagccatcgtcttctacttctactagtaaaattagcaataaaagaacttcatcacatatgaacagcaatgatgaaccaccaccaaaagcacaagttattggatggccacctgttcgatcatatcgaaagaacattttagaagcgagctacgttaaagtgagcatggatggtgcggcttatttaaggaaaattgatcttaatatttacaaaagttatccacaattactcaaggctttagagaacatgttcaagtgctctattggtgtatattcagaaacagaaggatacaatggatgtaattatgtaccaacttatgaagacaaagatggtgattggatgcttgctggtgatgtaccttgggatatgttcattaattcctgcaaaaggctaagaattatgaaaggatctgaagctaaaggcttagcaagcctatagatctgatagattgatcagaattcagatcatatcatccgtgtgtttgatctcgaggttttgaacatgtatatctaactctattcctattggatttatccatatcgaaaatccttaacgaaagcttaggttccttcaagttttggtataaccaggtttttcgagtgtattagcagaaaagtaacagtttggatcatcgttttccttgtacattcaagttccgtcctatttgaagaatctatggggtatttccaaaaaagggatatcgggataatatgaagtattatgcggaagcaaanaaacacgagaaaaaagaactcgaaggcggcggcccgggaccccaattcggccaaaagtgagccgtataaagcgcgccaatggcggcggttacaaacgtcggaccgaggaaaa

SEQ ID NO: 9222 - DNA, 869 bp, Solanum tuberosum
  Predicted polypeptide sequence is orthologous to G451
cacaactgcttctttgtaccaaaggatagtaaacaaaggagcaatcttgatcaagaaagtgtttacaaaaatttggggctttttctgttttgagatttgaggtttttaatttggtgttttgggtatttcaagaatcaattttttttggagaaaaaaaaaatgacaagtatagtgggaaatcagaaagatctgaatttcaaagctactgagctgaggttaggtttgcctggtacagaagatcaagaatctgaccaagaaatatcaaattccaagaataacaacaaaagggctttgcctgaatcaactcatgatgaagaagattgtgaatctaagtcaagttctgatcatgtcaaaaccccacctgttgccaaggcacaaattgtggggtggccaccagtgagatctaacaggaaaaacataatccaaccaaagaaaacagaatctgaatctggaatgtatgtcaaagttagcatggatggtgccccttatctaagaaaaattgatctgaaaatgtataaatgttatcaagaactactaaaagccttagaaaacatgttcaaactcaccataggtgaatactcagaaagagaaggctataaaaggatctgaatttgcccctctttatgaagacaaagatggtgatttgatgcttgttggtgatgttccttgggaaatgttatgtcttcttgtaagaggctgagaataatgaaaggatcagaagcagaggcttgggatgtggagtttactttataaattataaaaattcccaattagaacattttgactgatgatgaaagtttttccttttttctcccttttacagtaaacaaagagtcctttcttccccttaggttctttgaattaaaaat

SEQ ID NO: 9223 - DNA, 615 bp, Solanum tuberosum
  Predicted polypeptide sequence is orthologous to G489, G714
ctgaagagaataaaggaggacactccagaaaaatgacattgcagcagcgataacaaggacagacatatttgatttcttggttgacattgtaccaagagaggacttgaaagatgaagtgcttgcatcatcaattcctagagggaacctccctgttggaggccctgccgagggcctcccatacaattattatatgcctatgcaatctgctccacaaattggagcttcaggggtgtatatggggaagcctgctgatcaagctctttatggccagcatccccgtccttatatggctcagccagtctggccccagcaacagcaacctccatcagattcttaagcatctggggcatcagattactgttggacaccagatggtagtctaagatgcaagtactggacaatacactaccaggatagcagactgcatatttgaattaacaatagggacatatagagaactagttcttcggtgtttcctacagtagcttaatcatcatatgatgagctcaatgaattagtaacaaaatgacccccttcttattttcgtgtgtttccagatatgtagcggtgttgaatgtttttcttatatttcatggtggtgagctcttatggatt

SEQ ID NO: 9224 - DNA, 1006 bp, Solanum tuberosum
  Predicted polypeptide sequence is orthologous to G489, G714
ctttgattgaaccctagctctcactctctctttctctctctaaaaaaagcataaaagtttcaatctttcaggtaatttgattggagaggcgaatccagattttggagcttcaatcagtgggagcccacagcctaaggtagccttgaattctccaaaagggaatcttgctcaaaatggatcatcatggaaatggacagcctccaggtattggagtcattactagctcagctccaatatatggtgctccataccaagctaaccaaatggcagggcctcctgcagtttcagctggtgcaattcaatctcctcaagcagctggtctttctgcttcgtcagcccagatggcacaacatcagctcgcttatcagcacattcatcagcagcagcagcaacaattgcagcaacaactccaaactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgactctgcgtgcatggaaccacactgaggagaacaaaaggaggacgctgcagaaaaatgatatcgctgcagccataactaggactgacatatttgatttcttagttgacattgtcccaagggaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgttgatcaagcactttatgcccagcagccccgtccatttatggctcagccaatttggccccagcagcaacaaccaccctcagattcttaagcagctcaaagcttagattacaggaatccagaagctaagagcagtgagtagtctgagtagcg

SEQ ID NO: 9225 - DNA, 1295 bp, Solanum tuberosum
  Predicted polypeptide sequence is orthologous to G519
ggtcaaacaactgaaactaacaaagcagcagcagcagcaacaaacagagaagacaacagaggaagataaacaaaggaaattaagagggagatttatcgaatcgaaagggaaagggaagttacgaagagtgagaatttgaaggaaatgaacaaaggagcaaccggaaatcagcaattggagttaccggcgggattcagattccatccgacagacgacgaattggtgcagcattatctctgcaggaaatgtgccggacagccaattgcagtatcaattataactgaaattgatctttacaagtttgatccatggcagttgcctgaaaaggctttgtacggtgaaaaggagtggtattttttctcaccaagggatagaaaatatcctaacggttcacggccgaaccgagcagcaggaaccggttattggaaggcaaccggagcagataaaccggtgggaaaacccaaaacattagggataaagaaggcacttgtgttttatgctggaaaagcacctagaggaataaaaaccaattggattatgcatgagtaccggctcgccaatgtggaccggtctgctggcaagaacaataacttgaggcttgatgattgggtattgtgtcgaatttacaacaagaaaggcacacttgagaagcattacaatgtggacaacaaggaaactgcaagctttggagaatttgatgaagaaataaaaccaaaaatattgcccacacaattagcacagatgccaccacggccccgatcgacaccgacaaacgactacttccatttcgaatcatcggagtcgatgactagaatgcacaccacaaactcgagctctggctcagagcatgtcttgtcgccatgtgacaaggaggttcagagcgcgcccaaatgggacgaagaccacagaaacacccttgattttcagctaaattatctggatggtttactaaatgaaccatttgaaacccaaatgcagcagcaaagttgcaactttgaccagttcaacaatttccaagacatgttcttttacatgcaaaagccttactaaaattgtataaattcattggatctaaattgattgtgatccatgacattttctttgttctttggtggtgtaggtcaacttttattaattagtttagaaaagtacaaaatgcaagtcaaatttggtgggctgtaatgagcctttgataagcatagccaaagagtcatatagaagggcttattaatgttattattgtaaggtacatgtaaaacaaatgaaaatttgttaatatcaagttatcattcttc

SEQ ID NO: 9226 - DNA, 914 bp, Solanum tuberosum
  Predicted polypeptide sequence is orthologous to G519
gaagaaaaagtaatggtggatttgcaatttcctgctggatttcgattccatccaactgatgaagagcttgtgatgcactatttatgtccaaaatgcgcctcacagccgattgatgttccgattatagctgaaattgatctctacaagtataatccatgggatcttcctgatttggctttgtatggtgagaaagagtggtatttcttttcgcctcgagatcggaagtatccgaacggttcaaggccgaatcgagctgcgggaaatggatattggaaggcgacgggtgcggataagccgattggtcgtccaaaatcgatgggaattaagaaagctttggtgttttacgcaggcaaagctccgaagggagaaaaaacaaattggattatgcacgaatatcgacttgctcatgttgatcgatctgctcgtaacaagaacaatagcttaagacttgacgattgggttttatgtcgaatctacaataagaagggtacaattgagaagaatcaactgaatattcgaaaaatgaatgttgaaatgtcgccggcggtgagtgaaggtgatgtaaagccggagattatgccgtattcagtttcaacaaagccgtcttcgacgtcgtaccacgtttacaatgacttcacatacttcgattcatcggattctcttccgaaacttcacaccgattccagctgctcggagcacgtgccttcgccggagttcacatgcgagaaggaagttcagagcgagccgaatgtgaaactgaatgagtgggaaaaaactgcccttgattttccatttaattacacagatgccactacttctgagttgcagagttgttatgagatgtcaccactacaagatatattcatgtatctgccaaagccgttttaagtggggccccgccgatttttcatttt

SEQ ID NO: 9227 - DNA, 990 bp, Solanum tuberosum
  Predicted polypeptide sequence is orthologous to G519
atgaaagagtggtacttcttttcacctcgagatcggaagtatccgaacggttcacgaccgaatcgagctgctggaagtggatattggaaggctactggtgcggataagccgattggaattccgaaagcggtgggaattaagaaagcattggtgttttattctggtaaggcacctaaaggagagaagactaattggatcatgcatgaatatcgtcttgctgatgtcgatcgatctgctcgtaagaacaacaatagcttaaggctagatgattgggttctatgtagaatttacaacaaaaagggatcgattgagaagaatcggaaaatgaacactacctgttatatggatacagttggatctccagaagataggaagccggatattctaccaccgctacctccaccgcctcagccgcagcaattgcacaacgatttcttctatctgccgtccgattcagttccgaagatccactccgattcaagctgctcagagcacgtactctcaccggaattcacatgcgagagagaagtgcagagccagccgaaactgactgattgggagaaagctaccctcgatcttccgtttaattacatggatgccactaccggcgcgacaacggtggataatagcttgttaggttctcagtttcagagctgttatcagatgtcgccgctgcaggatatgttcatgcacctgcacagaccttttgagtggggcccagtggatcattttcagccgcaagcgtcaaaggagacttaaacgtccgtgactttgcacgtgcggccgtggtagaataatggtagtagcatcttttgcgttcacattggcaattgtgaaaacaacatttgtatatgtagataaaaaatattactagcaattaaataaattgcgaaaaaaaaaacaccctaataaagtttatataagtacataatgatcatgagactttttgtactacatgtggatgtactttagtatatggggtgttatcaa

SEQ ID NO: 9228 - DNA, 541 bp, Solanum tuberosum
  Predicted polypeptide sequence is orthologous to G525
ggtgagacatgtaattcacatgtgacgtgtttctccgattcagtggaggatcaaaaacctcaaacttatgatcattatcatgctcctctatcgagctcccctgtttcagtcgatttcccttcaaatgaaccaaaccaatcgatggcgtacatggaaaatttccagtatggagattctggattgatgcaagataactcgataatgaggcttttgatagataacaattatgggtcagaatcaaaacaaagtttgaggggttacgaagatcatgacttcaatatcacttcaactggcccagtggacatcgattgtctatggaattattgatatttgagagctggataaacatttagtagggacttgaaaaatgcattagaaattagaattgaatgtgggagttgggacagaggaattgtgcttataattattattcttcagatattgttttagattatttgcagtagtactacataaatatctgttgtgtatagatttgtctccactagaaataatacataagttaattggtttgttaatatgt

SEQ ID NO: 9229 - DNA, 872 bp, Solanum tuberosum
  Predicted polypeptide sequence is orthologous to G525
ctcttgttgggatgaagaaaactttggttttttacaaagggagagctccaagaggtgaaaaaacaaattgggtaactcatgaatacagattagaaggaagattatcacttaataatcttcctaaaacagtaaagaatgattgggtgatttgcagagtatttcaaaagacaactggtggtaagaaaattcacatttcagggcttgtgagagggaattctgatgaaaatgaaatggtcaattccattttgccaccattgacagattcatcgccaagtcacgtgcactgcttctccaattatgttaccactcaaaagaatcaagaaaacaacatgatcaattccttcaacaattctcctaatttccctcttctctcgaattccattgacatttttcaaagaaactctcttccaaattcgttcgcctggaaccaaaatgtccctcttcaacacaattttccacagccaggttcatttcctatacaagatcctgcaactctgaggaatttgcttgaaaattacggacagaacattcaacatcagagtttcaaaaaggagacagatatgatcagtgtatcccaagaaacaggtataagcactgatatgaacgctgaaattacatcagctcagcaggatcttgattgcttctggacttactgaaattctttgaccagaaaaaaaacgcaaaaaagaagaacagacataggagcttcattagtagtattagctattatggtgtgaaaatcatggttatatgtactagatttactaatcccctaagttgcattcaacatagtaaccatattatgttccaaaactataatcttacacaatttatttatttgtccgcattttaaccttaaaaaaaaaaaaaaa

SEQ ID NO: 9230 - DNA, 1047 bp, Solanum tuberosum
  Predicted polypeptide sequence is orthologous to G525
ttatggccttggtattcttgttacttctttttttcaatctttcaggttagttcccatggattctcctatcctaaaatttttccatcttctccattcttgatttagtattctagctcctggttttctttaatctgtttggcaaaaaaaaccccattttttatcactttatttcaaagccagctggtgaatcggtggtgatgaaaagattgtagtgtatatgtattaaggcggaagtaatttattcttgatcataaaaaagatggagaattattccggagttgttaaggatgatgatcagatggagttgccacctggatttcgattccatccaactgatgaagaattgattactcattatttgtctaacaaagttgtggatactaatttcattgctattgctattggtgatgttgatttgaacaaagttgaaccatgggatcttccatggaaggcgaaaatgggggaaaaagaatggtattttttctgtgtgagagacaagaagtatccaacaggggctgaggacaaacagggcaactgctgcagggtattggaaagctactggaaaagacagagagatttacagaggaaaatcattggttggtatgaagaaaactctggttttctacaaagggagagctccaaaaggtgaaaagaccaattgggttattcatgaactttcagattagaaggaaaattgtctcttcacaatctgccaaagacagcaaagaatgaactgcgtgatctgcaagagtgtttccaaaggaccagtggtggcaaagaaaattccacatttcagggcttttctggaacattgcatttcctaatgacaatgaaatcggggaatccattcagcgccaccaattgaccagattctcggcactggttcgaaaatcacagcacgtgccactggctttcttccaattgtctcactggttcaaaacaactgtttcctcttctgcacatccaatggatagttcccaacactctcctagtttcaatacctttcttgtaaccaattgccctttcattacaaatactcagtcattg

SEQ ID NO: 9231 - DNA, 799 bp, Solanum tuberosum
  Predicted polypeptide sequence is orthologous to G562
gttcttttatataatatgtactccatattttattattctatctagaaaaagagaaagtagatacaaaatgcagaaagtttgagacaaaaactgcaaaattccatcaattaaatctcaatttaagttggcataataatcttggttagcgtacctccaacaacaactacgcccaagtcccaaacaagttgtgatattgttagtacctccgaaaggaaataatcatctcagcagtgaattagtagagtgtctagttgctttctgacacatgggaagtattgaggatgggaagtcttctacgcctgagaaatcattttcgactgcacctgatcaaagcaattttcatgtgtatcctgattgggctgcgatgcaggcatattatggtcatcgagtagctgtacctccatatgttaattctgctgttgcacctggtcatgctcctcatccttacatgtggggcccgctaccgcctatgatgccaccttttggcacaccatatgcaggagtctatgcacatggtggtgtttatccgcaccctggagttcctattgtgtcccgtcctcaggcacatggaatgacatcatctcctgctgttagccaaaccatgaatactgcttctttgagtatggatgcttctgctaagtcttcggggaactctgatcaaggcttgacgagtcagtcaaaagggtttaatgggcttggaatgtcaattggaaatttcagtgttgacaatggtgatggcactgaccatggaccttctcagagtgggcaaactgaaggggtcagtgatggaagtacatac

SEQ ID NO: 9232 - DNA, 997 bp, Solanum tuberosum
  Predicted polypeptide sequence is orthologous to G562
gaaacttttcactactaaaattcgccttctcttctacagtcttaagggttgcttttctgtacttagttgggacaacactcttatcagtgactacaaaaggaaattctgattgcacctctaatttagttcgacatctacttggttccttatacatgggaaacagtgaggatgggaaatcctgtaagcttgagaaaccatcctcgcctgcaccggaccagagcaatctccatgtctatccggattgggcagccatgcaggcatattatggtcctcgagtagctgtacctgcatatttcaattcagcagttgcacctggtcataccccccacccttatatgtgggggccacagcctatggtaccaccttatggtgccccttatgcagcaatatatgctcatggtggggtttatgcacatcctggagttccaattggatctcatcctccaggtcatgtgattgcgacatctcctgttgtcagccaggccatggatggtgcttctttgagtttagatgcgtctgccaagtccttgggaaattctgatcgaggcttgatgactaaactgaaggaatttgagggcctggcaatgtcacttggaaatggcagcactgacaatgttgagggtggaacagacaatggacattctcaaagtggggaaactgaaggttcaactgatggaagtgacacaaatggagctggggtcagtgagagaagtaagaaaaggagctgtgagacaactcctgataactctggtgatgataagagtcactcacgaagatgtcaaccttctggggaagtaaatgatgatggtgagaaggcaatcgttattgcagcgaaaatgacgggaacagtactttctccttgcatgacaactttggaaatgagaaatcctgccagtgcacatatgaaatctagcccaactaatggttcaccactcagccctgcactgccctatgaaaccctggtacagaatgagcgtgagctgaagcgggagaaaag

SEQ ID NO: 9233 - DNA, 789 bp, Solanum tuberosum
  Predicted polypeptide sequence is orthologous to G562
gtccaactaaagaaccagtaggatgtattatgtaacatcataaacatactacatttatttatcaaatatgaagttcactccaacattaaacttacataagctattatagccacattcaactcaaaaatgaaaaaaaaggaaaagagcaaacatcggttctactgacctgtaaactacaattaggtaggtaaaattagaaatcttgcaacgtccgtaatcctattcagctgttcctctcccgtagttagcagtaattttggacttaaaattaccccaaaattacacaatcagactaaattttaacatctcaaattaaagtaagggttgtacccttcatcacccagctgctactgcatcacttctggggctgggatcaagtagttgatgaagctttgctccagagctgttgttctcataaacttcaccctcctcgtttgttgtatccgaggaacctgagttgttcactcttgctagcaggtttactgtgcctacaggttgcagtctcttatcatcaatcttacctaaactcacttcttttgtctgtcctagctcttcatttttcagtctctccattaaagcagcattatctagcttcagtttctccgagttctccattaatttgttaatctcggatctgagtgtcaagttctctcctgttaaagcctgaactcgtattgacaattcttcagcttcagcctgttttctcaatcttgatcgccttgcagattcccgattagactgtttccttttctcccgcttcagctcacgctcattctgtaaccaggtttc

SEQ ID NO: 9234 - DNA, 985 bp, Solanum tuberosum
  Predicted polypeptide sequence is orthologous to G567
gatatttattggcttaaaaaacttaaaaaagtcttagttttttttttctttttccggagagaaatatggatagagtattttcagtggacgatgacattggcgaccatttttggtcgacgccgccgacggcggagttgggcgttgattcacctacctctgccgccaccgccgccatctcctactcgaagatgatgaatcgcagctcttccgaatgggctttccagcgtttcctacaagaagccgccggtacgaccacttcatctcctcctctgccacctacaatggcgtcttcgtcgtcatcttcacaccaaaacgatgttgtcgagatcaaggatgagaatctttctactcctaatctcaattccagtacggcgttgaattcgaagccggcagcgacgtcgtttgcctctgcacctccgcagaatattcccgttgatgctgaagagtatcaagccttcctcaaaaatcgcctcgatttggcttgtgctgcagtcgcattgactcgggcgaagaatctaaagcctcaagattcaagttctattgcacctgataaaggtccagagactgctagtgcatcacaatcagtatctcacatctccactaaaggatctggtcaggaagtgagaaaagttcaagataaggattctggtggaccagttggaataccctctttaccctcagtgcagaagaaacctgtggtgcaggtgaagtcaacaactagtggttcatctagagagctatccgatgatgatgaagctgaaggagaagcagaaacgactcaaggaacggatccagctgatacgaaacgcgtaaggagaatgctttcaaatagagaatcagccagacgttcaaggagaagaaagcaagcccatcttacagaacttgagacacaggtatctcaactgagagtagaaaactcctccctactgaaacgtctgactgacataagccagaaatacaatgaatcagctgttgataatcgtgt

SEQ ID NO: 9235 - DNA, 946 bp, Solanum tuberosum
  Predicted polypeptide sequence is orthologous to G591, G793
acaccatcttatcattttacttgtaaagaacacttttttaagtagtatttgttcaattgaatgcttttctgagaaattaaggtggtcgaaaacagctccgatccaagaaagattgaatctttatagttctgctatggctaacaacccttctgagggaccttctgatgatttctttgaccaaatcatgggatttcctgcttacaatggagcagaaactaatttggcgggaaatgatgccggagctataccgccggcgatgatgctccagcttaactccggtgatgggtcgggtcaatttactggagtgggtcttggggttgggttaggtggtggggggttccatggtcatggtgggggtgcttcttttcctttagggttgagtttagaacaagggaaaggtgggttcttgaagatggatgatgtttcagcacctggaaggaggtttagagatgatgttgttgatagcagagcttcttcttctgtcaaacctggttttcatggacaacccatgccttcaatgccgcatccccctgcaatacgtccaagggtgagagctaggcgaggacaagctactgatccacacagcattgcggagaggttacgtagagagaggatagcagaaagaattagagcattgcaagagttggttcccagtgtcaataagactgatagagctgtaatgctcgatgaaattgtagattatgtcaaattcctacggctgcaagtgaaggtgttgagcatgagtaggttaggaggagctggtgcagtagcaccacttgttacagacattccaatatcatctgtagaggaagagagcagtgaaggtggaaataataaccaaccagcttgggaaaagtggtcaagtgatggcacagaaaggcaagtggctaaacttatggaaggaaatgttggtgctgcaatgcaatttcttcagtctaaggcacta

SEQ ID NO: 9236 - DNA, 936 bp, Solanum tuberosum
  Predicted polypeptide sequence is orthologous to G591, G793
taatttcgccgggtaaatctccggcatggcagcaaaccaaccggaagcctacgccgatgatttcctcgagcaaattctcgctattccttcctatggcttgccggttgctgatgttggcactccatcagagacgacgtcgtttacctcggcgtctgccgtatctcatcttaactctgccgctgctgctggcctacagcaacctatgttcccgttgggattgagcttggataacggccgtgatgacgtcagcgaagctggtgcttatgcagtgaagcatgaaagagatggaatgaatatcggaaatttatatgtaggtctagaacacttgcaatctcatgcagttcgtcactctctgccttctgttcaccatgtccagccttttcaaggcccaccaacaacgagcacaacagtaactgtaccgcagccaccttcaattcgtcctagggttcgagctcggaggggacaagccacagatccacatagcattgctgagaggctgagaagagagaggatatctgaaagaataaaggctttgcaggaactggtacccagctgcaataagacagatagggcagcaatgcttgatgagattctggactatgtgaagttcttaaggcttcaagttaaggtactgagcatgagtaggctgggaggagccagtgcagtggcacaacttgttgctgacattccattgcaatctgtggagggggacagtggtgaaagtagatccaaccagcatatatgggataaatggtccaatgtagacacagaacaagaggttgctaagctcatggaggaagacgtcggtgcagccatgcaataccttcagtctaaatcactctgcatcatgcccatatcacttgctgcactcatctatcctactcagcaaccggatgaccagtcactgggtcagcctgaagcggcagccccatcata

SEQ ID NO: 9237 - DNA, 747 bp, Solanum tuberosum
  Predicted polypeptide sequence is orthologous to G635
cttagaattgcttcggatggtattatagtggtcagtatggaaatactacgtcctcaatccacggatggtatgacagagaaagctttgaaggggaaaaataagaataaccacacgctgcttgtggcttgacaaagggaaacttctggatgcgctccataaagctgcacatgcttcactttcaagctgtccattgaattgcccattgtcccacatggaaagaactgtgtctgaagttcttaggaaattggtcaggaaatacagtagtaaaagacctgaggttattgccattgcctttgaaaatcctgcaggagtcctggctgatgaaatcaatggaaaactttctggaaaatcacatgtaggttttggaatttctgcactgagaaatgtgttggatgaagatcagaaaagaagacaggcaagtggagcacgtgcagaagaaggtaatggccatggctatccaattgatgatgcagctgagcaagtgaaaggtgatgatatggatattgagagacttacgcatgatggagcaactacttcaagtgcaaactcactggatgaatattctaccactgaggaggaatcagaatcgtccagaaaagagagcattcaaattgattctggctttccacaatctatgatgaaatcttccaagcctttgaagagaaaccagatggaaaccatgatgagataacagaaattgattacgttgcgcggggaactccacagcaagttccaagttgttcgggg

SEQ ID NO: 9238 - DNA, 987 bp, Solanum tuberosum
  Predicted polypeptide sequence is orthologous to G653
ctgctttttcctcttcttttttctcccattcatcattctctctttggctcattctcccagaaaaacattctcttcatccgccattaacgctcgccgcatcacaaacttgcaatccacacataatcaacaacttgcagcaatatttattttgatcttccaatagtcaaagaggttggaggatcagatctaggattatttttgttgtgttgaagtcatgtcgtttacagggactcaacagaaatgcaaggcttgtgaaaagactgtttacccagttgagcttttgtcagctgatgggattagttatcacaaatcttgcttcaaatgtacccattgtaaaggaactctcaagctgagcagttactcctcaatggaaggtgttctgtattgcaagcctcattttgaacagctctacaaggagtctggcaacttcaataagaactttcaatctcctgtgaagtcagctgagaagttaactccaatgctgacaaaatctccaagcaaagctgccggcatgttttctgggacacaggaaaaaatgtgccacctgcggtaaaacggcttatccacttgagaaggtgacagtggagaaccaaagttatcacaagtcgtgtttcaagtgttctcatggtgggtgctctttaaatccttcgaattatgctgccctcgatgggattttgtactcgcaaacctcatttttcacagcttttccaggagcaaaagggagtaacaatccatttaatcaaggtctgccttcaatgaaagcgtccagcagcaactgtcccaaattcttaaactgtaatccccgtcaattatttatccacgcagctggtctttaaatatttggttccttcctcttttccgtatatctccaattggtgttgccctttcggttactgggtgtgaatcctgatcttccacaacctgttgaaaaacttaattccttcctgtggtggtggttgtcccttaaaccttcgggatggttaaaat

SEQ ID NO: 9239 - DNA, 789 bp, Solanum tuberosum
  Predicted polypeptide sequence is orthologous to G663
ctcctatgatgtgtacatctttgggagtaataaggaaaggtcatggactgaagaagaagatatccttttgaggaaatgtattgataagtatggagaaggaaagtggaatcttgttccaactagagctggattaaatagatgcaggaaaagttgtagactgaggtggctaaattatctaaggccacatatcaagagaggtgactttgatggggatgaagtggatctcatcttgagacttcataagctcttaggcaatcgatggtcacttattgctggtagacttccaggaaggacagctaacgatgtgaaaaactattggaacactaaccttctaaggaagctaaataccagtactaaatttgctcctcaaccacaacaaggaattaagtgtgggcaagccaatgccataataagacctcaacctcagaaattcagaagctccatgaagattaatgtctcttggtgcaacaacaattagtatcgtaaataatgaagaagcatcgaacgacaacaacgatatgcaatggtgggcaaatatactggaaaattgcaatgacattggagaaggagaagctgaaagaacactaccttcatgtaaggaaattaattgcaatgaaattgataaaacaccaagtttgttacatgagggaggcaactccatgcaacaaggacaacgtgatagtggttgggatgaattttctctagatgatatatggaatctacttaattagcgggtgattacacgaatgactgagaggtgatggtctgaacttttgattcgttgtctta

SEQ ID NO: 9240 - DNA, 490 bp, Solanum tuberosum
  Predicted polypeptide sequence is orthologous to G663
cagaaatggtagtattataattaaaatatatgtcttagaactatatattattaaaaaaaatgaatactcctatgtgtgcatcgttgggagttaggaaaggttcatggactgaacaagaagattttcttttaagaaaatgcattcaaatatatggtgaaggaaagtggcatcttgttcctgctagggctggtttaaatcgatgtcgaaagagttgcagactaaggtggctaaattatctaaggccacatatcaagagaggtgactttgctccagatgaagtggatctcatcttgagacttcataaactcttaggcaataggcaagtctatgtgtttattagactgcgatcattttattcaaaagtttatgatgttagggatttacgatataattttctttttaatgtattatatatatatttataaatattaccatttcttaatatgtgtaattatttcatttaaaagttacgaaaaaaaaaaaaaaaaaa

SEQ ID NO: 9241 - DNA, 1125 bp, Solanum tuberosum
  Predicted polypeptide sequence is orthologous to G663
aaaggttcatggactgaacaagaagattttcttttaagaaaatgcattcaaatatatggtgagggaaagtggcatcttgttcctgctagagctggtttaaatcgatgtcgaaagagttgcagactaaggtggctaaattatctaaggccacatatcaagagaggtgactttgctccagatgaagtggatctcatcttgagacttcataaactcttaggcaataggtggtcacttattgctggtagacttccaggaaggacagcaaacgatgtgaagaactattggaacactcactttcaaaagaagttaaatattattactcctcctcctcgccctcgtcctaatcctcatctacatattaagcataagagcatcgtggttactaagaatgaaataataagacctcaacctcggaacttctcaaacgttaagaagaataattctcattggtgcaacaacaaaagtatgatcacaaacacattagacaaagacgacaaacgttgcaaggaaattgtagtaaatatttctgagaagccaacaagagaaaatacatcgtcgatagacgatggagttcaatggtggacaaatttactggaaaattgcaatgaaattgaagaagaagtagctgttacaaattttgaaaaaacaccaacaatgttgttacatgaggaaatatcaccaccgttaattaatggtgaaggcaactccatgcaacaaggacaaagtcatgattgggatgacttttcaactgatattgacttatggaatctacttaattaaatagtaatttctttttttgatttttcgtgatgtccggtacttatattagaatctgactgaattcagattcacgcgactccttatctagggggactcgaacccaacacctctgattaagaatgaatgagtacttattactccgacatatggttggtattaaagaaatatgtaatggtaattaatattattgtaaacttgtaatagggatccaatcgtcctttatactttgtatcctaattacaagttgttaggaatgtaattttaagaattattgtaagtgcatgcactctatttttatatttgatgtgaatttaaggattgagcataaatatgaaaaatcaaaat

SEQ ID NO: 9242 - DNA, 1071 bp, Solanum tuberosum
  Predicted polypeptide sequence is orthologous to G663
actcctatgatgtgtacatctttgggagtaataaggaaaggttcatggactgaagaagaagatattcttttgaggaaatgtattgataagtatggagaaggaaagtggaatcttgttccaactagagctggattaaacagatgcaggaaaagttgtagactgaggtggctaaattatctaaggccacatatcaagagaggtgactttgattgggatgaagtggatctcatcttgagacttcataagctcttaggcaatcgatggtcacttattgctggtagacttccaggaaggacagctaacgatgtgaaaaactattggaacactaaccttctaaggaagctaaatactagtactaaatttgctcctcaaccacaagaaggaattaatactagtactattgctcctcaaccacaagaaggaattaagtgtgggaaagccaatgccataataagacctcaacctcagaaattcagaagctccatgaagattaatgtctcttggtgcaacaacaatagtatcgtaaataatgaagaagcatcgaaagataacaacgatatgcaatggtgggcaaatatactggaaaattgcaatgacattggagaaggagaagctgaaagaacactaccttcatgtaaggaaattaattgcaatgaaattgataaaacaccaagtttgttacatgatggaggcaactccacgcaacaaggacaaggtgatggtggttgggatgaattttctctagatgatatatggaatctacttaattagcgggtgatttacacaaatgacctgagaggtggatggtcttgaacttttaattttgcttgtcttatcctattgataaaaattcaagttttacaagtccttatttttattcttgaagatttgcctatggagtaaattgaggtaaaaaattcgagaccacacatataattaggtgcatggcctttgtattatctacgtgtgtgcttttgtgtttttaaggtgaacaagtttatagtggaatgtgaaagtattccaagtgtgaagtatgtaatatgatatatgaaatgaagtgattattatatt

SEQ ID NO: 9243 - DNA, 1120 bp, Solanum tuberosum
  Predicted polypeptide sequence is orthologous to G663
atcatgagtactcctatgatgtgtacatctttgggagtaataaggaaaggttcatggactgaagaagaagatattcttttgaggaaatgtattgataagtatggagaaggaaagtggcatcttgttccaactagaactggattaaacagatgcagaaaaagttgtagactgaggtggctaaattatctaaggccacatatcaagagaggtgactttgattgggatgaagtggatctcatcttgagacttcataagctcttaggcaatcgatggtcacttattgctggtagacttccaggaaggacagctaacgatgtgaaaaactattggaacactaaccttctaaggaagctaaatactagtactaaatttgctcctcaaccacaagaaggaattaatactagtactattgctcctcaaccacaagaaggaattaatactagtactattgctcctcaaccacaagaaggaattaagtgtgggcaagccaatgccataataagacctcaacctcagaaattcacaagctccatgaagattaatgtctcttggtgcaacaacaatagtatcgtaaacaatgaagaagcatcgaaagacaacaacgatatgcaatggtgggcaaatatactggaaaattgcaatgacattggagaaggagaagctgaaagaacactaccttcatgtaaggaaattaattgcaatgaaattgataaaacaccaagtttgttacatgatggaggcaactccatgcaacaaggacaaggtgatggtggttgggatgaattttctctagatgatatatggaatctacttaattagcaggtgatttacacgaatgacctgagaggtggatggtcttgaacttttgatttcgcttgtcttatcctacggataaaacttcaagtttaacaagtccttatttttattctttgaagatttgcctatggagtaaattgaggtaaaaaattcgagaccactaatataattaggtgcatggcctttgtattatctacgtgtgtgcttttgtgtttttaaggtgatcaagtttatagtggaatgtgaaagtattccaagtgtgaagtatgtaatatgatatatgaaatgaagtgagtattatatt

SEQ ID NO: 9244 - DNA, 784 bp, Solanum tuberosum
  Predicted polypeptide sequence is orthologous to G666
acttctctgtaagacttaattccagtacacgtcagagaataaatagctttcataatcaagcaaagcacaaaattctactagctaattttttgctttgcttaattatgaaagttaaaatatacactaatgttaaaaagcattgtgtaccagacaaaaaataagaatgaggatgacatccatccctagttaaaatgctactactagaaactaattgggaatttgggagtaagaaaaacaaaagataatggaacacaccccaaatagaaaagcaaaaacaaatccttctaaattaataaatcgtcattttcatcaaacagccaactctccagcattactgacaattgaatttcatcatctatttctcttttgctttcaccatgaaatttaccagcagcttcaggtgtcgtagcttgagaaaattgatctgaattcgacggttcaaatgaagacgaatattcagtcatggcattattattattagtattacaagaatattgagtacttgacgaagcctttgattgctcggaattatttgtggattcacttttagtccactgtttgagtaatttggctatgttttcagcatttgatgcgtaagtagtagtagacatttttgcttcttgtttaatgtatgggtaacatccaatatcagtaattgtatagtcaggaattgggcttgatttatcgagtgacagtgcattttgtaaagcttgtttggctgtgttaatatcagcttgaagtgtctttcccatgggcctctggaaagttgattatatggttgata

SEQ ID NO: 9245 - DNA, 1166 bp, Solanum tuberosum
  misc_feature (558)..(558): n is a, c, g, or t
  misc_feature (840)..(840): n is a, c, g, or t
  Predicted polypeptide sequence is orthologous to G666
ttttttttttttttagaatctaaagagtctggtaaatattattactagtactactataaactattcactacatgtgcatatatttaagattacttgtaatatatacacttttctttactcttgcaaattttagaatttttgctcaggctagctactaagtaagtaaacctgttaaactaaattacaaagctctaattaacaagtaacaaacattaaaaagacattaaagaaaaccccaaatttgaacttctatgttttttctgaagaaatatttactagagctgtcatttactagtaaatatttcttcaaaaaaagtcagcagattcacccaaacccattcccataaactcttcttcttgtgctggtgcattaatagcatcatcaaatagccacttctctagcaaagttaacgggacttgtgactcttccaaacttggcttgctctccgcttgaaacaaaaaaccattttccgaattcacattcggaaaatttggcttgctttccacctgaaaaatctcaggtgtgaaagcattaccttcgctaaaaaaggagtcaanatccctcaggtgttgcagcacttatggtaccttcactaggactcgaccctgaccctgaccccgacccaattgacgggttattcaacgagctttgagttgtctcagaagttgatcgacttaattcagatgatttgggggaatccttcatccaattttgaagtaacctggaaatgttttccgcactggatgcataagagctggatcctgtaacgggttgttgagcaagaaattgggctaaattggatttagcagattgaatcagatttgtcaaaggtgataaangcctcgcagaagggcttttctagccatgttgaatatttggctcgtgccgaaattctggcaagcccgggggaatcccattagttcttagagcggccgcacgggggggagctcaagtgtgtcccttatgaggttaatgccccgctggagtaacagggcaaaaccggtcccggtaaaaatgttaccgacaaatcccacaaataagacagaagtttaatataaaacgggggcgaagaggagcaacaaaaatgggtcgccacagccgttcaaaggaacaggtggcgacgttaaaacgcacgaggaggtgtatgggcccccaccaaaagcgg

SEQ ID NO: 9246 - DNA, 588 bp, Solanum tuberosum
  Predicted polypeptide sequence is orthologous to G707
gtttcaaaacgatagcttctaaagaatacaatgttgttacaaagagttaccaaaataaatgagacaaatttaggatacaacacaactaaacaactcctctcaaactttcaaattatttttccctctcaaacttaaaattaacatacccttacactttcatgtttcaaatcaccccatatgcataagcgaacattcagggtcttcctaattcctaagtcaatggcccgaaccaccactcttgcattgtattaagaatctgagttatcaattcaggcccttaacacttacaagagttcttctttttttatttttgtggttcgttcttgactcagctccctatagtccaattattttgaaaaagggcaaaaaaggaaataaataatttaactttcacaatgtagggctcctttgattttttggagagtgcatgagatgagattattgactgtctcaacagattccactgttagcttagctgtaggtaagctattcaccaatatttgaaaagctacagttaagagggacccacttactctcatatctgggcctgggccaggcccattattaagacttttcaccaaattaggc

SEQ ID NO: 9247 - DNA, 943 bp, Solanum tuberosum
  Predicted polypeptide sequence is orthologous to G720
ttcacaaggcatttcattactggaggaaagaatgtctctgagtcacttaatccggttaaagaatctcttttgtccatgctagagctccaaccagtaaagcgcgaagcagataatgagaatactaatgaagctgtggtggaaaaccaaaaaacatcatcatcctgctgcgataaatatccagctccttcaaccccacaacagaaacaaggagtaaggtcagtggatgatggtgatctccaagatcatactatcttgtcaaatgaacaagatagtggggtgcatgaaggggacacaaaatctgtcgaaactacttgttgcgattctgttgctgagactactgtcttggcagattcttctgagcgactaggagaggctatcacaaaggaggagcatgattctgctgctgatcaaaatatggaggatcctattgctacttgttcacgaagtaatgacaatggcagtgcttgttctgctgacccgaacaaagcttatggtctccatagttcaagtgggacaaaagctaataagaagaaaatgaaggtagactggacacctgaactacacaagaaatttgttaaagcagtcgagaaaattggtatagatcaagccattccttctcgaatactagagctgatgaaagtagaaggcctgacgagacataatatagctagccatctccagaaattcaggatgcagcggaggcaaattttgccaaaggaagatgaaaaaagatggcctcgtcctcaacctagagattcagtacagaggacctattatccacataaacctgtcatggccttcccaaactatcattctaaccatgcacccacagctggtcaattctatcctgcctggataccaccaggaggttacccgaatggtgcacatatgtggggttcgccttattatcctggatgggcaccacctgagacatggcactgga

SEQ ID NO: 9248 - DNA, 966 bp, Solanum tuberosum
  Predicted polypeptide sequence is orthologous to G720
acccataaactaaggatggtttattcattatttttccaaagaaatcaatggagcacactcatcagcccaaacatccaaatttgggctagaaaaaaaaggggaaaacccatatttggatccattatttacaacaacccgattttgaccttcgagtcaatgccatacacgtggctaactctgtgccaatcatttattcattcttgagacatcagaacctcctcgggtcgggtcgggtcgggtcgggtcgggttatgtcatggtgcatgggtccatcaagtaattggagattattattttctgacatacaccacctgtgggacctagaaaaaaatagattgacttttcatctcatcttcgataacaggagccgttgatttgtgaagggatgattgagatccctcgtctagaaagttcgtcaagaacaccctctgtggaaggaggttttaggcccaaaggaagtggtaaccatggtttggttattgcctcctttattactttatcaatcacctcatccgccgggtgaagatcaaacgacttctctagcatgctatatctgttatgcattccgtgaggccgatacactccaggcattctgaggatatgatggatatgatccaaactgcggtgacatgacaggggagccccatgtatcagcatgcagctctggacgaggtgtccagttgccaagttctctgcaggctttccatcccggaatagtaagggttgaaccccagaactttgtaaacccgttcgcgataactttgctggttggtaacccaagcaggaataaaatttgaccacccggggccacctgatttcgaatgatattggttggccaatggtccatgaatacgggttcattcacaggaatcagttaaaccttccattgggaacctcgaaattccataagaggtttgcgagaattaagaggccatcttctcttttctcacatcccttttgggcaac

SEQ ID NO: 9249 - DNA, 773 bp, Solanum tuberosum
  Predicted polypeptide sequence is orthologous to G730
ggcatctaactttttgttaaaatgatttagcaaaatcaactaaaaaagctttaaccttttttggtcaaaacaaaattgaaccatattcctgcagtcacgtacagagaaaactatagtctaatagttagggcaacttaattaattataattactctacataatccaaattatttaacacttgagaagattcaaatcatttgaggatgatccagcttgtcccattttccagtttggtcttcctagtgtaaattcaagatcaagcaatgtatcatttgaagatgagttattggctgtctcaaatccatccatatttgtatatatgtgaggataattagcaaatgtcctttctctatttgagtggctccatgcatttgtctgatcaggcatgaatgatgaaggatccctcaaatgagacatattttgtgatatggtacttggttgtgataatgcatcaatctcctcaaaagatttttcatattcaccattattaatcccattgttttggttcaaaaatatattaatttctccctgccctttagctgtagctttgtcagtgctcttcactgttctatacatctgtaagtgactcttcacatgagctaaggttagatctttcacattcatcaactctagcacggattttggtgttgctcgttcatgtccacctaggagctgaacggcatgaacaaaatgagcatgaagagttgaagtccatctcattctcggagctctaacgcttcttttcactccactatcatctcgaactctcttga

SEQ ID NO: 9250 - DNA, 551 bp, Solanum tuberosum
  Predicted polypeptide sequence is orthologous to G730
cacatcaaatattatactattaaagtattataaaaattctttacactatcagataactagtgccctctttgcttttggcacaaaaactaatttccacatataggtccatcttttttactagggtttagctttcgcgctaagacccttttggctataaaaaaaagtacgaattcacatttttgggaataattttttagaatagcatatgaaagttcaccttgaagagttgttccaaaaaccctgaaaatcattatcttgatgaatattccttttatcttgttgaactgataattcagactttcttgaatattcttcattttcaactagaggtggatccaggatttagagtctctgagtgccaagtaaattcatctattatatcaatttagacttcgaatcaaaatattcatcaaccatcaattcctctgatgtatctccggatgacaaattatcgaatacctcagattggcctgaagaagctgatctatcagttgtcttcacagtccgatacatctgtaaatgggatttaacatgtgctaaggtgagatctt

SEQ ID NO: 9251 - DNA, 674 bp, Solanum tuberosum
  Predicted polypeptide sequence is orthologous to G732
ctagctcgagtatttttttttttacatgctattggagtttctgaatcttgaaatggttattaatatactactacgataactacaaatcgaagaaaaagactttccaattacaactgcataattaagtcctgaaagagaaactgaaaatgagattacaaacccacatttacaagaacaccaatattcctcgagaggatttattcttaataaaataataatactactactacttgacaaaagagaaatcttagcaagatcactaatatttctactacttgatgatgataatacataaaaagaggattctctctgtttgattatttttttttcccatcatcaaccatgatctgactaatttttttttgaaattcattggctcgactaatattgccacgtcagtactgcaagacatcggcagtcataatgggttgattggcagatagataattccaagaattggtcacgttgaacccatcaagcataatgtcattttgtgcaaaattgaagctataaggctcattgtggtccatgacaagtccattacaattgttgtatgcatccaaaactgcaatgatttcattaagtgactcaagcctacggctaagttcattaattgagctctccatattgaattttcagctcaacatgagataatgttgtgtgtaacattcata

SEQ ID NO: 9252 - DNA, 683 bp, Solanum tuberosum
  Predicted polypeptide sequence is orthologous to G748
tgtgcctagtccatggagtcttccttggttaactccaccatcgccaaccgcaaaccaaaaaggatcaagctctgctcctaattcgcctttagggaagcactcaagggacggtgaattgcttaaaccaaacaatcccgagggtcaaaagaactcagaggggtctgttttagtgccaaaaacattgcggatagatgatcctgatgaagctgcaaagagttctatatggtccacactgggaatcaagtacgactccgttagcaggggagggcttttcaaggccttgcaaccgaaaagcagtgaaaaggatcaccctgccactacatccccggctttgcaggctaatcctgcagccttctctaggtccctcagcttccaggagagagtctaaagtgagcaattgtctccttcagctctgaggtacatagttgttaaccaacttatcttccggaagatggatgttggtctgagaatcttaagatgcctcaagtgctccaactgaaactgggaaagctattgttcaaattagtgtttatccttcccttgtaacatatttttgcttggtcagtgtgtgttttccatgtacataaactttatacagctgacagtagaaagtggaagagagaaacgtttagatgtatatcatgtacctgtcaaagttttagtctggaaggcggcttagcttc

SEQ ID NO: 9253 - DNA, 782 bp, Solanum tuberosum
  misc_feature (638)..(638): n is a, c, g, or t
  Predicted polypeptide sequence is orthologous to G748
agtgaaatcttccaagactgaggatgatcagaatgatgcatcgaattcgcagcagaaaacactgaagaagccagataaaattctcccctggccctcgttgcaatagtatggatacgaaattctgttactacaataattacaacgtcaatcagcctcgtcatttctgcaagagttgccagagatattggactgctgggggtaccatgaggaatgtgcctgtgggagctggtcgtcgcaagaataagaactctgcttcgcattgtcgtcacatcatgatctctgaagcccttgaagctgcaagaattgatcctccgaccggatttcatcatccagtgttcaaacccaatggaactgtcctatcgtttggtcctgacttgccactgtgtgactctatggcctctgttttgaatcttgccgagaataagacaccaaatgggatccgaaatggtttttacagacgagaacacaagaatccttctggcataggtggagaaaatggggatgactgctctagtggatcttcagtcaccacttcaaattcatcggcgggatgggttaaaaaccgccccctgaggcagttatgcaaactataaatgcctttccatctccagttccttgtctcccagagagtaccttgngcctattccatacagctgcttgttcctttccctgccattacccctgctggatatcctatgccattctgcctcaccttattgaaattgaatgtgcctggtccatggagtcttcttggtaactccacatcgccaacaggaaccaaa

SEQ ID NO: 9254 - DNA, 899 bp, Solanum tuberosum
  misc_feature (667)..(667): n is a, c, g, or t
  Predicted polypeptide sequence is orthologous to G748
aggtggagatactggggatgagtgctatagggggtctaacatcccaactccaaatatgatggtggaagaaggtaaaggagagacccacaaggctgttatgcatggtataaatggcatcccatctcctgttccttgcctccatggagtaccttggccttttccatggaatgctgcagttcctatgtcggctatttgccccattcccttccctatgccattcttccctacaccttattggaattgcagtgtgcctccttggagtaatccttggctgagtccacctctgcgagcagcaaacgagaaaacatcaggttctgatcctacttcgcctttagggaagcattctagagaaggggatttgcttaagccaagcaatcctgggggcaaagaacaatcagaccaaaagtattcagaggggtctattttggtcccaaaaacattgcggattgatgatcctgatgaagctgctaagagttctatatggtcaacactcgggattaaatatgattctgctaacaggggagagtttttcaaggccttacaaccaaaaagcaatgacaagcacaacaaagccaatacatctccagtattgcatactaaccctgcagccttatctagatctatcaccttccaacaaagtgcctaaagatgatcctatgaatctccngtaggatgaaaaagtagcaaaggtaaggataatggctttttttctcccatttgagctccagcgggaaagtacttgatccactttcatgggaatttcctgccttgaatggaccacttacaagggcaaccagattcactttccagaggctgaagagggtaaaaatcctcttcaaggttgattcccactggaacacctggcggaaaaggcttatttgttagcaaaaccttattgt

SEQ ID NO: 9255 - DNA, 1088 bp, Solanum tuberosum
  Predicted polypeptide sequence is orthologous to G783
agatagctctcatctcgggaagaagattcagaagaaagttccaaaaagaattcacaaagctgagagagagaaaatgaagagagagcatctgaatgagctttttcttggtttggctgatgctcttgaactatctgagcagatgaatggaaaagcttctgtattgagtgaagctgctcgatttgtaaaggacatgctttctcagatcaagcatatgaggacagaaaatacaactttgctgtctgaatctcaatatcttagcgtggagaaaaaggagcttgaggatgaaaatagagctctagaggctgaaattagcaaactgcagactgaggtcaaagcaagggaagctgagactagtcttgacctaaatctagctcctcctgaaattcatcatacagagtttgcctcacaaactaactatatgagattgcctgcttcggagcacgcatttcagcagtcacagatgatgaaccctgtgtacgtctttcccttgagttctaatccccaggcttatccagcgcctgatgctgcagattccatggctatgcccacatctactgtgaagaaaccacagcccagataccccactccaaatgatgtatggccatcccaaatccttgaaaagaggcctcagttgttgcgacaggaggttcaagatggtgcataataatagtagtctagtagaaacgagacattcgttcatagggaatggcatgtataattagttaggtaatgtaggatttagacgatagcagcagcagcagattcgcaatactttggacttgcaagtctcattgttttaaccttttgtgtatttgatcgcattaaaaaaacaaaaaaacccgggggggcggtaccatctcgcctaatattattgtaaaacaggctacatggcggtgtttaaaactctgaaaggaaaacctggcttactattaagcttgaaattccctttccagggttataaagacccccacacgctcacaaagatgccatgtatagaacccttcggcaacgcggcgtttgtatcacacgcgacacattaacacaccgctttttttcattcacacgggcccacacaggcctgttatttc

SEQ ID NO: 9256 - DNA, 1007 bp, Solanum tuberosum
  Predicted polypeptide sequence is orthologous to G811
atcaaaaatgaattaaaatacattacaagtagctaatatagaatatagctcacataattataaatcatttattttttttactaaactaaaatccaccaccgaataatgaaaatggataaggcggtggactagcttcctccgtcgccgtattcctcctcctccaccacctccaccgccgccatagtcgtaaccgtaaaagttatccattggtggagccgtgaaaccgccgctctccgacgagccagttgacaatgtactagacatagtaggacaacttccgtaagcttcattagtcatcatcatcggccggccaccgatgacgactttttgccgactcatccacgccgtggacggcgtttccgacgacggcgaggattgatagaacgtatccttatcgaaattcgcgtcaggagatcgaatcgactgtatcgtacctggctcataagttatcattggccgacaacccagccacgccggcggtggcggagttcccgatgacggagaggactgacagatcgcatccttatcgaaattcgcgtcgggtgagtgaaatgacgatgttgcccctactgcatcttcactctttactgaagaccaactcgttgaattcgaaatcataagtctccttttcttctcacgatttgttaaacttagccttttggattctccttctccattaaaattctgggcaaaatctcaggatcatcaaacaacttttacacaaaaaaaagccatcaattgctgttggcctctttctcctgtaggctttctaaatctttcctaagttcatattctctccaactctcatgatctaagaacctttttgttccctgcttttaattcttggaacaatcttctggtaaaaatttctttcgtcttcaactcttcattcctggttcctgagaaccatgcaatttctagctggggcgttttcctccctatttttttccacacaaaatgcgtttttctcccaaaaacatttcttttggcattcccccttttggtca

SEQ ID NO: 9257 - DNA, 786 bp, Solanum tuberosum
  Predicted polypeptide sequence is orthologous to G812
gctaaaataactcaacttcttaactgcataaactaccttacccaaagagaaactttccatttccaaaatccaaaatccaaacttttttcttcctaaaaatacatatattttcccctgtttcttgatgatgaatcaattgtattctgttaaagaggagttcccggggtcaagttctggtgggggtgagcccccaccgttgacaccacaaccaatggaagggcttcatgacattggtccaccaccattccttacaaagacatatgaaatggtggatgattcaactatagatcatgttgtttcttggaacagaggaggtcaaagcttcgtagtctgggatcctcatgccttttcgactacactacttcccagattcttcaaacacaacaatttctcgagctttgtcagacagctaaatacttatacgaattaagatctggtgatgttcctctgatgaatccttcaagttctggtggttggtataacctattaaaatattcatcgtgctgcggacccaaaaaaaaaaaaaagcactagtgtcaagaattgtttgctaagatggatcttggaaaaatttggaagatgatgatactaagctgcagatgggatttgattgttgcagggatttaaaaagattgatccagagagatgggaaattcgcaaacgaggcatttctaaaggggagttagcatcttctaagaacatcaagaggcgaaaaacgtctaattctcctacagagcaaggtctcggtccttgtgtcgaattgggatttgatggagagttgatcga

SEQ ID NO: 9258 - DNA, 534 bp, Solanum tuberosum
  misc_feature (502)..(502): n is a, c, g, or t
  Predicted polypeptide sequence is orthologous to G869
gggttgtgatatatgtcggcaaatttctgtttggctgtgattagagctccattgaagctctgggtatctgtttcttcagtgatatttggtctttgcatgcaacaaatcctctgctgtgatcatcagcagcagggtactactctgtttttcacgactgtttcgatgcgtttgaggcccaaaaggacttgttctggtgttgtttgctttggtggatttcatataaaccgatttttacatcctattttgctcttgagacggccgattacttcattttttttgctgagtttttcaaattaaattcaaatttgtttctgtttccttttgataaaccaattttctgggcatagtttgaggggttttgaagatttgaagaaatcatgaaaatgtttgagtctcagagacaatttcagaaatcgaaggttagggaagaattagcccgacccatgaggaaaatccggatcgtttgtgacgacccggaagctactgattcttctgatgatgnaagggttgatgtatcgaaacccaaacgatttg

SEQ ID NO: 9259 - DNA, 304 bp, Solanum tuberosum
  misc_feature (147)..(147): n is a, c, g, or t
  Predicted polypeptide sequence is orthologous to G869
ggcttaggaagaaatgctgcgcgtactgcgttaccttcataactagtgtgccgttggcattttgggtatttagaatcccttctttttgacctttttattgtttatatatgaagcacacactggttttagagcttaagttattcaatntggtttaccatttgtttcttccccaaaagtcttactttgtacaaaggttgtgattcttttggcaagaaggtaaaaggattcctaactgaaatttggccaagctggttaagtaaatcccattttggaagaaaattgggtttggctttaaaaaaaaaaa

SEQ ID NO: 9260 - DNA, 717 bp, Solanum tuberosum
  Predicted polypeptide sequence is orthologous to G881
gtgacaagagataacccttctccaagagcctattttaagtgttcatttgcacctacatgcccagtcaagaaaaaggtacaaagaagtgttaaagatgcatcaattttagtagctacatatgaaggggagcacaaccatcctcaaccatctcaagctgaagtgtcattagtcaatacaacagatccaacatttttgaacaaatttatggaaaacatcaacacaaattcactgcaacaacaatatttagtcgaacaaatggcgtcttcgttgtccaagaatcctagttttgcagctacagttgctacagccatctcaggattacttttttgaatatgatgatttacctttcaaataacacaaaattattgtttgttgagaggataaaatggtccttatgtagcttttagttagttgctcatgagatttagttagataatgtattggtgtagcgaaacaccaagcggtatatattttctatttgctctctcaatctttaaaaaaaaaaaaaaaaaactcagactagttctctcaaaccttgggcgtgagcctgggcggagcggccgtcggtgcagatcttggtggtagtagcaaatattcaaatgagaactttgaaggccgaagagggctctcctctcctcttttttcaaatctcgatcgattgaattcaagatcaatgtatataagttaaactctgacatattcacgtaccttatttta

SEQ ID NO: 9261 - DNA, 777 bp, Solanum tuberosum
  Predicted polypeptide sequence is orthologous to G881
gattttgaggagaaaaaaaagtgtttgtttcttaactcaacacacctgaagaaagactacaactttgctgattcttggaattttcatacatcaaagaagaaattaatatctatggaatttaccagtttggttgatacttcattggatttgagctttaggcttcgtcctgttcttgaaaaagttccgaaacaagaagtgcagagtgatttcactggattgagcagagacatagaaagagagaatatgggggtgaaaaatgaggcaggggatttgttagaggaactaaacagagtgagcagtgaaaacaagaagttaacagagatgcttactgtagtttgtgaaaattacaatgctttaagaaaccaaatgatggagtatatgagcacacaaaatggtgtagcagaagatagtagtgcagggtcaaggaaaagaaaagctgaaagtatctccaatatctctaatcctgtaaacaacaacaacaataataataacaatatggatgttgttcatggacgttcatcagaaagcagctcaagtgatgaagagtcttgttgcaagaaactcagagaggagcacattaaagcgaaagttacaattgtttctatgaagactgatgcatctgatacctctcttattgtaaaggatggttatcagtggaggaagtatggtcagaaagtaaccagagacaatccttgtccaagagcttacttcagatgctcatttgcacctggttgcccctgtcagaagaaggttcagagaagcatagaagatcagtct

SEQ ID NO: 9262 - DNA, 936 bp, Solanum tuberosum
  Predicted polypeptide sequence is orthologous to G896
gattatagttcatctcttccttcttcctttaaaccttcatccacttcatttcaataaacttcctctaatttctttgttggaacataatccagatctgagagttattactctttttttacctcataaaattagttttttctcttgatgaaacctgctttcaatattaactatcatctcttttgctcctttttatgattgggtcacaaaattgaagatactaaacaggtttaacagaagacaaaaccacaagctggtttcattgatggctcgcatgcgaggcggcgcagccgggggtgatgcacccgggcctgcagacagagccccagcttggggtagacgccgaccccgagatcgaggtagggccgcagcaccggtccgagatagggaggaggagtcccaggcagcatatgtacctccacagccagtggggccaggatcagcccagccactacccgcactagctgcagctcctgaccttcataccctgctgactcagatattagatgttattggtgagatgcgtcaggcaccagcaccagttccaactcctgctccagcgccgcagggtcagcttgtcgtagcggcaccagaggttcagccgccaccagttcatgtgaccgccctgccagacttaaaggacagggagatgccactgcacgagcaaaagatgctcgaggtattccagaggttggaacagccgatattctcaggggcgattggggaagatgcctacgagttccagctcacttgccaggagcagttacagtcattaggcctcttggagtcgagaggagccgacttcaccgctcatcagttccgtgggctagccaggcagtggtggcacacgtatcgagagtccaggtcagttggatcgcctcctatatcttggagtgagttctcagaggctttcttggcccggttcatgccacggagcgt

SEQ ID NO: 9263 - DNA, 1031 bp, Solanum tuberosum
  Predicted polypeptide sequence is orthologous to G896
ctccctttaacctaaaccccattctccatattcctcaattccaaaaaattctttgtacccttaccccaattttcttgagccatagatcaaccatgatgatgctggtaaactgttccaattgtcataccccattacagctaccaccaggtgcaagatccattcgttgtgcgatttgtcaggcagtaacacagttggctgacccgcgtgctgttcctccaccaccacataatcaataccagcacccaccaccgtcttcctctgccgccgccgcacctccgtccccttacaaccacgcacctcctggcccaccacccaatgctcatggaagaaagaaagctgtgattgttggtgtatcgtataagtattctaggcatgaactgaaaggatgccttaatgatgctaaatgtatgaaatatctcttgatcaacaagtttcattttccagaggcgtctattcttatgcttactgaagaggaaaccgatccatatagaactccgactaaacagaacatgcgcatggcattgtattggcttgtacagggatgccaatcgggagactcgctactctttcattattctggtcatggctcaagacaaaggaattacaatggagatgaagtggatggatatgatgaaactttatgtcccctagattttgaaactcagggtatgattgttgatgatgaaatcaatgcaacaattgtcaggcctcttcctcaaggagtaaaacttcatgccataatagatgcttgccacagcggaactgttttagaccttccattcctttgtagaatgagcaggagcggacaatatgtatgggaagaccatcgtccccgttctggtgtctggaaaggaaactaatggtggtgaagttttctcttttagtggttgtgatgatgatcaaacttcagctgatacatctgctctttcaaaaataacttcaactggtgctatgactttctgtttcatttcagctattgagcgtggtcatggtgcacatatggaagtatattgacggcaatgcgaaatgct

SEQ ID NO: 9264 - DNA, 425 bp, Solanum tuberosum
  Predicted polypeptide sequence is orthologous to G896
ctgtcggctagcagcggctctcagggaaggcctggtctccaccctcccagcctagcctcgcggaccctcgtcctccccacatcggacctgctcacctgcctggaccctgggctgccagatgcaggaagcatcaaaccccccagcctcgtgggtgcggggcagggcgcaggcagcacagcttagatgccctggtttgtccctcttgtctcctgggaagagcttgctcccgcccagctctcctgccactggcctttcagggttgggctgggcccagagtgccttttagtcgcttctcacggtggcctgatggctcaacccagtcccaaacgggcccagtgacactgccgactgcaccccagctcaggcccccactgcaccagcaatgctagaaaaccaagccaataaaagtgatttcttttttcatt

SEQ ID NO: 9265 - DNA, 947 bp, Solanum tuberosum
  Predicted polypeptide sequence is orthologous to G896
caatggacagcaggagatgcaaatgccagtggtgcggcatgaagatagcagctcacattgggagcacaaacaattacctgtccaaggtgccaatctgttacacaactccaacctgcaagaaactatggctttgctaatttccccactgccaataacaatatgagtccgggatttccatcttttccatcgaggccaggaaggatgagtccaaatgctaataattttcagcctcaacaattcaaccctatgtcaccacagattaataatatccgtcctcctgcagtacatggacgaaaacgagcagttctgtgcggaattacttaccgtggccatccaaagagtctgaagggaagcattaatgatgttttatccatgagatattttctggttgagaagttggggttcccaaatgcatcagtggttgtccttactgaggatgagaaagatccatacaaatacccaaccaaggccaatatcagatcagccctacgttggcttgttcaaggctgtcagccaggagattcactagtgttccactactctggccatggcacacgagtacgagaccatgatggtgatgagattgatgggcacgacgaatcactatgccctgttgattttgagacagaagggaggatactagatgatgagatcaataataccattgttaggcccttaccccgtggagccacacttcatggaataattgatacatgcttcagtggaactttcctagatttgccctttttgtgcagaataaacagggcaggatactttatgtgggaggaccatcggatccgctcatacaaaggtactaatggtggaatagcaatctctatcagtgcctgtgacgaccatcaaaactctggagatacaacggctttcacaggctttccaacaggtgccctgacttatagtttcatccaaacattggagcaagagactaa

SEQ ID NO: 9266 - DNA, 484 bp, Solanum tuberosum
  Predicted polypeptide sequence is orthologous to G896
cccacttaaagaacaagtatcaaaaaggttggttgatcaataacctgtttattctgcacaaaaagggcaaatctaaaaagttccactgaagcatgtatcaattattccatgaagtatggctccagggggtaaaggccttacaatggtactattgatctcatcatctagtatccttccttctgtttcataatcaacagggcataatgattcatcatgaccatcaatctcatcaccatcacggtctcgtactcgtgccccatggccagagtagtggaacactagtgaatctcctgaccgacaaccatgaacaagccaacgtaaggctgatctgatgttagccttggttgggtatttgtatggatctttctcatcctctgcaaaaaaaaattgtgtattacatgttagaaatcggactgttagtgctcaaatatataccttgactgttttcattagtgcaagaagattacaataaaaaaaaaaaagt

SEQ ID NO: 9267 - DNA, 784 bp, Solanum tuberosum
  Predicted polypeptide sequence is orthologous to G921
tcaggatcagaacagcgatggatcgaagaaaagaaaagttgaaaacaataataatgaaattgtgaaatcgtcagttcaagtgttgaattcagagagcagttcaagtgatgaagattcatctccaaagaaaccaagagaagaacacattaaaactaagacttctagagtttatatgagaactgaaccatctgatacttctcttatagtgaaagatggatatcaatggaggaaatatggacagaaagtaacaagagacaacccatctccaagagcttatttcaagtgctcttttgctcctacctgccccgttaaaaaaaaggttcaaagaagcgtggaagaccaatcgattctagtagcaacatatgaaggagaacacaaccattctaaagtggatactgttacaacaacttccccttctagccgtttcaacccgaaaaacaatgtttcgggtaattatactgcttcagtaatgccaagttccactactaatatcatcaacacatcaggaccaaaaccaatgttaactcttgatttggctgaaccaaaaacattacaaaatgatgtcaaaaaagtgaacagcaatacaagtacaagtggtcacaagcgtacatcaccaggaaatgatcatcaacaacaccaaaatagaccagagtttccacatttcttgatagaacaaatggcttcatcattgactaaagatccaagttttcaagcagccttagccgccgccatatcggggaaattcttaccaaataataaatacactaggggataatggatggga

SEQ ID NO: 9268 - DNA, 829 bp, Solanum tuberosum
  misc_feature (21)..(22): n is a, c, g, or t
  Predicted polypeptide sequence is orthologous to G937
ggccccccccaatggttgaanntttttccatacgtagttaggcactgctctttcatttctcaagtgttgggacgtaaattcaagttccttatactgaaacaacaaataactagaacacggttcgaaatgcacagacaaaaaaagaaaaggagatctaatcctgcaaaatttcacatctctctcaagatttatatataagtataatatagggtatcgatttatggtaattaatttctccaatgtatcttatctgcaaaatccatggtggagatctatacatcaatctttccagaggtgagaacatggtttttccagctgtgattctcggattttacatcatcttcttcttccatgctatcacccacagtcgtggaagtacctccgcaactaccagccaagtgtagaggaccctgaggggaaccagattgtgaactgctctgctttgaggattccccatattggccttgggacatccataaatttcctagagccacaccagactgatttgctggttgagtctgtgaatttggaactcttcgtgtatgaagcctgtatttctgcaaatgactctttacttcatcattggttaggccatccacttgcataaggtctctaatctgcttaggagttgcaacttgtgaacccccaagttgttgtagtgcatcaacaaatcgcctatgcaattctggtgaccagcatcttctttgctttcctggaagactgctgctgaccagtgatccatcccttatatttgattggcaacctgctacaactagaataatccacctcttgctaccattgtgtttcgaattcaaaccactattcacag

SEQ ID NO: 9269 - DNA, 935 bp, Solanum tuberosum
  Predicted polypeptide sequence is orthologous to G938
gatctgataaccagattcccgggagggttgaggaatcgagtgtgatagtttccactccccacactttacaggagctgcaggatacaactctaggatcccttttgtctgctttgatgcagcactgtgatcctccacagaggcggtttccgttggagaaaggggtatctccaccctggtggccctgtggtaaagaggactggtggggtcagttgggtctgccaaatgatcaagttcaacctccatacaagaagcctcatgatctgaagaaggcctggaaggttggtgttctaacggcggtaatcaaacacatctctcccgacattgctaagattcgcaagcttgttcgtcagtcaaagtgcttgcaggataagatgacagctaaggagagtgcaacttggcttgctattatcaatcaagaagaggctttggctcgtaagctgtatcctgatagctatccacatggatctttagctattggtaatggttcctttttcatcagcgatgctagcgattacgatgtggaaggagtggatgacgagagaaacaatgaagtggaatgtaaaccccatgacatcaatctccaaactggaattatgttacctaaagataggatcttgatgccaggtttagctccagtgaaaggagaaattatcgatttaacttgtgattttatccaaaagaggaagcaaccatgttttgaggagtctgttgatcaaaagatatatacttgtgagtaccttcactgcccatacagcaattatcaagctggattccttgacaggacttcaagaaataaccacccaatgagttgtccattccggttcaattctgctcaaacacttagtacacctaagtatcagatcaactatgagcacaacacagttttttcctgcacaaactgctccttctaagccagcggtctcgtcagtcactgc

SEQ ID NO: 9270 - DNA, 898 bp, Solanum tuberosum
  Predicted polypeptide sequence is orthologous to G938
attattctctaagctgagttccagttgaaacacaagttttgcaacaacaacaaaaaaagtgatctttttcaggctcatgtaatctgatcaacttcaattagattctgatctgaatattggattttgggtattagctgcttaatcctgcttggatcctgtggaagttgcaagtaacttcacttttttcatcttgttaagatgatgatgtttgaggaaatggggttctgtggggatcttgatttctttcctgctccgctgaaggaagtggaagtggaagtggctgctccacagagtcagactgagccggattctgtggttgatgatgattatagtgatgaggaggagattgatgtggatgagctggagaggaggatgtggagggacaagatgaagttgaaaaggctgaaagaaatgagtaaaagtaaggaaggtgtcgatcctgcaaaacaacgtcagtcgcaggagcaggcgaggaggaagaagatgtcaagggcacaggatgggatcttgaagtacatgttgaaaatgatggaagtatgtaaagctcagggttttgtttatgggatcattcccgaaaaaggcaagccggttagtggggcatctgataatcttagggagtggtggaaggataaagtgaggtttgatcgaaatggtcctgcagcaatagccaaataccaagctgatcatgccatctctggcatgaacgaggggtctaatccagttggtccaacccctcacaccttgcaggagctgcaagataccacccttggttcgttattatcagctttgatgcagcactgtgatcctcctcagagaagatttccattgggagaaaggtgttccaccaccatggtggcccacaggacaggaggattggtggcctcaattgggtttgcag

SEQ ID NO: 9271 - DNA, 730 bp, Solanum tuberosum
  Predicted polypeptide sequence is orthologous to G938
gaagcagaagaacaagcaaaccactgatcaagctcggcggaaaaagatgtcaagtgctcaggatgggattttgaagtacatgttgaaactcatggaggtctgcaaggctcgaggatttgtttatggcattatacctgagaagggtaaaccagtgagtggttcatctgataacataagagcttggtggaaggagaaggtgaaatttgataagaatggtcctgctgcaatagccaagtatgaagcagaatgtcatgcaaaaggagagggaatcggcaaccaaaatgggaacccacaaagtgttctgcaggacttgcaagatgcaaccttgaggtcccttttgtcttctttaatgcaacattgtgatccacctcagcggaagtacccattggagaaaggtgtctcaccaccctggtggccatcagggaatgacgaatggtgggtgaaaatgggtctgcctaagggtcagaaaccaccgtataagaagccacatgatgtacagaaaatgtttaaagttggtgttctaactgctgttataaagcatatgtcacctgatattgcaagatcacgagattagtgcggcagtccaagtgtttacaggataagatgactggcaagggagagctcaatatggttagctgttttaagcagagagggatccactatcccggctacaaaccagtgacaatgggtcatctagcatacgtgaggcacctattagaggtcatggtga

SEQ ID NO: 9272 - DNA, 1083 bp, Solanum tuberosum
  Predicted polypeptide sequence is orthologous to G938
ctcacactctgcaggagcttcaagataccacccttggctctttactgtcagctttaatgcaacattgtgatcctcctcagaggcgatttccattggaaaaaggtgtttcacctccatggtggccaaatggacaggaggattggtggcctcaattgggactgccaaatgatcaaggtcctccaccttataagaagcctcatgatctgaagaaggcttggaaggttggtgtcctcacagcggtgatcaagcacatctcccctgatattgctaagattcgcaagctggtaaggcaatcgaagtgcttgcaggacaagatgacagcgaaggaaagtgcaacttggcttgccatcatcaatcaggaggaagttttggctcgtgaactttatcctgatcgctgtccacctttgtcctcaggtggtggtagtggaaccttcactatgaatgacagcagtgagtatgatgttgaaggtgctattgatgaccctatctttgatattcaagagcaaaagccaaaccatctcagtttgctgaatgtcagtgttgagatgttcaaggagaagctgcctctgctacaacagtctcaggccaatgaagggtgacatttttgccaacttagatttcactcgcaagaggaagccggctgatgacttgacttttctggatggatccgaagatatatactttgtgagtgtcttccaatgtcctcatagttagcttcgcaatggttttccagacagatccagcagagaccaatcatcatttaacttgccttttcagaatacctcccaatttggagttccaaactttcccgttgaagaacttcaacccatctgtctttccctcaacagttattctccagccaaagcaagctcgcttcccgttcaaaccagttcaaccctcctttgatacatcctgaacctgcgggttcccgccagatagccacaggtaaccaatgacctatttccttcctatgaacgtatgttcccggaaccaaactccaatgcgggaagttttgattccaaagagtctcttacaaactcttttacacaaaatcttttttttccaaaccccttcaaactctct

SEQ ID NO: 9273 - DNA, 846 bp, Solanum tuberosum
  Predicted polypeptide sequence is orthologous to G938
gatcgctgtccacctttgtcgtcagctggtggtagtggaactttcactgtgaatgacagcagtgagtatgatgttgatggtgctcaagatgagtgtaactttgatgttcaagagcaaaaaccacaccatctcaatttgttgaatgccactgttgagagattcaacgagaggctgcctctgcaacaacagtctcatccaatcaaggatgaaatgattaccaacttagatttcacccggaagaggaagcaatccaatgaacagactgttaccatggctcagatttatacgtgtgagattcttcaatgtccttacagtgaacttcgccacggttttcaggacagatctgcgagagacaatcatcaactggcttgccctttcagaaatacttctcaatttggagtttcaaagtttcccatgaacgaagtcaagccagttgtcttccctcaacaatatgtcccgtcaagttcagttgctctgcctgttaatccaagtccacctccctttggtctatttggagtaggagttcctgaagatgggcaaaggatgattgatgaccttatgtcattctatgactgtaatatacaaggaaacaaaagccaaaatacggagaatgttgcaggtgaccaaagagcagcagtttcatcaacaaacctcggtgttggaccaggtcaaatttaccttacaacagtcgagggatgatggaggcggaaatatctttcacaacgatattcactgtttcccgcaagtcaaagttctatggcacccgacaaaagcaatccctgttgatcaattgcaaggatcccttaattccacgtgacatttgcatttcttggtttggggcctccg

SEQ ID NO: 9274 - DNA, 633 bp, Solanum tuberosum
  Predicted polypeptide sequence is orthologous to G963
ctcactttccactttctcctcttccttacttcttcttctctgcacgctgcttgagaatgttctccatggtgttcttcaatgctgactttttgttccttcttctttgggtattcaacatccttcacgaattggtgatgaagagtgctgagatctttagctctcaaaggtgtaattttcggtatgatttcttgtcgagctcaatagagagcgtgagccttgcattcagctttgaatttccgtttgcagccgaataggagtgactcaaggaactcccgtgcttcttcacctcgatttctctgttggatgctcgttttggattcagatacaactcctagactctcaccttttgctagtccatgtaccactgtttgctggctgaaatagcttaggattagttcctttacagcttttttgttccagaagtagatagcatctaaattgtacatatcatagctgtggaaccctgtaacttctatgttgtatctaagcatgatgaccattgttgttgctgtaaattctccttgtttttatcctgactgaagggacctgatgtttatcaatgttaagaatatgtttaccttgccttggtaaaaaaaaaaaaaaaaaaaaaaaaagaaaaaaaaaaaaaaaaaa

SEQ ID NO: 9275 - DNA, 909 bp, Solanum tuberosum
  Predicted polypeptide sequence is orthologous to G976
cttcaacatacatgtataaaccatgcctctctcaatgtacgtggtgggatctcaattgagttataagaaagaaattaaattccatggattcatttgttttaatagctccatagattttctgcatcagaatgtcccggtgaatcatcggaccgcggcaagctcattcttggagggctcaccatcattgcctccgccatgtcaactagcaaattaggcatatcaaataatgcttcttcatcaatgtattcatgatccctagtttccatcatatgcacactccccgacgattgatgatcatccgtacctgatacagagaagagacagattcaaaatttaaactgtactgttgaattttcatgattcttcaatactacaattattctacttttgaaatactgaattcagtatcagagacgaattcagaatttaaattttactattagagtttttaagaatcatttatataaggttatctttatatatatccttttcgaattcatattgatagtgtaaaaattgtttacattgtcaatatatataaatttaagtctatatgcatttttgtatcgaaaatactgaattcagatgattgtatcacaaaaaaggtgaatatatttacctggttgagttcccgaggtggtttctccggtttcaatcttcatcagggcggcggcggtggcggcagcttttcgtatatccgcggcggcgggtgaaggaggaagtgaaggatacgaattaatattaccaggaaagttaattacggcgtcgtctccttttaaagccattgcagcgacgtcgtatgcagcagcagccatttcgggtgtagggtaagtacctaaccatattctcgtagtcttacgtggctctcgaatttcggacacccatttcccactcctacatcgtattccg

SEQ ID NO: 9276 - DNA, 897 bp, Solanum tuberosum
  Predicted polypeptide sequence is orthologous to G993
cttcctaattttccttttctcatcaaacaaatcaacacacacacacaacaaaaaaagtttaaaaaaatggaaggaagtattagtagcatagatcaagagagtactactagtgactctctctccattgctccggcagcatcgtcgtcaacgatgataaaatcgttgacgacgataaaaccgccgccggagagcggcctttgccggatggggagtggtacgagtgtgataattgatgctgaaaatggtgttgaagctgaatcaagaaaactcccatcttcaaggtacaaaggtgtggtcccacaaccaaatggtcgttggggcgcacaaatctatgaaaagcatcaaagggtttggttaggcacatttaacgaggaaaatgaagccgctagggcttacgacgtcgcggcccagagattcaggggccgcgacgctgtaacaaatttcaaacccttgcttgagaatcaagaaagcgatgacatggaaatcgctttcttgaattcgcattccaaggcggagattgttgacatgctacgtaaacatacgtacctcgatgagcttgaacaaagtaagagattatttggatttactaaagatggtatgataaacagaaaaaatggacaaataattagttcgatttttggtagtacaaatgataaagtcaattgcaaagcgcgtgaacagctatttgaaaaggctgttacaccaagtgacgttggaaagcttaataggcttgtgataccaaaacaacatgctgaaaaacattttccattacaaaatggaaataattcgaaaggggttttgttgaatttcgaagatttgaatggtaaagtttggagatttaggtattcgtattggaatagtagtcaaagttatgttttaacaaaaggatggagtcgt

SEQ ID NO: 9277 - DNA, 721 bp, Physcomitrella patens
  Predicted polypeptide sequence is orthologous to G1006, G22, G28
tgatcccgatcacaattcacgagtgaagattaatcaatggaggtttcaaggtaataaatgatgtgcgagaaggagcagacgccccgaaaattccatgttgtagcattctcagctgttgtacacactccaatggcgttgtaatctatcgatacattgatgatgcctaaaccagcggttcctctacgaagctttgtgagagttgaaaggggataatgatcgtccccgctctatgtaccgaaacaccactctccatgaaccaagagcttttcgtgaagaactctacagtattctgcacaaaaattgcaacaggagagccatgatccttccttagaccagcagctcatccttcacacgcggccgcttaagctcatagctttctgcggaggccacagcgctaggcctcttgttgctcgatgcgatcgcaatcttcgtaagactgtggatacatctttgcttttgagaattcttcgccgcttgtcggcaagatgaggacgacagcggagggcgaggcagtgattcagggttggacagagcggtggtggctttgagtgggaagtttaagagagcgcgtgagcctcgcatattaagagctgctcgatcgtaagccaatgctgcttgctctgcagtatcaaaggttccaagccatacccgtgcaccgttcttggctgaatctcgaatttcggctgcgaatttcccccaaggccgctgtcttactcccctg

SEQ ID NO: 9278 - DNA, 655 bp, Physcomitrella patens
  Predicted polypeptide sequence is orthologous to G1006, G22, G28
tattgtacaatatcccgaggaagtgctatctcgcgcttcctacacaaagatttgtaaaaattggagggtctctggaagcaatggcttcgaggcgctcaagattcctagtaagttcgctaacagtaccaaatgcggtggccttttagaggaatatgacctagagcttctcattcttcgcatcgatcacgcctatttgtggtaatttagattcttccatgctctccgtgatgatctgctgcgcgagcgtcgtcctgctcgattcgataggtttctcgatgcgagggtttctgcttccttgcctggcatatcgttcaagaaaggagcctagaagagaagaattctagaactgctgctgctgggatagaagtgatgctgaagcggccgaggatttcttggaagtgcgtgaggtggaggacgacacagggagggggtggcaatgactcagggttgggacagagcagttgtggccttgagggggaaattcaagagagcgcgagagcctcgcatgttgagtgctgctcggtcgtaagccaatgccgcttgctccgcactatcaaaagttcccagccatacccgggcaccatttttcgatgagtctcggatctcggctgcgaatttaccccatggcctttgcctgacgcctctgtaatgcggc

SEQ ID NO: 9279 - DNA, 725 bp, Physcomitrella patens
  misc_feature (70)..(70): n is a, c, g, or t
  misc_feature (200)..(200): n is a, c, g, or t
  misc_feature (454)..(454): n is a, c, g, or t
  Predicted polypeptide sequence is orthologous to G1006, G22, G28
tgcttgtttttactggcaccttagtgcaaatgtacatccggactgacggtcgatcgaactattgtacacnaaatccatctaaatgaaaaaagcactttgggagcaaactaatcataggggatgcagcccggacaacctaattgcctcatatctggatcgcgaagtcgaatcgacaatctggcagccgcaggaaaaatcangctgttgctaatttactttacaatgttcaaaaacctcctttgttttgtatcacacgtgatatcccaagaggaaacaaagaacttctcttgatgcatgcagctgctcaccatgggttttcgatccatccttcgcacatgatcacgcctcagctcgcaatctctttgctgtttcaagacgcacgctggagcagaatcgcttgttggatccagtcagtttcttgcagggcatttgtgagatgctttcgctggttggntgagttattctggatgcattgcggctggtggaggaaggctccggagcaggagggaaagactcggggttggacaaagcagtggttgccttgagggggaaattcaagagcgccttggagccacgcatctggagcgctgctcggtcatatgccaatgccgcaagctccgctgtatcgaaagtccccagccatatccttgagccgttcttcgaggaatctcgaatctctgcagcgaatttcccccatgggcgttgcctcacgcctctgtaatgtg

SEQ ID NO: 9280 - DNA, 550 bp, Physcomitrella patens
  Predicted polypeptide sequence is orthologous to G1033
gaccaccttccgcatacttcattttcatggagactttccggaaggagttcaaagcagcaaaccctgatgtgaaaggagtcactgcgagcgctaaagctggtggcgaaaagtggctcagcatgtcagaagaggagaaagcgccttacgttgctgaggcctctgttaggaaaggccaatatgagcaagccatgacagcctacaagaatggcaaagccttagagtcctccctgtagctgaaatggcagacgaagtccagttaacaaaaatgaccctgtggttttcggctttccaacgactaagatcaaatttaatgcatataaatcatctgcggttgaaggcttataggtacacagattcttgttgtttagttttgatatagaagcagatacggagatttttcaactccaatgttcattgagcacagtgcgtacatcagctctgttttcaggctgtgttgaactcttccacagtaaagtgtctctgaagctccttgaagatgtttaagccttttgctcggtaatattcaagttgaactatgtcacaagtctac

SEQ ID NO: 9281 - DNA, 770 bp, Physcomitrella patens
  Predicted polypeptide sequence is orthologous to G1062
atgtgaattagaactcttgaacagccatttagtctgatcacagaaggtgcaatagaaaactggtgagcatccatgcaagtagacaaactacatatataatgagagtactatccagaaagaaagtctagagcaccctcaacgaaacagaatgctactctttgctgctcattacatgcttacaaccgaatgcttgcaaatcacatcgttgaagcactgtcctaacaatttagatacccagttctgattctgatataagtatttttcgtttgttgactctccacttttctagagtttccatggagaagaaaacaactggattccaacaactcagtcacttgggatcattctcagaaagatcttgacggatggctcggaagatgagctcttttactgcctcctcttctgcttccaaaggtaggcactccgggccagcgtgtagcagcatggtctctttctagcatctccaggctgaaagctcggaaggaaacgttttcgcaacacatgatactgccttgcattacactgatgctcttcgagtcaagcgcggcaaggatgtcgatcaaaagccctggccggtttacacaagcaatgcacaactccaatctcccattgacgcgtttcacttccacctgtggatgctcataaagaacatggtttgtggaaccgatgtctgttgtttgccccccaacctgcgcatttggagggaacgcccctttacctttgcttgcagggttattctctcgactgctcggtaatattgattgcaagat

SEQ ID NO: 9282 - DNA, 468 bp, Physcomitrella patens
  misc_feature (324)..(324): n is a, c, g, or t
  Predicted polypeptide sequence is orthologous to G1067
cgtggagtgcagtttggccttcctttaataatatgcccttgtgcctctcggttgctgccttgtggtgttcgcatttgataagaaggggtctgatgttggtagtactcccgacgctggtgttctcgatggtagctcgcaatattagccagttgagcatgctcaatattttggttctattatcattgcctgcattctgctgtgtactgtaacgttatcattttgactgatagatttgaaaggaggcgtgttttgtccatgcacagctcacaaccctccgatttgagacagtgaaatgatctttcttatgttcaggtgatattgtanttcacctgactgagtgtagaaatcatgggcttttataagccttgacaagtccattaaagaattagtgataggttctcccaatctatccatatattctactactcaataaaagatgaccttgttccgaaaaaaaaaaaaaaaagt

SEQ ID NO: 9283 - DNA, 605 bp, Physcomitrella patens
  Predicted polypeptide sequence is orthologous to G1076
attgcgctgcctgctggctgttcaggttcggattgctctgtgggactatgttatacaagttttgtaatgcagtcgatgggttataagaggacaaatccggtgattgcattgtcggtgcagctgaagctactgtcacttgcagcatcggcggctcgtcctccgctagcggaagccgatcatacgttgcgcccgtgaacgacgtcgcaaccaccaaaactgggctggccgccatcaacgctcctacaacacacccacccaaaacttgccccgacgcccccgcaaaggaaattgtgagccccgttgtaagccctgctggaggagttggagacggtggaggcaaatacgacccagagagcgagatgatttcaaagcggccgtggatggtaacagtcgccccgggcgttgtagattgccgtagagtcacattcgtcacagtcccgcttccgcccatgacgcaaattcctctctgtcgccgacgagcgaagtctgcaacgctctcccaaacatcatgcccacttgcaacctccaggatgtggggtctcatggcattcccgttctccctggtgataataactggaggtttaggtttatttttggagccagga

SEQ ID NO: 9284 - DNA, 646 bp, Physcomitrella patens
  misc_feature (632)..(632): n is a, c, g, or t
  Predicted polypeptide sequence is orthologous to G1084
gtgatgtttgggagtctccaacgtttacatatgtaaaatgcctcctgatctaacaacttgtggtttaattggaagccttttggtgaacaagtgctcatgccaatgctgcagcgttgaacttccccgagatagttcacgtttggggaaagcctgatcgccacggacaaacttctataaggtcattactatcattggccaaaaatcttactcctgaaaatcccataacaccatccttggactcggcacttcgcattcatgcagacgcaatcctgtaggtgtcccagccaagggactattgaaactagtatgattcgcgttggtagcactgctcgagctagagtactgtccaccgtaccctggcaacgtctgctgggttgtcatgtccagaacagaaccaggggtgctagtcgatgacgttgtggatggcccactgaagttcctgtagccgaaactttctggcagaggtctctgttgattgtatccgagattgatcctcacatccaacttactcggcgctgatgttgactggggtctcgacaaatctgatccctgcatgtaggaaacttcagcgtggctttgagcgagctgattgtgcacttcggaactgaaccggctgagcggcagttgcgaancggcgcaactggga

SEQ ID NO: 9285 - DNA, 726 bp, Physcomitrella patens
  Predicted polypeptide sequence is orthologous to G1089
cgtctgccactgggtttggctttcaacctcctccccagcagcatcaacatcagcatcagcagcatcactctcagcacgtgcgggacggcgttcactcgtgcaacgaaaacgattccagtatggacatgcatgcggatagcgttgctgaggactattatcgctgacctcatctcagggaaggtcggcatgcactatcgggtatcaccaccggctttctgacatgatgtacaggcaattttcagagacggtggtttgctaattcagctcagtgttagctattttgtcctcacgaacgccttcttggtgtcatacagatgacatatgtttccgctaattatggctcctgaattgtgagtattggagatgtatcaactgcgagggttatcaagagcttgtgctggcagaaaagattgtaagaagtaggattggattgtgctcaaagggaaccattacactggtggttggtaggtggttcaaatgtgggtggcatgagctgccgccttgggcacttagcaggtagattgaactttaaataaaactaactagggtcaaccttgtatctgttgacctgggcttcaataatggagtcctgggaagtcgttgccaagtgttttgtagagcaatgtctcaaggaaacattccatctcaatggaacgattgtaacggaatgcgatcgctttacaggttgatattacctcatagagaattatagaggcattgtaatgg

SEQ ID NO: 9286 - DNA, 725 bp, Physcomitrella patens
  Predicted polypeptide sequence is orthologous to G1134, G2555
ttgatgaaagtttaactttcaaagattcaggaaacaatctccagggttgagacgacggaatgatatgcagtttgaataggctaagcagggggctcctctagaacccaacagctaatgcaagcctaccatgtggttttggcaaggtgaatacggttccataccaactacgagatagtttacagtgaggatgcactcgctaacagtgcaatgatcagttgaagtccgtgtgttcgtccgtcctctgtcggaattcaaagtctgggattcataagtggccttcaaaagatgacgacgacgacgacgacctagatgacggcgagtgatgttgatttccctcatccaagtcatacaggagctgcagacataaaagcacactgccaaacccacagaggctctgatgtgtatctccgctctacgaggaaggaaggtatgatgtcttcgaaaggacgcaaacaaatcccaaaaactgtaggctcagttatgccgtggagtggcaattgccaatgcccgctacgaagggttccaaggaattaaacgtccgcatgaatccactttcatggagcaaacttggtgtgttgcagaatcttcaactcgcggtttgtgctctaatgctgttcttcaaacgcacaattgtctccgaaagatccttcacttgagtttgtagatgctttacgtactcaaccgcttcgtcaagcatatctgctgtgtttgtttgcttgtccatg

SEQ ID NO: 9287 - DNA, 758 bp, Physcomitrella patens
  misc_feature (756)..(756): n is a, c, g, or t
  Predicted polypeptide sequence is orthologous to G1136
acagaaggaagaatgtatctgctcaccttcaaccccattgtacacccagctgacaatcgattaagagattcctgtgcctacattcgagttagaaaaactatgtttcctagataattaatttcctctaccaaggtgagtctagagctacaacctaatcaggctactgctgagaaatgactaaattttctacaatttccaattgcgacggtccagtatacacatccttatatacaccaaaaggacagtttttgggattagggaggattgcctagtttttgcaaagccgtgtcacttccttcccgcttcgtcaaatacccagtggcttgatcagacctttcaagtaacgcagcgagctgctcctgcgtgtacctttcagttggtttcatcttagcaacaacaatatgcaagatgtcatcacttgtggaggatgtattagaatgttgtatgtccaagcgcaattcttgcagggccatcatcatgttgacaacagagtaagcatctcgcacgcagttgactcgtatcattgcctcctctccgaagacgttcacggcaatgctgaacctcttaccaccaggaaatatgccaaacacaggccgagtgccattcctctcaggcttcagttgggtatcgtctttaggtgcaccaattacaagagcctcttggccacgctcgcgcttcgcactgcaaaccctctgaaggtcctttatgcgcatttctgcgtcatgaagtttctcctgcaggtagttgatgtgcgcnat

SEQ ID NO: 9288 - DNA, 431 bp, Physcomitrella patens
  Predicted polypeptide sequence is orthologous to G1146
atcatatagctctagttcttggggcatggggcgagaccttttgcagaagaatgaagaacggacaagtctaaacaaggatttgcccgaaagcgaacacaacccggacggacggggtcgaacaactgacccgacggtcgtcggatttcaccaggacgaagaccggcattgggtcgccgagctttcctgtggtcacacccagcacttgcgccaccagccgccctggcaatcccgggcctgggtcacagacccggcgcaacgccttgaaaaaatagacaagccctttacgtgcggctggtgtgcgcaaggctcagataaagataaccttggcacctgattcccggtaggcatccaggcataggccgccaccgaagccatgcacctccagagaattcgcatgcagactttttttatcgcgccaaaaaaaaaaaaaa

SEQ ID NO: 9289 - DNA, 549 bp, Physcomitrella patens
  Predicted polypeptide sequence is orthologous to G1146
gctttgtcacttcctttgcctccgagagcgttgctgcgctgctgttccttttctattgctgctctcacaggacgtgtggttcatcgttgcggagttggggaatgtgatatgaaggtatctgcggctccgacgcgttgttttggactaatttgttctgttttcatgctcttgcgctcggatccggggtgtgtaatgaagttcctgttgcggtttgcgacactatcgtgcctgtgtatagttcagtactgccggattggagtggcgtgtccatcagcttcggccctttgttgacgcggcgttttcggtcattagattgagaagaaggtttggcgccgtgttacaaggtagagagacggctggcattagtaacgtgaattgaagttgaagcaccagggaccttcccgagaatttcagtttgcctcttgaagaagtgtgggataggttggcgaacttcagttagtcaccttgtggagctgggaggtctgctttaaactggaaagccgaaggagaagtacgttagtcttaaagatgttgccatgtaccaagaat

SEQ ID NO: 9290 - DNA, 334 bp, Physcomitrella patens
  misc_feature (231)..(231): n is a, c, g, or t
  Predicted polypeptide sequence is orthologous to G1150
tttttttttttttttttttttttttatccaaataaataattgaatgtattaggttgagacacattcatgatttgaatggaccatgtcaatcttcctcgagcttattagaggatcacaaaactgactctttaattacattgtatggccgaattaaactattctccggcggcttgcaggatgaatcttttttttactgcatgcactttgttccaaacgctgtaatttgcgtcnggcccccaacctccccgcattgatttttaaacatttcaactgcctgcgtatccctcaagaaatataaaacattcctcccatgcctcccattcctcccattcca

SEQ ID NO: 9291 - DNA, 753 bp, Physcomitrella patens
  Predicted polypeptide sequence is orthologous to G1246
taatttcctattgatagtaataatttacacttctttacttgtagcagacaattggtgacacaacacagatctccatgatttagtcatggagtttttgactctacaggtgattacatctcatactcaattgcagccccagacaatgatttaggatatgtatccaaatgagtcgcgtggaccctttccgcacgctcactaagtgtttgaaggtaacgagtcctgttcaagaaccttactaatctgatctcaaagtattcttcgatacggctcgactccttgcaccgtaacaaccgaaaagcgagtactttcagcggaaagcctaaacggtaactccatgctcaagctgataaagtggatatccttgcaaacgcagcattccaaccaaccgctgagacatcaaagtaccttacaaagaacaaacatgtcctcccagagtatgtttagtgacaaaaatcactgaacctctcagcccgatccacacgagtcaagggcttcgttgagaatcgtctccagtacttccaaccacgcaactccgatcttgtgtgctcagttgtgtcactgagaaggccacgagcagcaaatcctaagcccaaaaacgagggagtatccacaaatcctcggacccttgacagaatagatggcttagatataggatcccagtcatccagttcaaaaaattcctccatctcagcctcagaaattttctgctctgaagtaatcaactctacgctcatattcgtttgttcctctgta

SEQ ID NO: 9292 - DNA, 405 bp, Physcomitrella patens
  Predicted polypeptide sequence is orthologous to G1326
gactctacggtagtttttgtatataggacgttgagatggtccgactggcggccgattttcagtgtaggggcacgctttccttgaagtgctatggatccagcaagggtggaaatggcttttggagtaggttttttaatttaattttaaatcatcatcaggggtctgtacttagaatgtaaagttcattggagagcgcaaattatcaagaccaagtgcacatgatggttgacggagattgtccaagctaggttgtgttcggtcaattgagttggctgacctatttccattatcagtaggcctaatgaagctccttcttgctgcgccattgagctacggagtggcattccaatcttctggaccgtgtggtatttagtattatcctgtggacttgatagcacggatgga

SEQ ID NO: 9293 - DNA, 748 bp, Physcomitrella patens
  Predicted polypeptide sequence is orthologous to G1335
tagctgtttatgcaattgctaacgcacaagtttatgcagcaattgttaaaactcgcttacaataatggtataagaaactcatggtgttttcatcattacgactattttgtgcaccaccgctactactcatagcatgcttgcaatgcaaatgcagccaaaacatcgaagtccacaacagtcgaagaactctcagctacacatttcctccacattctttaaaaaaactctatgcatagtggctgaaactccctactgctattcacactaaatactaccagctctggttgtaatttccgctgcgcccaccagatgagtatctacggtcatcataacttcctgcgccatagccgccaccttgggaagcaccatactgtgtagtatcgtcataagtgccaccaccaccataacctcctccatagccaccaccaccgtatgctccaccgtaactgctgccaccgccagcaccacgggagccatatcctcctacattagcaccttggggacactctcgagccatatgtccctcttggccacatgtgtagcatggcctgccaccgccaccgccaccaaagttgccaccatacgctcctgcacctccccgactgccaactgggttggggcattcacgagaaaaatgtccaacctctctacagttgtagcatccttcttgtcccttattgccacccttgactccaccccatgtatcaccgtatgagcttcctcttatgccgtcacgttcacgactccg

SEQ ID NO: 9294 - DNA, 563 bp, Physcomitrella patens
  misc_feature (495)..(495): n is a, c, g, or t
  misc_feature (516)..(517): n is a, c, g, or t
  misc_feature (539)..(539): n is a, c, g, or t
  misc_feature (542)..(542): n is a, c, g, or t
  Predicted polypeptide sequence is orthologous to G1341
gatgttcactttagagttgtaaattacatgatcctgggttactctatgccaagctaggccccagcagcacaacctcgaaggatttctaccatttgttctcctactttgctgcgcctgctgtcgcacatgcatgcgaaatcaggtgagagcgaagcattcactaaactgctctaccatcatgttgtctctctaacctactcctcaaatgggaaacgccgccaacttgctggtacacactcccaggtaggaaggtgcagttctacaagctacccacttcagagctaccaaaactttcctaccttaacttccacaccccagcgaaggtgctagagccaagaatagttcaacctagaatataacaccaacccccccgtccctccccactcccaccccttcctccttttttacccggaaccccattttctacacagtgcataggcttttgaacctccatatacaataaaaaaaaaaagtcgaccattataaaacgcccanttgaccaacccagtcccttgnnctgcttcaaaaggaaagtttcntcnccttgaggaaagtttcattac

SEQ ID NO: 9295 - DNA, 745 bp, Physcomitrella patens
  Predicted polypeptide sequence is orthologous to G1364, G481, G482, G485
tttctttttttccaaagattgtacagttcccgcactgggtcagcagcatgttgaaaaaaatgctgacaaattcctcactgcttgatcccttaactgacgctgtgctgactggagctcaaaaagccctccgatttttccgcagacagcatctaaaatgagcagctagggtagaactgtcaaaaccagaagtgcatccacgactaacttcctcttcttttccttatgctaactcaatcgtcacgtaaaactgaccgttccccataagctctctacacctaaaggactatgggtttctgggttactccctaatcttcatctacaaggagagtcgaatgcctttacacagatttacaactttcacccaggagctcccatcatcagttgctgcatcttgtcatttcaaagatgcagaaacagaagcctgtaatactaataatgttgaacctgtagttgccaggattcatcatctgcgcttgcatgtaagggttatagcctccttgctgcaccatctgaacgccaggagataccatgccacttccctccttcttgccagaagatgattcaccagccttgttcgtcagagcaccctcagtctctctgtacttgtgaaggtaaaccttcagcggctcgacgtagtcttcaaaccctaatgtgctcatggcccaaagtaaatcatctccattgatcgtctttctcttttcccgctgacacttgtcgctagcttcgctcgtgatgaaactgatga

SEQ ID NO: 9296 - DNA, 733 bp, Physcomitrella patens
  Predicted polypeptide sequence is orthologous to G1364, G481, G482, G485
actttgcttcagcacgcgcgcgttgtggtcgatctctcgctggagcaacagaaagccattcttacttctagcacttctcggaggttattgatttctcgcaaattgctcttccacctgccctctttcgtgagggagttcgaagctgaaaagtaatgagctgaagattaaggtcttttacgagtgaacagcgagcacacagctagcaactctttcggagaatactccaggcgaaattggtcggatggccgatagctacggtcacaacgcaggttcaccagagagcagcccgcattctgataacgagtccgggggtcattaccgagaccaggatgcttctgtacgggaacaggatcggttcctgcccatcgcgaacgtgagccgaatcatgaagaaggcgttgccgtctaatgcaaaaatttcgaaggacgcgaaagagactgtgcaggagtgtgtgtccgagttcatcagcttcatcactggtgaggcgtcagataagtgccagagggagaagagaaagacgatcaacggtgacgacttgctgtgggccatgagtacacttggtttcgaagattacgtggagcctctgaaggtttacctacacaaataccgggagctagagggagagaaggcttccacggccaagggtggtgaccagcaaggagggaaagaagggagtcaaggtgttatggggtccatgggtatgtcgggcggaatgaacggtatgaacggtacg

SEQ ID NO: 9297 - DNA, 1813 bp, Physcomitrella patens
  Predicted polypeptide sequence is orthologous to G140, G146
aaggaaggcagcactggaatggaataatgagtcgtcactggcaaggcagcactcttcctcctctatgtgaggtggttctccttgtcgtctgttgttagattcatcaggagcaggaggtggaggaggagggtatggcactcctctcacctcttgatttggacaggtcttctcgtgtgcgactccaaccagcttgccttcagattcctttgagtgatgccagagcggctctgttgggtttgcttgcttagcttaggtgcggattcgtaggacgagggggctggggaagttggctatggatgatgactacagcgtctggacaaccctccgatcaatggcagttcggggtggttgcaccctcgactgccacggcgacgcaagagttgtctgttggggagattctggacgaggattgtgaggtgccaacgtgtttgtcgctcgggatgtcgagcgggaagggtgattcgagcactgagtcgacacggcggaagggtggggttatgggtcgcggcaaaattgagatcaagaagattgagaatacaaccagcaggcaggtgacattctccaagaggcgcggtggtcttttgaagaaggcgcacgagcttgcggttctgtgtgatgccgaggtggcgctggttattttctccagcactggaaagcactttgagtttgccagttcaggcagcatgcgggacatcattgagcggtacaggaagagctcggatggtgcagtgaagcgtggcaccaatactgatttacttggtcgggaggtgattaagttaaaacagcaagtagaacgattggaaagctctcaaaggcatatgcttggtgaggatctttcagctttgaaggtatctgaccttttggagctggagcagcagcttgatcagggtgcttcacgagtgagagcaaggaagaatcaactcattttagaagagatcgaagacttgcggagaaaggagcatgaactgatgattgcaaacgaggctcttcgcaagaagattgcagacgctgaaggtgctgcggaagcagcagctcgagctaatttcccggatgctcggctagaaagccccaaaccgttcgccagcgatttctcacgagatatgagtgtgagttcgcagctggcagcatcagtctaccctcatcccaaccttctacaggcgcaaagatcacagacgtcattacagcttggatggctatctgagcaacagatccccagcacggaagaaggttgtgcaggtgaatctagcttgaaatgggatcatccgcactttcacattcagaatagactccatgcaaacatatcaccaagtgtgagaacttataagttacatgtcgatcgataagccacttcgaacgacagaaggctctttgggagcccaggctatgggtcctagcccctcgtcaccgccgttgcttctcaataatccagatgcactccagctgtagcctgtagttgtagagtgtccgaggtttgatgtgatcagtgtcactcatctagaagcatttagtgtggaccaaaatgacgccctgacgggtattagtttgctctggttggttggtcttcggacggcaagtgaaacactttgatacccttatgtattaactcgtatcggtggtgtgagcgttgatcgaaacccagtttcaccgtggcttaaatctgcttttaaacctcaattttggcagttgaattagcgattttgttacatagcatcaaaaagacgtaaggagtttaaaaaatatcctagtttcttgtgatgagttcatacgctttgtattgttatatgtatcgggtaaaattttttgacccttgccg

SEQ ID NO: 9298 - DNA, 1777 bp, Physcomitrella patens
  Predicted polypeptide sequence is orthologous to G140, G146
gttgtgagaagcagactcgtaaggtgtagagagcgggctatggacgatgactgcgtctggacaatcctgcaagcagtggcagttcggggctgtacccagtactgccacgcaagagtcatcgagtgagataattctgcacggcgattgtgaagtgccgacctacttgtcactaggcgtggcgtgcggcactggaggggattcgacctattcgacagagtcgcggtccaagggtcgggttatgggtcgggggaaaattgagattaagaagattgagaatactacgagcaggcaggtgacgttctccaagaggcgaggagggcttctgaagaaagcgcacgagcttgcggttctgtgcgatgcggaagtggcacttgttattttctccagcaccgggaagctctttgagtatgccagctcaggcagcattcgagacatcatcgaccggtacaagaagggctcggatggaatgcaaaatggcgccagaaatgatttcatgggttgtgaagtagtaaagttacgcgagcaattggagcaactaaaagcctctcacaggcacatgctcggtgaagatctgtcgctgcttaaggtgcctgatctattgcaactggagcaacaactagatttgggtgcctctcgagttcgagcaaggaaaaatcaacttatattggaagaggtcgagtcattgcggagaaaggagcacgagctgctaattgcaaatgaggaccttcgccagaagcttgcagatgctcaagggattgctgacgcagttacagctcgagcgaacgtgtctgaaagccctaggcccttgacgagcgctctcacacgagacatcgttatgagctcacagcagcaggaagtcactgtgcatcctcaccccaaccttcgagacgcacaaaggtcacagacgtctttacaactgggcatgttctcttctgagtcatacctcccaagctctagcagggggccatctgagcatccgattcccgttgggccagaaggttgtgcaggtgaatctgccatgagatgggagcaccctcactttcacagtcagaatagactccatgcaaacatatcaccaagtgtgagaatttagaaccattccacgtagattggctgatcattgtcctctacgtgacagtctacacgccgttatccatctcaggcttcctgaaggccctgctctgaagcatcacttcggcagtagattgatgattttggatagaaatagactggggcttctgtgaaattcctgattacttttttatcaaagtgacttcttccattggcacgtgtagttttaggtatttctcgttcggtagacaccttcaactgggtagtttttttggatgtcttgttgaattgtagtataacaactgtagtcagtttcattagcttgttctgaaacgatttgatgcttgcatcgagaaactcttgatcagtttcagttggtagcaaaaagattctcgtcaccaatttatgatcacttgaaggtcttgaacataggttttaagcagaaacatagacagtgttgtggaagttaaatgagtgtagagtatcctcggtaacgtaagcttttccaaccatatatattcagctgagaagcacgttatctgctggaactcgttaaccactcaatctataaattaacctaacacttgtgtgtctgaaaagcatccttcagctgcacttggaacaaaattgacatgaaagtggtgattgttatcacaagaatatatttattgattttttgttgaatcagttcttcataaaaaaaaaa

SEQ ID NO: 9299 - DNA, 1397 bp, Physcomitrella patens
  Predicted polypeptide sequence is orthologous to G140, G146
gtcgacacggcgaaagggtggggttatgggtcgcggtaaaattgagattaagaagattgagaataccacaagcaggcaggtgacattctccaagaggcgtggaggtctattgaagaaggcacacgaacttgcggttctgtgcgatgccgaggtggcgctggttattttctccagcactggaaagctcttcgagtatgccagctcgggcagcatgcgagacatcatcgagcgctataagaagagcccgaatggcgcaatgaagtctggcgccagcactgatttcctgggtcgcgaggtcgtgaagttacaggagcaagtggagcggttgaaaagctctcaaaggcgcatgcttggcgaggatctttctgcgcttaaggtgcctgacctgttgcagttggaacagcaactcgatctgggtgcatcaagagtgagagcaagaaagaatcaactcattctggaagagatcgagggattgcagaaaaaggaacaggaactgatggttgcaaatgaggatcttcgcaagaagattgcagatgcagaagcagtagcccgagctaatctatccgaggctcggcccgagagccctagacatttggctagaactctttcacgagacgtgagtgcgagttcgcatccggcagcaactgtgtaccctcatcctaaccttcgagacgtgcaaagatcacagacgtcgttacagctgggcatgttctcttctgagtcatatcccccaagctctagcagatggccatctgagcaacagttcccctctgcctccgaaggctgtgcaggtgaatcttccatgaaatgggaccatccgcactatcacattcagaatagactccatgcaaacattttaccaagtgtgagaatttaaaaagttacatttcgatcggtaagcctctccgaacgacagaaggcttttaaaagttggggttatgtgctctagcctatcgtctccggtgttgtttctcgtttacacagatgcactctagctcgaggttgtgactgtagagtgtccgagggttggatttgatcattgtcatgctctcagaagtacccagtgtggttgtagtaaaatcctgcaactgctggttgtctttgttttatttcgtttggtttgttttcggttttggggtatgaacctttttgggatttctctccgtttacggtggtaataagctttgatccaatcttcagtcttttcctgttttgaagctgctcctaagcttcaatttagagggtgactattatatatcaaaaccatacagtgatagtagggttctcagaatccgtcctcgtcccctattaaaagttttcaagtttgttatatggatcagctgtaatccttttgattcctgagaaaatacagtaatactttattggggaaaaaaaaa

SEQ ID NO: 9300 - DNA, 1698 bp, Physcomitrella patens
  Predicted polypeptide sequence is orthologous to G1480
ggcaccaggtgctgtgggaggaattctctggggatttcgaggccttgttgtatgttgttcagtaaagggagtagctttttccacttgaaggggctggtgctgctgttgttgcaagtcttttgacattgaaagaggcggggttgcacgccccggtgtgaggaagagtcttgtagtaggtgggttgtgttgtgccgtggtatagtatgccgaagccttgtgatgcatgccatgtttccagcgcggcggtgttctgccgagcggacgctgcctacctgtgcgtaggctgcgatgggaaggtccacggggccaacaaactagcgtctcgacacgagcgcgtgtggatgtgcgaagtgtgcgaggttgctccagccgtggtgacctgcaaggcggatgcggcttctctctgtgtggcctgtgacacagacatccactccgccaacccgctagcgcagcgtcacgagagagtgccggtgacacctctgttcgagagtgcgagtcctttgcgtgggccagatttctgcgtgttggtgtcagagaatgggtgccatgatctgctgaagggctgtgaggacgcctcggttgtggaagctgtctcgtggcttcttccgcaccctaagatctcgaccaactctattatcagaggcagcgctgcagccgacgagatgggttcgtcgcctttccacgaccggccctttagtcccaagcccaagaaacagaaggttgaattgcccgcggacatattctctgatgtggaccctttcctagacttggacgatgcaaccgttaccggaattcaacccgacagcttggtaccagtccatatgccagaatgctccgaggacacggattcgcttgctcactccatggacccttcgtttactaaatttcctctctcggcgaagagcggttacagctatggcacatctacccttactcagagcatttcttgttcgtctctagatgccgccgttgttccagactccagtctcagcgacatttccacaccctacctagactcacaaagctcccaagatatgtcagctcgcctgccacaccagactggaggtcccattgacaccgtcgaccgtgaagctcgcgtgttgcgctacaaggagaagaggcagaagcgcaagtttgagaaaacaattcgctatgcatcaaggaaggcatatgctgagagccggccgaggatcaaaggaaggttcgctaagagaactgattccgacatggagcagtttggctcagtggactcaagtttcggagtggttccaagtttttgagttttcttgtgtattggagtctccatcgagcaaggtcatctgaaatggaaagctgctgtgtaacatagaggagctgctgtaagaactgtgtagagccatccaagtggtgaagcacctgaaaaagtggcagcaatgtaaattgttcagactctcaatggtcaccagtaccaagtcatgccattctataatccctttcagaacacgattaaatgccttgtggacagtacaggatgtagtcagagttctagtagtggtttttttctatttttctttttgttgattgagagctttcggaacggtgagaacttcgtggcgcgaatcctctgtcctgcgatcgttatgatgcagcgaattcttccgatcttgatgtatttcaacacttccataatgctcttggatttttgggtcatttcctcag

SEQ ID NO: 9301 - DNA, 760 bp, Physcomitrella patens
  Predicted polypeptide sequence is orthologous to G1646, G715
gagtgttgctgtataactagatcaggtcaaaaactgtagattgggacacccggtacagtctgaaagataaaaccagggagacataaaagaaacaatggtactaagaaaatggatacccgatcctcgaacctaacattaagagcaactcctgcacatgctaataattatgcctgcactagtatcactattcacaaatttctaccagatccatggaggggtcgggtccctttgtgcccttcatgacttgctaaaccaaacataaactctgctagaattagcagtgctcagaactgtcgcatcaccgcctacagctacgatttccttaaaatatagttgaaagccaacacaaaagcgctgtagtgaaaggtaaaatcctgatcctgtgaccccttttgccataagaatgacagatggtagcaacagtatgataaataccattcccacgtgacgaaagaatctcgatgcgatagccctttccttgagttgtcccgtcttcgatgctcagcgttctctaggtggtaatgcattcactgttgctgctgctcggggacaaaggcagtctgtggaggctgatacatcatttgtgggtttggtggctgcccaaccatcatctcaggagcccccatagaatgatgcatttgctgtccagccatgggtggatagaatattcctccgtaaggtacagaaccatcccctggaacaccagtccatggcacacccaaatcttcttccttcaactcgtcacgtggaacgatgtcaa

SEQ ID NO: 9302 - DNA, 746 bp, Physcomitrella patens
  misc_feature (745)..(745): n is a, c, g, or t
  Predicted polypeptide sequence is orthologous to G1646, G715
aggcttttagagaacagattgaaaatagtatacagtttcagacgccacaaccagagcccgaacaatcaggccaagaaacattgacaaaccatgttcaaggaacttgcctgtcaatcaaagaccaaactactgaatgctctaagctgctttatcatcaaggagatccccaagcaatcacacatctgtgagtccttcacgtgcaaagcccattgctcaccagtctacatcgaccccagtctacatcgatccgtactttcacaaccctagaatacaatccaaccgcgccgctcacctgcaaacgccacaatcaaattcgtcaactatttggcggcatcccagcttgctgattaggtggcatttgagttggttgctgttgccacatctgctgcatcggagcttgctgctgcatgtactgcattgggggtcgctgcggctgcgactgcggctgcggttggtacatagccgtcgggtccatagccatggctggcctcacgcccatcatcgagttgcccatcatggcaggagagcctattgcggcttgcggaactgggccttgcggtgtctgtacgtaatacactccttcgtaactcacagggctaccaaccggcatggcacctcgagggacgccaagaccgtcttccttgttgagctcgtcacgcgggacgatatccaccaagaaagtcgaagatgtctgtgcgagtgatagcagctgcaatgtcgttcttctgcaaagtgcgccgcttgnt

SEQ ID NO: 9303 - DNA, 722 bp, Physcomitrella patens
  misc_feature (673)..(673): n is a, c, g, or t
  Predicted polypeptide sequence is orthologous to G1660
tttgatatttgcccttcacatgttataaattttatcacaaggaatgatgcacaaacctcgtaaccaccataatacagaaaccatgaatctccaaggcgaagtccaagccctggtttacctgtatgagttcagaagatggttaatgacctattctgttcaactttgtttttgctctcattgattttacaactgctgctcctgattgtaggggatatacaagacttcgtcctgtaaccacaacccaaacttcttgtgtacttcctcctttaccaacgcaataagagcctgcacatcctgtgatttcgaacctcccccgttgatgagaaagttggcgtgcttttcagagaccctggctcccccaattgcaactcctttgagcccagcttgctctatcaaagcaccagctgactggcatcctgcccctgggttacggaacacgcaacctgcgctcttctccgtcactggttgtgtcctcttacgcctctccaaatatatccgctgtctctgctttgcatcagaattcggctgcaaatcgaaagtggcggcgacgatgacagaaaagtcggacattttttgaaatggggaaaatcgataatcgaatttcagttcacctgcatctcgagaaagtgagtgtgaaactccactcgtcgtcaggatctccacgttttgcacnacatctcccgtttcctgcccatctgcacccgcgttcatataaattgctc

SEQ ID NO: 9304 - DNA, 1485 bp, Physcomitrella patens
  Predicted polypeptide sequence is orthologous to G1660
ggttcttttcttcctacatcgtgtcgccaggttttgtaagagctgtttgttatgatcatctaagtcgaggcgatggcagtaacaaccatgggttgaatccgttatctggttgcgatggctgtgatgtctttgtacacaagcaggggattccatcctagcttaactgattggagaaaccattctagattttgggaagggcgagttgagcatgtggagttgggatatgagctaagtggaaggtgttttggagcatcgaggtcaatagcatgtactcgatggtgtcggactgtcgtttcatgcgatagcggaagagcaagtagaggtatctcagctggtgctggtcaagcagaggtggattccggagctcatcctgtgaagtttaggtatgatgtgatgctgagtgaggtgagcacatggggcattggcggtccagcgaggatttacgcggaggtttcaactcccgacgaattggctactgtgctcaggtattgtacatgccacaacgtgcggtggtttgtggttggcaaaggatcaaactgcttattcgacgaccgtggattcgatgggtgcgtaatcctcaaccgcatcaattttctggagaagcttgggaccggtcggtaccgagtaggaagtggctacgcattcaacacgctaggagtccaatgttcccgagatgggttttctggacttgaatttgctggtgggattccgggtactgtaggtggagcaatttatatgaacgcgggtgcagatgggcaggaaacgggagatgttgtgcaaaacgtggagatcctgacgacgagtggagtttcacactcactttctcgagatgcaggtgaacggaaattcgattatcgattttccccatttcaaaaaatgtccgacttttctgtcatcgtcgccgccactttcgatttgcagccgaattctgatgcaaagcagagacagcggatatatttggagaggcgtaagaggacgcaaccagtgacggagaagagcgcaggttgcgtgttccgtaacccaggggcaggatgccagtcagctggtgctttgatagagcaagctgggctcaaaggagttgcaattgggggagccagggtctctgaaaagcacgccaactttctcatcaacgggggaggttcgaaatcacaggatgtgcaggctcttattgcgttggtaaaggaggaagtacacaagaagtttgggttgtggttacaggacgaagtcttgtatatcccctacaatcaggagcagcagttgtaaaatcaatgagagcaaaaacaaagttgaacagaataggtcattaaccatcttctgaactcatacaggtaaaccagggcttggacttcgccttggagattcatggtttctgtattatggtggttacgaggtttgtgcatcattccttgtgataaaatttgtaacatgtgaagggcaaatatcaaatgataattatgattctacaaattcactaaaaaaaaaaaa

SEQ ID NO: 9305 - DNA, 753 bp, Physcomitrella patens
  Predicted polypeptide sequence is orthologous to G1767
aataacctcagagccgaacaaggactcttcagcttgaacaacataacatcggtgcctcttatcgttctccactgacacttcttcaaatcatttacgacaccagtcgctaatcttaactttaaaaatgtcgctttgtacggcaagacagaggcacatcacactccgcaagcagtagaaaagagcatgacagcaagaagactgagccgagatgttagatcgtcaggatttggtaatgtacaattcagctttcctaaccatcccccaatcgtgctcgtcagtgctctgaaccacaatcaccagtggcgtgaaaactttaccagtggatctcactgatcagccacggcgaccaacctaaccaccaccacagcaagcccatttggaacttgacacctactctaaatcaacattttacactggctttgccacctaatatcctatataattcaacacaacaccactttcgcactatcctccacacgtacaagacacagacctgacatggggaattccaaaaaaaccaactcttccatcagtgtatccaggcgctctctgcacctcagtgttacagtgaaaaccttccaaccaccaggcctctcccttttgattgttgaggtcgatggtgtttacccagcttccactcttggaattggacttcaatccagtgtcgcgcttaaccgggattagtatctgtcccgaggattcatcgcaatccaatattgtggcctccttaatcctggaactgtgacgctcgag

SEQ ID NO: 9306 - DNA, 800 bp, Physcomitrella patens
  misc_feature (733)..(733): n is a, c, g, or t
  Predicted polypeptide sequence is orthologous to G1767
aatagtggttgatttagaccacaagtagagtcaatgcagattaggagtatgtcacctcttattctaattagtctatcttacagcaagaaatcctcgcgcaacaagtaacgcatgaggagaagtacgagatcccaatgcaactcgcctcatattttgtaacgttagacgggcatgtaaagatgggctcaagtaggggattagtgtggcatatatattcttcagtagatctcactcgaggtcatgactgttggaatctagtccctctgattttgcttcgtcgggactaccactgaaagttttcatttcgggcgcagcatgaaaaacctccttcatagaaatgcgtaagtcgtgtaatcggctgccaaattcttcggagaacatctgcagttctttctctaaatcctgcagtcgagcattgcaaacatctcgtcggtgctgctcacgagccagcttgaacattgcatcctttgcggctagggaaggatcatggaccttaggtccaaagaatctcatcttttgagacatacggttcaatccaaagtccagcctggatcctaatatcacttctcggctgcactctccttgctctctattgcaacttaatgtacttgagtgcaagctccagctcgcacaaccatctcaacaggaactgcacctttccccttcaagcacacctccttctgaggaacccaccttcaccccaactgtcacacatgtgactggcagcgcggangtcggcccgtctccacccaatctaagaaagtacagctcctccccgcaccccaccttcgcgatggatt

SEQ ID NO: 9307 - DNA, 745 bp, Physcomitrella patens
  Predicted polypeptide sequence is orthologous to G1855
tcttgattacaatggaaaaggttcaatgacccgcacatgctttctgattgaccaaagaactcagaaccactaattgttcccatgaatcccctgtatctcaatgcattgtacataatacaatcgactaacttagtctgaagaatctcccgataacgtagcgttagctgctttaatttcaccaacccaataagtcttcacacaaaccaaaatcttctctctgatgaatggaccctcttcatgatctgccaaccggcactcccaacgcataccttgggtgatgatcataaccttgttgacaacgtcaacttcatcacgtatcaaaactgccccctcaggtcgcaggattcggtccatctccaaaagcacgtatgtaatatcacacctgtcttggtacatgctgaacacgttatctgcatgaattaggtcataagttcgtgggtacgtagagaatgcctcacaccaattctggtaagtcccaataaatccacgctcgaaaattacacccaatgtgtcagttttagcttccgggggcatggcgttcataacccatacagggtctttgacaagagctgcagcaaagcctccaagacctgcattcatgtccataatgttcctgtatctaccattggtaagtggtggaatcaaatgatttttgtagtatttgactcgcttctcccacaattctgcgtcttctttgaattcctgagctgtcataagcggaacacttccgctagcgatccttgga

SEQ ID NO: 9308 - DNA, 776 bp, Physcomitrella patens
  Predicted polypeptide sequence is orthologous to G1855
atgagttttcatcaatatggaaaaaagaaaaagactaattggcatgaacatggttcctgatcgatcaaaaacctggactgcgattctaatcctgctgctcacaaaccccacagcacctgataacctgcaaaaatcgtgtcagtctgatgcacccatcgatgctgtggtattggcagctttgatctcaccgacccagtaattcttcacacacactaagatcttctccttgacgaacgggccgtcctcgtggtcggcgagccggcactcccaccgcatgccttgcgtgatcaccatgaccttgttcacgatctccacctcgtcgcgtatcaacaccgccccctccggtcgaaggatccggtccatttccaacagcacgtacacaatatcacacctgtcttggtacatgctgaaaactttgtctgcgtggatcaggtcgtaggttcgtggatacgtggagaatgcctcgcaccagttctgataagttccaataaaaccacgctcgaagatcacgcccagagtgtcaactttagcttccggaggcatggcattcatgacccacacaggctccttgacaagagcggcggcaaaacctccgagtcctgcattcatgtccataatgttcctgtaccgaccgttagtaagtggggggatcagatgggttttgtagtacttgattcgcttctgccacagcttcgtgtcctccttgaacttctgcgccgtcatgaaaggaacgcttccactactgatccttgggggaatggcagtcgaacgcgcag

SEQ ID NO: 9309 - DNA, 782 bp, Physcomitrella patens
  misc_feature (718)..(718): n is a, c, g, or t
  Predicted polypeptide sequence is orthologous to G19
gctgccttgtcttgtgacctgtaagtggtcccaacaacaatctaaccaccggcaaactccattgtttctggaatggctatttcaatattcaaactactatttcttctacatcatctttctctccagtaggcgcatttcaagttaccatgttgaaactccagtgactacattgccgaataactggttgaaccttcagttaccatattagaacatacctttttaaggagagaagacatgaattaataaaacctccggatcagtacttaagagtgaaagagccttgccgacttagttatttccatttctgttcggtgagctcagtaatttccactaactggcacactcacgctgaagtggcacagctgctgcacagaaatctggtgaaatcccaaaaaatagacccttaaagtcggtctgaataccgataagtgaacattcgaaagcgtcctagtccacgaatgtcggttttgcagaagcgctggggaaacgataaaatacgcacctctctgtcgacacacttggagggacctgaggagtgctggctgacttcggcggagttgcagtgctcacgccaactttgccattcctggcaacaacctcagctcaccatggattccgttcgatgtgtccacgcgatcggtaactccgcaagcttaacagctggttaccggcgattgagctatctcaccagccctgcgaccccaccggtcggtcgcangcttcaggctcaaccatgcatacctatcgtctaccctgcactgccacgaatcggctcctccgca

SEQ ID NO: 9310 - DNA, 774 bp, Physcomitrella patens
  Predicted polypeptide sequence is orthologous to G1903
agcgggggcagtacaccccattcccttttaaccatcgtacattctattctcagagtaaattctaaaagccaggtataaaatggaagctctagagaaaaatgtatgtaaatgcagagaaaaactctacaaagacaccgcactgaaaactagatacagatcttttgcaatggccaaagattcaaccaatggctttcgtgataggttaaaggctagcccaaactttgtgtggttttgacctaccacctttctccagagactgttttcaatcaaattctagtaaatacaaaaataactagatgactattaacagaccatgtgtccatgacaagacattcttgaagtcgttgacacggccctaatacagaagtctgtcgcgacttttgcccctatccactgtggaggtgcttggatatacattgcgatgcatccaacactgcaccttacaaagtgacagcatttcaattttgtagaatttatccaaaacatggataaaaaatctgtgacgattcatctgctttgggccattcaaacggtctcttcaaagcaccattcccaaccttaccgattgttagcagcactactagcagcaccgaaggcggccaaaagcttgaccaagtcggtgactgaggtatcttcccgcccatcagaagatccccccgaggaccttgtctgtgctccccccgcagcacttctacgattgtgctgatactcgtaagcagcagttttcgacgttcgtgcagttgacagtacgctcaggaaatcagattgcttaag

SEQ ID NO: 9311 - DNA, 792 bp, Physcomitrella patens
  misc_feature (713)..(713): n is a, c, g, or t
  Predicted polypeptide sequence is orthologous to G1950
attgttgattgaactggttcataatactgaacaaaaaaaaccttgtgagatcaaggtttggtggcaatagcaaaagctgtggtgggattaggagcacctcaaacagagcctcaaacagagcctcaaacagacatggataatttcggctatttcattagcggctgtatcgaatcaaaagctgaggccgtacagggtagttaatcaccaaattctctaagtacttattttagcgttaagctctagttggccactgagtgtaatgttattatccatacaatgtatttccatggtaacggttggtatagaaagtactcccgttatatttatgttgaaaatacctccgctagctcaggaaagtgattggaatttctggcaacatcaaccgcggtcaggccatctctgtctctggcattcacatccgccccagctttgaggaggagtttacatatttctgcatgtccccatcctgctgcaacgtggagagttgaacggtacatatttgcagctgacgggttggcttttaccaccttaatcaaaaatagtaccatctctaactgtcccctgctagcggcccaatatagggcagttgaacccttgcaatctttcgcttccacgtcaacacccttctcagcaagccaacaagctgccgtcacatgtccagctgatgcagcacaacgaagaggagtgcatccactagcgtcacgagcacttangtctgcaccccttgaatacagtaattccagacaacccacgtggccccctcttgctgcttccgtgtatgggttgcccacc

SEQ ID NO: 9312 - DNA, 717 bp, Physcomitrella patens
  misc_feature (680)..(680): n is a, c, g, or t
  Predicted polypeptide sequence is orthologous to G2057
atgtaaaacttcgttgaagaaatgtagatacattacaatcacaggtcttcatacagaagaatcggtctccaaggaaggactttaattaggcaccaaaaagaaccactgtcacttctccttgaagtatatctatgttcctgaatacaattaaaacttaaatgacttttcatgagaatcccagaacatatcccggtggcccagcaagcactccctgccaagaggctaaaacgtgggaatgcggcatgagtccacgtacctaagagaatcactttcgtcctcttctgtgtgtttcacaaaattctagaggacgctcaaataaacattcaaagaatgtactagtctggtgaaataatactccacatccaagatggataagacaagacatatcgctctgccaatagagcacgttgacccaagaaaaaagaaacacagcgggggtgcagacgaaaggcatgacctctctgtacgaggctgcaaaagagcggaaatcaacattctgcgcacagtagtgatccgttctgtacaaaatgtagacactagatccttctctctagtgatccgcaaggctgatttcctcccccccgaaatactcttgccacatccgatgatcaccgaatcctgagtctggcgcccaagagacgtcactcgtagattcttggcacgaaagagagggcgtgaanggtgtggttggaccaatattatgctcattagcttctt

SEQ ID NO: 9313 - DNA, 747 bp, Physcomitrella patens
  Predicted polypeptide sequence is orthologous to G2094
ttgcgtgtacccggcggccaccgctttattccgtttcctatgaacactagtccaacacaccatagcggagtatctgcatgaacttaatggtactggaagtgaaagcaaatcgacatcaatggggattcagggatttttagggcggttggatccctgttcacctgtgcactctaacaatgtacacaagctgaaatattccagagcttggaaggcgaaaagaaactctgctgtgctggggcagataaacctcatgaacaatctcgcttaacttgtctttttatctaagcgcagaattttcctacaaaatggaattatcccggacttctttttttttgaaccctgcctcattgtttaatgccggtttcttccattgtgaaggtgatggtcgacaggcttgacagaacgcgatgtcaactccaggattgccctgcacaattgtccctaaatttctactacatgatgcacagtccagcgtttcaggacttccacacactctgtctgtgtaagcgcgtgccatctcaatcacagcatctgcgtgcgcaccaccctctcgcatcgagatggccttcttcagcattggatttggtgctgcagcattttgacatgctccggagttgttgtaagacctgtgtagctctatgggtttctggtcacacaagcgaccacacctatacgaccgtgttctttgaagtcgtcctcctagtgcagggtaggtctttggaagctgtgaattgttcaattggtcca

SEQ ID NO: 9314 - DNA, 752 bp, Physcomitrella patens
  misc_feature (720)..(720): n is a, c, g, or t
  Predicted polypeptide sequence is orthologous to G2226
gagccgaacttcatcacgtagcaagaacacatgatgcaagacagtgttgtgaacaaaaactacataaaaaaaggactaaacattaccactgtatagagactccctgtgcaccgcgagtagcaaggtgacttggaggcacgtctggagacattggggtcgtcgtcttgtacccagaggtggaggtcgtcacttttctacaacgagatcaaccctacaaattgggcaagcagttcctccgcacgagagccacgattccacacaatcggcgtggaaagtatgcccgcaggaggtcgtatggttcttgtttgcatctgagttgggtccaaatgcctggaaacagatggaacaaggctcatcctgcggtgcctccgcattcggaccatctttggaaacaactgggagtttctttgcaacgatgatcagattctcccacttcaccatgttgtttgcccgtttgaaatactcatacttgtccgatgctctataccacggaactgacgatgtcttggccgaccgtgtcctgctgcttctccaacgtggggtagtagtcatcggttggagatttcccactaaagcactttgtaagaagattagtaaccttactgcaccgtcgtgacagttctgagccacgtaagggtggggaagttggtgattgctttgcggccctcatacatccacatacaactcgtgaaggagcaagtcttgacttgcaccccttgnttgcaaatcggacaggtaccttgctccttgga

SEQ ID NO: 9315 - DNA, 741 bp, Physcomitrella patens
  misc_feature (678)..(678): n is a, c, g, or t
  Predicted polypeptide sequence is orthologous to G2371
aattttttttacagtaccgaatagtatacattgccagtgcaaaccaacggcagtgcatgaaatactgaaaataggaagaagagcttattattatggcagtatagtacgagactttcctcatcaaacttggccgtcgttgcagatcctcaaacatgtgtgttcacagcgagcaacattaaccaaagcatgcagttttgcagactgagtagtgggcttcgagcatagcttgtggaagcaaccccatctgatgaaaagcttgaagaggaagagggtgtttctctgtcaatgcaccacctcgtcgtgcttttgtagatgttttctttttttgtcgtagtgccacaaaagtactagcaactcattcatagaaatcacctctggaatcgtctatgggtaagaaccttcaaaaaggttgcgtagttcagagattcagcaacagtctggtgaatccaagcagtctgtgcacgaagatctggcttaaattcaccgagcacttcatgctttgcaaacgcttactgggtcacggatgaacctcagcttgtggactcatgggcgactacgcaaaatattagaccagagtggcgaagaatcttaatcctaaatgaggtccctttgaatgcaagatttcatacacttccaccgaactggaaaccttgttgatcgtttgatatttgctggggntcggcgttgcctactcaaccgccaacattgaacgatttccaagatgatgaacgctgctaccaa

SEQ ID NO: 9316 - DNA, 663 bp, Physcomitrella patens
  Predicted polypeptide sequence is orthologous to G2394
aactttcgattcatacaactcgttctgatcacaaagaatggtgaattcggtgccgcctgaaagcgtcgcactcacacaggaccacacatgtcggcaacaattattcaaaatctcggatgctgtctcgaccggtgcaagtgcaggttaacaagctaggttaaggacttccagttcagatttgtctagtctacgccatggcctacatcactacctccggacgatagtcgaacattgacgatagaccgtagtagctggctctggcgatgactcgcctccgaacgatgtgtaaagccagattcccagcaggaggagcaaccagtgagctccataatctagcaatatcgacatcgtgcctggctggttgttccggttgcgagcggtggtggatgttgcagtacactaaggggccaccagggccataggaagcgccgatcctcctttccgatgcgccaaggcgaccgtatacgggactcctggagtttcctgcaaaaaactgaaaccagagaagtattgcgataggcacccacatgagagaaggaaggaagggagctggcttctccttcggtggatggtatgacacactgcgacattgcatggtgggtttcggcgcctctttgtacgcaattgcaacgagaagaacaaaggcaagaattatggcgggca

SEQ ID NO: 9317 - DNA, 740 bp, Physcomitrella patens
  misc_feature (722)..(722): n is a, c, g, or t
  Predicted polypeptide sequence is orthologous to G2510
caatcagccggactgcaggtacggcggcgcgccagaggacgagacaagggggatgattgacaagtatgcgaatctggctctctgaaggcttaaacgtgctttgcagtgtccttatgtaaaaccctttcaaaagtgattaagtcgcgttttccttcgactgtgattcttcgcggtgaagtagttgggaattgcgaggaagtgttttggaaagtctggtttcgaaagatctagattgggaagatcagagtgtggtagtgaaacaaaaataaccgaaaggtttggtgaggatggttgagaaagtagtggtgtcgtctttgcgtgtcaagcgaggaggcaatctcttggcgccactgaagaggaatgtgtccagcattgctaaaaatcctcaacgccaaagagtgggaaaccggtagggagccccaaagtgtacaaaggagtgcgcatgcggacttgggggaagtgggtgtcggaaattcgagagccgaacaagaggtcacgaatctggttgggctcattccccactgcagaaatggcagccaaagcgtacgatgccgctgcggtgtgcttgcgcggacgatccgtgaagctgaacttccccgacagccctcctcgatgcgcagccgttgcaattcgccgcgcgagtccaagcggagcgaccgcagcgcgtggcgtgcatccatctgcaacgtctgaccgggcattccatctccgtcaaaattggngacacattatcatcgctg

SEQ ID NO: 9318 - DNA, 488 bp, Physcomitrella patens
  Predicted polypeptide sequence is orthologous to G2574
taatataaattgcaattcacaaatacatttttttaattacaaataatatccagtcgtcactcaattccgcccccctacgctcccaaacgtggataatatcacattttgcatactcgaaatcacagatctgaacatcattcgtaagtactcaaattgcagagtccccagaagaacaaaatgttgaaccttcaagtgggatttgtaacttacaagtccggtaaaggaataacacgaacaagaccaaagcctgctctggttatgcttatcttccatgccatcactcacaattcctccacacgccgccgctgcggcaacagtcggcagactagcaacctgcaattaggacggggattcgacaagcaagtccacaacaaccatgaaagagcacactaactcccaaaacatgtcaacgatcaatcgaccagtaaaacgagcgcagagagagagagcagcgctgaaggaacgctatgatgagtgccgcactacac

SEQ ID NO: 9319 - DNA, 717 bp, Physcomitrella patens
  Predicted polypeptide sequence is orthologous to G2574
gtcagctgactccgcaacaaatatcacttggatcagaagcaatcaaagtctaacaatcaacagggtggttcttagtcacaggaattgcatcccactatcttcttggggatatcaactcaaatgtcacctattatgaataacaacttcaggaaaagggtatttcccatcatgtctatattgtgaccttgcatcaatgttgagcctagacattgtagcaaagtcgaaccttacagtacaaagccaaaaagctaacctttttctaaagggtcctgaatacaacgctccccggaaataaaatggttagcatccatctcctacctatcaaatacaactccagtcattacagttccaaaatgtccaaagaggagtgcacagatatttactatgctcctgagcttcatccaggaatcgagtgctgacgggtaatagacagccactgtgacagttcagtgttaaacaaagggattaacaccaccagcggggcggacaacgttttgtgagaaaaattggttgttgggataaggaccgtcttgaccaaggggttgagtggatatgtatcctccagaaacattcgactgcgttgaaaacacagggctaggtgacgtcgattgatctgagccgaagttaagagatcctggaggaaaagaatgatcatgaaactgcgagaaggaatgtgcccagtcatgtgtagccgcattggttggtatagtctgtgga

SEQ ID NO: 9320 - DNA, 738 bp, Physcomitrella patens
  Predicted polypeptide sequence is orthologous to G261
cgtcaatcaatatgaacatatcctctcgaagtcttttaactaagtaacaagagctataatagctcaagataataattctaataccaaccaagtcccgacatcattttaaaggttaattaaccaggcgctagctgacccaattgatgagataggaattcaacacgaggcctaccgaaactactttgctgcgcattcttgccaccctgcgacacatcttctgtctcagactcaggctcacgctcaagatcgatttcggcacgggtgacaggttgtgggtcttctgttaggaattgctcccagaaaccagaattgtgcgctgcggaatccgtgcgtgcgctctgcacttcagcttcatgggatgccgtgcctctattacagtccggctcatgcaaatcattactatcacggtattcagagtgaggatgcctgctcctctctgcagatttatcgccggatgacgctctcatgatatcaaagttgagtggcgatatagatgtagcttcctgcgcttcattgacactcacgtcaatcacaacaggcgcactagagaaaatatcaggaagtttggtattaatttcctcgactgtgactctggattgtcgattcaaaatattgctatctccgctattaggagaagtgtctggctctcgcatgagggcttcaaaatgacggctatccatagcggagtgggagtcagaagagcaaaagatctcaataaccctggcacgtgctctagct

SEQ ID NO: 9321 - DNA, 770 bp, Physcomitrella patens
  Predicted polypeptide sequence is orthologous to G261
atgagtgatgagatagagatcgtcaatcaatatgaacatatcctctcgaagtcttttaactaagtaacaagagctataatagctcaagataataattctaataccaaccaagtcccgacatcattttaaaggttaattaaccaggcgctagctgacccaattgatgagataggaattcaacacgaggcctaccgaaactactttgctgcgcattcttgccaccctgcgacacatcttctgtctcagactcaggctcacgctcaagatcgatttcggcacgggtgacaggttgtgggtcttctgttaggaattgctcccagaaaccagaattgtgcgctgcggaatccgtgcgtgcgctctgcacttcagcttcatgggatgccgtgcctctattacagtccggctcatgcaaatcattactatcacggtattcagagtgaggatgcctgctcctctctgcagatttatcgccggctgcgacattgaaaagaacttggggttagataatagcaagagtaggatggtctcgtgtaaactgtagacatcatcacaagggacctgacaacctgacccacaatgaattgagcaagttgtcggtgcagggttcaggctgtttaaacaaaacaatgcaatcagggtgaaacgaaaaaatatagttggagggaagttaactcacatgacgctctcatgatatcaaagttgagtggcgatatagatgtagcttcctgcgcttcattgacactcacgtcaatcacaacaggcgcactaga

SEQ ID NO: 9322 - DNA, 679 bp, Physcomitrella patens
  Predicted polypeptide sequence is orthologous to G280
tagaacgtctacaactcgatgtgtgcaacaacaaatgtccactacactacgggtgtgagcaacaacaaatacagcaaaattgagctggaagagtcaatgcaccagtaaataaacatgcacacttcaccagcaaagagccactttaaaatgacaacctagctagtcaaaaggctgcatctaaaaagatatcaaatttgtcagctggacgatttcgcctttggtggacggcctctcttcttcggcgttggcgtcgtagcggcggcttcggcaaactgtgtttgagcctctaccgagtcatcttcaccctcagcttcagatttaaccttcggaggccgacctctacgctttggtgtagcaccagcctcctctactttggccttcttcgcaacttccacctcttctgcagcttcaggtttagccttcggtggcctacccctgcgtttcggggttagaggactagctagatcagcttcacctgcagccggcttgccacccttgcctcccgaggcaggagcctcttccgaagacttgctgactgattccttagaagcatctgtttttgccttcggaggtcggcctcttcgtttggcaggctcactatcctttccaccttcctctccatcgctagcgcgagagggagttttcagcttcggaggtctaccccgcttctttgctcctg

SEQ ID NO: 9323 - DNA, 803 bp, Physcomitrella patens
  Predicted polypeptide sequence is orthologous to G280
cagcaaagagccactttgaaatgacaacctaactagtcataagacaactaaatctaaaagtggaatttgtcagctagcagacttcgctttgggtggacgacctctcttcttcggcgtcggcgtagtagcggcggtttcggcgtctcctgagccatcctcagcttcagattcagctttggccttgggaggacgacctcggcgctttggtgtggcaccaccttcctccgtcttacccttcttcgcaacctccacctcttctgcagcttcaggcttagactttgggggcctacccctccgtttaggagtaataggactggatagatccttcttctcagaatcatcctcttcggaagccttgctaaccgattccttggaaccatcagtctttgtctttggaggccggcctcttcgtttgggttcactaggactttccttcccggtctcttctccttcactggcagcagaggaggttttcagctttggaggtctgccccgcttcttcgagccaggagccgcaggactttcggttgcaggggctcttcgctgggctgtcatttttgtttttcggaggtcgacccctgccacgtttaaggtgtttcggtgacgcctactttctcttcagttgcctcttcctcggttgcatcggcagcctcctccacattcccaccaccggcaataggttctgccacgctgtcatcatgtggtatctcctcttcaacagcttgtctcgtcctggcacctttcaactcgggtccagtatacttctgtacattggcaacgaatgctgacgaccttccgctaat

SEQ ID NO: 9324 - DNA, 587 bp, Physcomitrella patens
  Predicted polypeptide sequence is orthologous to G3032
tggggaactccgtgtttagtcgccggagcaagctgcgagcttaccatataatagcactggacttgtgttctatccagggtatatgtgctgctcaaatctcgcacttattcgcgatttcaacgggctgcgactgaggctgctttgggagggtggtcggagctgatcgggagcggcgcttggtttttggcgtcgagcttcacaattaatggggggaggggaggacgacgagatctcgatggcagaggtcccgatgcagactgcggagaaggaaagggtcgacggattctgccccggaagggttgagaagacaacggagggtggtgcgaaagaaggtggaggtccagaggtgtcgctggcaattcatggagagaagtcaaataaacaggatgagagtaggattgaaacgaatgactccagcttagcgaatgataaagatggatcacaacaagtatgttcgggcagtgactatgacggcggcaaaagtgatgacgtagaatccaccggtggaggtggatatcctaaaactaacgaaccaatccaagatgcctctgctgcccaaatcgcccaagagaacaatgatgtagcaa

SEQ ID NO: 9325 - DNA, 2108 bp, Physcomitrella patens
  Predicted polypeptide sequence is orthologous to G3032
gcgggcggggaatcatcgctagcggggaagggagcgagggagagagagagagcgagcgaggaaggcaacatggagttgtcgaccctgccctctctgcatttctcccgcagtatttgcactgctgaggtgcggcagccaggttgttgtggaattggctccggtttcgcaacggcagcgtctcggattgagcccaggctgggaggtggagctgcagtattgcggcgagctagccatggctatggcgtgggatgtgaattttctataccacgcttcgtgttggggtcattagatcataagttgggtgaaaagctgttgcgtagggctgtgagaagcggagcgtcgggtttgaggaatcgacgggaatggagatgtatgaacgcggaatttggagctgatgccagcaacgcgggttcgccaggatctgtgcattttgttggtattggaggagcggggctttcagcacttggtcttcttgcactgcgacagggttggcaagtaagtgggtccgacttggtatggagcgaggaagttatccggttgaaagaggctggtgcccgtgcatatgttggccacagtgtggctcaactggtgcctcaagggtcgcagccgccggatgctgttgttgtatccagtgccgtgggtccaggcaacgaggaggttgaggctgctcgtgccctaaatgtgcccatttacaagaggggtgattggctagggaagattacagaaggctaccaactgatagccgttgctggaactcacggtaagaccacgacgacagcaatgttaagtgtggtcctgcgcaacttaggggaggacattactgctattgtgggtgctcaagttccacagtttccagatggaggcagtgcattgtgtggaacgactcgcaagtttgttttagaggccgatgagtatgatggctgcttcctaggtgtttcacctcacctcgcagtattgacgaatgttgaatgggaacacgtcgacatgtttcctgatgaggaagctgtcaaaaatatgttcaagaagttcgtcttgcaaatcaagccaggaggttgtcttgttgcttgtggcgacagtgccggtgctaaatccgtgttaggactgatagaagaggagcaagagaaagatttaggttctccattccccagagagagacgggttgtaacttttggtttaggagcgagcgattggcgagcgataatgcttgtcccaaatccacagggtggaactgattatacggttgtatacaagaacaggcccatgactcgagtcagtttacgcttgcctggcatgtacaatgtgctcaattctctcgctgtcattgtggttatgtcgctgctggcagcagagaaggaaagcgacgttggggcacaggcaaaactcatgaagaggaccgccgaggccgcaggaagagctctaggagctttttcgggagtacgcagacgctttgattttgtaggatctgttcatggatgtcatataatcgacgactatgcccatcatccaactgaggttcgtgctgttctacaagcagctcgtcaacgatatgatcagcagcccatctgggtgatatttcaacctcatacggttagccggttggctgcatttctaccagactttgctccggcttttagtgctgcagatcgagttattgtgacacaggtgtatgctgctcgcaacattccaactgagaaggttgtaactggggaagatttagccaatgccattattgggcctccagccgtctatattccagacttggatgttgtagttgagcggctatcgtgggaactggcagccctagataagaatgagatgaatgaccgcggcaacattgtgttgcttactcttggtgctggtgatattaccgacgtgggtcgacgactcatgcaggcatgtgaagtcgcatcacgatagaactttacttcgaaaacccaaattttactctgcatcgattcctgagcgtaggcagctttatgttggtggtatgagtctgttggtttcttcgctggctcacactcatcacatgattttatttcttatgtaatttgttcctgtggttataacttaaagatagcccttgcaacaaaagatgctttcacagtgcc

SEQ ID NO: 9326 - DNA, 2261 bp, Physcomitrella patens
  Predicted polypeptide sequence is orthologous to G3032
tggagagagagtgagtgagtgagagagtgagagttagtgagagcgggcggggaatcatcgctagcggggaagggagcgagggagagagagagagcgagcgaggaaggcaacatggagttgtcgaccctgccctctctgcatttctcccgcagtatttgcactgctgaggtgcggcagccaggttgttgtggaattggctccggtttcgcaacggcagcgtctcggattgagcccaggctgggaggtggagctgcagtattgcggcgagctagccatggctatggcgtgggatgtgaattttctataccacgcttcgtgttggggtcattagatcataagttgggtgaaaagctgttgcgtagggctgtgagaagcggagcgtcgggtttgaggaatcgacgggaatggagatgtatgaacgcggaatttggagctgatgccagcaacgcgggttcgccaggatctgtgcattttgttggtattggaggagcggggctttcagcacttggtcttcttgcactgcgacagggttggcaagtaagtgggtccgacttggtatggagcgaggaagttatccggttgaaagaggctggtgcccgtgcatatgttggccacagtgtggctcaactggtgcctcaagggtcgcagccgccggatgctgttgttgtatccagtgccgtgggtccaggcaacgaggaggttgaggctgctcgtgccctaaatgtgcccatttacaagaggggtgattggctagggaagattacagaaggctaccaactgatagccgttgctggaactcacggtaagaccacgacgacagcaatgttaagtgtggtcctgcgcaacttaggggaggacattactgctattgtgggtgctcaagttccacagtttccagatggaggcagtgcattgtgtggaacgactcgcaagtttgttttagaggccgatgagtatgatggctgcttcctaggtgtttcacctcacctcgcagtattgacgaatgttgaatgggaacacgtcgacatgtttcctgatgaggaagctgtcaaaaatatgttcaagaagttcgtcttgcaaatcaagccaggaggttgtcttgttgcttgtggcgacagtgccggtgctaaatccgtgttaggactgatagaagaggagcaagagaaagatttaggttctccattccccagagagagacgggttgtaacttttggtttaggagcgagcgattggcgagcgataatgcttgtcccaaatccacagggtggaactgattatacggttgtatacaagaacaggcccatgactcgagtcagtttacgcttgcctggcatgtacaatgtgctcaattctctcgctattggcaggtcattgtggttatgtcgctgctggcagcagagaaggaaagcgacgttggggcacaggcaaaactcatgaagaggaccgccgaggccgcaggaagagctctaggagctttttcgggagtacgcagacgctttgattttgtaggatctgttcatggatgtcatataatcgacgactatgcccatcatccaactgaggttcgtgctgttctacaagcagctcgtcaacgatatgatcagcagcccatctgggtgatatttcaacctcatacggttaggtaggtacttagttcctgaaacttgaatgtttttcacttttttgaagactccgttaataacatcttttgttgatttttgttgtcacagccggttggctgcatttctaccagactttgctccggcttttagtgctgcagatcgagttattgtgacacaggtgtatgctgctcgcaacattccaactgagaaggttgtaactggggaagatttagccaatgccattattgggcctccagccgtctatattccagacttggatgttgtagttgagcggctatcgtgggaactggcagccctagataagaatgagatgaatgaccgcggcaacattgtgttgcttactcttggtgctggtgatattaccgacgtgggtcgacgactcatgcaggcatgtgaagtcgcatcacgatagaactttacttcgaaaacccaaattttactctgcatcgattcctgagcgtaggcagctttatgttggtggtatgagtctgttggtttcttcgctggctcacactcatcacatgattttatttcttatgtaatttgttcctgtggttataacttaaagatagcccttgcaacaaaagatgctttcacagtgccaaaaaaaaaaaaaaa

SEQ ID NO: 9327 - DNA, 753 bp, Physcomitrella patens
  Predicted polypeptide sequence is orthologous to G309
tcttgatagtaatctgaggaactatcagtgaagtagcggtgatgtcgagtagagatatacaactgctttgaaagttgactgtttatcgaagaatccgttactgatgatcactatagtataaaaagcggaaaatgggttgaccagctctaagctctcaaaattatactgcaaacccaatttgcaactatgtgactgaatccccctgcaaagacagggctaaggcataatcagcacgagttcctcatgtcacagctgtacaagaaacaatgtgatgtcgactagtgccttccaatctttagagcctcctgctgcattgtactagtctgagacattccaagtcatcatcacacagcacgttgtttttcattggtgaccaagctagtccctgtgggaacgaagtccttgtcaggcttccacgccgaagcagtgagcaggggttgctccatccagcccagtgtgacggccccattttcctctgctagtgtgtacccatccgaatcaaacatgcgtaggagaataagtgcctgcgtgtaggcactgtcttcaagagggactttgacgaagcccgatcggctcataattgagcgccacctggaaatattctcgtgcctttccatcctatctgtgccctcacatgacagaatgttgcgaatctcacgcgcaaatagctgctccacttgtacacgagcgctactttctcttgaaatattagcttccagagaatcaaaaacagcagaatagtattgtagcgac

SEQ ID NO: 9328 - DNA, 720 bp, Physcomitrella patens
  Predicted polypeptide sequence is orthologous to G328
aacgtttaaaatcggaggaatgtgctgctccatgtgaagacacaggaaacatgcgcggcatgtccaccttttctagcgttcgaaatcaacaaaaagaaataacactaccggaacctcctgctctgtcctgcctcctgcagtgtccatcagtaagcgatgccctaccaggggaaaagaatggcatgacttagcgtctccgactgtatctttttacattctgcgtcaggcgctttcaacacaaggatagctctacactgttcttacagcagtcttaaggcaactcctctatggtacataaaataggcattcgacgtgaaacactcaacttgattgaagcaaggttgatcatacagatattcagaaagaaggcaccactccaaaacttgagtccatagagcaagagctgaacaactgctccacatcggagtccgtcctcttcgcgaacctgcctttgatcctcggccggccctcggcgtaagctttcctggatgcataccggatggttttctcaaacttgcgtttctgcctcttctccttgtacctcatcactcgagcttcccgatccactgtgtcgatgggcccgctcacctgctgcggcatgcgggtgccagacaactcttgagcaccttgagaatccagtggatagggtgttgagatgtcacttagactggagtccgggaccacggcagcgtctacagacgagcacgaaatgctgtgggt

SEQ ID NO: 9329 - DNA, 579 bp, Physcomitrella patens
  misc_feature (119)..(119): n is a, c, g, or t
  misc_feature (257)..(257): n is a, c, g, or t
  misc_feature (288)..(288): n is a, c, g, or t
  misc_feature (348)..(348): n is a, c, g, or t
  misc_feature (355)..(355): n is a, c, g, or t
  misc_feature (422)..(422): n is a, c, g, or t
  misc_feature (460)..(460): n is a, c, g, or t
  misc_feature (548)..(548): n is a, c, g, or t
  misc_feature (556)..(556): n is a, c, g, or t
  Predicted polypeptide sequence is orthologous to G328
tctgctgtacataaattatacttccaagtatccaccacttccagagttcaggagagagcgagagagagagagagagagagagagagagaaaacagagaaaagagcactaccagcactcntgctctggtctgcttactgctgtgagtatgtaattgaagccctaagtggggaaaaaaattggtatgacttagtgcctctgactatattttttttgcattgggtgtcgaaaactttaattctacactatttttacaganggtccttcgtagtacatcaaataaaaattcnacgtgaagcattggaattgaccaagactgtgttgatcattcaaatattcaacaagaaganggaaccnccccaaaacctgaatctgcggtgcaactactaaacatctgctccacatcagagtccgttctcttggngaacctgcctttgattctcggccgactctcggcgtaanctttccttgaagcgtaccggatggtcttctcaaacttgcgcttctgcctcttctctttgtatctcatcactcgagcttcccgatccantgtgtcantgggcttgctcgcctgatgcggc

SEQ ID NO: 9330 - DNA, 591 bp, Physcomitrella patens
  misc_feature (556)..(556): n is a, c, g, or t
  Predicted polypeptide sequence is orthologous to G362
atctctgggcgcgtgaagggtcgctgcccctttgggtcgagcgcagacagcacggaggatgaagaacgcgagggaaattcagatgtggggcaggggtccagttgacatcaggcaatgtaattcagagattattgtagggattcctgaaccaatttgtatggaggatttgaagctatttgaatttgtttcattggttcttaatcgcccaagctagttgcggtgcaggcgccaggaggcatttagcggagtagaattgtgagtgtaagattacaaggtgccgaagcgaatcccgcaatggcgaaaccagcagtggaggcagccgaagacttaaagtcactgcactgggatttgcgatccaaggtgggagactgggaccccaagtacaaaaacgcagggccgtgtcgagtggcgggatgtggcgcccgcccaatgcagtcgccgcttacctctgatttgtcccttcggctgagcacttgggattcggagcttacggaagcatgcccccagctcgctggagagtgcggaggaacgtggattgcgtcgggcgcaacaggangccccgtcggtcgaggccccatcttcgccttggat

SEQ ID NO: 9331 - DNA, 1481 bp, Physcomitrella patens
  Predicted polypeptide sequence is orthologous to G409
ctgtgagtgttgggtgcttgcgatgtcctttcttgcagtgagtggaggcgaactagtcgccagtgcactaggcatgaaatgatgtgctcgaggaatttagccatgtgacggatacaaccagatgcaggggataactacagagggacgtcgctagatcagttgtggagttgctaggattactggaattgtaatggcagctttggggagagctggagaaacgatgtcgatgacggcagtttctagttcgggaggaggtctggaagaggaagctacagggcgtgggcagaagcggccccaccatcccatatccgacaaagggcctggggaggagcctgaggaaggtgacgattgttgctacgacggcgcccacccaatggagaagaagcggcacctctcgttcgagcaggtgcggtccctagagcgcaacttcgaaatggaaatcaagctcgagcccgacaggaaaatgaaactggccaaggagcttggactgcaaccccgccaaatcgcggtctggttccagaacagacgtgcacgctggaaaacgaaacagctggagcgcgacttcgaactgctcaactctgggtacagcaaactgaagcgggacttcgagaaggtgctcgaggagaaagatgtcctcaaggccgagctcgtgcgtctctcagccaagattatccccaaagattcccaatccgtagacttttcccagagcgagaaggactcgcattgcaagccaacggcaaatgacccagcgaaatcagacaagctgaaggaatccaagcctgcgactcccaaggataaccaaagcactagatcctctcccaccacagtcgtatgctctgccactacgcttgaggcagagataacctcaacaagctctggcagcaactccagcgatctgctcgacgcggacagcccccgcactacggacagcaacccccgcgaggagcagctggcaaattactgcggccaactccttccagagaactttgtgggacaccttacagttgaggaggctgtgaacacttcgcagaaagtttattcggtgaagcttgaagatggtttgccatcacttccaagttagacgcgactagtggctattttttgccgcccatggctgagccaaagtattcttccttggtgggattggccgtaaccggggcattcaaattgtgcctttgcggcatttttttcccttagatcttggttagtttaattttttagttctctctctctctggccctatgtgaggatcaggctggttatgttcaatcgattctcgttaccgaatacctcgaggaccacacaccagtagcatctaactgcaagtgcatgtccagtttgctccaacgacttgtgtgatatatttagttcagatagagttggtagagcttcaaaggtagtgacgagcatccatgattttttaggactgataagctgaggtcttgctcatccttctcattttttagcactttgtaaaggcg

SEQ ID NO: 9332 - DNA, 1802 bp, Physcomitrella patens
  Predicted polypeptide sequence is orthologous to G409
ccagagaatccagctgaactgaaggcttctagactcgaaagaccagtccattgttgttggctcatccctctctgctctccctagccgttcaatgcgtgcattcacattgcacacgaacgaacaacaaacaacaacatcaacaagtagctctgagtcactgtgtttgatcaccgtttcagggtgagaatctggagaccggaatgaaagcaccctctctcgggtgaacagagcgatcagggatggcaattacaagcatgggagggtacccttgccagagcgcaatgcagcagctcatacgcaacgagagcagctcggattcgttggctgcaattctcactccctgctcccctcatgtgggcctacaagcgccgccacatgtaggaggatcgctagaagacgctgttcttgtagcgtcggagggaagcagacagaagcgtcctttctttgccacatacgatgccccgacggttgaggatggctcagttgaggacgatgaaggtgccgatgactctcaaggcgcttcacagctcgagaagaagcggaggctgactttcgaccaggtgaggtcgctggagaggaatttcgagatggagaacaagctcgagcctgaacggaaaatgcagctggccaaagagctcgggttacggcctcgtcaagtggcggtgtggttccaaaacaggcgagcgaggtggaagacgaaacaactggagcgagattacgaggcactagccgcggattacaagagcctcaagcatgactacgacctcgtgctggcagagaaaaacaatttgaaagctgaggtgcaacgtctatccggcaaggcgccaacctctccttgtgctgatggcaatcaaatcgtcgcgggtgaatctgcacaaaccccggaagtagacgttgagacttcggagcttgttgcaaggcagcacacctccaggtcaactccaaccgtggacgtttccctggcgtgcgtgaaggacaaagacttcgaaaccagtggttgcacggacgggaactccagtgacgtgctggacgccgacagtccccgaaccaccgatagtagcagcctctcggcgatgtcggaccatgatcagctgatatacagccatgaaatcccaccacccgagagcttcatgggcctttctggcatgctacacgacgtcaccgtgaagctggaggaagggagcggccacgggttccacgacgacaattcttctaattattttcttctccatctggaggatcaagccggcgtgcttccgtggtgggattggccttaaagcattcacggttttctgtacatagatccacgtctgggctgaacgatttcacctcaattttccaagaggagttcaagtatgtatcatgacttacgtttgccgtcaccaacacttcgcgggagcttcatcccgccgacttattgttagccgtttatgtacatttgcagagtggattttgtgtcacgtagtttgaacttgcaggagtcattggatcatcgggtactttgttactagatttcaagagtttagcacacagtggcagcgtcggattagccttagcatctgttccaaagaggtccgattggtctaaccaatcgaccgcgactcacagcgtcaggcatgatgcatttcagccatcaccatcctggaatacttcagcatcgtcaacatcggacatgtaatcacatctccgatcacatgatgcatgttcttttggtagattggctcatgttgatgtatctatcaaaggcccgcgctgcgctctttgcagcaattttccctccgaaataaaaaccattggaattc

SEQ ID NO: 9333 - DNA, 1593 bp, Physcomitrella patens
  Predicted polypeptide sequence is orthologous to G409
cacaggttcaatgcgggaacttcctagcgcggcaatgttggggcagcccaggctattccggtataattcttaggcagcaaccagacttatcagaggtgcagggggtgttcaatcccagcactgcgaggcttgacatggcgagtaacgtcggcagaaggggttacagtcgcggtgggtccaatgtcgtgcctgtgcgcaacgacagctccaccgacaccttagttgccatgcttgcttcctgctctcctgttgctcttcaagtacaacgtactggtggaagcttggaggatgcagtggtaagctgtgggcagaagcgctccttcttccccttgtttgaagcctcgagggaagatgccggagacgaggatctgggagatgactgcacccacaatgtggagaagaagaggaggctcactttcgatcaggtcaggtcgctggagctcaactttgaggtggagaacaagcttgagcctgagcggaaaatgcagcttgccaaggagcttggtctgcagccgaggcaagtggcagtgtggttccagaaccgtcgcgcgcgatggaagacaaagcagctcgagcgtgattatgaggtccttactttggattacaaccggcttaagagcgaatttgaggctgtgttgcaggagaagcaagagcttcagggcgagatggagtgtctgacggggaggttgcagacgtcaccccaacttgcctcaggcgatggtgtgtcagaaaaaccttctaagaaatcatcgaaagctgtggcgtctcaactttcgctccaaaagatggtatccgaagagtgtgtcgaagttagagagtaagcctcaggacccaaacgacagtagcaacgatgacaaggaggaaggctcccgagccacaagctcagatagcatttctagtgggattctggacgcggacagtcctctcaccacagaaatgatcactacccaccactttgccacatatttcaatccacgtcgccgcagagatgcccctgagctcccaatatcatcaacatgagcgacaatctctgcaaccaaatgctgtccccccatgcttgccagcagatttctgtgaagcttgaggacggctcgtctcaggacgaatcttctagtaattacatcctgacgcagttggacgaggaaaggggtttgccctggtggggattggccttgactggatcgtgcggcggaactcgaaaacgccttccgtgagattcgtctattccttttgaaatccagttgttattttccaggcactaccatcgccagcacaaccgatttgttcgatctgggtgcatggtggtccagatgcagcgctgaaagccttgatctgttatcgctaccagattactcagcattcgtcctgtgagcctaagtgttatatatcatatcttagagaaaccaggttctgctgttgtaagtcatttccatgatgctagactaggagtccgaaatgatgcaacatcagatcaaataaattttttgctcctgaaagacaacactaatgtgccagatcatctgatgtagaacttactgaaataacaaatgggacggatctgcagtgtcagaactgtgtccaagcctgtaactt

SEQ ID NO: 9334 - DNA, 1324 bp, Physcomitrella patens
  Predicted polypeptide sequence is orthologous to G409
catgcatgtgcgaaacgatagctcgggcagcagcttggttgccatgcttgcctcttgttctcctgctgctgcggttcaagctcaacctggaggtggaggcatggaggatactgttagttgcggtcaaaagcgaccttactattctactatcgaagcgtcaggtgaagatcctggtgaagaagatgttggggatgattgcattcaacaatctaagaagagaagacttaccttcgatcaagtcaggtcacacgagaaaaacttcgagattgagaataaactcgagccagaaagaaaaatgcagcttgctaatgagcttggacttcagcccaggcaagtggcagtgtggtttcaaaatcgtcgcgcacgctggaaaacaaagcagttagagagggattacgaggtccttaccttggattacaaccggctcaaaagcgaatttgaagctgtgctgcaggaaaagcaagagctacaggacgagatggagtgtttgacggaaaagatacaaaccgcaataccgaattctgcggatccaatattggagaaaagaaaaagaatcatatcaatgtctcagccttcttcgctgaagacattcgaaggtcctgtgaaatcggaaaggatagccgccgaagctaatggcaggaacgatgccctgacaccgtgcaaggaggagggttccaaggaggagggttccaaggagacaagctccgatagcatttcccaggtgaaatacttaacgcggacagccttcgtactatggatagcggctcgcttctcccattgcccgatagtatgagcacattttcacatgtttgtacagagatggtagactccaacatcatacacatgagcgaccaactctgcgaccaaatgctttctcctcaagcttgccaactcgtttcggtgaaaattgaggatggctcatatcaagacgactcttgtaattacatattgacactaatggattcaattgaggaaaagggtttaccgtggtgggactttccatgatcagtgctctgcacaagcatcggagggagatttttttttttttttaaccaattcgacccttcaagcgtcatgaagtcgcatccacttccattgtagcgatgtaaagagttaagatgcgccgctctcgctgtcgcaactacaggacgcacttctctctcttcgagcatcgtgtacttccgtatttaagtcggaccttccgaatcagcggccgtcgaggagcgccaatcgcaagagcacttcttttcttgtaacttgcacatatttattatggaaattgaaataataaagtgttgctgttgcaactcatttcgagggcggt

SEQ ID NO: 9335 - DNA, 2594 bp, Physcomitrella patens
  Predicted polypeptide sequence is orthologous to G450
gagggtttgaggtgcagaagaagagccccccgccatagccactacaaagcatacgctgcaactccacagttaagcttagcttgcgagttaccgagtgtcgagagtacagctacttttgcctctggagttccacaccacaggagagcgcagaatcagttccctggtctcgcgacgagggtcgctgtacagtcgcttactgtgaggtttcgaaaaacggaacaggatactggaagcgttttggctggggaaggagtgggaatacggttgtcgcgaaggggtggctcaaaggctgactgactgcaagtgctttttgaaactaagctgccacaagtcgtggcgcggttaagtgcagataggtggtgcgaggtcgtggaaggtggtggtccagttcacagcggagcttgactcggcgactgaggggaggagacggagacggttcgaaagagttggaaacgagggcgttccattgcctttgacctagtcgtaaacgtggctggaagttgtaggatgagctggaagccgcatggtccacgtcaacgtcaagttctggacgaacatgcctgcagcttagggaagagataatgaagtttagcaacgaagttgtccacaagtctatgaacatcaccgaagattgcagcgccctgaccggtgcgctgctgaagtactcaaccgataagtcaaacatgaacttcgagaccctttacagggatgcagctgtagagtcccctcaacatgaagtcagtaacgagagtggcagcactttgaaagagcatgactacttcggtctctctgaggtatcgtcctctaacagcagcagtggcaagcagccggagaagtgttgcagagaagagctgaacctgaacgaaagtgccactacgctgcaactcggccctcctgcggcagtgaagccgtctggtcatgcggatggggccgatgcacacgacgagggtgcgggtccagagaaccccgcgaagagacccgcacaccacatgcaacaagagtctcttgcagacgggaggaaggctgccgcagaaatggggtctttcaagatccaacgcaagaacattttggaggagttccgggccatgaaggcgcaagctcacatgacgaagtctccaaagcctgtccacaccatgcagcacaacatgcatgcatccttctctggtgcacagatggcgttcggtggggctaagaacaatggtgtgaagcgagtcttctctgaagctgtcggaggaaatcacattgcagcgagtggtgtgggcgtgggagttcgggaagggaatgacgatgtgagccgttgtgaggagatgaatggaacagagcagctggatttgaaggtgcacttgccgaaaggcatggggatggcgcggatggcaccagtatccggtggtcagaatgggtcagcttggcgtaatctgagctttgacaacatgcaaggtcctctgaatccgtttttccgcaaaagtctagtgagcaagatgcctgttccggatggtggtgattcatcggcgaatgccagcaacgactgtgcaaatcgcaaggggatggttgcatctccctccgttcagccacctcctgcgcagaaccagactgtgggttggccacccgtgaagaacttcaacaagatgaacacgcctgctcctccggcttcgacccctgctagagcttgtccgtcggtgcagaggaagggcgcttcgacgtcgtcgagcgggaaccttgtgaagatctacatggatggtgtgccgttcggtcgcaaggttgacttgaagacgaacgacagctacgacaagctgtattcgatgctggaggatatgtttcagcagtacatcagcgggcagtattgtggaggtcggagctcaagcagcggggagagtcattgggtagcgtcgagcaggaagctgaactttctggaggggtcggagtacgtgttgatatacgaggatcacgagggagactcgatgctggtcggagacgtgccttgggagttgttcgtgaatgctgtgaagagactgcggatcatgaagggttcggagcaggtcaacttagctccgaagaatgcagatccgacgaaagtgcaagtggcggtggggtgaggagattgcaatggcgggatgtgcgagcgtggagggaagggggttgggtgtgcgcgtgcgcacgtgatgtggggttgcagtggtggctgttgcacccggtggagcaagagaaagtgaaggcgggtgcatcatttttcattgatcggcagtcgtggaggaaggcgaagggggcacagtggcgatggatgtcagtgtggagcgttacataaagtcggtggcgggaggcggccgttttttttaaagaaactttatttatctttattttttttatttttttggaatttgcaatgggaaagaaattggagttagaatattttctcgattcgcgtatgtggcgggttcggggtaggatgggggacatactggggggcggtagtgtggaggcggaggaggaggatggaagtgtagatcccgagtgcatgggtggaacggtgtgcagtgcgggacgtgctgtattttgtagtttcctgttgtgaatgttatttatttaagcctctccgc

SEQ ID NO: 9336 - DNA, 2174 bp, Physcomitrella patens
  Predicted polypeptide sequence is orthologous to G450
agcctactccgccgcagccgctgccaagctttgtcctcctcctccctccgccatagtcgcactcttgtcgctgttgttccgcttgctcccaagtgagtcgcctcgcagagacgagttggaagctagactgccaatgtctacaaagttttatgatgggatatgtgtgcggttaaaaacaaaaacaatgaacttttagcagtgaagttggacattattcaatgaacgtcagcgaaggttgtagcaccctaactggtgcgcagctgaagtactcaaccgacaagtcaaacatgagctacgagaccgtttacagggatgcagctgtggagtcccctcaacgcgaggtcagtaacgaaagtggcagcactttgaaagagcatgactacttcggtctctctgaggtattgtcctctaacagcagcagtggcaagcagccggagaagtgttgcagagaagagctgaacctgaacgaaagtgccactacgctgcaactcggccctcctgcggcagtgaagccgtctggtcaggcggatggggacgatgcacacgacgagggtgcgggtccggagaaccctgcaaagaggtccgcatatcacatgcaacaagagtctcttgcagacgggaggaaggctgccgcagaaatggggtctttcaagatccaacgcaagaacattttggaggagttccgggccatgaaggcgcacgctcacatgacgaagtctccaaagactgtccaaaccatgcagcacaacatgcatgtatcctactctggtgcacagatggcattcggtggggctaagaacaatggtgtgaagcgagtcttctctgaagccgtcgtggcgaatcacaacgcagcgagtggtgtgggcgtgggagttcgggaagggaatgacgatgtgagccgttgtgaggagatgaatggaacagagcagctggatttgaaggtgcacttgccgaaaggcatggggatggcgcggatggcacccgcatccgggagtccgagcttcgacaacatgcaaggtcctctgaatccgtttttccgcaaaagtctagtgagcaagatgcctgttccggatggtggtgattcatcggcgaatgccagcaacgactgtgcaaatcgcaaggggatggttgcatctccctccgttcagccacctcctgcgcagaaccagactgtgggttggccacccgtgaagaacttcaacaagatgaacacgcctgctcctccggcttcgacccctgctagagcttgtccgtcggtgcagaggaagggcgcttcgacgtcgtcgagcgggaaccttgtgaagatctacatggatggtgtgccgttcggtcgcaaggttgacttgaagacgaacgacagctacgacaagctgtattcgatgctggaggatatgtttcagcagtacatcagcgggcagtattgtggaggtcggagctcaagcagcggggagagtcattgggtagcgtcgagcaggaagctgaactttctggaggggtcggagtacgtgttgatatacgaggatcacgagggagactcgatgctggtcggagacgtgccttgggagttgttcgtgaatgctgtgaagagactgcggatcatgaagggttcggagcaggtcaacttagctccgaagaatgcagatccgacgaaagtgcaagtggcggtggggtgaggagattgcaatggcgggatgtgcgagcgtggagggaagggggttgggtgtgcgcgtgcgcacgtgatgtggggttgcagtggtggctgttgcacccggtggagcaagagaaagtgaaggcgggtgcatcatttttcattgatcggcagtcgtggaggaaggcgaagggggcacagtggcgatggatgtcagtgtggagcgttacataaagtcggtggcgggaggcggccgttttttttaaagaaactttatttatctttattttttttatttttttggaatttgcaatgggaaagaaattggagttagaatattttctcgattcgcgtatgtggcgggttcggggtaggatgggggacatactggggggcggtagtgtggaggcggaggaggaggatggaagtgtagatcccgagtgcatgggtggaacggtgtgcagtgcgggacgtgctgtattttgtagtttcctgttgtgaatgttatttatttaagcctctccgc

SEQ ID NO: 9337 - DNA, 789 bp, Physcomitrella patens
  misc_feature (713)..(713): n is a, c, g, or t
  Predicted polypeptide sequence is orthologous to G489, G714
aagtctaaagaagaaaaaacaggacgatgagaaaattaccaatgctaggataatggatacttacgccttcaacctgaacttaaatgaaattctgcaattgctaatacttggccggcgggcagtaatctatagattcacaaagtttgcgtgatattccctgcgctagttacggtgcttaaataaataccttcatagctacaatgagtagaactgagaatcatttatgtcgatgtttacagttaagatgtgcagctactcaaatataatttaatgctaaacccaaaagtgtcgatatgacaagaatacacctgcatgttgcgactcctccttccttgtagtgacaattaataataccattacgatgagtaccgctgcatgtgacgttagccacttggttcaagagccctgtatctcagagctcagaagttcttgcattctcctgaggttactgcatctgctgctgctgttgctgctgctgctccggcgcgaaagcagccggtggtggctgatacatcatttgtgggtttggtggcatgcctggctggccgaccatcatctcaggggctcccataggatgatgcattggctgcccgggcatgggagggtagtacattcctccatattgcaccccctcagctggaatccctggaactccagaccatggaacacccaagtcttcttcctttaactcgtcacgtggaacaatgtctacnaggaagtcaaaaatgtcgcctctagtgatagcgccagcaatatcatttctttgaagtgttcgtcttttattctctt

SEQ ID NO: 9338 - DNA, 655 bp, Physcomitrella patens
  Predicted polypeptide sequence is orthologous to G562
gcatttaaataaaaatgaaaccccgttgcgcgacgtgtgaaaatgtacaaaagcaactaccaattatcctaaacatcaccttgagtgttcgctgctactttcaaagaatgctggaccagcgcagcagtgaaataaactattcactctaacctctcccagtcaccaaccatccctcgaacaggacacccatctgtggaagaattcaaatgtttgtgcagagttaaattgtacatgatttatagaggggcgtgtagaaagagggaaaattcgaaatcgttttgttggaacccccaccgattcgccagctccgacccagaacctccaagcctatgtagctgcagcttgctcctcttgaactttcgtacctgagccaccgttaactgcaggcttcccctctttcggcttcgtgatgtttccgttcccatcattctgtgactcttctatctccttcgctgacaacactgcctcgttctccccacccacgggagcaacatctcccgcgtctgcagcagcagcatgtgcaccacccatctccgataccggtgtgccgcggatcttctgcaccagagagccattctccgcctgcaatctcttgcactcttccgtcatccggttcaactccgtcagcagggtcatgttctctgccgtgagcgtt

SEQ ID NO: 9339 - DNA, 788 bp, Physcomitrella patens
  misc_feature (698)..(698): n is a, c, g, or t
  Predicted polypeptide sequence is orthologous to G720
tcttttccaaaataaataaaaataggacaaccttaaaactactggaaacgatgatacacttttcaaaatttacggtgagtactaaaatgggagtgccaccagattctgagacccttaaaaaccaacttgacacttcctgtcaccaactacctggtctcacctgtaagaatctaaatactaggcacatctaaatttcactatacagggctcaatcaagccttcaatttcgaatggatggagagttgacccgccgcgcaaagtttgcaagtaaccaatgcacaggttcacaacaaccccagatacctgaaggagcctgaataggccttccctgatcctctcttttgaagtgtgatgtgatggaaacttgctcagatttcgcggaggatgtatcaacattgcctgacaaagatgtagcttcgacatctttggttgatccagccgagttgtcagccagcttagattctgatatgttgatgagaggcaccgaagtcccctcatttgtggtgcgtaactctttaattggagggctctgcgtgctatcaactgaaaaagaagtaccttcttcactttggctttccagcaagtgttgttgctttcctgcggtcccatctgcaagtggctcttctatttgcacgctcgaatcacctgagaaagagccacctgtatgcagaacctctccagcttgatgctcatctccnaatccatccttcggaaaagcttcctctacttctttggtgagcagctctggagctctatccttcagcatctcttcaatctgcaagcctgaa

SEQ ID NO: 9340 - DNA, 773 bp, Physcomitrella patens
  Predicted polypeptide sequence is orthologous to G732
ttatctttcaacgtttaaaacaattcagtttctcccaatacatttccaggaccctaaaaaccttaccaaatctgccttcaaggtatccatacgttagggacatgacggatggaaatcatggcaagtaatcagttcagatgtaagatgtatcataacatcttcggcagacaaactccaaccttcaatcgttacacttcagttttctgtcagagacagagttacgcgttcaaacactccgtgaaggacccataccactgctcttgaaggagaactggaacaccactaatgctagcgtcgaactggtccgagtcaatttcgtcgtagagctcctgaaagaagccacgtgacatgtctatgcaggagaagtttcgcttcttcgcaccgaatgttgaagcagtcggagggctgcccttggaagatatttcaagttttatgcaagcgtctggggaaatcagccctccatcaaccatgtgacagatgccagagtttacatctttgccttcactgagttccccagaatctgcctgagcacgtggatgtcgggcagaatcgagttctttcattaactcctccactttgacagccaattcattcttctcgagctcgagtttcttggcgagctgctcggctatctttaacctacgggatagagtggcgttctccaaacgtaattgagcagtcaaaatttcgagctcgtccagacgctcctgctttctttgtccttgaccgttgtgctgacgcacgatttgaggacatcctcctctttcttttct

SEQ ID NO: 9341 - DNA, 705 bp, Physcomitrella patens
  Predicted polypeptide sequence is orthologous to G732
gaagcggatgatttcaaatagagaatcagctcgacgttcgaggctccgaaagcaacaacatttggacgaattgcgatcgcagattgcacaacttcgagccgaaaatacacacatgctgaatcgattcagtcttgcttctcagcagtatgcgcagctgactgaagaaaactgtgtactaagatcaaatgctaccgatatgagacatcagctccaaatgctgcatcatgctgcttcgagtcaccaaccattgtctctggaacgtggccttggcacagtgcaaccccttcccttaaatttgagttgtgttctggtctaacggaggatgccaattggtgatagcttgaaatttgagccccttttcagtttggcgtttgtatatgtttttttgggtagggctcagtgtgaaatgtttccagatgagttgatttgcattaagcaaatactcttagtacggattgatttgcttggatagtgcctgtttgaatgcacgcaaaggcgtcaaacagacgtctctagatcagttagcgtgaccgctgcactgttttgtgcaattactggtggaagggttctatgcctcaaatttattgtgggtattggtggtaagtcagggagtgcaaaacgtatccaccggtctcactcatgcgaaaagagcatgaggtattcctgctttccgaagcacatagtgaaacagattgaattatctga

SEQ ID NO: 9342 - DNA, 730 bp, Physcomitrella patens
  misc_feature (25)..(25): n is a, c, g, or t
  misc_feature (92)..(92): n is a, c, g, or t
  misc_feature (644)..(644): n is a, c, g, or t
  misc_feature (665)..(665): n is a, c, g, or t
  misc_feature (674)..(674): n is a, c, g, or t
  misc_feature (706)..(706): n is a, c, g, or t
  Predicted polypeptide sequence is orthologous to G748
gcgataatagacctcatttgattanaacataattagtagcagagataaccaaaaaaaacgataacagtgtaaaataccggcagctacacacnaaacatgtaaatgaccagacgaggcctcgaggatcatgtgaaactccatgaaaaaattcacggttatatgctaaaaagataagaaactatataaaggcagggagcagcactggcactttgtatacctactttatttatagaggaaacaagaatgattagattgtcatgatttcacttgcttcctatcacctgatgtgatagacactttgttgtctcccactgggagaaacgccttaaaattactaccagatgcgacagtctccacccgattctcagctcccacagcagtccacacagagcttcttggagtgtttactgcatcgtctattttgaccatctttggcacccaaagagaactctccaccctctccagctctggccgatctcgtgggtgcttgttcaacaccggacgaataggcaacctactctgaactggggagacgtttccagacataggaactgcaggaacctgcatggaggctgatgcggcagcggctgcggctgcggctgcgtccggtccccaaggcatgggccaaccagcaccccatccangtgacatccatgatggtccangtaacccancgggcatccctggaatgagagtcgatccccancaaacattagaccaaagcccattc

SEQ ID NO: 9343 - DNA, 750 bp, Physcomitrella patens
  misc_feature (131)..(131): n is a, c, g, or t
  misc_feature (499)..(499): n is a, c, g, or t
  misc_feature (578)..(578): n is a, c, g, or t
  misc_feature (650)..(650): n is a, c, g, or t
  misc_feature (662)..(662): n is a, c, g, or t
  misc_feature (708)..(708): n is a, c, g, or t
  Predicted polypeptide sequence is orthologous to G748
gtgcgagcaagtaaaaaattattaaacacttcaataaatttaaacatagttactggcgaagagaaaagaaaaaagaaccataacagtgtaagttaccatgcaggtatacagaaaaacatagcagcgactangcgagaccccacatgtccacatgaaacttcaagaaagatttcacggaggtatgccaaaaaagatgagaaactaaataaaaagcagcaagcaatactggagcttttcatacctactttattttagaggaaacaagtatgttgacagcagctgggttgtcatgatttcacttgcttcctatgatgtgtcagatgctttgctgtctgccactggaagaaacgccttaaaattactaccagatacgacagtctccacccgattctcagctcccacagcagtccaaacagagcttcgtggagcactcccagaatcgtctaccttcaccatctttggaagccaaagtgaactctccaccctatctaggtctggncgatctcgtgggtgtttattcagcaccggacgaataggtaacctgctctgaacagggggaaagccgcttccagacatangagctgaagcagtctgaaaggaagccgatgctgatgctgccgcagcagctgctgctgcgtccgggccccaangtatgggccaanccccaccccatccaggcgacatccaaggcggcccaggcatccccgnggggcatccctggaatgagagttgatccccagcagattcctg

SEQ ID NO: 9344 - DNA, 763 bp, Physcomitrella patens
  Predicted polypeptide sequence is orthologous to G843
tgattatccaacgtgtaatgaatgtatctaagcgagaaaataatctgtgatctgagagtcccttcataccaatagattacattctatgtgcatgaaagacctctacacttcactctgggcagcacgacttaagattgtggacaaattgcagcagaaactgagaagccacctgagagctcccaatttgcctttctgcctatacagattattatctatgtttctggccagggaccgtgcaaaccccgtttctgtagtgcaaatgttctcaaacgatgtccttgggtgcacctgaggaggccacatttgcatagtacttcacctatccgaagctgacgcagtaggtccatctccttgtatccaaccttttgaaaggagcagttcataaacacgatcagtcttcacgggatccactttaaacatttgatgtgcatcggaccttcgaacttgccccgacttcaagctctccagcatgagatgttccttcatccttaagtaatgagcaggtatgagcctgtgctgtacacatagatcttgctcagtgtgagagagtaagtccacaccaggaaagcctccaagttcaaaagatgctgaagttcttttcgagctctttccaccagaacctgctaggagactgctcccaattggcagaagatggggacctactcgtcctttcgggacctcgcgcgtactgccaggaaatgcagcttccccttccttctccctactcaagtaccgattaactcgatgcgttgaaaatttgcca

SEQ ID NO: 9345 - DNA, 726 bp, Physcomitrella patens
  misc_feature (15)..(16): n is a, c, g, or t
  Predicted polypeptide sequence is orthologous to G896
aacgtttatattatnnttttataataaaacatattacagacattggacaaactgttcgtttgtggtcccgcgaatattacaacttctcacattctggacatcttcgtgagctctcgttgagaatttgagtctttctaacttgagcatttatcaatagaactagtatgttgagaatttgagagtctttctaacttgagcatttatcaatagagctagtatgtcgtccagaccatctagggaaaatctttgaagtttcttaccaattcattatacctcttggttcgtgcccaatttctgatgtcaggcatcggtatccgctcttacaaaggaaatactgatttgaacataaccctcactaaccacaaaactgaagtgtgatggaagttactacttttgtattttgacgcaggctactgcaaattcctgcgactctgacatgctcaaccagggacacgaccttttaggtgtgaccgaggtttaaatgtacaagtttttaacttcacgagcaggtaaaccctttttacgattcacatactgcaataagcacttctcactcggccgccatatcagttaaatcattttaaatattacccacccacgtttcacgttcatagtctaaacggcgttgaaacgtcgaaacatcttgacgatgttagttgtggttccggcgtgtcaccgccttcgtagctgccaccttttagaagcatgtcaatgagtgatgtgacc

SEQ ID NO: 9346 - DNA, 742 bp, Physcomitrella patens
  misc_feature (287)..(287): n is a, c, g, or t
  Predicted polypeptide sequence is orthologous to G896
atttggaactcatcctcatgacaaggatactcatcgcgactgcggactctgagtgctcatctattctacaccatcaacccccatcagttacactacattggtgttacaactaccaaatcacaaccagaagaactaaatcccaagccctttacaaaatcacacccgatgtcgcaagcgtgaacattttcaagattgaaaattgtaagataaccctacaggtggaaaggagagttaatgtcaaacgcctcattcgccgtcaattgcggttcctgagtgagaccaccagncaggctaccacctgataccaacatctccatcaagcttgtgatagtccctgtacccattcccgagttcaccttagttgtgcgaattgcttcacgcatggcgcacaataaactaccatacgtttgagcgtggcccctttcaatcgcttgaataaagcagaaggtcattgcaccagttgacgtgatctttgacagtgccgaagtatcagccgatgtttggctgtcgtcacaaccactgaaagagtaagcttgtcctccactggtacctttccaacggcggttagctggccgatgatcctcccacgtaaattgaccgtatctattgaacctgcaaagaaacggcaagtcgagaacagttccactgtgacaagcgtcgataattgcatgaagtcgcacaccatggggaagaggcttgacgatagtatcattaatttcatcatcaacaatcattcctgccg

SEQ ID NO: 9347 - DNA, 847 bp, Physcomitrella patens
  misc_feature (4)..(4): n is a, c, g, or t
  misc_feature (20)..(20): n is a, c, g, or t
  misc_feature (24)..(25): n is a, c, g, or t
  misc_feature (27)..(27): n is a, c, g, or t
  misc_feature (30)..(30): n is a, c, g, or t
  misc_feature (32)..(32): n is a, c, g, or t
  misc_feature (34)..(34): n is a, c, g, or t
  misc_feature (36)..(36): n is a, c, g, or t
  misc_feature (45)..(45): n is a, c, g, or t
  misc_feature (48)..(48): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (62)..(62): n is a, c, g, or t
  misc_feature (66)..(66): n is a, c, g, or t
  misc_feature (70)..(70): n is a, c, g, or t
  misc_feature (77)..(77): n is a, c, g, or t
  misc_feature (81)..(81): n is a, c, g, or t
  misc_feature (84)..(84): n is a, c, g, or t
  misc_feature (88)..(89): n is a, c, g, or t
  misc_feature (92)..(92): n is a, c, g, or t
  misc_feature (95)..(97): n is a, c, g, or t
  misc_feature (103)..(103): n is a, c, g, or t
  misc_feature (106)..(106): n is a, c, g, or t
  misc_feature (111)..(111): n is a, c, g, or t
  misc_feature (116)..(116): n is a, c, g, or t
  misc_feature (122)..(122): n is a, c, g, or t
  misc_feature (125)..(125): n is a, c, g, or t
  misc_feature (128)..(130): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (149)..(149): n is a, c, g, or t
  misc_feature (153)..(153): n is a, c, g, or t
  misc_feature (156)..(156): n is a, c, g, or t
  misc_feature (162)..(164): n is a, c, g, or t
  misc_feature (171)..(171): n is a, c, g, or t
  misc_feature (177)..(177): n is a, c, g, or t
  misc_feature (197)..(197): n is a, c, g, or t
  misc_feature (203)..(203): n is a, c, g, or t
  misc_feature (210)..(210): n is a, c, g, or t
  misc_feature (221)..(222): n is a, c, g, or t
  misc_feature (224)..(224): n is a, c, g, or t
  misc_feature (238)..(238): n is a, c, g, or t
  misc_feature (241)..(241): n is a, c, g, or t
  misc_feature (250)..(252): n is a, c, g, or t
  misc_feature (255)..(255): n is a, c, g, or t
  misc_feature (258)..(258): n is a, c, g, or t
  misc_feature (265)..(265): n is a, c, g, or t
  misc_feature (272)..(272): n is a, c, g, or t
  misc_feature (275)..(275): n is a, c, g, or t
  misc_feature (282)..(282): n is a, c, g, or t
  misc_feature (286)..(286): n is a, c, g, or t
  misc_feature (291)..(291): n is a, c, g, or t
  misc_feature (295)..(295): n is a, c, g, or t
  misc_feature (300)..(300): n is a, c, g, or t
  misc_feature (312)..(312): n is a, c, g, or t
  misc_feature (318)..(318): n is a, c, g, or t
  misc_feature (326)..(327): n is a, c, g, or t
  misc_feature (337)..(339): n is a, c, g, or t
  misc_feature (347)..(347): n is a, c, g, or t
  misc_feature (352)..(352): n is a, c, g, or t
  misc_feature (357)..(357): n is a, c, g, or t
  misc_feature (361)..(361): n is a, c, g, or t
  misc_feature (367)..(369): n is a, c, g, or t
  misc_feature (373)..(373): n is a, c, g, or t
  misc_feature (379)..(379): n is a, c, g, or t
  misc_feature (389)..(389): n is a, c, g, or t
  misc_feature (393)..(393): n is a, c, g, or t
  misc_feature (397)..(397): n is a, c, g, or t
  misc_feature (400)..(400): n is a, c, g, or t
  misc_feature (404)..(404): n is a, c, g, or t
  misc_feature (407)..(407): n is a, c, g, or t
  misc_feature (415)..(415): n is a, c, g, or t
  misc_feature (427)..(427): n is a, c, g, or t
  misc_feature (436)..(436): n is a, c, g, or t
  misc_feature (446)..(446): n is a, c, g, or t
  misc_feature (514)..(514): n is a, c, g, or t
  misc_feature (536)..(536): n is a, c, g, or t
  misc_feature (540)..(540): n is a, c, g, or t
  misc_feature (552)..(552): n is a, c, g, or t
  misc_feature (575)..(575): n is a, c, g, or t
  misc_feature (587)..(587): n is a, c, g, or t
  misc_feature (619)..(619): n is a, c, g, or t
  misc_feature (664)..(664): n is a, c, g, or t
  misc_feature (845)..(845): n is a, c, g, or t
  Predicted polypeptide sequence is orthologous to G938
tgangcaaatcgataaacgnccannangtnantncnggaaatccnaanttggcatnanananaacntgantttgaangacntcngccnngantgnnntacaantcntcacntgacngtggcntcntannngcacngangangtgaggantcgnaantgagannntaaccantagaantcctaaaagtgccaaggcangtgacntccacantgaaagcaacnncnttgacagagaagantcntcccaaccnnngcntanttcaaanggaccangcnttcaaangtcntccantaantgaantgtttgccaccntgcagnttttttcnnacaggtgtannntgaacaantgcgnttcantgcnttgcannntcangaagcntttggcagcntgcntcangcntgantcnttagggcnttgggtttccangaagtaccnttcccaccgnaagaatgaaccccctcctttcctgaaatttttgaatccctccaagaagggggtgaaagggggaagcantcccgccccgaagacctgcaantgantttggacaccangcggttagcggtcgaaaatgccnatcctccgccanttgatggtcaatctggccttagaatccggccnagaatcaccttgccttcctttcggtgccaagggtgggtggtcaanttccaaggtcctgcctcgcctcaatggtggttttaccttggctcctccacctgcgtttgaagaagggaggcaagctcctgaatggtcgaaggagagcgagacgacccctcccggaggtttgaagcctgtaagcctgggcctccacctccatggtggcctcaggagaaagcggccttgcggncc

SEQ ID NO: 9348 - DNA, 790 bp, Physcomitrella patens
  misc_feature (712)..(712): n is a, c, g, or t
  misc_feature (787)..(787): n is a, c, g, or t
  Predicted polypeptide sequence is orthologous to G975
atggtgtgaaaggaaatcatccgcaatgcatgatgcaaaatgatcttagtcacaacgcattttttttattattattattaagattttctaatttcagagtgcattgcggcaaaacgccttcgcaacaatggatcgagtatctgtctacatgcaaccctatgttgctggcagggaccttctggaacttacgccagaaagaaaccccaaagaatgatagtgaatcgaagagtaaaacaattactctgactatgtacaaaacttccatgtcatttgcaaaaaattcctcgagcatagccgatgagttggagaacagaacacaattgttcgtgctcatcgcacatttctttgccgttgccgttgccgttgccgtgaaagtactcgggcaaagaatagcgactcatctctgatacggcgggctacaacaaaaccgtaagatctactcttacatgcacagaaaggtctccgcccattcggaaatgagaattagaagaaaaaccatagccctcgccccgaagtagaccaatttcaccagatcaccacagaaagaacatcttataaccctctgtgacgcttcgcggcagagacggcttgcttcttgacaaaaggagcaatctcctcccaactaccgcaaggcaactcggggagattttccattgaatcggggaaattcaatggtatcttcttgccagtgtaaaagattccaacatcgtangcccgcgctgcctcctccgccgttttgtacgtccccaaccaaatcttccgcttctgcgccgtggggcctaatttncgt

SEQ ID NO: 9349 - DNA, 783 bp, Physcomitrella patens
  Predicted polypeptide sequence is orthologous to G976
atttctcttcttctgctgctgcacacgtgcaccatgcacacaccaccccaacggctggccataacagccatgaagattgattattattctgaacaaaaccacctacaacctaagtattaactccattgtactgctccgtgtgggcttcgcttcatgctcaagtggttggaactcgtaacctttaagcaactcattcgaacatcaacatcatggcccacatggattggcgagttcgcatccgatggtaattctcagccgaccagtcttgcttgcactgctgggtccaacctagaaccgacgccgctaacgtaaccgtgcctctgtctatctgtcctctctccctctttctttagccggaagaaggtactctcgcacgcttagcagccgaggtcgccctctgcttcacaagggcggcgaagctctcccacggaagctctggggggatggggtagagctgcagctgctgcggcgaatcctcgaaattgtaggggattttcttcttggtgtagaagatgcccacatcatacgcacgcgcggcctcttcaggggtttcatatgtgcccagccagattttgcgcttctgcgatgtgggtcgaatttcggtcacccatttgttcaactcaggccggtgccgaactcctctaaagatagtagtatcgccagtgccaacactcacatcatctgaatcccatgcggatggcaccttattcaaatctatattccgaaatttaagcgcattctgaccgctatcatctcttgccgctaaccgcattcctttcctct

SEQ ID NO: 9350 - DNA, 972 bp, Aquilegia formos X Aquilegia pubescens
  Predicted polypeptide sequence is orthologous to G1006, G22, G28
atccaaaactctctctcgtctcttgcactctcaagtctcaaaacaaaatcccctccctcccaccttaattttatgtaccaatcgaaatattctgattctgattttggtttaattgattcaattagtagacatttacttgaaacttcaaattccaacactatgagtttctcttcatcgaatccttcaatttattgtagaagttcaagttttagtagtttgttcccatgtttaacagaaaactggggtgatttaccattaaaagttgatgattcagaagagatgttagtttatggtgttcttcgtgatgcttttcatgatggttggttaccttgtttagattcttcaaacttaacggtaaattccgttaagtctgaacctatagatcaaagatttcaactacaacaacaacaacaacaacaacaacagcagcagcatcaacaacaacaacaacaacaacaacaacaacaactagctcatcagcatcatcagcttcaaaatgtaatgatgaatacaagaataccggaaaaagcgacgaaacccgttgtcgcaaagccaccagtagtaaaaggaaagcattatagaggagtaagacaaagaccatggggaaaatttgcagctgaaataagagatccggcaaagaatggagctagagtttggcttggaacatttgaaacggctgaagatgcggctttagcttatgatcgagcggcgtttcgaatgcgtggatcacgtgctttgcttaatttcccactcagagttggtttaaatgagtcaatgactcagcaacaaccgattcaaggcacgtcaaagcgttcgtcaccggaatctacgtcatcttctgcgtcattttgtttaacggataatggttcaccgaagagaaggaaaaagagtgttaaatcggagagtcagagcggaggtgaattggtgagtaagttgagtcagtaatagtactgcaatagtgcaatgaatgat

SEQ ID NO: 9351 - DNA, 761 bp, Aquilegia formos X Aquilegia pubescens
  Predicted polypeptide sequence is orthologous to G1033
gattcaacaacacatctctctctctctctttctctctctctctctcttcttcttctttgcaccacacaacacaaaccctaaccctaaagatttcagtatgaaagctgggaaaggaaaggctagtacgactaaaaagaatgatagcaagctttctgtaaaaaaagctgcagcagggaaaaagcctgcaggaaaggcagcgaaagatccaaacaagcctaagaggcctgctagtgctttctttgttttcatggaagattttaggaaaacttacaaggagaaacatcctaccaacaaatctgtctcagttgttggtaaggctggtggtgataaatggaagtctatgtctgatgctgagaaagctccctttgtagctaaagcagagaagaggaaggttgaatacaacaaagtcttgcaggcttacaacaagaaactggccgaaggaaacgatgaagaagatgaagaggagtctgataagtccaagtctgagatcaacgacgaggatgattcagagggtagtgaggaggaggatgatgaagagtagattgggaaaagctgaggagatggaggcataagagatgtgcagttgccatcttctaaattgacaatgttgaattatcaaggaaatagttgttttttcgtttttttttttaatttgggggaaaaaatatttggaagcttgttgaagctcaaattactcttgtacttaaatctctactccatcatcatcatcatgttttaatgactaataggtcgttttcttt

SEQ ID NO: 9352 - DNA, 891 bp, Aquilegia formos X Aquilegia pubescens
  Predicted polypeptide sequence is orthologous to G1048
gttcgtcatctactacaactttatttccaagtgctgaagttcaaaaaacggaatgacgggtggagggtaaaaccatacattatatggaacaaacaactcatgcagcaactgcaccattacagatcatatttttcatctttgatctagaagccttgcacctcttactcttgaaaaaaagtcttaatgttcctaatcctatgctcttactttttgctcttcctagagccacgagatccacgactttttggttctccacgtttaccagcaggtctgctggtagttgcacacggagcatttctggagagaacaggcccaggatgcccaggaaccatagcagggaacccaacagcagggattccaaaaagagtacggcagactcctgcttggttcttgaagcactaaaggccttctcctgtaactgaaaatgtagagcatgattctcagcggcgcaacactggagcaaccgctgcaatctgatgcattcagcttccagatatttgctcttgacctccaaatccttaacatacatctttttcctctctcttgacctcacagcggcatctctattcctcatttgcctcttgcgcttcttggtattgggatcatcgtcctctttgtcctccaaagaagcagagtcagtagttgtaatagtcttttccttttctaaagaggccttttcctggtggtcgtttagttcattgtcttggtcgtcgtcgtcatcatcatcttggaaagaaacttgggattcaggagttgaagtctgagggtcattcaaaatcaaaactggtgtcccaagggtagtaacaacttggttggaggaggaattggatggggaataattggtgttaagaccaggaggaggaggaggagagggaggaacatcatcatcga

SEQ ID NO: 9353 - DNA, 1000 bp, Aquilegia formos X Aquilegia pubescens
  Predicted polypeptide sequence is orthologous to G1062
caaagttatctctttctctctctctctctctctctctttatctgaaaagttgaacaccttttccttctctctctgtaacctctctttgttctttcttcttttcattactctcaatctggtttgctttgtttccccttttttttttttctaaaaataaaacacttttgaaacaaacctctcagaaaaaatgcttccaaggaataataataataatggagttctttggatgcaagaagaagaagaaggtggtgaagtaggagtaggagatggggtttcatggagaaacaatggagtagtattagaaaacaaagaagatatgatgaatagtggtggtggagtgagttcactatctactttcaaatctttacttgaagaagattggtatttaaatactactagtactactactactaataataataataataacaactctatgcaaaacccatctcaccatcaagattttcaaactatgcaaaaccccatttctggagagaatttacttttgcaacaacttgattcttcttcatcttgttcaccttcttctgttttttctcttgacccttcacaagtacattctttcttaccatctaataaatctagtctatcttcacttctcaatgttgtttgtaataacaataacccttttgagaatggttttgatttgggttttgaaccagggtttcttatgggtaatcatcatgcttctacttctcctgttttaatgaataggggaaatgggttgttgactgaattcaatgatttgaactctcaggaacatatgggtagtcatgatttatcttcaaattctcaatttgttaatacccatttgttaccgttgagtgataatagtggaactagtttcaatcctattggttttgggggttttgagagttctgcaaattctttgtttctgaataggcctaagtcttaagacctcttgatagctttcctcctcttggagcacaacctactcttttcaaaagagagctgctcttcg

SEQ ID NO: 9354 - DNA, 952 bp, Aquilegia formos X Aquilegia pubescens
  Predicted polypeptide sequence is orthologous to G1067, G2156
cataacatggtaacatacacactagatctggaaatcgatgagaggaagattgatgattgaaaaatataaaagtgaaagaaaaggcaagacaaaagatccggaaaataaaatgctttgtacatgaagttcaatttactgacctagtggagtcttttctaccatcttgtttatatggaagacctatttcttcaataaataggtatcaacatatcaaaaagcttgcgtcaaaatggtggcctagtagcattaccaccccaaccatatgcatccccaggtaactgtaaatttcccatgttcattcccaaattataaaatgaaacaccactaccacttggaccacctcctcctccaccacttccattagcaccttcccctaattgtgcaccaacacctcccccaccaccagttacacctgaggactgtgacgcggtaggctgtaactgcctaggagactcgtcttcctccaatggtagcctttcaaacacggcatttgcaaatgaagcagccatcaaaaccactggaccagatgccatcaattgcccaacgacactgccaccgacaacctgcccttgtccacctgataaaaatattgtaagcccacctgcacctggaggtgctggtggtgggagaactgtacctgacagtgatagaatttcaaagcgaccgtgcagtgtgactacacctcctgatggagtggccggttggcgtaatgtgacatttacgactgtaccaccaccactgagaacacaaacccctcggcctctttgccttgcgtaattggacacacattccattatgtcagcacctgatgatacttcaagaacatgagatcttagtgcatttgggctatcccgagtgacaattatagggggtttcggtttgttctttgaaccaggaggtcgacctctaggtctgcgggaggcattattacctccaccgggagctagttgta

SEQ ID NO: 9355 - DNA, 939 bp, Aquilegia formos X Aquilegia pubescens
  Predicted polypeptide sequence is orthologous to G1089
tataccttgcacataaattaaatcagttccatttttcttctatttaacaacaaaccaataattacagccgaattgccaactcataatctccctttacacggtataaattttggtaaagagagactataaatcaggaattttaattcctgaaacaaaaacagaaggcaaacaaaatatctgcagataataaacaattagttgactaggctacaaagagccgcctataaataaacttgtctcagcgagctgcttcgacatcacctaatatacaagattactgatacttaaggttctaaaatacctcttctagtgtccattttctgcactgcaataatcatgttgggagtcctctatgaaggaaggtttcccaatcttctcttcatgtattctgttttcactgcattgcaccaactcatcgtacatttttaaagatgccttcgagaactctgtaagtgactcgaaaatagaagaaaatcctgtctgaaatccatttaatgtgatacgctgtgtttcctgcatgtaattgtggtgcttctctttctccttctctagtcttatcctaaatgcgtccaacaggtccttcctttctgtcaaatagtccgcgtgattctgtatttcaagctggccttcctgttctgaaagcttggaaaccaaaagtctattttcggttctctgaaaagcatgaactttcctatcaagttcttttgcgaggccctcaatcttcctcttctggtgctgctcctctccttgctgaccccacaaagccctgacatccttggtaaagcttttcattgaataagctactgatttatctggcaacttctcgagtgaggcaaaccagtcatgacagatcacaagcaatgggggtccagttactcgataaggggggctgaagaccttcccctagagcaaaattcaacctcagggacaatgaacttg

SEQ ID NO: 9356 - DNA, 924 bp, Aquilegia formos X Aquilegia pubescens
  Predicted polypeptide sequence is orthologous to G1133, G1137
gactgccctagcaaatggacctcaagggtggttctatggcttaccccgttatcgccaggccttaacacacattcctgactgtgctcccaaggagctcaatgctcacccagaaggatacaatggggatatcacttcagaagcagcatcaaggccacctgaaaagaaatttattgtttttgatcactctggaaatcaaacaagattgatttatagtcctggcactgattatcccaatcagtgccctgttgttcagaacccaatagcattcgacaatcacagcctccaaatagaggaatggaggattaagaatggccttttgtatggaggcagccccgtttctttcaatggaattgatgagaagagggaatatattgaaactgtggaggaaagtgaaatgcatgaagatactgaggagctaaatgcactactgtattctgatgaagaagatgaatgggattgtgaatgtgatgaagaagttagcacaggtcattcccccagcaaaatgaccagccacattaagccagaaaaaaatgcaagtgctgaagaagttgctagctctggtggctgccatcctaaaaggaagagattacatgatgaagagtatagtgcatcctcacttgtggacactgcaagttcagggaaacctagtggatcatcggagtctgaggatgatgcagaatctagttgtggggggagcagatttgattcattaccagtcaacaaacgtttgaaaagggaaaaaatccgtgagactgttaacatattgcaagacatcattccaggtggaaaggacatggatgcgatttatgtgttggatgaagcaatccaatatttgaggtcccttaaactcaaagccaaatccaatatttgaggtcccttaaattcaaagccaaatctttcggagaaagtttagactaagcagca

SEQ ID NO: 9357 - DNA, 886 bp, Aquilegia formos X Aquilegia pubescens
  Predicted polypeptide sequence is orthologous to G1136
attatcatctaaattctgagctaaattcaggcagaactacaaagccatcaacaactattaacacattcgaacctaaacaacaaccttataaccacccctactttatctcaaaacttattaatcctatatacagagacaataaattaatacaaaaagaggttttttacagcataccgttacagcccgggaacccttcatccaaaagaagatggcgctcttcatcctcttctttgcttttattaaccacctcaatcgctacttcctcaaccagtacaaactatagatatttcgatctgcgtgaggtgttaaacatcccagcttcaacattgtgcaacaatttttggacaattgtatatatagcaatgcaatcaccttgtttcaaaaattctagatgccaaagcagccctgagctgctcaggagtgtaaatccgactagacattttcacatttgtctgttgtaccattagatccttcaccactgacacagtagcataaatcacctccaagtctagatctttcatagcggccattattcgagctgctgggtgattattcttgttgcactgaattcttatcatagcttcccaacccattatctttacatcaatttctgcctctgctgacttctttccatgttgatctatggtccttagatctctatcagactgtaactgtggcagtggaactggtcgaggttctttgctggctagttctttcttcaaggaatccacttcagcttccaacccatccttatctgactctgcagtttggagtttagttctgagctcattgatgtaagaaattgcgtcaccaagtagagaagctttgtccatcttcgaaacattaggaacaacagccctaagggcatagaatctctggttaagct

SEQ ID NO: 9358 - DNA, 946 bp, Aquilegia formos X Aquilegia pubescens
  Predicted polypeptide sequence is orthologous to G1140
gagaaatacagatagaaagagtctttgtcttgctatataaagtagttttcttcattaaattcaacacttttgaaccacttcttactccattctcattggtgtgttttcagagcttttgattcgtcagcaactatcacccaatcagtttggtaacaaaagcaataacatccaatagacaaatacccatctctctctattagggtttggtgttggtcactaaatttggaaaaatgccgctcattttggggcttttttggttgatttattgaacacaccaaaatatctgttgggtttagaaagataagtttcttaattagtgatatattggtttggtttggttctggtttttgttctttgtgcaaagagggtttttattgattttggaaagtggaattttgattttggacaagatggtgagggaaaaaatccagaccaagaagattgacaatactactgcaagacaagtgactttttctaagagaagaagagggttattaaagaaagctcatgaactttctattctttgtgatgctgaagttgctctcatcatcttctctgctactggcaagctttttgagtattctagctcaagtatgggtgagattcttgaaaggcaaagtttgcactcaaagaaccttcaaaagcttgaccaaccatctcttgagttgcagctagagaataacaactatgctagattgagcaaggaaattgccgagaagagccatcaattaaggcaaatgagggggagaagagctgcgagaattaaatattgaagagctgcaacagttagaaaaatcacttgaaacaggcctgagtcgtgtgcttgaaactaagagtgataaaataatgaaagaaatcagtactcttcatacaaagggaatgctactgatggaagagaatgaacgattagaaaacaagtggtagatatgtccagtgaacaaggaaa

SEQ ID NO: 9359 - DNA, 922 bp, Aquilegia formos X Aquilegia pubescens
  Predicted polypeptide sequence is orthologous to G1146
tatattaatctgcaatataaaactagttcttcgaaagttcagatattgaagtttcaacaacggcagacattaaagagtttaaaaaataaaacatatctttcacattatccctgatgatgagaagcgggtgtgcctctccatttacttaagtaccagcatgcttccacagacgaacaaattccaaaatatggcagatatatgtatcaactacagaacttgttagaattgccactttttttttctctggaatttccacgaccatgttcttcagaaaagctgtggtgtcttttccgcataactacaaagaaaacaagggggagatttttcttcttcaataaaagaatatgccttccataaagcaggacaaaactgaactggccttcactgacacccaattctatgcggcttgaaactagttgatctcctgaacaaaatcaacagctcccaaatcattactgaatgaactgcaccattccaagaatcatgtaaagatcttgaatcaactcttgctgatgggtttcgctgataccagattaccagacctctgtatttttgttacctctggccagtccatgcacgccaccccatgttgtattgaaggactagaatcttcaccaaatggggatgagtaacatcaacatcaaaataatagggactgtccgtcaccattggaattttaagaagtgcatccaatagaatgtgtttcaaccaccagcctttcacgttggtctttagagccattttcatggtactccttgctcaatgacctgtatctccatacaaagtgtttcttcaaaatacgagaaatatttttcaattgcaatatctcgtaatgaatctgagcatgtcgatgaccaggttctgctgcagtgatgtcaactactaacgtcatataaaagaatctctctcatgatgtcatttt

SEQ ID NO: 9360 - DNA, 877 bp, Aquilegia formos X Aquilegia pubescens
  Predicted polypeptide sequence is orthologous to G1146
tttgaaatcacggtaccatgagttgcatgaccaaagtccagcgcaaagaactggacttactaattgttattttgccagacaataatggttctctttatggtgatttgaaacgaatatgtgagacagatcttggtcttgtttcacagtgttgtttaacaaagcatgtttttaggatgagtaagcagtatatggcaaatgtagctcttaagattaatgtgaaggttggtggaaggaacacagtgcttgttgatgcgttgtcaaggcgcatacctttggttagtgatcgacctactatcatttttggtgctgatgttactcatcctcatcctggagaggactcaagcccgtcaattgcagctgttgtcgcttctcaagattggccagaagttactaaatatgctggtttggtatgtgctcaagcccatcgccaagaactcattcaagatctttacaaaacctggcatgatcctgttaaaggaactatgcatgggggcatggtgaaggaacttttgatatccttccgcagagcaactggacagaagcctgagcgcattatcttttacagggatggggtcagcgagggacagttttaccaggtcttgctgtatgagctggatgcaattagaaaggcatgtgcctccctggagccgaattaccagccacctgttacttttgttgtggttcagaagcgtcaccacacacgactatttgcgaacaaccatgcagatcgtcgtgcagtggacaaaagtggcaacattttgccaggaacggtggtagactcaaagatctgtcatccgacagagtttgacttttatctttgcagtcacgctgggatacagggcactagtcgtccagcccattatcatgttctctggga

SEQ ID NO: 9361 - DNA, 997 bp, Aquilegia formos X Aquilegia pubescens
  Predicted polypeptide sequence is orthologous to G1146
tactaatttactatagtctggaataaaaaatcacacttgaaactccacaatcaacaagaaaataaaccgattacaaatccacaggttccagggaagaatccttaaagagatcttcttacaaaaccaagagcttctaataaagctcattcttaacaaaataacacaatgttcaaatcatttcacaaagatggaaagttgttggacagtaatatcaatttaagggctttgagcacacacacagctttatttcatttctccagacacagctcaccattaacaataaaatgttaagttcttcagattgtcacaaaggggcggaagttgtttaacttgggcatctgcaacttggtgaatcttgctgtctctgactgagctttcttcagaaaatgagccctcctcaaagtagaatcgtgcacgaaaagcagccagatgagcataatatgctggtgacacataggagaccgaacgtgtgcaccttgcatatatgtaacacaggttattggtgagggtttgaagttgatctgccgtgaactgattatcatcacatagaacatggtaatgagcaggacggctcgtggcctgaataccagcatggctacacaagtagaagttgaattgtgttgggtggcagatatctgaatccaccacagttccaggatatatatttccgctcctgtctacagacgagaaatcatcatggttccagggaaataacttggtatgatgtcgtttttggaccaccacaaatgttataggaggcacaacagattccttgaattcattcctccatgcctcccgaattgcttctagctcatactcgcggacttgattaaattgtccgtcactaacaccatccctgtagaatatgatcctttcacgcctccgctgattgttcttctcaaaagcgtgaaaatgttccttggccattctttccagatctaggatcttttcctcacgaccaagttgtgctgacagtataggaatataatttgtgaca

SEQ ID NO: 9362 - DNA, 972 bp, Aquilegia formos X Aquilegia pubescens
  Predicted polypeptide sequence is orthologous to G1146
atagcatgcagagtcatacttgggtggtgaatgtatagcagaacatgagttgggacaaaaccaataaaaactggtatctgaacaagtatttccctctgccacatctagcagtcaaaactaataaaaacggatatctgaacaagtatttccctcttagccacatctagcagtaaaacatgactttcttcacattatctttgagtgccgggagggctctcactgctccatttccaccaggggccctagtagtgcggccaccaacacctgaaccaccacgaccacctgctgcaccactagataaggaaccactatcagaggcatcaggctccatgtaaaaacgtgcacggaaagctgccaaatgagcgtagtatgctggggggactatagaaacagaacgggtgcaccttgcatacgtataacagaggttattcgtgagtgactggagtccatcggcagtaaagttgttctcatcccataatacatgataatgggcaggacggcttgtgccctgtattccagcatggctacacaaataaaagtcaaattcagttggatggcaaatcttggagtccaccaccgtacctggtaatatatttccgctcctatcaattgtgcgccggtcagcatgattattagcaaacaaccttgtatgatggcgcttttgaacaacgacaaatgtcaccctgggctgataatttggctccagagaagcacatgccttacgaatcgcatccagttcatatagcaagacttgataaaattgtccttcactgactccatccctgtagaatatgattcgtgaaggttttcgtccagtagctttatgaaaagatctcaaaagatccttgatcatgcctcctgtcattgtaccttttgcggatcgttccagactttatacagatcttggatcattcctggcgatgagcttgagcacaaaccaaaccagcatactttgtgacctcagccatcttg

SEQ ID NO: 9363 - DNA, 943 bp, Aquilegia formos X Aquilegia pubescens
  Predicted polypeptide sequence is orthologous to G1146
tgagcatatacacaacaagagatacatcaattgatagtggacaatgatttactaggaacattaactccacaagttctatttttaacagtaaaacattactctcttcacattgtccttcactgcgggtaacggcctcacaccaacctcccctgctccccgtgtagcacgcacagatggttggctaccacccgttgagttgttttcttgtaagtctggctccatgtaaaatctagctcgaaatgctgctaagtgtgcataataagcgggtggaacaactgagacagagcgcgtacaccttgcatacgtgtaacacaaattgtttgtcagggattgaattccgtcagctgtaaagtggttttcgtcccataaaacatggtaatgagcaggtctgcttgtgccctgtatcccagcatggctgcagagataaaaatcaaactcagtcggatgacatatttttgagtcaaccacagttccaggtaaaatattcccgctcttgtcaatactgctgcggtccttgtggttattagcaaacaatctagtatgatgtcttttctgtactatgacaaaagtcactggtggttggtaatttggttctaaagaagcacaagccttcctaattgcatctaactcatagagtaggacttgataaaattgcccttcacttacaccatccctgtagaatataatcctttgcggtttttgacccgttgcctttcgaaatgaaatcaaaagatcccttatcatcccaccactaacagtgccgcgcacaggatcgtgccaggtcttgaacaagtcttgtatgagttcctgtctgtgagcttgggcacaaactaaaccagcatattttgtgacctcaggccagtcctgagaagcaactacagccgcaattgaagggcttgaatcttctccattctcccggtgggtgacatctgctccaaatata

SEQ ID NO: 9364 - DNA, 847 bp, Aquilegia formos X Aquilegia pubescens
  Predicted polypeptide sequence is orthologous to G1198, G1806, G558
cagaaacacttgcttccaccaactaatctagctctggcattcaaacagggcctactacaacttatataatttataacaaacagtgcctactacaacttacagtgactattgttctaaaggtgatcactaaattaaacatacaacaccttggtgactagattttgctgctgttacaacttacaggagattagaacttgtgctactatcgtgctttccatagacatttgacagcttttcagaacagcgtcgagttcaagctggagttgcaagccggaccaagatactcattgtggttcagtgactcttgaatgctacctgccatttccttaaatacgttcagacaaaataaacaaatggccctctcactcccttggacgtgccaaccacagagaactaagtgcacggagccgagaaaaatagtctgtaatagcaagaagagcacgtgcagattgccgggttgtcaatattcgatgcatttgttgcagtgtttgttgcctcaggttgtcagcctggtgaaggaatccctcgagagtttcaagcttccccatggccatggccatctgacccatatagttcgccacgttccctgatgttcccgatgtgccaggagaaccactagctaatgtctcagccagagattgttgcaaagcttccataccctgtgacaatgcatcctccgcctgttgagatgattgctgcagctcgcagattcccattagctgttgctctgtcagaggctccaaatgatttacaagaagcttcagtagctctgatgaacggaaaccaccaagccagagaaacacctttctgcagtgtcttccacatgccagatagcatatggatacat

SEQ ID NO: 9365 - DNA, 758 bp, Aquilegia formos X Aquilegia pubescens
  Predicted polypeptide sequence is orthologous to G1198, G1806, G558
aattttgattatataacaaacagcaatacatgcatattatttcaactacagcttcaaacataactaaattacagcacctaatttgaccacataatgactgttacatgtaagaggtgaaatggcatatttatgatcacaataccaccatggggtcctagaacggtcaaacagattggcacacttccaaaactgggaagcatacactgaccatggaggatgaaactattgctgtgtaatcatctgatccatcatctcttgaattgttaggaaattacacttacagggcctctcattcttttggtcgggccaaccatagagaactaagagcacggagcctagaaaaataatcatgtatagcaaggagagcacgcgctgactggcgggttgtcaaaatccggtgcatttgttgaagtgtttgctgccgcagattatcagcctggcgaaggaaaccctccagagttccaagctttcccatagccattgccatctggcccatgtagtttgccacattcccagatgaccccgaggggccaagagaaccactggccaacgtctcagccaatgactgctgtaatgcctccattccctgtgataaggcatcctcagcctgttgggatgactgctgcaagttgcagatgcccactaattgctgctcagtaagaggctccaattggttcaccagaagcttgaggagttcagatgagcgaaagccaccaagccacatgaaacacctctctgctggagttttccacataccc

SEQ ID NO: 9366 - DNA, 961 bp, Aquilegia formos X Aquilegia pubescens
  Predicted polypeptide sequence is orthologous to G1198, G1806, G558
gtaaattgcaaatgacatttcattgatttacatgtacaagatctcatctctagctttccatgcatcttcattttctcctttcaatagcttgaaaacatctgatggccatgaaatggtgatgaaaatgcaaagttgatcatttgtagtttgtttcattctcttgatcaataatttgaaaaatggctctgttgatgttgaaccatttgtaaatcagatgttgtctgacatgagttatcatcgctgatcatgtgttctcgtggtcgtgatgcccacaacgaactgagtgcacgtaatctgttgtagtactcaccaattgccagaaaacaccgtgctgcctgtcgaactgtcaatattcggcgtaactgatgaagggtttgttgtcttaaattatcagcctgatgaacaaagccttcaagattggagagtttccctagagcaagagccatctgacccatgtaatcgtcaacattggatccatcgcatagggacccagtagcaatggtatcggccaaagattgatggagctgctcaaggccttgggacagagcatcttctgcttgttgtgaggattgttgtaggttacatattcccattaactgctgctcagttaatgggtctaactgaggcatcaatatcttgatgagttcagacggacgaaaaccacccatccagaggaaacaacgttcagctggagtgatccacattccagtgatgagatggaaaacatcggatttagctgcaattcccttaagtcgaaaaatttcatcatagtgagacagatatccatctgttatcatccttagatcaccatcagataggtgagcttgcaatgcagtccgcagctctgacatgtgcctatgatcatcttctaaccatcttgcatattccatgtcaagatagcagcatctgagctgagacttccacctgcaccacctcctgctagaataatccctgagatctg

SEQ ID NO: 9367 - DNA, 954 bp, Aquilegia formos X Aquilegia pubescens
  Predicted polypeptide sequence is orthologous to G1272
cagcctctccatcagtgatgggaacatgaccagagtacatatgactgtttgaattagaaacaacagggaggcatacaaaattggactcccaagtcttaacagaaaaacatagaacttcgaactttctcatgaagattggactcccaagtcctaacagaaaaacatagaacttcgaactttctcatgaagcctagggagctgtgcaacagggacaggtcctgcagatgtgatcccatgagaggatgatgaatcagaagatgaatcgtcaaacttgatgaactgccccatctgtgcagcagcaaggtgagcatagcagataggtgccacaattgaaatagcagttgtgctgcgctgatacacataggaaagcgagtgcacaagattctgcaattcatcagcagagaagccaatctcatcaagcaagacatggtagtgtgctggacgggatgtcccaattgctccattgtgagcacacatgtaaaagtcatagttcctaggatgcacaatctgcgtatctaccacagttccaggaggaacattgtttgggtcgttggattggaaaagctttgtgtgatggttcttttgagccacaatcaatgtaatcttcggaattctggtataacctaaatgctcaactgccttaacgatttgctccagctcaatgttcagaacttgaggaaactgagactcgcttactccatccctgaagattatgatctgctcaggcttgcgtccttgacttgacttgtaaaactcaaccagtaattcccttataatgccatcatcctccccatttggtagaagtttgaacaaagaatcaatcatctccacctttggtgattgggttcttacagatgccctgtatcttgagatcagcggccaagatcttgaaccaacaacagcagcaatagatggaacatctgattgaccaggagacccatgagatacatccat

SEQ ID NO: 9368 - DNA, 932 bp, Aquilegia formos X Aquilegia pubescens
  Predicted polypeptide sequence is orthologous to G1272
cttatcaactcatttcacgagagagaaacaagcttgttgattgaatctgtcttcttctcgccgcaatgaaaaaaccctagaaatcgatctgtgcatctattcaactataatatggagaaattagtatctgaagaaacaggagtaacacgacctcctcctgcccctaatttaccactatatgcgatggcagaaaataactttgcttatgatggtgagaaagccttgtacacaaggggtgcaataccccaaaaacaaatggagtttactgtgaaacgttttgggagccctggtgctgcaaaaataccaatgggactagtagctctaactttcaaaggatttgaaatagaaaacactggagatgcacttggactagtaattgatattatcttgagacaacaagcagctaaaaggtgttttcttgttcagaagtcctttcatgatgatgtcagggacatggttgatgtcggaggagcgactgcttgccgtggttttcactctagattccgtactactcagggtggattatcattaaatatggatgtctcttccaccatgatcttaactcttggtcctgtgtttacaaacccaaatttggaggaccctcgacatattgattggggaaaggccaaggaaatgctgaagaatatgagagtgaaggctagacatagcagcatggaattcaagatcattggaatcagtgagaaagcttgcagtcatcaatactttcccatgaaaatgaggagtgaagatggttctacagaagaaattgttgacatcattgaatatgagtgctttgtcaagaatcggaagattggactggataattctgcatacattccaaagtgtcccaattatcttcccttggagctctgtttcatagtttcattgcggcaatacacaaaagctttgtctagtatgcagagagcatcctt

SEQ ID NO: 9369 - DNA, 221 bp, Aquilegia formos X Aquilegia pubescens
  Predicted polypeptide sequence is orthologous to G1272
tttagctgcctgttgcctcaatataatatcgattactctaagtgcgtctccagtcttatctgcttcgagtcccttcagagctaaaacaattggtcttatcggtatttttgcggagaaactgatctcaacattgaaggttttggactgaaaagatcgctttgctctcttaaaaccagtttcaccgcgactctcagtcaaactaggactcccattacgtttca

SEQ ID NO: 9370 - DNA, 981 bp, Aquilegia formos X Aquilegia pubescens
  Predicted polypeptide sequence is orthologous to G1272
tgaagggcaaactgtgttgtctggaactaagctaagcctaagtactgcttcaaaataacaaatattgttttgacaagaactagttcaaaatgctttcaaaattttctatatacactcaagtaaattatagccaggtccataaccttaacagaagaacatggaagtcctcacattctcatgaagcctagggagctctggaacattgacaggacctgcagaagtaatcccaggcaaggatgatgaatcggaagacagatcctcaaactttatgaactgtccaatctgtgcggcagcaaggtgagcgtaacagataggtgccacgattgagatggcagtcgtgctgcgttaatatacataggaaagagaatgcacaaggttttgcaaatcatcaggagaaaagccaatctcgtcaagcaggacatggtaatgagctgggcgggaggttccaatcattccattctgtgcgcacatgtaaaagtcataattccttgaatgcacaattcgagtatccaccacagttccaggaggaacattgtttgggtcatttgcttgaaaaagcttcgtgtggtggttcttttgagccacaatcaatgtaaactttggaagcttagtgacacctaaaagctcaagtgcctttatgatttgctccagttcaatgttgagaacttggttgaattgagactcgccaactccatccctaaagattataatctgttcaggcttgcgtcctcgacttgactcataaaattcaaccagtagttcttttataatgccatcatcctttccatttggtagaagcttgaacaaggaatcaatcatctcaccttcggagattgtgtccttactgatgccctgtatcttgatattagtggccaagatctcgaaccaacaacagcggcatggatggcatgtctgattgaccaggtgacatgggatacgtccatccccagatcatgttggatgtcctagagtgagagtttc

SEQ ID NO: 9371 - DNA, 930 bp, Aquilegia formos X Aquilegia pubescens
  Predicted polypeptide sequence is orthologous to G1313
tgagtagcatattcccctttacgagggcagattattctacaactgtcattctgaggaaaaaagaaaagattctgcattaagttttttaccttaccatgtcctggttccatatatctgcattgtattatgtgggaagcatggcattccacaactaacacacagaaacaaatcaaccgcaaatttggtgaattatgataccctaacatgtcatccttactgacctctttatcaaggacacaccaagtctaaatgccaacattaaacaaatcttcggcatgaattcaggggagttcagacatttgacagactgctggcaagttattccagaaataagaaccaccgccccatccttgatttgacgatgcagcaggaatttgcttgtaatcgccatagaaatcttctccaataaatgttgatatggcatcagcaagaactgattggtccttagcacattcagaacgctgctcaaaccacgccccatcaagcaaagcatcaggccttggaaagctcaactggggggttatttgcctcccttcgtctggagtggtaacatgctcgattggttcttgcttaacttcagatccacacaaggctctgtcagcaggagtttcatccaatgaacttccgctagcaggagtgcattcactaaaaactgatgcggcagaacggcccaaaggagagatgggatcaccatattcttcccattcagcctcacaaacatttagtgccgaactgtccactatatcacctggtgtgactacacatgaatttgaactcttctcagatgattgattctttgcactacttaacgtctgagattcatgaagtaatgcatccaacacgccactgtttcgtggggaaacacagtcagattgcactggcctagtcggagaaggagattgtataaaggcatcaacagaatcgagagat

SEQ ID NO: 9372 - DNA, 903 bp, Aquilegia formos X Aquilegia pubescens
  Predicted polypeptide sequence is orthologous to G1335
ggtaacagttaaagttatccctccaaaaatacaggcttttgagaaaagagagaaaaacaaaagatgttaaccatttcatactacattgccttgtcaggagttgaaacattttcctactaaatatcttttccttccacgatagttagccagcacttccccttcagttgaaccttctaccaccatcaccaacttccatttccaaattgacaatcccttcccaaaatgtacattgccaccacagtagtaacattcaacaaaacctccatctacgttgcttccaataccttcggagtatcagactctcagtaagtttggcaaccatcaccactggtgccacttcccgtatgagaatagttcggcacagaatatcctgtcccatgacgatcagaagaataggcactgctaccatactcgttccagccatcactacgacgttctctcccaacaatataactgcaatcgtttgctcttctaatagtactccgaggaaaggaactttcaagacatctaatattgacagccatctttattccacacaccccaattttaatctcaaactctacaacatctcctttggcgagggagctttggtaatccttggatgccaatgaaaagcgattgaagaacagcgtatcgcctcccctgtcaggagcaatggatccataactcttcttggtgttgatccacttcacaactccggtcaacctagatgcctgcatgatcgcttgataggggagtgtatttgaatcacaattcaagggctgcgaacgagtgattgctggatgcttgggaggtacatttgagaaagtagtcttatgtttatttgattctggcaaacttgctagtttttcttgcttggaacatctttgttttctccatttttcctccttgtcagatgaatgg

SEQ ID NO: 9373 - DNA, 908 bp, Aquilegia formos X Aquilegia pubescens
  Predicted polypeptide sequence is orthologous to G1341
gaggctgctacttccagccattgttctacaatcgaaagactctatgcttgggagaagaaactatttgaggaggtcaagaatgccgagagtatcaaaatagaacatgagaagagggtagaacaactgaggaagcaagagctaaaaggggctgattacataaagattgataagagcaagaaagaaattgagaagttagactcaatgatgcaagtggcaactcaagctatagaaaccacatcatctgaaatcataagagtgagggaaatagagctatttccacaactccttgaactagtcaaagggttgacgggcatgtggagaagcatgtatgagtgccaccaggtccaaacccatatagttgagcagctcagattcctcaacactattccatctactgatcccacctctgaaatccatcgtcaatcaactcttcagctcgagctcgaggtccaacagtggcatcttgcgttctgcgatcttgtcaaatcccagagagattacatacagtctctaactggctggctccgcctcagtttgttccagtttaacaatgagcaactaagcaaagccagacaaaattctgcaatctattccctatgtgaagaatggcagctagcacttgacagggttccagacaaggtggcctctgaggggatcaagggcctattaactgtaatccatgccattgtagttcaacaggcagatgagtataagcaaaagaagaaatcagaggctgcatttaaggagctagaaaagaaagttgttgagcttcgatctttggaatgtaaatacggaccatatgcaacagctgaaagttatgggtctaggaagatcaaaaatccagttgcagagaagcaagcaaatgttgacatattgagggtaaaggcagaggaggaaaagaccaaaca

SEQ ID NO: 9374 - DNA, 864 bp, Aquilegia formos X Aquilegia pubescens
  Predicted polypeptide sequence is orthologous to G137, G145
cggctatatgccttgttattttattgtcagtacaaattttatttgtattggattcagtctggtacggtagaattgtggcaatcattagaatttgaagcaacaacatatactatcatggctgattaaggacaacctcgctggtaggtatcgctacaagaaaatatatttctgacctcaaaccatccaaccagggatgaaaccattgatgttttgagctggtgctgcaactgtaatctgttctggacccacatggttgtaaccaacatgcaatgttgaattgcatcccaaaggctggaaaaattcctcagattgagcaggttgacggcaatatggaatgttctgttcaccagatgcccatggtagtctaagggcattttctgcaatgcgctcatctagctttcttcttaaagaactgtttgcctcttctaaaacttgctccttcccttgaagatcagaaagctgatcgagcataaattgagtcttggtacacctaatttgttttagcgacatatccagttgatgctcaagttgatcaagctccttagtacttaatgagcccaactcttccccaagaaggttcctctgagattgttgtagaatttcaactcttgcttttagcctcaaatattcttggtagttgttctgtgtttctttggctgatgtgctcgtttccaatgctgcataactggatttttggtacttatcaagtgtcttcaacatgcttgaagtactgcagaactcatagagtttaccacgagtagagaagataatgagagcaacttcagcatcacatagcactgataattcataagctttcttcaataatccatttcttctttttgcaaatgttacttgacgatttat

SEQ ID NO: 9375 - DNA, 881 bp, Aquilegia formos X Aquilegia pubescens
  Predicted polypeptide sequence is orthologous to G137, G145
gattatagcaaaactgcaagtgcttctgcacttataagtgctgaaaatgatgtatgttactacaaccaaagttcatcattcatgctttatcaatttggccccatgtttcatgactgccagtaccacatactggaaaggaagaagtgcttctgcactcatccttagatacacacaccaacgcaaaagcaatacccttgtttgatttcatttgcaactacaatacaagtttctgcaacatagaatgaccaaaatatacttagtaggcatttcttctggcgcgcctaataaaggtcatgcttacaaacttagagcatccatccagggatgaagccattatggctttgggttcgaggcagaacatttgtatggtctggaccttcaggattggatcgtatttgcattgttgaattgcattctaaaggctggaagaatctctctggttgaagggtctgagtctgatggttaaatggagtatgtttatgtcctgcttcccataggagttgaagtggatcgtgactgtctgcagctttttcatccaacttctttttcaacgttttgttagcttctcgcagcatctgttccttcttttgaagctccataagctgatcaaacatgaaatgggtccttgttgatctgattactttaagagatgactccagttgatgctcaatctgatcaagttcctttatacttaatggatccaagtcttcaccaagcagatttctttgacactgttgtagaacttcatactttccttttagcctcacatattcctgatagctactcaactcagtatcatttgcacgtggagtatcttctaacgccccgtagctgcttcttcggtacctctcaagtgtctttaacatgcttgagctgctgca

SEQ ID NO: 9376 - DNA, 851 bp, Aquilegia formos X Aquilegia pubescens
  Predicted polypeptide sequence is orthologous to G137, G145
ataattataggaaattttcaaatcttaatggggaatagaaacttcaaggaataattcaggccatagttcactccgcggtgagatctgagaacatatttctcaaacacttataaaattaatttttatctttaatctctcaaaaacctagctagagctgcttaagtttagaaagaaagtactaagctataccataatgtacatctactgatccacaatcatcatcaacatcctaaatttgaaactaatacagtaattagcaatgaaacattatgaatgttcataaaatcacaaaaaataatccaaaataacaagcaattacgcgcttatttaacctaaaaaaagttaattagctgatctagagttgtacacacagcaaaccctataaaagattttgttattacaatgattatgattaataatatataagtagtttaatagtgagtaactaattaaatctcaaacgtacagatctctctctatatcacagaaaacaagacactttggaaacaaaataaaaactttttcctcaaagctataatcaagaattactagtagatctataaaaaaacaataaacataaaacgacagatcagttcatatagaagaagaagaagaagaagaagaagaagaagaagaagaagaagaagaagaagaagaagagagaaaaaaagaaagagtatatatatatatatagctactaggtagctagctagtagtagtactataccttgaagtactgcagaactcatagagtttaccacgagtagagaagataatgagagcaacttcagcatcacaaagcactgataattcataagctttcttcaataatccatttcttctttttgcaa

SEQ ID NO: 9377 - DNA, 934 bp, Aquilegia formos X Aquilegia pubescens
  Predicted polypeptide sequence is orthologous to G137, G145
agagtgttgaaaagaagaaacagatttgattgtgttttgtttactctagctatctagtttctttctttctttcttcttgtgttacgtttgtttgtgtattaatttaaaaatgggaagaggaagagttgagttgaagagaattgaaaacaaaatcaacagacaagttaccttcgctaaacgtagaaatggtcttttgaagaaagcttatgaactttctgttctttgtgatgctgaagttgctcttattattttctctaatagaggaaaactttatgagttttgcagtagttcaagcatgcttaaaactctcgagaggtaccagaaatgtagctatggaggaccagagcccaatgtatctgcacgggaggcacaggagcatagtagccatcaagaatatctgaggctcaaaggaaaagtagagtccctacaacgtactcaaaggaaccttctgggtgaggatttgggaccattgagtggaaaggagctggagacactcgagaggcagctggactcgtctttgaggcaaatcagatcaactaggacgcagtacatgttagatcagcttactgaccttcagagaagggaacaaatgctcagtgaagcaaacaaaaacttgagaagaaggttggaggaaggtacccaaccaaatcatcatcattgggacccaaacatgcacaatggtgtgacctttgctcggcagcaggctcaggctcagggtgaagggtttttccaccctttagaatgtgaacccacattacagattggatcatatcagaatgaaccaataagtgttgccacagccgggccaagcatgaataattacatgcaagttggttgggttgacatgcagttgaaagctcttccgcgagtggtgtctctcgtaccttaagaggctagctttaagcttattctgacaaagctaggaacagaaatg

SEQ ID NO: 9378 - DNA, 919 bp, Aquilegia formos X Aquilegia pubescens
  Predicted polypeptide sequence is orthologous to G1382
gctcaactttctcctatggccaaaagtataaacttatctaacaaggatttccatatactatttcaatatagataatatctatacacaagcctccatcttacaaggtcaatgtaatatacagcaacaaacagcattcagatggagtacgagctggatcagttgatacaacagcagctctaagatagaaagccacaacagcaagagtgttatgacctcaacacagcaaatccctgtataccatgacgtacttcccagatatattattgttcgcgaaaccacaggaaaattttatggccgcatcattaatcttcccacattttgttgatatggattagaagaatggtttaatggccgagtttcaaagctaaagctttcacccacgacttgccttgatccaaactgatctgtgccattgccttgccttgatccatactgatctgtgccattaccttgtcttgatccatactgatctgtgccattaccttgccttgatccatactgatctgtgccattactggaatatgcttgaatcatcctactagaaccaggatcagtaatataggagtaactacggagaggttctacatccattgcttgctgcatctcatttgatctattctctgggctcgagctgattccaacacctaaatcaagactaatagtgtcaatttcctctgatctggtcctcaacatgctatttggagctgtatgatatagtgtgggaccggctgtatcatgagcactagtcctcgcagcaggtacatcatgattatgctttccctcgtatgtggttatgactgcttttggatcgtgtgatgccctctctacgtgttttctaactggacaaccagcatttgtgcatttgtagtaactcctcggattgggatttcctttcaccactttctgcccatattttcgc

SEQ ID NO: 9379 - DNA, 952 bp, Aquilegia formos X Aquilegia pubescens
  Predicted polypeptide sequence is orthologous to G1382
cagaattggcatctctcagatagatatccaaattccaaacaagcctacattatcagggtaatgcggccctcgtaaatatctacatggatcttatttgttacaattcattggaacaatttcccaagccattattaactctccaagttttctgtgttgttcggataaaccaattgagtcgaagatggagtgtcaaagcttaagccttgatctgcatccagatctagctcatcattatgtgccaaaactggggcaggctcaatcatcttattcctatccagatctgtaatggtggattgactttctataggttccacatcaattatttcttccctctcacaaattctattttcaagactcaagccattcacgactccagcatctatcccatttgcgataagttctccggatctggtttttaatgtgtcatttaaaccgtccgcactgctaacgagacctgttgtatcatgcgtagttatccttgccagaggtaaatcgtggttatgttttccctcatatgttgttataactgcctttggattatttgctgctctctctacatgcttcttaacttggcatccaccatttgaacatctgtagtaattccttgggttagagttgcctttcactattttccgtccatatttttgccaacggtacccatcatccaccacatcaacctcacttagagtttcaacaacaacacgaggttccctgggagttctaataactggagtaagatcgacatcacctacgtctttcttccttcttttagattccatgtcgatatcatcctcaacctcattgccacgtttcaatttttcggccgtagtatcgaaattttcaacacttcgtgtgactggagtgagcttggggattcgacttgggttggtacaagcacatgtttggacaggtccatttgatggattatcacctgagccgtcagaaattctat

SEQ ID NO: 9380 - DNA, 945 bp, Aquilegia formos X Aquilegia pubescens
  Predicted polypeptide sequence is orthologous to G140, G146
tgcaagtgcaactcagttcagttcaaaaacgtcttattcactccattaaaatctctctttccataagtccttttctccccttcttctctcttctcttccaatgcctcatccatcacacacatctattggaaatggatgcttaatcacggattttccgagtctagcaattgcgggtgattccccccaaagaaaaatgggaagaggaaagattgaaattaaaaggatcgaaaacactactaatcgacaagttacattctgtaagcgtcgaaatggattactgaaaaaagcttatgaattatctgttttatgtgaagctgaagtagcccttatcgtcttctctagccgcggtcgcctttatgagtactcaaacaacagtgtcaaaaaaacaattgagaggtacaagaaggcttgcacagactctaccaactctggatctgtttctgaagctaatgcacagttttaccagcaagaagtgacaaaactgcgtaatcagatagccagtttacaaaaccataacaggaacttgttgggagagtctctcagtaatctcaatatcagggacctcaagccaatcgagaaaaagattgagggtggcatcagcaaaatccgagccaaaaagaatgaactgctgtttgctgagatcgagtatatgcagaagagggaactagacttgcagactgacaataagtatctcagggcaatgattgctgcaaacgagagagcccctgaacatatgaacctgatgcctgcaaatgaatatcacgccctgtcttctgcaccctttgattctcggaactttatgcctgcaaacctattggatcacaataacaattattctcgctcagatcaaacgacacttcaacttgggtgatattctgtgaaagcttttgctgcccgctgtctttatctctccctatcttataaatgtagatcaaatctactatc

SEQ ID NO: 9381 - DNA, 1027 bp, Aquilegia formos X Aquilegia pubescens
  Predicted polypeptide sequence is orthologous to G1421, G1750, G440
catttcttcaaataatcttcaacacctaaagatgaagacttgaaatcttcattataacaaggaaaatctccaaaatctccaaaatcatctctcattaaattgttgtttggtatactgaaatcaccaaacaaatcatcaagtggagctctaaaatcgaatatatcgttcaaaaacggtgtatccaacggcaaaaactcatctccgaaatgatttgataaacaatttgtttcatcttgaaattcttctgagtctttaggggttttggtgttttggggttttgcttcttcttcttctactactacttcttgtttatttgaagaagaagaagatgaagaacgatatcgaagaacagaagttggtgatgagatattgtgagattcttctgatgaatcataaccagaaactgaagtagtaaggtttatctcaggtttaatactagtcttttctttcttcactcttaccttttcttccttcttcacttcttcttgttgttcttcttgttgagaaccaaagttgattaaagcatctggtcctcttaacttgatagcagcattatcataaacccttgcagcttcttcagcagtatcaaatgtaccaagccacaatcgaacacgacgagcaggatctcgaatctcagcagcccatttaccccaaggacgttgtcgaacaccacgatacttcttctttccatcaccaactcttgatcgtttgttgttgttgttgttgttgttgatggttttgttttctgccaaaactttcttggatctgatctttagaccaccatttgattcttgaataacacttgaagaacaaggttcaacattgatttcatttatatatctcttaacacgacaacgacttaaaaaagtatggtcttcttcatcacttgaagaatcagttgcgttgttatcagttacagagaatcgaacaactttaggaccaagaatagttgatgaagagagagatcaatgtttggtggtggcttcttcttgttgatggtggttgatgtttaacaactttctttatc

SEQ ID NO: 9382 - DNA, 938 bp, Aquilegia formos X Aquilegia pubescens
  Predicted polypeptide sequence is orthologous to G1435
tatatgaggattttatctattattgggaggaacatgatggcgaggcccaatcgaattgaatttattaacacaccaatctctttgctgctccctatacatattataatgatgctgatcgaacccctgataggtggcagatggtggattaccaactggtattccgatatgactagcaccatgagccacaccaagaacaggcataggcatcaaaggatgatggccataaggcattggatgcggcactgcaggtgatgggattgctctgattgactcatttaagcttggtggaacaggtgtagacgcaaagagctgatccgaaggcgatggaccctcattcgacaaaccctgcattctgttcaaatacaatctatatttctgaagatgactagcgacattttctctcgtaagtccttctacattcataagctgcataattgtttttggtacagcattcttaatccccaaatgcgcaacaacatcaacaaatctcttatgtaattgaggagtccaaactaatcgagggcgtttcaatgcacgcgcagtttgatcatcattagaattatctacaccttcttctatcaaattctccattccttcttggtgttgcatcaacacagatttccgtttctcagatccatctttttgttcattttgaaacttatattgattatcatgttcatcagattcaatttcaatctcattttcttctctttcaacaacaacagaatccttaccagtaccaccaacacttccatcttcaccaaatgaaaataaagacttgaaattactagataaaaacccttgatttgatttacgcaaactcgaaaatgttttctgtgatgctcgattaacatcaatcaaagttctagatggctctggagttatactgaaagcagaagctaattcacgagaaattaaagattgagataatggtgtta

SEQ ID NO: 9383 - DNA, 935 bp, Aquilegia formos X Aquilegia pubescens
  Predicted polypeptide sequence is orthologous to G1435
caaccatcattaatgttaaacaaggattcctcaggaacaacactgagggacaatcaataagatttgatcatatcagtatcacaaattcacaatacatatgcaattgtacaaacacaaacagtaagcatgatgagtacacatttcaagaagaaaaaaagttggagggggaagcctgcaagaagatgaacggctgggttggaacatctaaacgatgagagtaatagaaaatccactgtcttccttaattggtgcatacaagaacaagcaaaaaggccaaaataacctgaatcctgtactggtgagagtcatatagaatccaccgtcttcattaattgctacaaacaagaccaaacaaaaaggccaaataacctccatcgtagatctttccttgacatggagtgaaagaaagtggaaacaagaaagccatggatctgtctaccaaggtgtggatcttcttttatgtgtatccatgaaagcacatttaacgttcttatccaacatgcaagtttacatagtttccaggccaattcccttgatgctccctattcatgctgtagggatgataatcaaacccggtataggatccaactggcatcccatgagaagtaccagcagctggcattgacggcgcaggtgccccatatggcaccgaagcaggaggcaggtttctgttcccactcgactcacgcaagctctgcggaacaggagccgaggcaaaaagttgatcattagaagatttcccttcattgatcctcttcaagtacaatctatacttctgtaaatgactagcaacattttctcgcgttaagccctcaacattcatcaattgcataatagtttttcggcacagcattatcaatccctaaatgcgcaacaacttccacaaacctcttatgaagctgaggagtccataccaatcttggtcttttcaaagc

SEQ ID NO: 9384 - DNA, 931 bp, Aquilegia formos X Aquilegia pubescens
  Predicted polypeptide sequence is orthologous to G1451
agcaataccaagccatttgctgcagctgctttgcaggatattagaaatggggatccattgaaacagcagtttctgcaatttcagcagccttttcaataccttcaacagtcatctggacctaaccctctgcttcagcagcaacttatgcaacagacacttccacagcagatgctgaatgagcaggcgcaaaatttagctgagaaccagccccggcacctcctgcagcagcaattgcagcaacaactgcagcaatcacttagtggccagcagaagcagcaggcccaacaacagcaacaacaaacttatcaagaggcattccaaatgtcaaacaaccaattccagcagcagcaacaatctatacctgctccgttatgccaaaaaacagatttcactgattccaatgttaccttctcagcatccctaaatccttctagtatacagaatatgctgggttcattgtgccctggtgggagtggaaaccttctcaacttcccaagaatgagtgagtccatgctaagtgattcgcagcaacaacaacaatggggacaaaagtttccttactcgcaaggaaatgcttttgaagggtcagcatctcttccatcttatcttgggaaggacggtgctgtagaagcggacaatggagatgcccaatcccatacactttttggtgttaacattgactcttccccacttctgctctccagtgtcattcccagcttaggtacctctgcaattgatgctgatgtgtccacaacgccctttggagcttctgggtttcagaattctctttatggctgcatggatgattcatctgatttgcttcacggtgcagggcaaggtgaccctccgactagaacctttgttatgtttacaaatcatgatcagttgggaggtcactagacatcggcaggttcagtagctatcgtgagct

SEQ ID NO: 9385 - DNA, 920 bp, Aquilegia formos X Aquilegia pubescens
  Predicted polypeptide sequence is orthologous to G1451
tcggtgacaaagtcgagctcatcttcccaataatttagcatatgagagtagtcatttgatttctgtgtctcacacaacctcatcttcaagggatttaaagtgtcatctatattaggattcttaataattcctatattttcacaacataatagatatagttacaacttacaagatatatataagcgtcatgcatcacttctgtgggaagaagatacaaaaccgatgggtcaagatggttcattgttgtatctcaaaaaaggtccttttttacccttccttttctacccgacttcacattctttcaatagttgagagaactcactgatgtacttctaggacttagatttcttgagtcctcgcagttcacatagctgttgtagctaccaccagaaagcctctgcctcggattcagaagctcaagaccttgtttccccatcttctgcacttcttggggcgagagtatcttgatgcaccagacgctgtttacaaattcctgccaggggtcatcgccgagaagaagaacgtcattctcccggtcgacgaatacaagctgccagcctgatcttaaggggtcctccaactggcctgtgaggccaaacatgcactcaagctcactgcgtagctcctggtagccactgaacttagtaatgtccaatgacctcccaaaggaccccgacttgtaaaccttaacaaaggttctgattggttggtttacttgcccctcattctctggggactgaagaaaggacgactcatctaagcaacttgaggttgccatgtttgagtgaagtggaaagttggtcccttcttggtcctctgagtattctctttggggaagtggtgataatggcacattttgaggtgatatgttagtttgttgttgaccaaattgttccacctgaggcatcagatactgggtt

SEQ ID NO: 9386 - DNA, 881 bp, Aquilegia formos X Aquilegia pubescens
  Predicted polypeptide sequence is orthologous to G1474
cacatgaattgtacagttctacttcaccttaggccgatcaccgagcctcagttcaagatctatctcctccatggaacttgagtagcttagtccaaatacttcagcttggatatgatattgtctatcaactgatttaggtttgaggaagaaaggcaaggaggttgcatcaatctttcttctcttgttactaattacctcatcatcatcttcaccagatcgcgtcttcctagtccgagaagctatcaaattcaagctcacatctgaatcagtcttatgataatcagcaccacaaaccccgagtcctaattcttgtgctctcaattctctctccccttcaagcttggaatcagatagactaacaaccttaactgcgattgagttggtgtgtgtatcttgggcagataataaggatcctactatttgatggttctgaactgtagtggaagaataagaaggagaaatcaccaaggtcttatcaagattgcacttctctagtgtagatggaattgaaaccctagaagcagttaggtttgagttagggctaaaatccaaactacaaacttgagaagtatattgatgaacccctaatgaagtagagggattttgatgctgtagtgtagtttcactatgaggatttggtgattgcttaagtctagctctatccctcctgtgtacattcatgtgaccaccaagagcttgagctgacctgaattctcttcgacaaaagctacaagaataagatcttggaggccatatacaaccaccatgaggtccagctgaatcttctgcaaaagcttgttcttcccatgaatcgttgtaactagtcctcgcagacgcttgaacatgctgagacttctcagttagtttccttctcatccaca

SEQ ID NO: 9387 - DNA, 893 bp, Aquilegia formos X Aquilegia pubescens
  Predicted polypeptide sequence is orthologous to G148
gtttgttaaatcttctacttttagaaccaaaaagaaagaaagaattatcacttcatcacttcacttattgtttatttgtgttgtgcaactatatatttattccttctttttaactctctcatctcttcttcacaaattataatagggtctttttttaccaaatccacccttttaatttctttaaatttaccacaccaccattaaatctctataaaaagcaaaataagagtgtgagtttctaactttctatactagttattccttctatctaactagtctctactactacctagctcttaagctttagcttagtagtactgatcgattattgatctctgcttgttgttctctttgtttctggtgatttatcaaagatatatttgataattatgggaagaggaagagtagagttgaagaggattgaaaacaagatcaatcgtcaagttactttctcaaaaagaagaaatggtttgcttaagaaagcttatgaactctctgtcttatgtgatgctgaagttggtctcatcattttctctagccgtggcaagctttatgagttcgctagtgctggtatgagtagaacccttgagcgataccaaagaagctcatataactctcaggatggcactcttgctgttgcagatcgtgaaacacagggctggtaccaagaagtttcaaagctgaaggcaaaatatgaatctttgcagcgctcccaaagacatttgcttggagaagatcttggaccacttagtgtcaaggagttgcataaccttgagaagcagcttgaaggagctcttgcacaagccaggcaaaggaagacacaagtaatgatggaacaaatggaggacctccgcagaaaggagcgtcatcttggagatataaacaagcaactc

SEQ ID NO: 9388 - DNA, 956 bp, Aquilegia formos X Aquilegia pubescens
  Predicted polypeptide sequence is orthologous to G1480
tcaattacctgcaaaatactgcaaacatttcacgtgtctgtaggacctatcttggcaatgacactaagatatgataagacagctcataacagatgaactctcaaaaatacttatttatttggctaagaacttcccacgtgtcgtccgtgggttcgtcaataacctgatttcctttccctgtatagatagatagaataaacaagggcaactctttctctccataactctctctactctctttacactactacttttctttcaaaccaaaaagaaatgaagatcgatgaaggaaatgggaaagtttttgcagcaagttggagtttatcagcaaaaccttgcgattcttgtaaatcatcttcagctttactgttttgccgagctgactcagcttttctttgtatcggttgcgattcaaagattcatacagcaaataaacttgcttcacgacatgaacgagtctggatgtgtgaagtttgtgaacaagcttcagctagtgtcacgtgcaaagctgatgctgctgctctttgtgtcacgtgcgatcgagatattcactcagcgaatccactcgctcgtcgtcatgaacgttttccggttgttccgttttatgaatcagctgcttctgctattaaatctaacgccgttaatcttcttgtacctgatgaatctgaacataataatgaagatctcgatgaagatgatgatgatgaagaagatgatgatgatcatcaaatcaacaacaataacaagaatcatcaccatgctgtcaccggaggagttgttgttacttgtcgtgaagaagctgaagctgcttcttggttacttccaaaccctaatcataataataaactaatggaaacacctgatttgaactgtgctgatcagtattcttctctgatgttgatccatatcttgatcttgattattcatcaccgttaactggtagatatcataacagt

SEQ ID NO: 9389 - DNA, 876 bp, Aquilegia formos X Aquilegia pubescens
  Predicted polypeptide sequence is orthologous to G1488
acacaaactcataaagacatgatacgagtttaatacaagcaaatgaattttctaatttaccaaaattgcattaagaattctacatgaaaaaaaaattaaagaaatttaaccgatcagcttcgcctttttttggggagttttgttttaccggatgatgaaaatacctacacttgggaaaatttaaggaaaaaattactgaaactccactcacgagttttgaaactaaacctgggattaagtctatttttttttttgggggggggggggatgggtcatctaattagatcatctgggcaaaatctgacccggtttgatgatggatcaaatagtcatcaacaccaccaccagaaacatcaaacaaggcattcgggtacaaaaactgttcttgttgacaactctgcatttccttctgcctacgaagttccatcaccttacgatgtgaattggaatgcttagcaagcacaaatgtaggactagaagcgggtcgatattcgggaacaagtcgacccgatttataacggaccccacatgcattacaaagagtttttggacctaatggccctgttctccactgaggagtcttgtcggtggcacaatgtaaacatctccggccatcaccatgctcggaaatctctttctttttataaacttttgtcgttttcttaccggaattcgatgagatatcagattcggatgaagatgctgttgttgtggttgttgttgctgttgtcgtcggagataaaacaagcaaacgtgaagaccaattacatggagctactctagacctcttacttcgagcttttccaggaactgaaacttcgctttgaaatatcggatgatgataatgatgattgttgtttcggtcgtttcggtttg

SEQ ID NO: 9390 - DNA, 894 bp, Aquilegia formos X Aquilegia pubescens
  Predicted polypeptide sequence is orthologous to G1494, G789
gagctgttatggcgtaatgggcaggtggttcagcaaagccaagcacaacacataggaaaccaggtgcggtgcataacgaactaggacataaaaagaagcctgatcatcctgctagggatgttgattccttcatgaatttgagcaatttgattgaagaagatgagactgaatcatggatccaatatccgcttgatgattcattgagtggggacttttgtgctagtttcttttacgacttggcaaactcccatccaattgagaaggagaagacaatcaagcattttggaacttcagaggaatccaatgttctcaccaccaatagtgttttgaaatcacagcaacatatgtttagacagcctaataatataagttttgccgagaattctacccagcaagatccttttggaagacttgaacggattgaaaattttcctcatttttcaaggccaatcaaggccgaaataggtacatcaaatgtgccgctcagagggacagaatcaggcttgatgactggaggagacgtcggtgaatcctcagtgatgacaattgggtcaagtcactgtggcagtaaccaaatgacaaatgaggctgatcgaagtaatgcagttggttcaacaggcatgtgtggaggccccaataaggatactagtcgaaaggtggttccccagtgtgagagagggctcacagagactcttgaaaccactatcacttcatcctctggtggatctggggggagttacatagggacagacaaacaatcaactagcacccagaggcacaaaagaaagggcgagatgctgatgaatctgagtgccaaagtgaggatgcgagtttgagtctgcagagcaatagatactcaacgatcacgtctacccgcagagtcgtgcagctgag

SEQ ID NO: 9391 - DNA, 879 bp, Aquilegia formos X Aquilegia pubescens
  Predicted polypeptide sequence is orthologous to G15
ggaagagaaagctgctagagcttatgatcttgccgcactcaagtactggggtgcttctacccatattaactttccgttggatagttaccaagacgaacttgaagagatgaagaacatgagtaggcaggaatatgtcgctcacttaagaaggaaaagcagtgggttctcaaggggagcgtccatatatcgaggagtaacgagacatcatcaacatggaagatggcaagcgcgaatcggcagggtggctggaaataaagatctttatcttggaacattcagcacccaagaggaagcagctgaagcctatgacattgctgcaatcaagtttcgtggtgtaaatgcagttactaactttgacattacaagatatgacgttgaaaggattataggaagcaatactctcctagccggagaacttgccaagcgaaacaaagagattgaatacaacgttaaagctgttgaacagccttcttctaagaattgcaggaaggaagctagattgcctgaagaggataatcgtccagagtggaagatggtccttagtcattatcctgaacagcagtctatcactacaagtgacccacttgatcacaaggaagcagagcttggtaattacatgaataaccctttctcctcatcggtacatagctcatggattgaagcgatgaactcagcccaacaagggatagatgagtcgggcaaactagcacctcacttatctaacaactcgtcagtggtaaccagcttgagcaactcaagagaaggcagtcctgataagaatggactgtcaatgctgttcccaaagtcccccccatgctcaaagttttcaactcctattgcaccgacttcaatcccatcttcacagctgaagccttcaat

SEQ ID NO: 9392 - DNA, 926 bp, Aquilegia formos X Aquilegia pubescens
  Predicted polypeptide sequence is orthologous to G15
gttatctaccaattctttccctcctctccaatacttgtgttttttaataccctcttcttttcccccctcatgcaagattttacaagttacattagtcatggatattttaagtatcagtccaagcagcaaacattggcatatgtgacatagaacctgcaggccttaattgagcagatgaaatccaagaattcattgatgtaactggattgatgaatttggaagtcgatgtaggccttgcaaacagcattgacatcccattcttatcggggcttccttctctcgagctgtttacgcttgtcactagagaagatgaattggataaatgaacacctagtgtggcagagtcatccaccagttggtctgaattcatattgtgaagttcgatcagatcatgtaaggcacccgagaatgatgaattcctgtaatttccaataccattcggtttctgctcaatagattcagcaacatcacttggtccatgaggggaagactgatacatgaccattttccaatctggtccacctacagtatgctcttctgataaaccgacatccccattgctgttctgagtagatggatggtgatcaatggcttcattgctagctgttatctctttgtttcgcttagcatgttctccagcaaggagcgtattacttgccataatccgttctacgtcatatcttgtcatgtcaaagttagttacagcattcgtgccacgaaacttaatagcagcaatgtcataagcttcagctgcttcctcttgtgttccaaatgtcccaagataaagatctttgttccctgcaaccctaccaatccttgcttgccatcttccatgttgatgatgtcgtgttactcctcgatatatcgagccctctcgagacccgctgctcttctttcagtgagcacatatctgctagtcatatctc

SEQ ID NO: 9393 - DNA, 872 bp, Aquilegia formos X Aquilegia pubescens
  Predicted polypeptide sequence is orthologous to G1506
gccggtattgtgtaatgcatgcggatcaagatggaggacaaagggtacacttgccaattatactcctatacattctcgtacttttgcacctcctgattttggagactcaaagcaatcccgacaggataaattaccaccctcaacaaagtctaagagctggtacataaaagttcataatgaaagtaaaatggaagatgaacagtcatctgcagaatattactcatattcgacatattttgaggatgattcgagcaataaatccagttcaggatctgccatatcagtttctgagagctgtgttcagttggggagcacatatgggaatgaaatatcaggcccattccaatcaagtttctgtgactttcagattccttcaagaaagagaacaaggatgagacgccatagtccgtctcctgttgagaagctcagacaagaccttgtcactattttacagcagcaagattcatcttattgttctgacttttcagaagaggttctgcttttcgagagagaagatttgtcattatcttctgagataggtcacgggagtgttcttcttaagcctccagtttcttccaaagaagaggagtcagaggcaagctcacacataataggaaatggggtttcttccttaaatgatctgtatatgggagtgtcatgttggtctggacgatcccataataatgaaataagttcacgtcaattgggaaaggccaaagtgatccaggaaacatggaataccaatgagtttaaagagaacaaagtaaagaaacttgtttctacagatagatctttgaagagcacattttctggtgatccggatgacatacgaaataaatattcttctcagatatgcgtgaatgacaaatctt

SEQ ID NO: 9394 - DNA, 918 bp, Aquilegia formos X Aquilegia pubescens
  Predicted polypeptide sequence is orthologous to G1506
ctagacatcaccatcgctttctgcattttaagataaataatattacatcttttttgtcagcctatacaaaaaaccaccaactttctatgatgccaagtttgatacaggtcagcatacttcaaacagtagaaggggcaaaaaaccattcaccaaactgcagttacatagactagcgtgttcggcatgcaaagcaaatggatttaagcccccactcacggagcctgatcgatcaatgtaagctcttggccatttatgatcaaccagtgtcaggcaaggtgagagtaaattgtactactactagtacttgcttgctgggagctaaaactcgatgttgggtatagcagctctgcctgtgggaatgatccattggagggtacatccagaagcagatcttgatcagaagtctcatcgttgaattgcaaatagtccagcataagggagctcttgtccggagcaaagccaaataagcttcttggactgaagcaagagccttcatggtcaagtacgtcctttgtctcatagctgggttttgtaacagtcctcttgggacttttcatcatggcctgcagttcttgcggattttggccattgcggggtctctttacatgtaacatcttcgatcctgttgcaagttccttggctcctgttttttgtttattcttcacgtcctttaataggttgtagtgttcaatccagtttgattttgtcaaattgactaatgcaagcttcttcagagttttgaactcatcagcatcaacttctgaaagagatcgatcaaagaccccttctgcaagtagcttctggaaagaagataggttctccgcaaatagaagctatcaaacatgcttttaaggctctcaggaagtctgaaagtatccacagaaggtagatacttcatcaattgtagttgttcttcgt

SEQ ID NO: 9395 - DNA, 903 bp, Aquilegia formos X Aquilegia pubescens
  Predicted polypeptide sequence is orthologous to G1521
tcaacacaaatacgataccattatcaacacaaatatgataccattaccaacacaaagccttcacttgcgcaacggctctgtccacaatggtgacattttccatgaatatttgtaccattccttcctctgcaggtgctccaccagattgatgttgatagtacagccaaactttcccacccaaagtaccttctattttcctttcgaccattacttcagaacctctccaacccgtctcccttggatcagtcgcataatctcagttcttgtagacctcaagtgtttccacacctcaccctggcaaagcaatgatgttccagagtttcctcagctgcattacagagtgcacaaactgcggacattgccctttgggtttgaaagaaacatttcttttctgctcactctcggcactcgtattcaacgacagagtcatatgtagccatttcgaatgagctcccagcaaaacatctcaactcatgccaaaacctatcagatcggtcatgtaagaatggtcgtaactgtcgtacaaacatatcctcaccagctgaacatactggcgagtcattgaacttctcatcaaggcttgacataaaaagcgatgtggctaaatgaacaattactaacggatctgagtcatgaagaatggcctgcaattcccttgttatccatggttctattcgctgttgcatccttgttttaacaacctgattcctcactatgtcttgttcctgaaaactattggaaggaagactggaagaggaactgctcgcaatccttgatcatatacattagctcgccattgaagaactctttgcgcaattccctcttcatgtttctgcccaaatgatctcctccatggcaattctctacaatgctggctcacaggttgccgccgtacttcattaa

SEQ ID NO: 9396 - DNA, 915 bp, Aquilegia formos X Aquilegia pubescens
  Predicted polypeptide sequence is orthologous to G1760
agaaaaccagatctctctttcttcttctagttttctctcactttattcatcttcttcttcgttgattgtgccctagatcttaaaattctctttattagttttgtttcagtactcaaaccaaccaattccaaagcttcatcaatgcagattacgtgtggatttcgacgatcgttatcttcataatctttgttaattatttgctgagtttcgcttaaattaactgagtaatcaatatgtaaaagaaatatatcaatgctcggatcgttaactatctgttcagcacataacatgattcctttcagtacatatcagtttatcagattttgaaggaatatggaagtgttcagtttaccccaacttggtagcccctggtgaagtctcatagttttgttgctctggctgacacaactggaggtggataggaacatgcaactcttctgaaatgctgaaaccatttggaagagagaagattgcataatgtcaaaagcagattcagcagagaatacatgaaacacatttaaaatggtggtaggtctataaaatatggcgaaggaaagttgatggatacctttacttctgaagttggattcaatagttgatgatgttcctccttggatttgttgtatcgttcaataacagtcttcatgctgataatgacacaggaaatgttttggaaatctgctctcagttgagattgggttgtattggagcacccagaaccagcatgtagagtggttccagaaagatgcattgctgcatgggaaaggaactggcttgactaataactactgggcccaatgttgtgctattgctgagttgtgaattggcaagacagcatggcttagtgtatggatggaatcaaactctgctgctgcagttaatgcattcagagaggcaaaataccatgggagctaa

SEQ ID NO: 9397 - DNA, 912 bp, Aquilegia formos X Aquilegia pubescens
  Predicted polypeptide sequence is orthologous to G1855
taacgaactcattcctcttacaactggaaaaatcagaactgccattgatactggatgtggagttgcaagttggggtgcatacttgttaaagagagacatccttacaatgtcctttgcgccaagggatacacacgaagcacaggtccagtttgcattagagcgtggtgttccagctatgatcggtatcatggcatcacagaggactccgtacccagcaagagcttttgatatggcccattgttcccgctgtttgattccttggcaaaaattcgatgggatgtacctgattgaagtagacagagtgctaaggcctggtggttattggattttatctggacctccaatcaattggaagaaatactggagaggttgggagagaagccaagaagatctgaaacaagaacaagatgcaattgaggatgttgccaagcatctctgctggaagaaagtgattgagaagaatgatctttcaatatggcagaagcccatcaaccacattgaatgcgtagagaaccggaaggtttatcatacaccacatatctgcaaatcagaaaatgcagatgcagcctggtacaaagaaatggaaacatgcataacccccctgccagaggtaagcaactcagatgaagttgcaggtggagcagttgagaaatggccagaacgtgcatttgccgttcctcctagaataacaagcggctcaatcccaggtatcaccgtggagaatttcaaagaggataatgagctatggaaggaccgtgtgtcacactataaaagaattattagttctcttcctcaaggaagatatcggaacatcatggatatgaacgctcacttagtggattagctgctgctctgatcaaatttcctgtgtgggttatgaatgttgtccctgcccacacaaaccaaaacact

SEQ ID NO: 9398 - DNA, 929 bp, Aquilegia formos X Aquilegia pubescens
  Predicted polypeptide sequence is orthologous to G1863, G2334
tcaagtcagaagaattatacaaaatttccgaaaccaacaatgaagcaaagcaagcagtaaagtttgaaatcctaagaactaaactatttttattcattgacaaaattaagtagttctagagatcagaaggtcaaagtaaaagctcaggtgctaacaccacttaaatctgacacagatcgatgagtggctccacgcaaaacacttgttggcgaagaactagaagctgaatgttgcaatgcctcagcaaggggaccccccattgagctcatctgatgatttccccattcagtaccccagctcaatctgttatgttctcctgttcctatgtctccatctctggaactttgctcatctccatttcctgtcgccaatttcagggaaaagtccgatgatggttggcagtcacctgcaggcaagttttctggtttggcattgatgttaataccatttggttcttgttgagatcttggccagtcatcaaagaaatgccgagtctgcccaccatctgttctgttctcactgtacttgttatcacattggtcctccaaaagtacgatttcctgttttatttctggatatctcgtgttcagtggagttggtgctggcacagaaagagaaaaatggatcccagtagcctctgtggtagaaggtgaagacccaatcaaggtagcagttcttaggccaccactggctgtgggttgggtggagggttccacaggctttcttgaacggtttcggcctcgatgcatgtggcgctcacaatacttctgacccgccaccacatcttttgcacatctccacttcttcccatcagttcttcggcacctacccggctctggatcaacagagtttccccagtacccagttcgcaacatagatggtttataatagctatactgttgaagatgaagaggttgataaagataaca

SEQ ID NO: 9399 - DNA, 947 bp, Aquilegia formos X Aquilegia pubescens
  Predicted polypeptide sequence is orthologous to G1863, G2334
tttgaaacaactcacagcactgtactagaacaataaaacatttgaaaaataacaaaaatcaggtgcaaacaacagaaaaaactggtatctatgggggggagtgagagtatggggtagttcttaaacaaacaaacacaatcaacattacaaagttatgatgactaaaatgttgctaaagttcaggtgctaacactactagtgtcagatgcagttcctcggggcagctcatacaggacgcttgttggtgaagcattagaggtagaagatcgcaatgcctcagcaagtggacctcccatagagctaacctgatggctgctccatcctgttccccaatccagtggtcgctcctctctaccattaccatcgggatattctggtttaactccatttcctgttgacagtttcaaggaaaaatctgaagaaggatgccctggagttgagatggagaggcaagttgtagaagaaccgccatttcccccaactccattggtatcttgatttaatctgggccaatcatcaaagaactggcgaaggagctggccatcagaccttccttcaccacaaaggttgccactctgcatattcagtagtccatttcctgctttgttctctgaggttctctgattcagctgaataagattggtaagagggggagatccagagagagcaaacggagttccactagcatttgttataggcaaagcagcaggaggattgggggttttctggtcaccctctattgcggtgggtgtggcagtttccacaagctttcttgaacgatttcgacctcggtggacatggcgctcacagtacttgtgggcaggcacaacctcccttgagcatctccacttcttgccatcagttcttcggcatctaccaggctctggatcaacagcattcctaccccaatatcctgactgcagcatagttggttgataatgttgata

SEQ ID NO: 9400 - DNA, 805 bp, Aquilegia formos X Aquilegia pubescens
  Predicted polypeptide sequence is orthologous to G1888
cttgtgagagagaccaggatggatagctatactaaaagttgctaactcaatgcgccagttgtggagcttctgccacctttgcgcccccaccattgcccatactaatttggaaattctctcaacttcaagatctttccaatcaatccccatatctatttttttaatacccttataataaagttagtatttgcttcaaattgaatattgcattatgggctcttttcttttcttagagatgagatgagatgagatgagaatgagatgagcttttccgcttccttcttgctttagagaaataataaacagtttgtaatagtaatactactataataaattctcatactagctaccaaaccaagaaatgaagatccagtgtgatgtttgtaataaagaagaagctttagttttctgttcagcagatgaagctgccctttgtaatggatgtgatcatagagttcatcatgctaataaactagctagcaaacaccatcgtttctctcttcttaatccagcaaacaaagatgcccctcgttgtgatgtttgtcaggaaagaagagcttttttgttctgtagagaagacagagcaatactctgtagagaatgtgatattccaattcacacagcaaatgaacatactcagaaacataatagatttcttcttactggtgttaagcttgcttcttgtaatcccacatcttcatctaatggttgtgatgattttcaaaaggtcaacaacaaatctcagtcattcataaagtctactccaccaccaccaacttctattgaaaatagtagtactactcat

SEQ ID NO: 9401 - DNA, 603 bp, Aquilegia formos X Aquilegia pubescens
  Predicted polypeptide sequence is orthologous to G1888
ctaaaaatattttaaaacctaagattgggaatgctcttacaaatggaaagaataaacccagattcagatctgagaaactgtaaatacaaaacttcccaaagaagaaaccaagcacacaagcgaaaaaaataaaaacataagataacatacaaaagtagtaaaaacaagaaaatcaagatttggggttggtgttcaactgttgagtgttgattcaattcatttcatttggctaccaaaaggacctgcctctcttatttgatggaggactaattgaaggaactgtaaaaccatgatcactccatctcttgttgttcatcttgattgggattacatctttgatttccttgaaaatcccagtctttttctcattgattgtgtgtgatggatgatcacaaggatttggagcttgaggtacccacatacacaaatcatcagaagaaaaacttcccagattggtttcaacttcagcatcaagaaaaggcatcaaatcatcattcttacagaaaccatgaggagcaactgaagatgaatccagaaagtcttcaacatgccatccaggcaaagtttctatcaagtactctgctatactacttgtagaaccat

SEQ ID NO: 9402 - DNA, 827 bp, Aquilegia formos X Aquilegia pubescens
  Predicted polypeptide sequence is orthologous to G1917, G383
atctttcttccctgaacctcctgatttcaagtacatacacacaacacactctacctccatttatacaacaacccttgtcttcaaattttcaatttattctacaaatagttttcattccatgtgaaaaataaacaaataggtatttgagtgttatataaagagatgtctaagtgcagtagtagcattcaagctcaaggcaatactaataaccgagtggccgattctgcttgttcttgtaatttgttttttaacaactctttgtcaatggtgttccctagcactcctcctcatcatacctttgatgaaccaatcacctgttcttctcctgttgattgcactctctctttaggcaccccatcaacacgtcaatccacctgcaacaatgatgttaaaaagtctggtaacaacaacaacaacaattccttcaggtcaaacctttgttggagtgcatttcaaactactaagaaggcaacctcgccatctgcactaccaccaccaccaacaggtgcagttgggtgcataaataacaacagcatttcaaatggtggtactggtgatgcacttcttgctcgtaggtgtgctaactgtgacactacttctacacctctttggagaaatggacctagaggtcccaagtcactatgtaatgcttgtggaattcgttataagaaagaagaaagaagagcaaccaccacatcaccacaaacaaacaatggagtcaataacagtggtactggtactgcaacacaaccgccccacctgatgagccaccatgcaacatggacccaccatcaccctggagcatcacagaaaggtagttggcaacg

SEQ ID NO: 9403 - DNA, 944 bp, Aquilegia formos X Aquilegia pubescens
  Predicted polypeptide sequence is orthologous to G1944
gaaattttgatgcatggaagggagagaagtaatgagttcaggtggaattacagtgatgggtgcagatgctccatcaaactatcatgtagcagcaagaagtaatgaaaaccctaatcagattggtggatcaacagctgtagctacatctgtgagtgtagctataggtagtggtagtggtagtgggactagtggaattggaggaacaacttctttgaagaagaagagaggtagaccaaggaagtatggaccagatggtacagtttcattagctttatctccgatgccgatttcatcttcagcaccggcatcatcaccggtattacagacatcatcagcagcagcagcagcacccttgacaggggagttttcgactgagaaacggggtagagggcggccagctggttcggtgaacaagcaacaacagaaagtggaggtggtggagaatttagggaattgggtatcttgctccgttggtgcaaatttcatgcctcatgtcatcactgttgctgcaggcgaggatgtaacgatgaagattatatcattttcgcaacaagggcctcgagcaatttgtgttctttcagcaaatggtgtaatttcgaatgttacacttcgtcagccagattcatcagggggtactttaacatacgagggccgttttgaaattctttcgttgtctgggtctttcatgccctcagagagtggaggaacaaggagtcgatctggtgggatgagtgtttctttggcaagccctgatggtcgtgttgttggaggaggagttgcacgtctcttagtagctgccactcctgtgcaggttgtggttggcagttttcttccctgcactcaacaagaacagaagccaaagaagcaaaaacctgaatcaacatcagctgctgcaccaactgcggcagttcctatttctagtgctgagatggaggaaggctaca

SEQ ID NO: 9404 - DNA, 825 bp, Aquilegia formos X Aquilegia pubescens
  Predicted polypeptide sequence is orthologous to G1950
tgaattgttagcatatatcattacaatttgaggatgatcacagaaattaccctatcaacctgataccggggttactaatctgctgctagaaactgtaatactgtacttgagctaatatttcagtttttacaacattgaagataaagataaagatgaagacggggctcctctatttaggaggaagtgtgaaatgttatcatatcccattgctttcgccatatatattggggttgcacctctcatactcatggcgttaatattggctcctctgttcaccaacagctcaactgtctcgaagttgcctccctcgactgccaagtgcaatgctgtgtggccttctttatcatggcattccaagtccatcccagactcaatgagcattgaaacaatatgtttgtgtccttttattgccgctgcatggagggccgtcagtccatattgatctttgtaatttggatttgcacctctcttcagcagctgcttgagattgtcaacttcgcctcttcgtgctgttgttagtaccatttctccctgttcaagtatcttgacaacctctttatgccccttatctcgagctatatcaacagctgtacgtccatccttagctgatatcataggatctgctcccatctccataagcaactctaccgtctgacggtctccattcactgcagctgtatacaatgcggtccatccctcatcacacttagcattcatatctgcacctccttccatcaacatcttaacaaactctacatttcctttacttgcagccacatgcaaagctgtctgaccatctctatccctacaatccaaagatcctcc

SEQ ID NO: 9405 - DNA, 921 bp, Aquilegia formos X Aquilegia pubescens
  Predicted polypeptide sequence is orthologous to G2
tcttattccgatagagaattcatggttacaagaattaaattggcaaaataacaaatggggttagaagaactcattggaaaaagcagatgatatactggatcaagggagctggcaaatcaataaactaacgagtcaggtggatctcatatgagagtggaaactgttcgttggccaagctgttgttggtctaattatctgcaatgggaatcctgatgatgctgcaggggtcgcatagggtgtaccagcaagccaactattactgcttctgttccagccagactgccgaagttgctcgcctgttggaagagaaggtccacctcccccacctagaccagttaggcctccattgtcgctatttggtaattggtagtttggtggactgaattgtggttgggcaatatgaaacatcgacacttctccactcctccttggctgcccatatatgaatggttcactggcattaagtctgttgggtggagattggatgtgggtctggttgagcaaccgtatggcctcactctcactatacgcattctgtttgtaaagatagctatgatttgcccccatgtgatttgcattggcatcaaacttgcgcatagaaccgcgttgattgttgctccaatctgatacatacggcatctgggaatatctcggatccattgcatgcaatctgttgtcatccctcgattcatgactatcactagtagaggttgaattccccaggctcaaatcaagattatgaacagcattgttaccttgcagcttctgtttcagtatcgaagagaccaagatacacatatccaaaaattgtcccattctagcttcccatcttccacatttgtgtaaggtaacccctctaaatttagagcttcctctaggaaatccggtactttggcgacgaagtacatgaacaaattcctc

SEQ ID NO: 9406 - DNA, 971 bp, Aquilegia formos X Aquilegia pubescens
  Predicted polypeptide sequence is orthologous to G2
tggaatgatgagaagattaattaacatgacaaattaacttgaaaaagagtggtggttatctctgctcatctcatgaaagagtgaaatccattctttggcagatatgtacttgtttgtgaagggaatcctgatgatgctgcacctgtgtatatttgttgttggttaggtggatttgatccccaactagtccaaccaggttgttgctgctctcctgttgctagatacagccctccacttccaattcctatgcctgttcggcttccgttgctgctgctaggaaattggttcataggtggattgaaatgatgaaggagttgaaccataggggttcctccatttctgttgaattgatcatatcttggcagatcagccatcctgagtgagactggtgattgaatgtgtgtttggttgagaagtcgaattgcatctctctccttacttcctccaaattgctcatccaaaggcattggcctaatgccatgattggtggtgttattcctccaatctgtttcaaaccgccgtggtgacaatggacggtctctttcctgaatcccattcttggatgaattccccaagctcaaatcaagattatgattggggacactaccatttgagctgagctcagtttcataaatactaggatcaaaattggtcacagcctccttcccattatacttgattgcagccttgtcgtaagccctggctgcttcaatttcagtgtcgaaaaggcccaaatacacatattttttgcccaagaactgccccatccttgcctcccatcttccacatttgtgcaaagtaacacctctaaattttgaacttcctctaggaaatccggtactttggcgacgaagtacatgaacaaactcctccttagttagattattcatctgttttagatcatcttcataatcattaagactaaaatttatatctgcttcactcccctgacttgatgctgctctatcata

SEQ ID NO: 9407 - DNA, 919 bp, Aquilegia formos X Aquilegia pubescens
  Predicted polypeptide sequence is orthologous to G2
catatataccctccatttaataagaaggttcaagcctaaaccacattctgtattgtgtgttggtaatgggaaaacatatttaccatatattatgtcaagcagatatgaagtctcaatacatatacacgagaaggggatgaattagatgaccacaatggtcgttctggttgcttacccccaaacttgtcattgtattttggtgattcagctccagcagcaatgttgtcgtggttttaacttctgtagtggtgttgggaggtggtggaaggaggataatatccatagtgtgtcatgcttatatgcggagggtgtggtggatgaagggcagctgccgaaacggaggtacttgacgaagagaatcctgatgatgctgcagtagagaacagtggcattggggtactgtcatctatgtggccgtgcagttgccatgcccagttggagagacgcctagaacctacttcaacccttttctctatctttctttcctcataattaggaaagaagctgggatatccaccattccacatgggaggatgcttggatcccattgccaggccatagaggggttgaccgcccaaggttgtcaaagaggggttgtctgtccttgctctcttggcatcaagcaagttgagagggtcaacgtggagattaaaagctcccacactttcgctctgatttaggtcatcagcagaagaagggggagtgatccccaagttcatgtcaagattgcacgcatttcctccattttcaatttccatgatctcgctatcataagtgctgggctcaaaattggtaacggcttccctaccattacatttgattgctgccttgtcatatgcccttgcagcttctacttcgctgtcgaacagcccaagatatatatacttcttgccaagaaattgtcccatacgagcttccc

SEQ ID NO: 9408 - DNA, 876 bp, Aquilegia formos X Aquilegia pubescens
  Predicted polypeptide sequence is orthologous to G20
caaacagataaaatcatagagttcgccaaaacatacactataaatgccataaaaaccacgaggaaaccttgctgcttgcatgcagatgacgaggtaaattttaatcatcgttcctcctgatgaaaacaagcatatgttgagctgggctcagtcttggtaacctcagtaacgacaggaagcctgggtggcggtacagaagcaagagatgtccaaagtatagggtccatagcaggatccactgtattgtacggcgtaagcatcggcgcggagatgaactgggtcaatggacatgaacttctttgaaaaggcaaccagttcatgcccaataatccaagtctctcactcccaccatcgccacacggtatttggatcgacttacaatagtccatttctacattgttcttgttctcattgctatagtcgttttcatcctgctcctttaaaactttctctttaaaactctggtaggcaggagaccttgataggatgctcaaagcagatagtgcagaccctcgatgcttcttactttcacatgaaaggccaagagaaggcattttatatggttctgttggctggacaccccattctaatgctttaagctcactaccaatatcttgttgaccaccaaattttgtttcttcaaaagatttctctgttcgacgtgttttgttgggcccccaccacttaaagtaaccagtcaaatcaatttttctctcgatgcaaaagcctcctggatattcactttctgtgggtgcaccctcagttgtaccataccgtatactacttaagtactcgggcatgcctatttgattgagagatgtttcccatggactattttgagatgctctggaaaggcctcggtacttagagatacca

SEQ ID NO: 9409 - DNA, 926 bp, Aquilegia formos X Aquilegia pubescens
  Predicted polypeptide sequence is orthologous to G2057
gaacaagaacaagacaacccagaagaagaagaggaagaacaacatcaacaacaaacacaacaacaagctcatcaacaacaacaacaacaagcacaagcacagcagcaagcacaacaacttgggtattatggattacaacagcacttccatcaacaagcacaagcacaacaacagcagcagcaacttttctatgtaagaggagaagaagggtcttcattagcattagattcacacttaccaaagaaaagatcttacttacctctttcagaagaacagaggagaaacatcgaatatgcaagatttggggaaaaaatggaagacactcagcatccccaacaacaaactacttcaagattgggattgttaaagagcagtgtaggtggaggagagattgtggaagttcaaggaggccacattgttcgatctaccggaagaaaagatcgacacagcaaagtctgcaccgcaaagggtccaagagatcgaagagttcgactttcagctcatacagctatccagttttacgatgttcaagaccgccttggctacgatcgaccaagcaaagctgtcgattggcttatcaagaaggcaaaggctgctatagatgagcttgcagagctccctccatggcgtcctactgccactaatacttccaatgctgggcaatcctcggaacaaggccaagaagaggagaatcagaatcaggccgatgcttttggtagttctagtaagagaccaatggaagttgaacaagatgcttctggttatggcttccagcagcaacatttgaacaataatcctagtagcagttctggtttccttccaccttctttagattccgatgccattgctgacaccattaagtctttctttcccattgctgctgctacatcatcatcttcaatccattttcaaaattaccctcctga

SEQ ID NO: 9410 - DNA, 868 bp, Aquilegia formos X Aquilegia pubescens
  Predicted polypeptide sequence is orthologous to G211
aaagcaagttgttcacagttataggaagaaatgaggaatccaagcatggcttcaaaagtgacgtgttcttcttcatccccagcttctggtagcactactagtaagattacaccttgttgtagtaaggagggattgaagagaggaccatggacacctgaagaagatgaggttctgtctgattatattcgaagagaaggtgaagggaggtggagaacacttcctaagcgggctgggctacttcgatgtgggaagagttgtcgtcttcgatggatgaattatcttcgtccttcccttaagcgtggtcaaattgcacctgatgaagaagatcttattcttcgccttcatcgtcttcttggtaacaggtgggctttgatcgcaggaagaatccctggacgtacggacaatgacatcaagaactattggaatactcacctaagcaagaaattgatcagccaaggaattgatccaagaactcacaaacccttaacccctgaatcttcttcatgttttagacctcttgcacccgaacctaaccttaacaacaacaacactaccaaccatcagcgtaactctccaagtatggacgaagttgcttgcggtggaaatgaagattctatcaaaaataatactaatgatcatcttgaggggatcattgaccatcatcagcataataactggcaaaactataatgccctattggctttacaaagaactaccaatgaagaaaatgatgaacatattggttattcgactggggaggatgttttctcatccctattgaattcttgggtttacgatgaggtgtttggttattccatatatggtggttcaatcaacttctctcaatcacgcttcgacgatgaatgca

SEQ ID NO: 9411 - DNA, 911 bp, Aquilegia formos X Aquilegia pubescens
  Predicted polypeptide sequence is orthologous to G2116
ccaaatttccgacgtgagcattcatacaacaaaacctgaagaacttcacaagtcagagcacaaacctatggtaataaggaacaacaaatgctacaaattgaatgaaaaaataaggaaatagttgaccaagagaagagcaaaagataatggaaagaatttttgtcagtctatggacaatctagcaaataaaccatgggcattgattatgggtaggtcagcggatgtgaagttaaggactcagttacaaagcactgctgcttccactggcagagatagaagggccttcggatttcacaagatgcgattctctgttgttactactaatatccaacccttgaaatcggcctagtgggtcctgctgcgacatttctgagaaagggtgactgctgcttcctggcggagtatgattcatcatgttagactgagaagaatgaaactgagagaactgcatgttctggtgccttccttgtcctggttgttgcggaagtgagaacattgacgatgtattatacggcatatattgcattcccatgttgaatgcctcactgtgactcactgcttctccagttgcaatcttgagcctctcaacttcctgtttaagtgcttcattcaaagcatcacgtaactgagcttgctgttccatagcttgtaaccgaagctttagttctgtgttctcgctgctcagaccagtcgtatccctctgaaataatgtgagctgtgcagaaagagtagttgcttcagtttgaagagtctgaacttttctctcaagttccaatatatagcgagctttacgctctttggagcgagcagcagactgacgatttgcaagaattcttttggctcgtttaggatctaatgcccaaagttcagcaagtttatcacgagccatagctttcttagcatccataaca

SEQ ID NO: 9412 - DNA, 967 bp, Aquilegia formos X Aquilegia pubescens
  Predicted polypeptide sequence is orthologous to G2141
aatttggtatgtctagcaatgaatctggtgaaggtgaattcagcggtggtggccaaggagaacactctattccggaaaatgatggtggtgagccttcctcgtcgaagggcattagcacaaagaaaaggaagagggctgctcagaatgctgaaattgatcaagataagggagcttcacaacactctggtgaggctaaggctgatgataagtctaaagagaagggtggtcagaatattaattcagcgaccaataagtctgctggtaaacatggtaaagatgtctctcaagcttcggatgcccctaaagaagattatatccatattcgagcaagaagaggccaggctacaaacagccatagtcttgcagaaagggttcgaagggaaaaaatcagtgaaaggatgaaatttcttcaagagcttgttccgggttgcagcaaggtcactggcaaggctgtcatgcttgatgagatcattaattatgtgcaatcactgcaacgacaggttgagttcttgtccatgaagctagcaactgttaatccacgactagacttcaacattgaagggatccttggaaaagattcacgaagtggtccatcgacattaggattttcgcctgatatgagtatggtccatccccagatgcatccatctcaacaggctttactccaaacaggaatacccggtgttggaaactcgtcagatgcacttcgtagaaccattaattctcaattggcagccttgaacagtggatacaaagatcttatgcctcagaaccatcaacagattgcgactgggtgggatgacgaactccacaatgttgtacagatgggctttggcaccaatggccctttcaacaatcaagatttaaatggtcctctgccaccaggccatatgaaagttgagctttaaacatcacctttcttctatcaccaaccaagtgaaagcaccttctgtgtttttttgcattg

SEQ ID NO: 9413 - DNA, 915 bp, Aquilegia formos X Aquilegia pubescens
  Predicted polypeptide sequence is orthologous to G2141
cagactggtggtgagatcatgcctcggaatttatcacagtttccagctgattccaacttcattcaacgagcagatagattttcatgttttaatggtggaagtttcagtgatgtagtaaacccctataacatatccaaatcaatgaattcttattccaaggatggagcaatgattcgaggctcatctgaagctctttcacccaatgcattgaagaatgcattaggtgtccaaactcaaacaaaagagaaaactgatgatgtagcgggatttgtaagagccactgatgaaactacgaatgaatgtaaaatgtccaatgagactgaggtcagtggcagcgatcgtcaagtaaaaccatctttgctggagactcctggagaaccttctgcatctaaaggacaaactgtgaagaagaggaaaagaatttgccagggtactgagatcgacagaactgaaggatctccacaacttcaaagtgaaactgctcaagatgacaatgaaactgaacagaaaaatggacagaagagatcaaatgttggtaaaacaactagacatggtaaagagagctctcaaaattcagatgcagccaaggaggattatattcatgttagagcgcgtagaggccaggcaacaaacagccatagtcttgcagagagagtgagaagggaaaagatcagtgaaaggatgaagtttctacaagacctagttcctggttgcaacaaggtcacaggcaaggctgtcatgcttgatgagataattaattatgtacaatcactacaaagacaggttgagtttttgtcgatgaaacttgcaactgtcaatccacgacttgaccttaacattgaagcttgcttgcaaaagaaatcatcagtcacgggtgtcatccatgtttctttctctcagatacaaatatggtca

SEQ ID NO: 9414 - DNA, 813 bp, Aquilegia formos X Aquilegia pubescens
  Predicted polypeptide sequence is orthologous to G227, G242
ctctataaaccacatctcaatacttcctttctcttcacattctcgaaaacaaaattttagggtttttgttaagaaatagggttttttttttttgttttagatctaaaaaaatcaatggcggctacatcatcaacaacatcaagaagagatcttgatcgaatcaaaggaccatggagtcctgaagaagatgatttgttaacgaaattagttgaaagacatggaccaagaaactggtcattgatttcaaaatcaataccaggtagatctggtaaatcatgtcgtcttcgttggtgtaatcaactttcaccacaagttgaacatcgagctttttctgctgaagaagatgaaacaattattcgagcacatgctaagtttggtaacaaatgggctacaattgctagactattatctggtcgaactgataacgctattaagaatcactggaattcaactcttaaaagaaaatgttctttttcaacttctacttcttcaacaacaacttctatgatgatgatgatgaataacgaagacgacgacaacaacaacaatcttgatcgtgatcttaatcgtccatttaagagaagatcttcaagtgttggaactgttattccaatgatgagttcatcttctggatcggatttaagtgattcaagtcttccttcacctgttatttatcgacctgttgctagaactggtgttgttcttccattaaatcgtgaaacttcttcttcaactaataacatcgatccaccgacttcactctgtctttctcttcctggtactactactactgttacaacaacaacaacaaca

SEQ ID NO: 9415 - DNA, 977 bp, Aquilegia formos X Aquilegia pubescens
  Predicted polypeptide sequence is orthologous to G2344, G929
gtcgtggtagagaaaagagaaatctcacttcgaagaagtagttgcagaaatcgattcgagaggtgtaacacatttttgagctcgggagaagtgtttgaaggtctatgtattactgtgcatgttttaaatgggtatttcggtagcagcatgatgtgggatatcagctacagttattcaaactgagttttttgtatcagatatacctagattccgctgcttcttgttctggacttctgatagcagtaggatagatttgctgtttagtcatagccatgtcgtcatctgttgaggattactcatccaattctgataatagtcgagctgatggacagcaccagcattctgaatcacaaactcaatctcaatcccaatccccagccagtggaactgttcactctaacctggcaccattctcggctgaatatatgatgcctcctcatcttgaagttggccatgctgtggtaaggctttaaaaggcaccgccagcttatccctatccagacccttactacaggagcattttcaatccctatggtgcacaacccatgattcaccctcacttgatggggatccaagccgcagttccattgccatcagatgctgtggaagaaccagtgtatgtcaacgcaaagcaatatcatggtatcctacgacgccgtcagtctcgtgctaaagcagaatcagaaaataaaatgctcaagtgtcgtaaagtgcggacttgctcaacccccgaatctcaaaatatcaagccttacctgcatgaatctcgacatttgcacgcattgagaagagctagggggtgtggggggtcggtttcttaatgtaaagccagatgagaatgaagagaacaactcagcctcgcatgatagcacacagcgtgatactggagattctaataaacaaaattcttcctctgagaaatcatcctgaatccttagtagagattgtcatactaggacacagaagtaatgcagacc

SEQ ID NO: 9416 - DNA, 973 bp, Aquilegia formos X Aquilegia pubescens
  Predicted polypeptide sequence is orthologous to G2394
tcatctgacatacattctgccatgcacacataccttgcgttacacagtacatccttaacgtatctaatcaaatcaaattttctattaggtttatttgatagtacaaacattccataactgtttcagaaaagaaaaatgaagtacggacattatgaaataaagctcgtgcaccagcagattatgaagtagtctctgagatgactagcagccaaatgaactgaacgaattccttctacaaacaagcttctgtttatataagacattgtcacaagtttgatctcatcgaaaaccatctcatgttaactgttaacacaaggatccatcaaattgtgtacccctttaaattaacagttccatcagagttctgcagccaaatcgaagcaaaccgtatatattttgtaatcactcttaatttaaaactgttcacttttgctaccatgtatattaacagcatgaaacctgctgtccattgctgcaagtgaaccgcctggtggggagggagtggtgctgtggtggggaactaaataattttaaagatcaacgtttccctcagataagctagaagagtattgggcagcatcagaccgattcaacattctctttaccacctcaacacttcaggctagcgaaagtcagactggcttatatatatatacacaggagctttaagacattctcactaaaacacagtgctcccatacgctgacccacctgctgattcgcttccaacccccctttcaccttgccgatggctggagtttgctgcagatggtgagccctcgttgttctccccaacctcacacttgcagagtggacataatgcgttaatctttagccatttgtccacacactccatgtggaaaaaatgattgcatggcagctccctcagctcatcgttgtcggcatactttgccaaacaaatgcaacaaacagcatcttctcctgagattacacgctctttttcagttccagc

SEQ ID NO: 9417 - DNA, 900 bp, Aquilegia formos X Aquilegia pubescens
  Predicted polypeptide sequence is orthologous to G2457
aaggaatttgacttggttcaagtagctagctagggttatgttaagatctagctctttatacacctgggaacaagtttaagcttttcaacaatcttcactagctagtaactagctagtctcatcaactatccagttcatctgtattaaaaagtctatttgatgttattgtaaatgctatctatcttttttagtattattctttgaaaattttgcagtagtactgtgtgtttattattcctactaacattcttgcacagtcttatttctttgataaaaaattcagacagaaactgcaaagcatgaagatttctagtcaccacactcaccaccacataatgtttatctttccttttggtctatggttcctttcatcatgtcaatatactttctttacctctctctcttctctttctatatctctgaagagaatctcaatagcagatctacaccttgatcatctctctatctctctctctctttaatcatgttcaccttattcatcaatagaagtggttatgaactttgtgggttttgttgcagtcaagtcgttttcttctctctctctccctcctttcttctctgttactatattacttttctttgtagtatttgtttttggtctgttcaaaaaagtcaggcgcaccaaaagcaataagaaatagctgaacatttggtcatcgatctatcattagtttaggagagagagagagcactttgttcttacatacttatttttgtactggaattttgttcaaagagaacattcaaagcttactaattgcaacttctctcttttttctttttttttttctttctaattatgtgtttttggattgcacgtcagtgttccatgcaccagtttgttcaatgtggtgacagttggatgtgggcattgcgcta

SEQ ID NO: 9418 - DNA, 869 bp, Aquilegia formos X Aquilegia pubescens
  Predicted polypeptide sequence is orthologous to G2550
tcaattctataaaaacaactacagaatcagatgaatataaaaagtaatgcagaagactcacctcatccaacatggatagaagttttgtcaatttattctgtaaatcctgtcgttcaccaggtgatagttcaactgtagagttactagtttgttcttgactgtctgtaggaattccggaagtagaaggtgcagtagtactatcctttgatcctgcatcagtctctctgaagctcttggaaccaaccccttggtgtttaccagcatcatgttgtttcagagcctttcggacattgactacttcatcaagcagttgttgtgttgccttgaggtatttggaattgggaatggtacttgcaaaacctggcagtccatatggagaagtaactaaatgcatctgcttggggtctaaggaaccctgcaggttgttcaatgcttcctgtttgattgcatcatgattgcctccctgaaaaccaggctgataataatctgcatttcttgattgcttatttggagaattttcctcatctctacaagtaccagatccactgccaccttctcctgaaatggtcggatgagaagccaagaaggaagagaggccagcattaggatgtcggaactggaatgaagggacaggaacagcagaggagaactgtgtgctaagactaagggatagtccctgtccctgcatattctgcccaccatctaggactcctaattgtggacgcagaccctggtggggatcctcattaacagtatcacggacaagatcatctctggcaccacttatttgtgcaccaagagattgaatggttgtatgtccaccaattggctgcataaacatttcgtttcttccatctctccatgagttg

SEQ ID NO: 9419 - DNA, 960 bp, Aquilegia formos X Aquilegia pubescens
  Predicted polypeptide sequence is orthologous to G2632
ggactttgttttcttgttcttctgatctcttctctctcatctcatctcatctcatgtctgtttgaaagatttgtccttcaatttggcttcaacacctgttaagtacacatatgaggtttaggtgttgatggttaagcaattaagttggaatcatgtgttcaaatcctgaaacaacaaatccagttgaagttgatcatagtaatagtaattctcaaccttggtggaaaagtaaggggtataatgctgcgccttcacttgaattaggtgatcctgcatcgaaaacttcacttgaatcatcaccggatagttgcatggtgacaaaagagggaaaaacgcaaggtgatggtggtttaaatggcagtgatactgtttgcaaagacgttgtaacttcggccttgccacagtcagggttggagggaaatcagggccctggacaccggcatctacagcagcttgcatctattgcacctccaacaggggttgaatacctagtctcacagactcagcctgaacttgttggccactcaattgcttgtgcagcatatccatatcctgatccatattatggggggttgttgactgcctatggagccccaactctggtaaatcctcaattacttggaatgcaccatactagaatgccgttgcctctcgaaatggcagaggatcctgtgtatgtcaacccgaagcagtataatggaataatgaggcgaagacagtcacgagccaaagccgagatcgaaaggaaactaattaaagttaggaagccgtatcttcatgaatctcggcaccaacatgctctgagaaggcaaaggggttgtggaggtcgttttgtcaacacaaagaagcgtaatgatggaacacagcaaacacccgaaaatggcacaggatctgcttctgtggctccaaatacaaagccatcaactccaccagggttctgcagtgaccaatcagtttact

SEQ ID NO: 9420 - DNA, 969 bp, Aquilegia formos X Aquilegia pubescens
  Predicted polypeptide sequence is orthologous to G264
caagcaatagtaatcagttgtatttctatcatgggcgtattctgatgtattcataattgcttggtgtcatagttagagatatcaacgataataacatatatatattcacaaagctagctggtagtgacatcttacattcttacatggaattgactgcatatcacatagaagctcagagagtgagctgctccgtatcactcgtgcttttccatggctttccatgtcctggcctcctctcttcttgatcgtctacctggttgcctctaaaactagaacttgcttcttcagtatctggagagcctggtctttcagttaagtactgttcccaaaagccatcattcgctggggcctgagcagctgcatgcacttgattactagcaggggcctcgtgcgaagatgaagagatcgcgtcattattggttatatttctattattcccaacatctctgacattattctctttgactgtagcgcaagacctcacctcagtagtaatagtgtcatgatttaactgggaggacttagctgaatactgctcattattggcttgaagtgaagaagaggcaagtgttagattcaaatggcaagggatatgaccatcaccatcttcaatagaagtcaaatcagtatccctcccctgtctagataacaatgaactatttcctaaagaaaacgatgtaccagtatctgacaaatccaatgtttgtggtaccagcataagagtttcagttctcaagtttgcattatgtggatcttcatcagatgttcttgtttgtggactcactccatcttcatcggagctttgtgcagagggggaaagaaaagtagtgtttgatacagctggtgataactcaagtctaagcttattagagaaatcctgctggataacatggcttgaaatagacctgttctgatcgtctatataactagtctctgcaacatcctgaatgtaatcgcccttgggcaatc

SEQ ID NO: 9421 - DNA, 923 bp, Aquilegia formos X Aquilegia pubescens
  Predicted polypeptide sequence is orthologous to G2655
gaagtttaagagctgctaaagagaagagatgagttcttctttttttcatcactttttgaagcagtagtgaaaagcacaactcctttaccaactttctttctttctttctcccacactctttcttcttcttcttctttcaagacttgaagagttgaagtttattagttactagtatttttcatgattctatcttattaaatgttactagaagcatttgtttctgatgatctcaacaagtacttcttaaacaacatgtatgacaatatgtgttctactactactcaacactacatccatagttcaacttctacatcaaatctattcaagaacaatgttgggaatagtggtgggattcttttctctaacaatgagagttttgaagatttaacaccattagattcttcatcttctatgcaattaggaggagggagctttatgaaaactcaagatgatgcatcaaattctactacccctcgaagtcgaaagcggtctagaagaccaagagtatgtaagaataaagaagaagcagaaacccaaagaatgacacacattactgttgaaagaaatcgccggaaacagatgaatgagtaccttgccgtgttacggtctcttatgccggaatcttatacacagaggggtgaccaagcttctatagtaggtggtgctatagaatatgtgaaggaacttgagcaacttctgcagtcgcttgaagctcaaaagcgccaacaaacgcaaaaagaaggaactgatgaaagctcaagcaacttcttccctcctcctttttcgcagttcttctcatgccctcagttctcttggtgtcaaattcccgggtgacaatccatccgagaatcggactgccattgctgatatcgaagtcacattgattgaatctcatgctaatcttcgaattctatcaagaaaga

SEQ ID NO: 9422 - DNA, 932 bp, Aquilegia formos X Aquilegia pubescens
  Predicted polypeptide sequence is orthologous to G2655
tttacttgttcaaaaaccttgtacacaaatgcacacaacataaaactaaatttgaacaaaagatttggtgcactcatttagataagtagatagcatgcttggggtggaaaactgaaaatggattaggatttaggagttatggtaattttcaagtttcaactcaatgcagcagaagtagcagcagcagcaacaccttcttcttcaattctttgtaacatttgatgaacagcagaagcaattccatctactgatttcagttggcaatcttcttcaaccttaacactaaaagaatagagaacaagttgttcaacagtagtaacattaagatgaagaactgaaagatgaaggttttgaaaaccaacaaccatctttaagatctgttttggtcttttctttgaaagtattttgagattagcatgactttcaaccattgttacttcaatatctgcaattgatgatttattctctgccattgattcctttgttgcatttgatgatgaattgttgttttgattacaacttgaagagtattgaggatatgcgaagaaatctgcaaaaggggttgttgttgttgttgttgctgttgctgctgcttctggttgttctttaatttgcttttgtgcttcaagtgattgaagaaattgttcaagctctttcacaaaattaattgctccacctattattgatgcttgatcactcctttgaacataagaagctggcattaaagatcgaagaacagcaagatactcattcatctgttttcttcgattgcgttcaacaacaatgtgggtcattctttgattctcaacttcttctttgttcttattaattctagttcttcttcgctttcgccgcgattagtactagtagtactagtagtatttgcagatgtcttcataagtagagatgattcatcacaaactcttcagatg

SEQ ID NO: 9423 - DNA, 884 bp, Aquilegia formos X Aquilegia pubescens
  Predicted polypeptide sequence is orthologous to G2655
aattaaagtacaagcaagaagctagtgtgtacaatgcatttgcacgagaaaaccagaatttccatgcatttacatgagagtacgaacatctgaagaaaaagtacatcatgactttgatatctcaagtacatatcttatatctagatctaaaatttgtcatgctggtctggaattattgatcatattaattacttaatcaagctggttaaaagttctcttgaatgtagaagatttcctcaacgtgtgcagtttacaagctagctcttgcaatgttgttttcagtagagcaggagatctttccagtccgtcagatatcttgcactcagagtgatgtagtactttgcttccatcgcgacaatgagtagaactaacaagttggagattatgagcttcaagttcatctaatatagctgacaacaacaaagcctgtgaagtacccttaatatctgtcaaagtaacattaactcgatcacctctaacccgaatagcaacagataaagaaggttcaggagcaaccttaatatcacaatcacttgaattcaaaaaatccgatgaattcctgtcggatagtagttgaattgttggtgaaagtgaagtcttattattagacctattcaagggaatggattgtttttgaagtgacccaagttgagctgcagctaatggaatgtatttgatgatttcgtctagaattgaagattgttctttccgaacggtgttgggttgaggaagtaaagaatgtagtgataagaaaagttctctcatagattttctacgctcacgttctgctaatatgcggcgctctcttgcattaattggtgagccagatgaattcctttcggatgatacatcccaatcgttattccattcgactgtcattgttt

SEQ ID NO: 9424 - DNA, 998 bp, Aquilegia formos X Aquilegia pubescens
  Predicted polypeptide sequence is orthologous to G268
cttattcacatgataaacatacaatcaatgttaactatgggcaagatacaagtagattacaggaaagaacaaaaaaaaattgcacatcacacaaaatactttactgggggtagtttgtcccctagcatgacttaatctccaacctctgccaccccttcaaaacatttgtagtttgatttgagagcactatctcttgcaagacaagaggaaaagatgtccaaattgctgtcttttggtttcaaatatttatcatcggagcatatgcttatcacacatcaagaccttccaacttgcatgaggaccttcagaactgtcatggattcctgcttgccatcccatagctgtagctatctctttaagttcatccataatggttactgaatcgcgaatgtaaactcgtccaccaggtctaagcattctatccatttcaagcatgatcgtcgagacgttgcatcttttcttctcaactgtgaagaggccatttgcatgcagcaagtcgtaagtccttggataagtatcaaaaggctcacaccagtcatgcataactcctatcagcccacggtcatatatgacaggcagagtgttaggaccactaacaggaacaacgttcattacccaggaatctaactgaagatcaatcattgctgctgcaaaccctccaagcccggccctcatgtccatcacatttcgtagctgcagtttcttccaatggtaagcacgaacataactttctattatgtcataccaatatttggattctgccttcaacagctcctttctagatatgtaggcatccatttctatgctctggagcctatcacgagggtgatggaggcgctcaggccatgtagtgacgtttgctccatatccattttcaggtagtcgagtgatgcatgctttcaaccccacgtaccagacatcatctggattatcatctccgtcacacagaggaggttgagttccagcatcacgattaacataacagctattattcaaag

SEQ ID NO: 9425 - DNA, 900 bp, Aquilegia formos X Aquilegia pubescens
  Predicted polypeptide sequence is orthologous to G274
ggggaaaataggaatacataataaatatcgtatgagatctaaacaaaagtattacatcagaaatcagcacgataaataattaataaacatcagaaggaaggttgtccccctttcattcaccctttaacgcgccatgaaaaaacgctcagggtgtacattagaagtagatcaaaaaattatgcttatgcgtgctgtgagacctctgagagcatggctgcctgctgataaaacgatgggacttatattctctctcactgtgaggatgtagaattattgtcaccaacgacccaatattgctttacagcaaccaatatcttctcagggacaagaggaccatcctcgtgatccaccagcttcaagttccatctcataccactagcaatctttttcaccttgattaacacatcgacttcatcgcggaatatgactgctccttctggtcgcaaaatacggtccatctctaaaagaatgtcttctgcgctacatttgtttttgtacaagctaaaaacaccattagcatgaataaggtcataggtccttggataagttgagaaggcttcacaccagtcatgatagatccctattaatcctcgctcaaatataacacctagagtatccttctcagcaatagtaggcatgacattcataacccatagtttggaggattcaattgctgcagcaaaacttcccaatccagcattcatatccaagatgttgcgataccttcccgtgtcaagtataggattgacctttttataagcttttacatgcttcttccataatttgttatcttcgaggtacgattcaacggaaattccagggacagatccactacttattctgggaggtacagcatttagtctttcagggaaaggcttcagctcacctccagcaacttca

SEQ ID NO: 9426 - DNA, 936 bp, Aquilegia formos X Aquilegia pubescens
  Predicted polypeptide sequence is orthologous to G274
tgacagtatgacacagattacagttacaacatcaacaacaataagttataagctcattaatctattactcactggatgtgctattgcttccaccaccaacccaatactgttttacagcaactaatatcttttccggtactaacggtccatcttcatgatctagcatcctagtgtcccatctcatccctttcaccaccttcctcaccttgttcaggacatccacatcatctctaaatataacagctccttcggggcgtaaaatccggtccatctccagaaggatgtcttctaacttgcacttgttcttgtacagactgaacaaaccactagcatgaatgaggtcataggtccttgggtatgttgagaaggcttcacaccagtcatgatatatgccaatcaaacctctttcataaataactcccaaagtatttttctcggcaatattgggaacaacattcatcacccatgattttgatgactcaagagctgctgcaaatcctccaaggcctgcattcatatccatcatattccgatatctcccagaaccaattaatttgttgattcttttataagcatttacatgctttttccacagtctattatcctcttgataagattccactgtgactcctggaacaagtcccttgactactctaggaggcactgctaaaagcctagctggaaatttctttaactctcctccagcaacttcatctggactggtgacttctggataaggggttatacatgtgttcattttcttgtaccagacatcatcatagtcagctggctcacagaaattagtggatttccttttacaggaatcactgttaacctttttcctccagatggctatatctcccttctcatactttttctcccagcaaagactttcagccaattcttcaagtgcattttgctccttctgtagttcct

SEQ ID NO: 9427 - DNA, 901 bp, Aquilegia formos X Aquilegia pubescens
  Predicted polypeptide sequence is orthologous to G2747
gtttgataaagttgtcacaccaagtgatgttggtaagcttaatcgacttgttatacccaagcagcacgctgagaagtactttccactggactcaactgccaacgagaaaggactactcttgaattttgaagatagatgtgggaagtcatggcgatttcgatattcttattggaatagcagccagagttatgtaatgacaaaaggatggagtcggtttgtcaaggagaagaagctatatgctggtgacattgtttctttcgaacggggagctggtgaatctgtcaaagataggttatacatcgattggaggcgtcgatctgatgttcaggatcctgggatgttaccgcctctacctcttctccatcccctctctatgcccaggtctgcaccttggggaggactaatgttgccaccaaacatgccaatgcacatgccacgggacgatatggtttggcagcggatgaattatgctcagaatcataatcatttccaaaggactaattacagtggcatcagtgccaatggttacaatgtagtgaactccggatcaagcccaattttttatttaagatcatcagctccatcacaacagattggggtaatccaacaaggtagggatgcgccgacggtattcaattctgtgccagtagtccatggtaaggcatcggcgaagagattcaggctgtttggtgttaacctagaatgtccaatgccagaaaaccctgaataccaatttttggattcggcaacaataaatcatcctacaattggttctcttgctccctcccaaattcccccttccattccacctctccagctaaggctctataacagtgaatcaccaccaagagaacagtctgattcgccaagggaaaacgcgtctatgtcattggatttggac

SEQ ID NO: 9428 - DNA, 887 bp, Aquilegia formos X Aquilegia pubescens
  Predicted polypeptide sequence is orthologous to G2754
tacttcagttataaagattagaacatcaatggttttaaactcgagcaattacatacggcactttaccatcttccatttcatattgctacactagacaacaaaaacaacaacactagaccaatctccatccataaaaaaaacccttctacagtagtttcaaaatgaactttccccaaagttcccaaaaaaaggggtcttcaaatagcttctcatctatccgctcaaaaatcaggtagagacagttagtccacagatcatcaacatcatcctcttctacacaaaaagaaactcgacaacgacagatttgtacaaacaatcaactgttgagtgtcgacagcataccaccagtcttagttggtataaccacctcccatcctggccctttcaagggatatatatcattcaatgctgtgatcttaccatcatcagctgaggtgccattgatcagatcactacgatccaaaacccttcgaagattttcatcgcttatctctgtctgaatcatcttctcctcaggattttcctcatctcgaagcagagccaatagatcctcttcctcaaagacattcaaagaattggacttagtcctttcttgctggaactggcctttcccaatcaccacatgctcaagcctcaacttactgaaagctctcttcaatacgcgacactctactgactgtgctgtagcgagtctatacacatgaactggacgggtttggcctatcctgtggcatctatccatggcctgcaaatccatttgagggttccaatcactatcatacaatatacaggtgtcagctgaagtgagattgatacccaaaccaccagccctagtgctgagaagaaatattcttagattgctgtttacatcattgaactcctggatt

SEQ ID NO: 9429 - DNA, 948 bp, Aquilegia formos X Aquilegia pubescens
  Predicted polypeptide sequence is orthologous to G2766
cttcgttttgattcagtgacaaacaacatgagaaactgaaactccctaacacacaaatacaccatttgcttccaacggtatttttcacaaatcatacccaatcttaataggttaatctaagttgggttcttgtggaacgtctaattaggactgaacagctcatcagcattcatatatgatgtaattaatcccaaaggaaaagaataagtaaaataaccactactatacaacataaggcttctatcaacgtgcatgattgctatatttgatttggtgagtttcagaaatgaatccggctcaggtggccgctaccttctacatcacctatgccacccttgctttgatgttggaagttcttgatcttcctgtctagccaatgttataaggctggcttgcttgagttgcttccacaagtgcaatgatccagatctttattaagtttctggacttcggtctggaggcctttgatgtgttgtacggccaaatctaacatgtctgctgtgcttgtttgcttgtccatgttaggaacaagctcttgcaatttcctcaacttgtcacttatcctcgtccttctttccctctcggctatacttcttggatgagtagcaaaaccacgcttagcacggatcttgcaaggaacagagtcaggttggatctgcagaagcttctcaacagccgccatctctaatgaggtcctgggtaagctaaactgggagtctacaccactgagcgcagcaacgatgtctccgtcgattgtcttagctcgtttgtttgatggttgagaaaacataatcgtattgccatcatcccatgaccccatttgatacctgccagaaacatacgcctgtcctgcatttcgtacaccatcatcagaactacttccatctccaatactctcactgacttcagatatctgagaaagagaatcctgtctggtgaagctcaatt

SEQ ID NO: 9430 - DNA, 821 bp, Aquilegia formos X Aquilegia pubescens
  Predicted polypeptide sequence is orthologous to G2789
agagacaattggaatgtaagaaagatagcaaattccatcaatcttttcttcttcttcttcttcattttcttcttttgcttctcttccaacttttaccgatcacatggggtaagttgtaggaaacttttctcatgaaatcaaacttaccaagaatacttgaatttgtacatgcttcctcaatcaatcaagcagaacatgaagcatcaaatcatgatcatcaaactgtgaaaacgaagatattaaaagaagaagaagaaaccaagtaattgaaaccctaataatctccaacaacaactcatcaaattctcttcatcagcttgaattcctcaaagggtttcttagcaattactcataggtaatgggaaagtggaaataaggtaggaagaggtgtttcttgtgtgttttgtcaataaggtggacgaccagttgcccaataggcctcactaggtaattggcaagaattgagaaggttgggtggtaagccttgaaagagtggtgcattaggatctgccataagttgctgttgttgttgttgttgttgctgctgctgctgttgctgttgttgaccaaccattcctggggaatcaaggggtcctccactttgcaaagggagtggtggctcctcatcttctagggggagccgctcataggctgcgttaccaaatgacgcagccattattactaccggtcccgatgctaaaagttgtccaacaacgcttccaccgaccacttgcccttgccctccggccaagtaaatcgtcaatccggtggctgatgggggagctggtggtggtagaaatgacccagatagggatagaatt

SEQ ID NO: 9431 - DNA, 842 bp, Aquilegia formos X Aquilegia pubescens
  Predicted polypeptide sequence is orthologous to G280
agtggaactctctaaaaacaaacaaatcctataaagaagaaagaaaaaaccttgccatcatcaactgcttccatactttacatccccaattacagaaacatgaaacacccaaacttaaaaacaccaacaagtcaacaactactaaactcaacaacaaacagacagatcagatagattcaggtaaacaaactaactcaaagataaactaaaatcagcctaggcttcctcaatcacacccaactgctgcaaattggggcttaaccttaggtggtctaccgcgaggcctaggtaatccagtcatcggcacagtggtggtagtttccgtttccgtttccgttgccgttgctgtagattctttgtcagctcctgaatctttctttgggggacgaccacgacctctaccagtaccagaagtagtgactttgagaggagcaacagtaacagagagaggatctctctgcttaggaggacgacctcgacctcttggtggagcagttggatcagctgttgctgcagctggagtagttgaagaagcagaagcagcagcagcagcagtcttggctttaggaggacgacctcgacctcttttgggtggagcattagggtttggacgcatatagttgttcttgaccaaaacaagctcaccgttgtctttcatctggttaagactgtcagtaataagtgtggtatgagattcaggtagatctccataagtagattcgatatatttcgaaattgccgacttgtttgaaccatctttatcatccaaagagtcaattgctgctagtatcatctgtatatttaatagacaaaattaaaacaaacccacatcaagatagatc

SEQ ID NO: 9432 - DNA, 957 bp, Aquilegia formos X Aquilegia pubescens
  Predicted polypeptide sequence is orthologous to G2982
cttaattctaatactgtattattacatcaggaatattagggtaaagtaaacaacatgtatgttacatcaaggcattatacgattctagactagaaaatcgtcacataggaatgctttgaaagctttgatagacagacagacttgcccattcttcaattctttcaactggttatcaaaaataactgagatgagagacccttgcatcccaagggacccattacttacacactttttacaaaaaataaaataaaataaaataaagaacttaaaaatgacaaagcttaactattactagtgatcatgcttagaacgagcttttagtattcctggaagaggaggtgatgtgggaggtctacctgaagcagtcgacctaatgggatgttctatctgggactggggcatgctatgaatgctggagctctcacctccagttgcggtagcgttatgggtgtcatcggcatcttgtggtatcttaccaagtctcatagctttaagaacatagttgtcatcatgtagctcaaacggggtgctgttgaagtcaaaatgcaccagctgcatatcttctgatatttctacctcaacggttgcatgaggacgtgtctgaatcagaataaaaggtaaagctacaccgcctgtaggcatttttcctgattcatacatttgttcgtttcgttgtatcaggttttgaagacctacagattgttcctccaattcttgtaaatatgcagcttttttttcaaccctatttttgagtcctatacgttcagactttaactcttcaatatcacttgcactagtgtgaggtaagcctttccactgtatctcttttttatcttttgatataatatccattgccatgagaacattcagagcatcatagactctacgccgtatatttttctcgtagtattgttgcctatctggagagtctggcctactgttaggatctgcgattca

SEQ ID NO: 9433 - DNA, 883 bp, Aquilegia formos X Aquilegia pubescens
  Predicted polypeptide sequence is orthologous to G2989, G2990
cttttctcatcttcttaaaacatacttcagttaatacaacaattagacccaaattaataaaagaagatcagagaaatttaaacaactactacaattaattaagtctacaacaagtacttcgatcccctaatctaaaaaaaaaaaatctaagaagaagaagaagaacaattagtaccaacatgatgatgaacactactattaccatgattctcatgattgttgttgttgttgttgttgttgttgttgatgttgttgggaagaggaggagaactagaagagacagtagtgttgttgttattgttgttgttgtgatgaagaagaagattaggagtaatggcaccattaacatctcttttcccaaaagtatgtttgttgttatgcatccataccttcaaaacacttttaccaacaccaacttcattacaaaaatcttcaactaaactttcatctcttttctgcatcttccaacccaatttttcagaaaaagaatacatcttatctttctgttcttgactaaatttagttctgaatctttttctaccaccatttgaaccagttcccattggactaattactgtaccatcagctgtagtagtttgttgttgttgatgatggttttcaggtttaactgataatccaccagtacttaaagctaataacatttgtggtgcagatgctgggtaataagaagatgaaattggtggtggagataaagatgctgattcatttgttggacttgttggtgcacgaatttgagttggaagttgatgttgaagatgatgatgagggttatggtattcaatcaaatgagttgattgtactacatcttctggatctcttctatgaaaattacagtgacatccacaagctgcacattttaatg

SEQ ID NO: 9434 - DNA, 886 bp, Aquilegia formos X Aquilegia pubescens
  Predicted polypeptide sequence is orthologous to G2993
gtcattctcttttcacactctttcattaactttctctcatcttcttatcaaaagaaagcctagcctagcatatgcttagtgctacaataatcccattgttttcaaactccatccaagtgctagccatgatcctgtgttctgcaatctcaaggttcatttcttcttgggctaactacacttccaaaacaattagttaaacaaaatcttcttctcattcttcgctaaactccaaatcagtccccaactcccaatgtactttgtgacattcaacttcttatcttagcatctcaaagagttctgatcatcagcttagcttgtttgtgtattaacaaatctgtttttttacttcaatccttgatatttagttttgttttgtgtttggtggggaggagtttagttttccttccatttggaaaaaaaagggaattaatatctagataatgttacaaagattctcagtgtatttagagcaatgggggggactggagagatagaagtagataattgtcaagtcttatcccaagaaacccaggtcacaaacaacaacttgctgtaaatttaatcattataggcatctaattctctttttatctttcttccttcttttggtctcaaaacaaacaacaacaagcaaacaaaagactgagaaaagagttgagacagaggaaggagatggatctttcaagtcatgaaggggatattccaatgccaataacaagttcttatggtggaggacttggacatggccatggtcacatgattcatcatgattcccaatcacttaaccacaaccacaatcacatcataccttcttcagcatctcaagtagtactcccctcaaatggccccattaatccttcaactctggaagatcacatgccttaca

SEQ ID NO: 9435 - DNA, 931 bp, Aquilegia formos X Aquilegia pubescens
  Predicted polypeptide sequence is orthologous to G2998, G2999
tgcaggtggattaacaacaatgctgagagttggggctaaaaccccccacaaaacaagaacattaattttatgtagcttttcttagtatggagtcttgaatcttttgattccatctaccctcagctccattgtaatcccatctattaagctaactacctatctggtataattattgaaagattcagttatgtcttacaattcttccttcttcttcattgagtgcttgttgttgtgcatccagaccttgagaacttgcctcttcacaccaacttcagcacagaactgctggactgctgcctcatcttgcttttgcatcctccatcctaccttctcagcaaattccatcatcttgtctttctgctcctttgagaactttgttcggaatcgcttctttgataagctcccatattgtgacggttgtggtgttgtcccttggccagcattggtgtgaaacatattcatttcctcgcttgaggaatcggttgctgcactaccaccaccaccaccaccaccaaaggtcaccataatgggttgcatcattgcgccggatggaggactagaaggcaaaccaattgggagtttatgatgttgaataggctgaggtataggtggtgctggtaatggaggaggtagaattctacttcgacttccattagccttgctattcggattgtagcaatagtagtaatttgcaccagattgagcctctccatcagactctttcctgtggaaattgcggtgacaatcacacgctgcacatttcagggattctactgtcccttcttcaccaagcataaattctccacaaccatcaacaacttgaccaccaatactggctgcgtggttcttaagacactctcgatatcgaactgaggagacttcatttctagctgtggagtcctgggggttgatcccctacaattggtgcagt

SEQ ID NO: 9436 - DNA, 937 bp, Aquilegia formos X Aquilegia pubescens
  Predicted polypeptide sequence is orthologous to G3055
tattgcttctaagtactaatcatactaaagcttcttcacacgtgagaaagaaaagcaaattcgatcttctaaaccttacaaatgctaatacaatattagaaactatgtattgtttggatgacgaaagccatcctacatttatgttcagggaaaaaaaactagctataaattgaaaaccaagtaaacaagctatgaaatactacttctgatataaaattcattttgctatccaacagtaaaccatcaaacctgtagcatcctgatgaaaaccctactgtttatcaccaacattctcttatttcattgtcaaatcaatgaaatccaattatcgaggagtatcccattcattgtcatcaatccaatcaccgtatatcctactgatcttgtctgggcccttccatttttgaattggcctcaaccccggcctcacatttattcctgaggaccgttgtgagggaactcccatgtgataaacatcagtatgaggagctaatgtggaggatgcaaccacagtctccattggtgtctttgaagaaactccaacctgcttcatatctgaaggaactgatgcaacatctctaccttccacatccacaagccctccaccatatctgtgtagttctcctaatccatgggcaaaatggcacttgcttccgaaagggcaatatcctgtcatttcccacttgttacaaatccttgtcttccagtttgaaggcttctggttcgatccattcacattgtttccatacccattattacccatagttggtcccaaactgatcgcgacactttcccgagcttttgactgttcatcatgaagaaaagtacaattatctccatagggacagccctcctcagtgtagaacttcttgcaatgacgccctttataagacctttgactctcagcacctaaaccagaagagataagacaggggat

SEQ ID NO: 9437 - DNA, 969 bp, Aquilegia formos X Aquilegia pubescens
  Predicted polypeptide sequence is orthologous to G3060
tctattttctccggtcgagaaaagagagagactcagagactcagagactcagagacctcgcgcccgcccttttctttctttctttctttctttctttctctcttcttcttcttctctctctctctctctctctcatctagggtttatctttgtttcaaatttgttgatagggtttatctttccctctctctctctatcttgatttgtgtctgccatccatggacttcggacgtgctcgcaaaagagggaggcctgaagctgggtttaatggtaatgctggtttcaagaagaacaaacaagaaatggactcctttcctggtataggaagcaaatcgaagccatgcaccaagtttttcagcactgctgggtgcccatttggtgagggatgccacttcttgcattatgttcctggtggcataaatactgtggctcagatgaccaacatgggagggaatccagctcttcctcctagaaatgcaatgggtccacctccctttccagatggctcatctcaaactgctaaaaccaggatgtgcaaaaaatttaacagtgctgaagggtgcaagtttggggacaaatgccatttttcccatggtgggagggaaattggcatgccatttgcaccatcgcgtgaagatcctcgtgccatgggccctaacatgggtaggtatgccgggaggcctgagcagcctccaccaggacttgctgctgcagctagtttcggtgcctcagcaactgcaaagatcagtgtggatgcctctctagctggtgcaattattgggaaagaggtgtgaattcaaagcagatatgtcgcatcacagtgctaagctatctatacggagaacgaatcagatcctaacctgagatatgagcttgaagaacatttgatcagattagcagctagtgcaatggtcgtgagctatgtgatatagtctactgcaggctatgagcaacctgctgcacagcacc

SEQ ID NO: 9438 - DNA, 885 bp, Aquilegia formos X Aquilegia pubescens
  Predicted polypeptide sequence is orthologous to G3067
cataaaaccatgtgagggtacacttgaaaaaaaaatgaattcaagaacttttttttttaactcagaggtttacagattacaacaaagcaaggaagtagagctcttggattaagtaaatagagttcttcaatatttgaataaagaccaactttcccagctaatgaatcaaaaccaacttgacctgcaagttcttgaatgttttccaatggtctatgaactctaccagcaatcactctacagactatcaaagctttccttaatgatggattttcctcattaagttcaacagattcaaatgctcttccactagttgatgttgtgaaaacaccaataccatctttaagctcttttttagtagagaaaccatgtcgtataattcgacatacactgcatttttctgatatacacaggtttgaggaaccattcatacctagtggacatactaaacttgttccatagaacctcaatagctcatttccatcggcaaggcaacgcgaatgtttcttaggaagtttgctggctttgttctttaccatctccctgtattcttcaaaccgagcaagcgtcttttgcatgttatggacctttagtactctatcaatacgtgcgcaattgttctctgatttcaaccagcttgttctacaaattatctcgacaattttgcgcgatgagtctccttcagcaagttcagtaactgcatgtttggagagatgatgtgcttctgcagcttcccatttcccaaattgctccccacatttggggcaagtaacaagagaaggcccattcgaatatacagcataagaggctttaaatcttgaagacataccaccatcaccaaatgtagcagaacttccaaatctagagcttttgttaccagagagagga

SEQ ID NO: 9439 - DNA, 931 bp, Aquilegia formos X Aquilegia pubescens
  Predicted polypeptide sequence is orthologous to G3074
ctaatactttgtcagtgatggctaatgagtaataagcagccaggatggtggtacacaactgcacaacccatcggaggtcataatgatctcttcttgttagtattgatgacatcatataatacaattcccagaaaggacactcttcagaatttctacgtgtaaagcacatttcttgcccaaacactggacatatttgttgcccaaacaccggagacattcctaaccccctaaagctcttgatgatattcagtagttcagcatatattcacctactctatatcagagctgagtcaaacctaactgccttctcgcaccactatccttcttcgtcataatcttcatcatcgtcatctaagcttctattaaggtgaacaagctgaagagggtctatggggactttctccatgtctgaatgagaccaccctggatattcttcatgttgcatctcaggggggtcagttgatgagataggggctgctggtactgagacagtggctgctggtactgagacagggggcgctggtactgtgacggttgtatcgccattcacatgcaagtccacatttaaatcaaagttccgcacagctagattcgtactgccacccactggcgttctggcttccgtctcaatgtctacccgcatggggtccatattctgtttgtcatgttgaggagacatatctggatcatcttcacacttcacagattgagcactctggctattcctgccacgtcctcttccacgcccccttccccggcctcttccactgctgctgttgctgcctgcatcatgcagtctgctcctttttgcctcatcgtcagtatcattatcctcatcgtccaatgtttttcttcttttggcaacggatcgatcctcggcggcggcatcggatccacctaaatctgggaccttactgacaatttctctcag

SEQ ID NO: 9440 - DNA, 898 bp, Aquilegia formos X Aquilegia pubescens
  Predicted polypeptide sequence is orthologous to G309
acaaactatttaggtctgcaaaatacaatacacattgacatattaagctatccttgagctgaggaaaattcagaaagggcattaaaaagtggaaaaagaaaaagaaggtaaaacataaaatgaaagggtgttgagagctcagagaagcactttgaactttccagtgctggtgggtcttccttctcagttctctttcacaacctctcaactcaatctgaaaccactcaaatcaacaagaatctggtttggttttggttggattgctaacttggcaaagggactaggttaagactcattgaaataattcaactgaactcaactaaatcggcaacaggtccaagtttccaggccgaagtagctatgagtggacgagtatgccaacccagcattaaacaaccttgattttcctccaccctgtaccctgccacaccaccaaacaaagacaacaacatactcgcttgcttaaacgcattcgatccaaggtgaactggattaaatccagctgatcccattctaattcgccattgactcaatgtttcatgtcgttcaactctttccaatccttcacaagcaaccacattacaaatctgttttcccaaatacacttcagacatcatttgatcttcactagtactaccaccaccaccaccaccaccttccaatgagtcaaacagagttgagtaataatgtaacgattctgtaaaccgatccaagaacactgatccattatgatttgcttcttgttcaacaattgtcacaattttcggcttcatacgtctaattgaattcaatactctttcaattgcacctggtctagccaacaatctatgcaactcaaatactgaattaaccgcaacagcttcacccgatcgaagattgagcatttcagcattaatat

SEQ ID NO: 9441 - DNA, 906 bp, Aquilegia formos X Aquilegia pubescens
  Predicted polypeptide sequence is orthologous to G309
aatacatatctgattatcaacctctaattaaaactataaattacaataacaacataactagactagaaaaacaaaacctggtaaattaaaaaaaaaaggaaaaacagcaagacagagagagagaacatgaaaacttttggtggttggtgcagattctccagtttccaactcagaatcatcagaaatcagataagcagcactccaaagactgaaagtggtctgctactagtggttgttttggtcggctagacaggtagtttaataaactcagtgattgaactcagttacactccgatttaatacttgaaccaatttgccatgctgaagaagcaacgagtggacgagtatgccaaccaagtaacaaacatccattgttttcttcaacattatatccactaccagcatcaaacatagtcaataatgagttaacttgtctaaatgtattagatccaagatgactcaatgaaaacccagccgattccaatcgattcctccactgattcaaacactcatgtctttcagttcgatcaacaccttcacaagaaacaatattacaaatctgccgtccaaaatacatctccgacataattaaatcttgattgctaagtggtgataaaggatatccttctagtgaatcagacagagatgagtaataatgtaaagcttcagtgaatcgatcaatgaaatttggtccattgtgatttgcttcttgttccacaattgtaataatctttggtttcatatctttgattgaacttaaaaccttgttaagtgcaccagattgagctagtaattgatgtaattcgaatactgaattcaccgcaacagtttcgccatgtcgaagatcaaacatagatgcatcaagatcagctaatgaatttgcaacaaaacctctatattcaaatt

SEQ ID NO: 9442 - DNA, 927 bp, Aquilegia formos X Aquilegia pubescens
  Predicted polypeptide sequence is orthologous to G309
gagaaagcagagctcttcccccaagcctatccctcagtcccattatgttcagtttctgcacctattaaagtttttcttttaggaatttcttcaaacacttttcctaccattaaagaaaaaagaaaaaagaaatgaagagaactcttcaccatcatcaagaaaacggtggaggaggtaataatagcggtgctggcggtggtggtgaacctgctgctgcttctgcttctgctgcaggttattcaatggagactactggtaatagtttagtagatttaggtaaaactaagatgatgtgttgggaagaagatcaagattgttttcaacaacaacaagatgcaggtgatgatgagttattagctatgatgggttacaacgtgaaatatacagagatggctgatgttgctcaaaagattgaacaacttgagatgaagatgatgaactgttcatcatcagctcaagaagataatgtttttgtttctcatcttggttctgaaactgttcattttaatccttctgatatgtctacttggcttgaaaatatgctttctgaagtgggtgaacttactcttcctccaaatttcgatacttgttctttaaatgatattttaaataattctactactactactactactaacaaatctccctttcaatcaatcgttgatgaaaacctttttattcctccagctgaatcttcttctactactattaatgtttccaatctcatcatcgatcctcctcagatctacactgaagaacccaattctttactgtcagattatgatctcggtgtaattccaggtgaagctgccatttatggtacttgtagtggtagtaatggagaaagagaaaataaaagaattaaacatgaagaaatattacttcctcctgcctcttctcctgtctctgccattgttaatgctcctc

SEQ ID NO: 9443 - DNA, 931 bp, Aquilegia formos X Aquilegia pubescens
  Predicted polypeptide sequence is orthologous to G326
gcaaaggaggaggaggagaattcaaattcgaatctcaatcggaactcagcttctttcttgtacccaaatgttccttgtgctcaaatcccacaaacttcttctaaaaaaggacagaatccaagttgtgggaaacataaacagcttatattaaagcaattacttcaactatttaagcgagatctgaaccgagatgctgaagatttgagcccaggaacgcccactcaacaagggagtgcagaaggtattgatttgcaaaagggagtttgtgtcggagatttaatggatgccaatcagatgatgcagcagcaattaccgtatacttccctgcttatgtctagtgtcgagactgatcacaaaggaaatgtgcgtctattggaagatcatcatctctggggatgtaatcctccaagcagtgagtccagtcagatatgggatttcaacctagggagatcaagggatcatgaagcacctaaccaacttgaagatgggtacagtacaaacagtgaaggatttatgatacagacgtacactgattttaccaaaaagactccctcagaaacaacaaaagtgctagaagatgtttacgggattaattgctccacaacaggccaccatatgaaatcagattataacacttcaaagaagcctgcatcttccagaagaacactaacatcagaaagcaacaacttaaacttacctggagccgatatcaattacatggaacagcctctcctgcttagaggtgaaaatgcaagaactacaactaaggtagacatggagttgttagctcagaatagaggcaatgccatgttacgctacaaggagaaaaagagaactcgacgatttgataagcatattcgatatgaatcaagaaaagcgagggctgatactaggaagcgagtgaaaggtcgattcgtcaaggctagcgaaa

SEQ ID NO: 9444 - DNA, 949 bp, Aquilegia formos X Aquilegia pubescens
  Predicted polypeptide sequence is orthologous to G328
gtcagaaacagattgttacttagttaattaagtctgaacatgatgaagaaagaaatgaggtcaggtagtggtggtggtgggtggtctcgtgtctgcgactcatgccgggctgcagcctgtgcagtcttctgccgggctgattcagcatacttatgcaccggttgtgatgcgcgtatgcacggtgccaaccagctagtatcacggcatgagcgtgtctgggtgtgtgaggcgtgtgagagtgcgcctgcagcttttacctgtaaagctgatgctgcatctctctgtactacctgtgatgccgacatacattcggctaaccctctggcgcgtcgtcaccaccgagttccaatactgccaatttcagggtgtctgtatggaccttcggctaattacccgagtaggccattagggtctgtagctgatatggaggatggtttcttgacctcagaagtcggtgaggagttagaagaagatgacgacgaaacatcatcttggttgttacttaaccctgttaaccctgttaagaacagcaacccgagcaacgggttcttgtttggtggagaagatgagtatttggattttgaggagtacaattcatgtactgagaaccagtaccaggatcagtataaacaacagcagcaacaacagcagaacagtttcagtattcagcataaccaagttaaaaatgatggaaatgatagtgttgtgcctgttcagtatgggagtatggatcagcatcaccaccagcataatcttcatctggagatggaccatgaggcctcatcaaaacctggattcaactttaccgcttcgcttactcacagtgtctctatgtcgtctatggatgctagcattgtaccagattctacaatgagtgaaacttcaaacatgcactcaagaactcctaaaggaacaatcgatctattttcagtcctccccttcaaatgca

SEQ ID NO: 9445 - DNA, 952 bp, Aquilegia formos X Aquilegia pubescens
  Predicted polypeptide sequence is orthologous to G363
gtaaggatattcatttatctgggattttaaactacaatttgtgcaattacggtgatattggccaataattcttctgattggattaataaccgttcaaactttaggctaatgtagccaattggttttcttccgaagagacccatatttatccttagctgcattcctgcatgaggttttctacatctgctatgaacattcagcctgatatgaattttctcgcggctttcaactttgaaaaacataacttgcatgtctcaggatgggtcaagttgttctgatattttgataaccacctataaattagtcatgttggtggtccatttgattttaccagtggatgtggccactgacaatcaagcatctgcatatataaattattgtgtttgtatataaaaatagccactcctctaatttgggtgaacttggccttctgatcacaagtttcagattgcgaagaagcgatgaaaacaccaaactctgattttcaggaagagtctctgtctgaaggggaatcagatgttagcagccaggtcgcttctaatatatcaatccaagaaatctcctcagatgctccaatagataccactacaacctcctcctgtcttacggatctactgaatcctgcccctggatcgatttcccttgaccttagcttaagctttaaggtgggtgatggagagtttggaggaaggaaagaaccgatgggaatctcgttatctagcacaagtgagagtagcagtgaagctgtgcgtacttcagcaccatctgtcccaagaattttctcttgcaactactgtcatcgcaagtttttcagctcacaagctttgggtggccatcaaaatgcacataaaagggagaggacacttgcgaagcgagcgatgcggatgggtatcttttcagataggtatgctagcctagcttctctgccactccatggatcgacatgtcgttc

SEQ ID NO: 9446 - DNA, 920 bp, Aquilegia formos X Aquilegia pubescens
  Predicted polypeptide sequence is orthologous to G4
aaaaattgttctcagagtaggtatattttagtaccatgaagtcttatttacatacagacagcaagcagccaattcctcagaagacaccccccaccatctgagggaaatcttcaaagctccagaggtccatcgagttcccaccatcctgagtagcatccccactgaataggctatccattgaagaatcccagcttccctcaagatacggaatctgaagaaacttcatctgagactcgaaggcagacagctcctcagacaaattctttgctgtatttccctcaaatggtgccgcaaccccagaattggtcttcagtttcttacatgggttagcagcttccatgtattcagcagactcattgccttctgttgtagttgagagaactgaggttatttctggagtcttggattcatggtctccccacccaaaatcagaacaattaaacgagttgctcccttgatcagaagtaaaacagagggctcctccatcagatggggtaaaagactggagtccattttgatctttcattgctgcaaaacgactcataatccctgaccctttgatcacgggcttctcctccacaaatccaagagagtcattaaaaccttcacttgagtagttcataatactaaaatcctgattgaggattgggttctctattgtctggcttgctttaggcagtgccttctgtgaatttgtcttcacagtacgattttgagcagttgggaaattctcttcagggaaattaactttagctttgttgccccggattctacgtgcctcagcatcgtaagctcttgcagcttcttcagcagtgttgaagttccaagccacactcgtacaccttttctaggatctctgatttctgctgcccatttcccccaggggcgctgtcggatacctctgtattggttcttccttt

SEQ ID NO: 9447 - DNA, 923 bp, Aquilegia formos X Aquilegia pubescens
  Predicted polypeptide sequence is orthologous to G4
accctaacacaaaagccacacctgtcaaaattccaaccagggaagatgcagattataggtttttctcgacctacgccgccaaaattgccctgagcaataggacaaaaattctggatccaatacagtaataaacatgtttaactatgaaagagagacttagaaagttgtaagtttaagaacatgtaactttgtaaattggaggatatcaagaagcaaatttagaagatgccatccattggtagaagaaagtcatcaaggctccacatatcgatcttgcattcatcatccccgttgaggaggctctccattgctgcattacagctctcaaaatttgggatttcaaggaagttcaattctgactcaaaatctaagaaatcctcctgaagtttttttgtcgtatttccttcacctgggcctgtctcagagatagtctcaagtttcttattcatgttagcattttcagcagtctctagtctcttattcatgttagcatcttcagcagaataggatgcttcactaacaagacttgaaagacctggtgggatttcaggggcttctgaatgacaatccttcaatccaatgtttgaaccattcatgggattgctaccctggtccgatttaatgagggacgctccatcaggaagggtcaatgtgtcgagttcagttggattttcaatcatggagaaggaacctgtgagtttagagctattggctgagacctcctcctccataaagtcatgagaatcaaagaaattatggcctgggttgctccatacgttgaagttgtcattgagggtgaggttgaggttgagattagactcctccaagataggactggctttgggaagaagcttctgaagctttgacttgactgccttctgttcaacatcaaaggggatgttcatcatcgaagcttgcactag

SEQ ID NO: 9448 - DNA, 967 bp, Aquilegia formos X Aquilegia pubescens
  Predicted polypeptide sequence is orthologous to G409
tttatatgttactaataacagttacaccctgcaggcgatatataataaccatcttataatgcatagcaatcccattattcaacttacacaaccttcacaacaaagagagtactatatcacaaagtttgaaacatctataattaagcccagtcccaccaacccaatgtctcactctcctggtggttctgctctggtgcagctggaaagacatctgagaaatagctccggctgtcgtcactaatgtcatcttcttctgactggactccatctactgggcctatgcattgaccatagtcatcgccagggaaataggaatcaacactgtcaacaagctgtcgacattcctcatcaaccacagcacttaccccactgccagagctcaagcgatcctcaaccttaacattaaattgcatcgtagttacatcaacattttcttcagtggagagtggtgggtcagatatctgatttaactccatcccagctccctccttgacctgcaacttcccagttaaggaaaccacctcagatttgagcttctcattctctttaacaatgtcatcgtaatcagaacgaagggaatcataagaagctttaagaagatcataatctctctctagttgcttagtcttgcaacgagctcgtctattctgaaaccaaactgcaacttgtctcggttgcaacccaagcttcttagcaagctgggtcttacgatctggttccagcttgttctctgtctcaaagctcttctccaatagatgaacctgctcagaagtaagacgacgtttcttttcaggtagctgttcatcataaaactcctcttcaattagttcatctgatgaactataaaaaggacgtcttttcaaagaatcttccatattaatgaatgatcttgaacctcgaagaacgggatctccactccctaaaagcaacatgttcccatggcaggaaccatcaaagaaaagacggg

SEQ ID NO: 9449 - DNA, 957 bp, Aquilegia formos X Aquilegia pubescens
  Predicted polypeptide sequence is orthologous to G409
taacgttttccattatcttcttcattttcttctccgttaactttaacagtggtaatcaccaattcatcttcttctgagtgatgggtgtgagtttccgttggtctcatacttctctcatcactgagattcttgttacaagctttttccgtcacaaagtctactgaaacttctgtcctttagttcttaaactcgttttaaaaaaaaaatatgattgtttgaagttttcccgggaattcaaattctactactaaaaaagctgtaagcttttaaaaagcttactatggcgagtaggaaggtttatagtgcttctaatgtccctgttttacttcaaaatgatgggatttcttgttctaatggagcttttgaagctctcttgatgcccaactccacttcttgtttcaatggtaagagatccatggttaacttcgaagatgcttgtcgaggaaacacacaaggaatgtccttttaccatacacgtgatcaagaagaaaatggagatgatgacttggatgattgtttccgtcaacctgaaaagaagaggcgcctatctgttgatcaggtccagtttttggagaagagttttgaggtggagaataaactcgaacctgagagaaaagttcaacttgcaaaggacctaggcttgcagcctcgacaggttgcaatatggtttcaaaaccgccgagccaggtggaagacaaaacagttggaaaaggactatgatgctctaaaagctagttatgacagcctcaagagcaactacgagaacctcctcaaggagaaggagcaacttaaagctgaggtttctagcctcacagacaagcagttccacaaagagaatgtgagtgaaaattcagaaacatcgaaacccatggaaccatctcaaccactggctcagcccgattcagtccctgaaacaaaaacatccaccattatatgtaagcacgagatctcagctct

SEQ ID NO: 9450 - DNA, 880 bp, Aquilegia formos X Aquilegia pubescens
  Predicted polypeptide sequence is orthologous to G428
cacattgttatggatagttgtacatatttgcagaaggtttgaattccaaagacaatataaaagcccaagttagatacatgtacagttacagttcatcgtttcctcctgggttgtcataaaacattgatccacctccgccacttaccccttcaatgacagcaaagcgcatgtcttcagatggcctccaatggcgctttctctggttgatgaaccagttattaagctgcttctggtccagtccagtcatttccgcaagcttagacttgtcctcttccgtgggatacggccatctatagtgagagttccaccagtccagtaatgtagttctcgcatccttaggcagctttcctttctttcttttcttcaagaagtctttcttgagactactaagatagccactatatttccgcataagcatatcttttaactcttggtccccagatcggagacttgaagattcttggctctccaatgattccttctccccacagcttagctcctcttctgaagacccaaccgtttcatcagattgatcatagtttccagatatggtagtagtagacattcctttacaaatatgattaagttgtgtttcaatcttgctcaagaatgttgctgcttcgtcaaatgactttgttaactcttctttataaccaaccaatatcttacaataagattccatgaactcatcaagctcgggatcatctccaatctcactattaaaactattgctacttggcctactttctcggctaatttcttcaaaaagtgatgcaacttctggtggcgcaccgatctgtacatagattaaaactagttagaaaatagataaacaaaagtagagttttatgtgttaagaaagagagaatgaagtaacctt

SEQ ID NO: 9451 - DNA, 948 bp, Aquilegia formos X Aquilegia pubescens
  Predicted polypeptide sequence is orthologous to G450
atgataagaatctaacattttgttaggatcattattacaaaataaaaataaaaatgcacaagacttagttttgacacttcaaaagacaaacaaatagataaacatactaatacgaggtcatagcaaacccccttgacaatcttaataatgttcaagcaggaggatcggtcttttacttttgaatcccacaatagctggtcagctcgagtcttcttgtcccctttgacgttgaagtttagcacttcatttgagtttcaatctgctaatcgtactcgccaatattgaatcatatattacctgagctttattttgtgtggtcgtcttcatgaattcattaatatctctgatttgaacaatctgcaggacactctcatcatgaataccaaccaaaatcgacaaatatgctaagaggtacaccaggaacttgcagttcttagtttgaatggctgtaaagaatgacgaatcaaatatccttgcatatttccatgtcattcttctcttattctctgaaagattatctccctcaaaagtcctaattacatttttcatatatctaaaaggaattacatacatcgtaccagtcaaaagctgaccaaaattttcaattgtaacctccaatgctctctggacttccacaaagagtgtataggcatgcatgccagtaaatcgaagatgttcctcatataacatttctctaagttcacgagccaatggagtttcattgtgaaggtatatcattccagccattccatacttaaacagggaatttgatcggaacttatcagaaatagcttctaaggactcttgtgaaggattataccaggtaagtggaaatttaaaatgataaaagtcctcaagctggagttgaggtaaggcaatgccctgaggtaattgttgacagatttggtgaataacctaagcaaggaggcacaaacataactgacagaa

SEQ ID NO: 9452 - DNA, 955 bp, Aquilegia formos X Aquilegia pubescens
  Predicted polypeptide sequence is orthologous to G450
agaaatccaacaagcaaagcaagaggaagaggaagagaattgaaataattagtgtgtgacgaagttcgttgtaatggaagtttgtcgaaaaatgatgaatttcgaagagacggagttacgtcttggattacctggtggtggaagtgaagctgagagtggaaagagtactggaaagcgaggattttccgagactattgatttgaagctgaacaatcttccttctaaggatggagagatggatccaagtgacaataaggtgaaaaactcaccacctaaagaaaaaaaccttcttcctactaatgatccagccaagccacccgccgccaaggcacaggtggtaggttggccacccgttcgatcattccgcaagaacatcttgtccgtccagaagagcaacactcaagaggagaaaggaatgagcagtgcagcctttgttaaggttagcatggatggtgcaccttacctacgtaaggtagacttgaagatgtacaagagttaccaagatctctctgatgccttgggcaaaatgtttagttccttcacaattggtaactgtggagcacaaggaatgaaagatttcatgaatgagagcaagttgatggatcttctgaacggaactgagtacgtacctacttatgaagacaaagacggtgactggatgctagttggtgatgtgccatgggagatgtttgtggattcatgcaagcgcttgcgcataatgaaaggatcagaagctattggacttgcaccaagagctgtggaaaaatgcaagaacagaagctaaagtggtaatcaccagtacagtctgttcaataatattcaagcacacagtatcgatgaagggtgaccgacagcgaatgtgcgttagatcaattgagcagagtgtctggatgtgtctgtactatggttttctttatatatatagatataaacaaaatggggacattgttttatg

SEQ ID NO: 9453 - DNA, 340 bp, Aquilegia formos X Aquilegia pubescens
  Predicted polypeptide sequence is orthologous to G450
gcgcttgcgtataatgaaaggatcagaagcaattggacttgccccaagagctgttgagaaatgcaagaacaggagctgaagctgaaatcaccacagcatctcctaatttgttattgtattgtagatgtcaagatgacaacaatgaaaccagatggattgagcaggatgatacgtagggtgtgttttgtattatgattgacacaagatatataggaaaatatgggatgtttgtacgtaatttagtagaaacaataagagttagtaatggtcaagcttgtttattatcaatggctaggttgatttaatattgtatccatgttggtttgacatttttgctttt

SEQ ID NO: 9454 - DNA, 995 bp, Aquilegia formos X Aquilegia pubescens
  Predicted polypeptide sequence is orthologous to G451
tttgcatttacatacacctctaaaatacaaagcaaaacaaaaaacaatttaatttaacctcaacactttctttctcttttctgtttttgaatctcctaatctaattctttatgagagagattcaaaacccccttagtttcttgaaaaaaaaaaaacccaagctagttgagacatctcttctcttaatttctcataatatatatcttagctagctagggtctttcttatacaccataccccaaacctctagcttctgaccctttcatgattctcagccttttgcaagaagaaatgaacatattccatggtacatctccaaccaacatccaatctccatctttatcttcatatgtaggtgcatgttcagatccattatagccttctctttctgaataagtaccaatagtgattttaaacatgttttctaatgcctttagaagttctaaataaccattatagactttaagatcaatcttccttaagtaaggtgctccatccatgctaactttcacataaattcctgatgtctcagcttcatccttctttgcttggaaactatttttcctataggatctaattggtggccatccaacaacttgttgtttagcagctggtgcagtttcctcatgaccacctcttgcatcagatacactagaattgttttctgatccacactgttgatcatttccaatatcagccaatgctcttttgttgctcttaacaattggttgtgatggtgatggtgtttgtgtactttgtttatccaatatatctgatccaggcaaacctaagcgaagattaagatcactttcatacttcatcttgctttccattaatcaatcttctcaaaccttcaaacaattaactgtagttgtatcccttttatgatatgataacaaactttccaatccaaatatcaacttctacgtaagtttccgatatgtctccgtgaaattcttgtatattccggtgagtttacacagtgtagatgaaac

SEQ ID NO: 9455 - DNA, 953 bp, Aquilegia formos X Aquilegia pubescens
  Predicted polypeptide sequence is orthologous to G489, G714
atacttttgaatggtttaatggtgaatggatttgcccagatacataagagcaccctgccatatcttttctgctcccattaaacagttaagaggatggagattgtggccggaacctgcttcccctataaacagttagctcctcattttgttcatcaccctgtggtatctgagaattatagctgtttagctgcaactggttcgcgcctgtcagtgaaatttccacagcatcagaggggcgaggtagagctctccgtctactctctctgaggtactcgccaaaatcagagctgttcagctgcaaatgattcgtgcccgtcagagaaatttccactgcctcagatggtcgaggttgagcatcccttgtactctctacgaggaactccccaatattagaactactgttcagctggacatgattagagcctgtcagagaaatttgcacggcatctgaagctcgaggtagagctcctcgtctacgctctccgatgtactcgccagaaaaataattattgaagcggttaaaatccagcatttgaaactgcatcacattagactgccatcctcccctccgttgtccagtgacttcatcttcagcacagttttgctggacctgatttggtcctatcactggaaaaggctcttgcgaaggttccacgcctttctcttcatttcctccaccagtaacttcatcctcttcatatggcttttgaacagcgtcaatgagaaaatcaagagcctgaatattgcttataacccttgagacatcactcctttgcagtgtttgccttttattactttcagtatgcagccaggagcgaagtgagagctctaaaataaaaaactcacaagctttcgcaatgaccactggggcatcagcactaaccatcttaacatggtcatcagatttcatagctttcctgattctagataatggaagctggtggtttgtgaga

SEQ ID NO: 9456 - DNA, 905 bp, Aquilegia formos X Aquilegia pubescens
  Predicted polypeptide sequence is orthologous to G489, G714
tccatatcattagaatagataatatgaactttcactgaatagaaaactaactggcagatactactattgacatataagttcaacacttacattgtcctcgaaaagctaacattatctccttactcaagaatctgagtgttcttgttcttgttgtagttgttgttgttgctgttgctgctgctgctgttgtgatgcctgcggccacatctgctgagccatgtaagggcgaggctgttgcgcatacaaggcctgatctatcacaggtttacccataatcatcccaggagttccaacctgtggtgaatgttgagggatataatagtaaggatgtggatccacagcacctccaactggaattgcccctcctcttggaattgatgcaagcacctcatctttcagatcctcccggggaacaatgtcaaccaggaaatcaaagatatcagtcctagtgatcgcagcggcaatgtcattcttctggagtgtcctacgcttgttttcttctgtatgattccatgaacgaagtgtcagctccaatatgaacatctcgcaggccctagcaaatataactggagcctctgctgcaatcatcctgacatcctcatctgctttcatgatcttcttgatcctagccaatggaagactgtggttcttaaagtcagttgtctgctcaatttcttggtattgatttgcccagaaagtctgaagttgctgctgcaattgctgctgctgctggtggtgaatctgttgataagcaagttggtgttgcgctagctgagctggggatgtagaataacctgcaggctggccagggggtgtaatggaccccacagatgtcacaattgggccagaagtatcccccatcatttggttaggctgatatggatttgcaacatacgacatttgcg

SEQ ID NO: 9457 - DNA, 960 bp, Aquilegia formos X Aquilegia pubescens
  Predicted polypeptide sequence is orthologous to G489, G714
ctgtaatttgcagttattatctcaatctcaatctcaatctcaattttaattttgccaaacaaacccttatttattacttcttcttcatcttcgttcttcacttcttctgtaattctcttacgaagaaccataaaagtaatagaagcaaataatattttcttgagcttagcccataacagaatggatcagcatggtcatggacagcccccagtcatgggggttgtcagcaatgcagctcaaatgccatatggtgcggctccatatcaacctaatcaaatgattgttggcaacccccctggttcggttgcctcatcaggagtaactattcagagtactggtagcccgcaggtttcaatgcctctcaggctcaactccaacagaatcaacttgcctatcagcacatccacctgcagcaacagcaacaactgcaacaacaacttcagagcttttgggcaaaccagtaccaggaaattgagcagacaattgactttaagaaccacagcctgccattggcaaggattaagaaaattatgaaagcagatgaagatgtaaggatgatctctgcagaggctcctgttatatttgccagggcctgtgagatgttcatcttggagttaactctccgatcatggaaccacacagaggagaacaaacgaaggacgctccaaaaaaatgacattgctgcggcaatcacaaggactgatatctttgacttcctggttgacatcgtgccaagagaggatctgaaagatgaggtacttgcatcaatcccaagaggaggtgctgtgccggtaggaggtccagctgacccactcccttattactatatgccacctcagcatcctcaacaggttggtagtccagggatgatcatgggtaaacctgtggtggatcaagctctgtacggtcaacaggctcgcccgtacatgcctcccgcagatgtggcctcagccacaacag

SEQ ID NO: 9458 - DNA, 897 bp, Aquilegia formos X Aquilegia pubescens
  Predicted polypeptide sequence is orthologous to G519
gaatcctcacaacaagcatcacagcaaaaaaagaaaaccaacaacagcaacaaaaccaaacccacacaaagaggagaaatgaagggtggagatttagatttacctcctggatttagatttcatccaacggatgaggaacttgtgatgcactacttatgtcgtaaatgtgcttctttatccatttctgtttcaattattgcagaaattgatctatacaagtatgatccatggcagctaccaggtactgtacttatttgatttttttaacaagtttgagctttagatgcttatcgatctcatatgcaaccgtttataaatttaaaattgaaattttaaagttagatttctattgttttaattgcaggaatggctgtatatggtgaaaaagagtggtacttcttctcgccaagggaccgaaagtatccaaatggttcaagaccgaatagagcagctggatctggttattggaaggcgaccggagcagataaaccgattggaaatccgaaaccaatagctataaagaaagctttggtgttttatgctggaaaagcacctaaaggagtgaaaactaattggatcatgcatgaatatcgacttgcagggatagatagatcagcaagaaagaaaaacaacgcaagggtaagtttttcagattaaattgaccattttaaccttataattgaaaaatatcagttggtccatatagtcttttgatctgaacttttttctcatgataaggataaactagtacaattatagaatttttgagtcacagttgaaatgttgtgttgatggtgaatcttgtgggctcaaattgagattgacattcctcgtcatgatgtagaattatttccactaatatctttatttagtctaaatatgtttcaaatgccgtca

SEQ ID NO: 9459 - DNA, 903 bp, Aquilegia formos X Aquilegia pubescens
  Predicted polypeptide sequence is orthologous to G525
ctttcttctttcttattaaaccttaaaaacctttcttctaaacctcttcatattatctatttgagtttttttgttaaggttttagagatttagtggtatttgattcataccctcttcttaatttagcttgttttattgtgttcaagattcaaattagctagtggttttttattcaacttttgtgagaaaaacaaggttgaaggtattagttttgaaaaagatggagaacatttctaacttacaaggtaaaggagatgaacagatggatttgcctccaggttttagatttcatccaactgatgaagagcttatcactcactatctttctaagaaggttactgatagttgttttaatgcaagagcaattggtgaagttgatttaaacaagtgtgagccttgggatttaccatggagagctaaaatgggagaaaaagaatggtatttcttctgtgtaagagatagaaaatatccaactggtttaaggactaatagagctactgatgctggttactggaaagctacagggaaagataaagagatttatagagcaaaaacactggttggaatgaagaaaactctggttttctatagaggaagagcacctaaaggtgaaaagactaattgggttatgcatgaatacagactagaaggaaaattttctctctacaatctccccaaaacagctaagaacgaatgggtactttgcagaatatttcaaaagagttcaggtgggaagaaaatacatattcctggtctgacaagattgagttccttcgacgatgaattaggtccgtcgcttttaccaccattaatggatccttctccttacagctctaagaacaaacctattgttacttctgaggtaacaacaaatcacgtgacctgcttctccaattctatgga

SEQ ID NO: 9460 - DNA, 953 bp, Aquilegia formos X Aquilegia pubescens
  Predicted polypeptide sequence is orthologous to G562
ttattaagatctgactgcgaaatctgctaaatagtttacaaaccttaatattcagtcacaagacattgctacatattcagcttaccacacatgtagcaacagaacaaagccggaagacacatagctactacataataatgtcttaactctcagaaacatgtggaatcaaatagaccacagataattacattctgaagttgaaatacaagagttttatctaggtaatattatgttggcagctccaaataggtgcaaagagtttgttatctcatgttagacgttgtcttaactaacctacctaagttgacgatttgagtaatttcaagctaataatgttccagaattacgaaaatgggtgtgacatatgagactgcttaaaacagatttgttgctcattagcctgcagccacagcatcggccctggggctcgatttcaaaagctgatgaagctttgcgccagaattcttattttcatgagcaccattctccaggtgatggttcaaagtaacagagtcagagttatgcaccctagatagaaagttctcagtactgacaggaacaggggtcagcacttctgccttgttagaaacggctttttctgccagtcctgattgtgcatcgttcagtctctccattagtgcagtgttttctatcctcagtttctctgaattttcagccaatcgattcatttcagatctaagggccaggttctcggcattcagtgattcaactttcaaagcaagctcctcactctccgcctgcttccttaatcgcgaccttcttgcagattctctgttagattgtttccttttctctcgttttagtgcccgctcgtccttcatccagagttcagaaggcaaatgatcacgagctggcatcgctgtgtcagttgtaggagggacagacacagcagtggcctttcttttccctgtggaggaaactatcagttctaa

SEQ ID NO: 9461 - DNA, 920 bp, Aquilegia formos X Aquilegia pubescens
  Predicted polypeptide sequence is orthologous to G591, G793
gagaaaaataaatcaagcactttacaaaaaacacaacccactcaaaaccgagtagtgcaaccttccaacacaacttttttaagcgaccaacaactatccaatatccatttcaattcccttttcagtttccttctaatacattaatcatgtctatgtacccatcttcccctttaaaaatgccccaccctccactatccaaaagaagggtccccaccggaaagtgttctggctatccaccactatcccacaccacatcaggagtacctatgattatttttctaggcatcacattacaacctatttgacgaaaaaaatgaaaggcagaacgaataatatggcatctgactttgattgcaatgctgaggggagttgactaagtctgacgtggggggaacaaatggaaggtgggatagttgtgagtttggagttgttcatgggcacgtccaattgtctgtatccttttcattttatgaaggtgcattaggttcgggtttgatcattgtggaggcatcgggtggttggtcgtggtatattgcagaggcaagtgaaatgggcatgatgcaaagtgctttagattggaggaattgcatggcagctccaacatcttcttccatgagctttgctacttgatgttctgtgccatctgtagaccatttctcccatgctggctgattactgccaccttcactggctccgccctcagctgatgaaagtggaatgtcagccacaagctgtgctactgcaccagctcctcccagtctgctcatgctcaaaaccttgacctggagccttagaaatttaacataatcaacaatttcatcaagcatagctgccctatcagtcttgttggaactaggaaccagttcctgtagtgccttcattctttcagctattctttctctacgtaacctctctgcaat

SEQ ID NO: 9462 - DNA, 964 bp, Aquilegia formos X Aquilegia pubescens
  Predicted polypeptide sequence is orthologous to G598
tgtttacctacctactagatgactacagaaagtaaacaatgtttctaacttatataagcatacatgtccacacactagcatcataatacaacaaaaattgtccaaactgttacatgtaaaaatcttaatcttttgaatctgaccatcaccttttctagagctagtagcccagtagtaaccaccactccttaaccaacaataccactcaaacaaactgtacatgacaagaactaatcctcaaaagctcaagacacaactaatagcacactttgaaaaacccagcggcacttagcactcaagttcttaatgctaaaatgctaagtgaaatcatctaatacatataaatccacccttgaagtgaaaaaaatataagggtaatataattatattagccaaaaagcaatatctaattaagtagagatgagatcatataccacccgttgtggaggtggaaggatatcgatcttcaacctcactaatccatcgcagaaaaacttttttgacaacgtgatcagatgtggtttcacgcggttgtcataaggttggaaaagaattcacctctacaactggtggtagatgatctaacctcctaactaattactattagatgtgggtgcggttagaagaaggagcgcttggtaggaggtcttccaagggtcctcatcaagttggctatctctagaacccgagcaacctttgtacctctcttggcttcagctgatgctcttttttcctctgcctttctatgtgcttttgcgacatcgttctgcattttctcaagagctttagctcttttctcttcaagtttcctctcaactttcttcatccaagttgtggccttctgcacctcttcaccctcccagccatgaataactgcatcttctctcttgaaccgattgttaatctttgatatctttgctgtctgccatgcatatatcttcgattcagtctctctttcttcact

SEQ ID NO: 9463 - DNA, 916 bp, Aquilegia formos X Aquilegia pubescens
  Predicted polypeptide sequence is orthologous to G653
gaagatccgagataaatgtgatttaaatagctcgttgattacgcgagttcattctttctcacatttttctgggagagataataagatttattattaataagaactcccatttggatttgaaatttcttttttttcttctgtgttcccagcaccaaaagtttgcttgattaatattccaagccttctgggttccttttgtgtattcagaacattaaactctttgtcaaccaaaacaaaaggaaaaaatgtcattcactgggactttgcagaagtgtaatgcttgtgacaagactgtctatgtggttgatttattgtctgcagatggaattccctatcataagtcctgcttcaaatgcagccactgcaaaggaactcttgtgatgagcaactattcatctatggatggggtactctactgcaagactcattttgagcaactcttcaaggagacaggcagcttcactaagaattttcagagcgctccaaagactgagaatcaagagctgtcaagggctcctagcaagctctctgctatgttttctgggactcaggataagtgtgctacttgcaataaaacagcttatccattggagaaggtgactgtggagggggaatcgtaccataaatcttgtttcaggtgtgctcatgggtgggtgctttcttacaccttcatcttatgctgctttggatggaatcctctattgcaagcaccattttgctcagttgttcaaagagaagggaagctacaatcatttgctcaagttacttcaatgaggcgtaatgctgcagcagttccagaacctacaccacaaccagaaccggaaacatcaagcgaaccagtcacagaaccagcaccagaagcagaccagacacagaccagtcataagtgtggcataatcgttgccattatttcttt

SEQ ID NO: 9464 - DNA, 898 bp, Aquilegia formos X Aquilegia pubescens
  Predicted polypeptide sequence is orthologous to G653
agagttaacttgcaaacaaagagaagctgaaaaagagaaaggggaatcaagtttgcctattccccatgagataaaaaggggaatgaattgaaaacaaacaaacaacaaaaacagtcttcatcaatgaaggagcagcgaaattgtaaaaaaaaaaaaaaaaaaaacaggtattggatgataaattaatttctctggtgatagaattgaagtatcaggcatcatctggcacagtggctgcagctgcggctgtggcagtgcctggagaacgcttgatagaagcacacttgataaggtggttgtagctccctttctccttgaaaagctgggagaaatgatgtttgcaatacaaaatgccgtcaagtgctgcatagtttgaaggggatagtgagcagccaccatgagagcacttgaaacacgacttgtgataggcctggttctccacagtaaccttctccaggggatatgccgttttaccacaagtagcacacttttcttgtgttccagaaaacataccagcagctttgctaggtgaccttgtcatttgtggagttaacttctccaccgactttgctaccggtgactggaagtttttgttaaaattcccagattccttgaagagctgctcaaagtggggcctgcagtacaggacgccttccattgaggaataattgctcagctttaacgttcctttgcagtgactacacttgaaacaagccttatgataagaaactccatcagcagataactgatccatcacataaacagtcttatcacaagccttacatttctcctgagtaccgatgaacgacatagctgtccgatcggtatcttctcgatctcaacagatccaagctttcaacaaacaaactagtttcttcttctcatttctgaataataa

SEQ ID NO: 9465 - DNA, 890 bp, Aquilegia formos X Aquilegia pubescens
  Predicted polypeptide sequence is orthologous to G666
gtctgatctagctaagaagaaaaaaccaagaggaagaaaaatcaatactctctctcagctctcacacttgatcatcactactactactactactactacatactcatagcttatttttttcctcaagtgaattaagataatgggtagacctccttgctgtgataaagttggtgtgaagaaaggtccttggactcctgaagaagatataatcttggtttcttatattcaagaacatggtcctgggaattggagggctgttcctactaatacaggtttgcttagatgcagtaagagctgcagacttaggtggactaattaccttagacctggaattaaacgcggtaacttcactgatcatgaagagaagatgatcatccaccttcaagcactgttgggaaatagatgggctgccatagcttcatatcttcctcaaagaacagataatgacatcaagaactattggaatacccatttgaaaaagaaactgaagaagcttcaaacaggtttagatggtcagaacagagatgggttttcaagttttcaaccatcaatcactaaaggtcaatgggaaagaaggcttcaaactgatattcacacagccaagaaagctttatgtgatgctttatctcttgatgataccaaaccttccaatagttgtttatctgaattgaaagcatctaatggttattactctctcacaagatcaagtcaaccaagtcaatctagtactacatatgcttcaagtacagaaaacatttcaaggttacttgaaggatggatggctaatgcaccaaaacctgcacaaactaattcagaaacaactcagttttccttcaacaatgtgactggaacagattcttcatcagaggaatgtacaccaactgcaacaa

SEQ ID NO: 9466 - DNA, 887 bp, Aquilegia formos X Aquilegia pubescens
  Predicted polypeptide sequence is orthologous to G675
tcaattagctacttattagctagtatccaattccaagcaagaaatgggaagatctccttgttgtgatgaaaatggtcttaagaaaggaccttggacacctgaagaagatcacaagcttgttcaatacattcaaaaacatggtcatggaagctggagagctctccctaaacttgctggtcttaatagatgtgggaagagttgtagattgagatggacaaattatttgagacctgatattaagagaggaaaattctcgcaagaagaagaacaaactattcttaatcttcattccttcctaggcaacaagtggtcggcgattgcgacacaccttcctggtcggacggataatgaaattaagaacttttggaatactcatttaaagaagaagctgattcaaatgggtttcacccaatgacacatcgtccaagaaccgacatattttcaagcttatctcacctcatagctctggctaaccttaaagatgttatggaccatcacccttgggaagaacatgctgtgagactacaagcagaagctgctcaagtggctaaactgcagtacatacagtaccttcttcagtcttcttctccagtgccaactggctcaaccaatttaactggccttacagatattgaggccttcaatctgttgaattcaatgaaagaacaacagaatatttcgaacctctcatcgcagctggagagtcccaactcaggttctcttggacttgccactacacaatcctttgatagttctatttccttctctcatttgccagatttacaactacaagtcccatgcagtttccagacatctttgagtagcgactttggacaagtactaactctgtactatttagtcaagaagaagctacacctacatctcca

SEQ ID NO: 9467 - DNA, 856 bp, Aquilegia formos X Aquilegia pubescens
  Predicted polypeptide sequence is orthologous to G707
ataatttctgtgcaggggtttgtgcatctacaattcacaaatggaacaaactcagtgttggaaatgtcgatgaagatgttagagttatgaccagaaagagcatcgatgaccctggtgaaccaccaggtgttgtcttgagtgcagcaacatcagtttggctgcctgtgtctccacaaaagctttttgatttcttacgtgatgaagggctcagaagtgagtgggacatactttcaaatggtggacctatgcaggaaatgacccacattgccaaaggccgtgatcaaggcaactgtgtttctcttcttcgtgctagtgccatgaactccggtcagagtagcatgctgatacttcaagaaacgtgcatagatgctgcaggatcacttgtggtgtatgctccagtggatataccggcaatgcatgttgtgatgagtggtggagattcagcttatgtggcattgcttccatcgggatttgcaattgtgccagatggaccaggagatggtaggtccaatcaacccagcaatagtaacagcaacaacaacaacaatggtagctctcagagtggtggtggaggtggtgggtccctattgacggtggcttttcagatattggtgaatagtctaccaacagccaagctcacggttgaatcagtggaaacggttaataatctgatctcatgcaccgtacagaaaatcaaagccgcccttcactgcgaaagttgatccaagtgggcctagtgaagacaataatcatgactttttttttgttttgttttgcttttattttggtcttttaagttatagttctataagttaaaagctcaagtgaaagacaatagagaaaaaaatggaaaggg

SEQ ID NO: 9468 - DNA, 930 bp, Aquilegia formos X Aquilegia pubescens
  Predicted polypeptide sequence is orthologous to G720
ttgcagagtaaaaccattcatgccacaagcccaaaggccctgcagaatcaacaactgcggtttttcttgtaaatttctctatggcctgaaaaaggatgcctagagcaaatcaagtatggtttgcactgctgatgatttattagggtggaaggattttccaaaaggactaaaagtccttctacttaaagaagacggcatttctgatacagaaataaaatcaaagcttgaagaaatggactatatcgtttctacacttttcaatttggatgatgctttaatggaaatttcaaacaagcctggaagcttccatgttgctattgtagaggttagcacaaacaatcaacacgaatgtttcaagtttctagaaaccgcgagagatttacccactattatgatttcaaacatccaatgtcttagcaccatgatgaaatgcatcgctgtgagtttcctgaccccgtccctcttcctatacatatggtaccaattctgatcgagttctaatacattttagcttggtgcggctgaattccttcaacaaccactgtccgaagacaaactcaggaatatatggcagcatgttgttcataaggcctttaatgctaaagaaagtgacctcaccaaatcattgaagcccatcaaagacactgtcgtatccatgcttcagctcccacgagaaacaaatgacactgaggattacaatttgttggaaacagagaattctgcccaatcccgggaatgcgagaatgagcaatcaacagtcagtgataagttcccagctccttcaaccccacagttgaaacaaggatgccgattttcagatgacaggactgccaagaccatactaacttcttggtagacaaagcacatagaggcatcgaagagaatcaaaatctgtcgatacgacttgcaactatttggttgctgaaacta

SEQ ID NO: 9469 - DNA, 972 bp, Aquilegia formos X Aquilegia pubescens
  Predicted polypeptide sequence is orthologous to G730
tcttcttcttcaaactattttacatgcttcgagtaattaaattaacagttgagaagggttagttctttcgaaggttcaacatagtccatttgccagctttgccttccaagggtgaactcaaggttaggcaacatatgtgaagatgccaaagagcttacatacaacttgtcactttcattgggacacaccaccaacgggtctggcctatatacttccttggttggtttatctgacgattctttggattggaagtgaacacgagttgtttgattctccttagacaatgggctccaggcatttctttccactcctccttgctcgaacccaggagatacaggtagtggtggtcctggtggtgatggtggtggttgtagaggtagtgtttgatgaatagaatgagatggattgatatcagctttctcacaagatagtccaccttccacttcaagaacatctgtcctctgattcaaacccatttctgtctgcccttgacctggtcctttgtcagtgctcttcactgttctatacatctgtaagtgactcttcacatgagctagtgttagatccttcacattcattagttccaaaactgatttgggtgttgctctttcatgaccaccaagaagctccacagcatgaacaaaatgggcatggagtgtagtagtccatctcattcttggagctctaacacttcttttacctccattacccattctagaatttctcttaaactctttaccaaacatttgggggtgatgaagatgatgaagataatgaagattcctttgtaatgatattggtgaaggatcaaatctttccatttcaatccctaaacttaatttaggctcaactccatttcgatgataacacttctcaaggttcaataaaccttgttcatgacttatatcacttccactactacttgcagagcttctatcaccacaaatcactctcctcattgctgaatcaaaa

SEQ ID NO: 9470 - DNA, 887 bp, Aquilegia formos X Aquilegia pubescens
  Predicted polypeptide sequence is orthologous to G748
cgaagatgaagtaaacgacgataacacacacattcaaagaaagaaagaaagaaagaaagaaagagagaaataaacagagcaaagcaaagctacttgcaagtagcaatttcttcgatcgaaaaacgccgattttatcggatttttgagtttcatttagatcgagagagagagagtgagtaagagagagaagcaaaaatgtcgggaactaaagacccggcgattaagttgtttgggaagacgattcctttgccttcaaacgaggagattcatggtgatagaggtggtggtgaaggtgatggtgatgttgtgatagaagaaagttctgatttttcttcaattgatgagaagaaattaaagcaagaaggagaagaattaacagaagaagatgaggacccctcaagtaaaagacccactgatattaaagtgcaagaagggtcacaaccactggtttcagaagagttggcagatgctacatcttccgggaataacgagaaccccaaaacgccctcatatgaaaatgaagtgggtgtgacaaaagatgacaggaacgaggaagaacagagtgacaccagtagctcacaagagaagagcatcctgaaaaaacctgacaagatacttccttgtccccgctgtaacagcatggacactaagttttgctactacaataactacaatgttaaccaaccacgacatttctgcaagaattgccagagatattggaccgctggtgggacaatgagaaatgtgcctgttgggggctggtcgtcgaaaaaataagaattctgtttctcattaccgacacataacagtttctgaagctcttcaagcacctcgtcctgatgctccgaatgggaattcaccaccctacagtgaaacccaacggcact

SEQ ID NO: 9471 - DNA, 935 bp, Aquilegia formos X Aquilegia pubescens
  Predicted polypeptide sequence is orthologous to G783
ttcaattcagttttaaaggaagtgggattgattttgttttgtgtatgaaattgaatcttggagtatatgaaataaggcataaactaacatggtttcagaaatttctactcagttggttaatgatgttaatgttggtgcagataaattgattggacatggaaggtctttttccaataaaaagaagcatgtaaaagttccaaagaaaatccacaaggctgaaagggagaaactaaaacgcgactatttgaatgagctctttcttgagctagacaatgctcttgagccaaatcggcagaacaatgggaaggcttcaatattgggtgatgctactagattactacgggaattgctttctcaggttgaaactctcaaaagggagaatgtggctctggtgtccgaatctcactatgtcactgttgagaaaaatgaattgaaagatgagaatgctgttcttgaagctcagattgaggaattacatactcaattaaaagaaaagtctccaaatgacctgacttggaatccagctactaccaaatcacagaatgccaacctgacatcgtcattatttcaggaccctttgaagttgcctgtagcagaccctacattgcaggcaccacctgttgttggtcctgtccttgttatccccctccatcatgactttcaagcacttccacaacctgaaactgcacaagttcctttaaaagctccatcaaatgtaaaaagacctcatgctcggtatcccactccatcagattcatggccttcccatctccttggagagcagcctaaacgaacagatgaaaagtagcttgggtaggagtagcactggcaatgggaaagagtaatcacaggctatgcgtaagcatgtatttgtctagaaaatttgagaactgtcatgttcagcagttatatagtgtttgaatgatccctatcaa

SEQ ID NO: 9472 - DNA, 892 bp, Aquilegia formos X Aquilegia pubescens
  Predicted polypeptide sequence is orthologous to G865
aacataaaatagaaagaatgtcgcaactaacacttccataaaggctaaacccacacatatattgataaagaaataaattggaagagagtaataacccttaactcatacaatgatcaccagccaaataaacttgcatgacttccttgtgcttgacatcttgatatattactctcttgggtgtcttctattcttatttgatctgccctgctcagaatgtttaggactagaagaagctcccccagaccttagatactgttgttgttgagatgtttctgaagacatcgatgaaggtgacaacattgttgaagaagttggtggtgaaagaaactgttgttgattataaaaaattggcgtcccatactgctggaaatcttcattattacttctaagaagttgtgcatattgaagaaggtctggatatgcatcttgagagagaggttgatgaggtggtggaacaactgggtggggtgcaccctccatgacagtactgtttgtctcttgagcgcctgtgtagtatctcagctcagttctcccttgaactctttcagggaaattaagtttggctttggttcctttgaatctgagagcagcatcatcataagctatggctgcagcctcggctgtatcgaatgtgccaagccagactcgagctgccttcttcgggtcacgaatctcagctgcccatttgccccatggtctctgccttacacctctataatgtcttctcgtttgggccccttggtcttgaacctgttgtgatggatcattttgcattaagacaggatggacatttgaagggttgtcttgacctgtgccaatgacatgagaaagtgcggataccatggcattcatgtcttgctcagaacgaggggaggcaccatacccttctgtg

SEQ ID NO: 9473 - DNA, 883 bp, Aquilegia formos X Aquilegia pubescens
  Predicted polypeptide sequence is orthologous to G896
agggtttcttatcaaccacatagcggcatagcctaccaatgtagtgtttccagtaaaacaatctggataagtaaatgctgaacaccagcttctaatcaccacgggcgtctatacctccacccagacaaatagaaaataaacaataattcgcacaaaccacaaaagctcatccaaataaagatatacagaagaataaaggtgaagcttctcatatgagcaccttgtcactgtacaaataaggctgaaataagctctgggaaaaaaggttgttgctggtaaaaatattattatagggaaaacggctttgtgtagacatcaaatggttcacatgctgttaactgtggctcctgtctcaaacccccaccgctgcctcctgtcaaaagcatggtcaaaagtgaattcacaggaccaccacctccaacttcatttcctgtattacggatggtagttcgcatagcattcagtatgctcccatatgtagccccctgtccatgctcaaatgcttggataaaacagaacgtcatggcacctgttgaagtgatctttgatagagccgaggtatcagcagaagtttgatcatcatcacaaccactgaatgaaatagcttccccaccgtttgttcctttccacacacccgatcgagggcgatggtcctcccagacatagtgtccactcctgttcattctgcagagaaaaggtaaatctaatatagtgccactgtgacaagcatctattattgcgtgaagtttgaccccacgaggaagaggtttgacaattgttgtattaatctcgtcatcaacaatcattccctgagtttcaaagtccaaaggacacagagtttcgtcatatccatccacctcatcaccattataatttctctgcc

SEQ ID NO: 9474 - DNA, 902 bp, Aquilegia formos X Aquilegia pubescens
  Predicted polypeptide sequence is orthologous to G896
tcacagaatgtcatgttcttattatttagcatagcgttatggtaatattattacaaaatgaattgtttcttgtaaatgtcaaacatttccgaagatgacagttgagtttcctgggacaggccattgaagagaactttctttaagaaggatgagatggggccattgcaacgtattcctgcattagcctcgcgtattgcaactcgcatagcaataagcaaagaaccatatgtgagtccaggagagctttgtgctgcttggatgaaactgtaggtcattgcacctgtcatagtgttgcctgagagtgctgatgtatctgcagaagtctgatgatcatcacaagcactaaaagacagggccagaccaccacttgtacctttataagtgcctgatcgagggatgtgattctcccacgagtaatagccatttttgttcatcctgcacagataaggaagatcaagaattgttccactgtggcatgcatccatgatggcatgaagtgttgtccctttcggaagaggcctaactatagtagcattgatctcatcatcaaggatcatcccctcagtctcataatcaagtggacatagagtctcatcgaaaccgtcaatttcatcaccattaatatttggttgttgtgagccatggccggagtaatggaacaccaatgagtcccctggttggcagccttgaactagccacttcaatgcatttcgaatgttttgtctcgtgggaattcgataggggtctcgctcattctctgtaagtatgagtatggagtcatgaggaaaaccaagcttctccacaagaaagtatctcatgcagttaacgtcatttatgctccccttgagttcatatctcttggatctataacacaatccgcacagaagagctctcctcttccc

SEQ ID NO: 9475 - DNA, 916 bp, Aquilegia formos X Aquilegia pubescens
  Predicted polypeptide sequence is orthologous to G921
cattgtttgtaatattcaatcaatttatatacaaaggttttgaaaaactctgtatgtcctagtttctgaacctttactgaattacaaaatgggtgtctttgcattcccatggttctaaaacaaaacaaaacaaaatacaattaattggatgtctctttgtcagataggaacaatttgtcaccatttttcggccggtgaagtttgaagaattcttcctgaaatggctgctgcaagtgctgctttgaaactaggatcttttgataaggaagacgccatttgttcaaccaaaaattgtttgtatgctggtgactgatctatttcttgagtagtaggtttcttggtttcatgacttaatccaggttgagtaagatcaagtgttatggaagggcctgacgatccaaccgaagcagaacaaggaatggatttaagtgttacacccaaagttgcctcggcttgagaaggatgtgggtggttgtgttcaccctcgtatgtcgctacaaggatagatcgatcttctacgcttctttgcaccttctttttgacagggcagctgggggcaaaagagcacttgaaataagctctaggacatggattatctcttgtgactttctgaccatatttcctccattggtatccatctttaaatatctgtgattcgataacagggttgttcagtatcagcttattatagaattatatacaacagtactacatgtagtatatatgatgaggtataacttaaaatgagatgtgtgaaagaacttacaagctggtctcagatggatcggtccttatataggctttcgatgtttgcgatttgtgttcaattcttggtttcttacttgactcttcatcactagagctactttccatgctaccatcactctatgagattgctattatcctcactgtcagc

SEQ ID NO: 9476 - DNA, 901 bp, Aquilegia formos X Aquilegia pubescens
  Predicted polypeptide sequence is orthologous to G938
acggagttttgccaacaccaaggtgtctacataaccttttctagagcaagatcagaccagataaccacataaccacttcaattctgaacctgcaatgaaagctactactagaattcctagagtctcaacaatgaaaggaaacaagtctctatcagctttaagattgatgattagtacaacaactaacaccaggatgatatccacctgataaagcagaattgtgcaaggacatacctccttccggataatacagactgagctccagatagccatcccattttttataggaaccaccccatattgtcttgcttaggcaacgctcctgcagcataatcaacagaggacaagttgaagggagatccatatctactgaactcggcagtaatgtcattagggttcgcttccatcagtggatcaaaggccttacactgatcaaacacattatcatctctattgaacattgtctggttcatgggcacattagtttcttcaaacatgttattccccattgcggtcccatggtcatagaagttggtgaattgaacttttggctgctcacaactctgatcttcagtaaccccaagatttccaggatttgaaccctggttgcactgcagattggtatcataaaatgacataagatcaccgatcattttctgtccatcttctgggagagtaattccagctaagttaaaggatggttggtgttggtttgtcgacacaggaactggcttagattgcgggaacggcaaggaaaagacttggggtttgtcttcctcgatgtgaaacggggttgtgattcctgatcccgcagagatagttccatacggacaatccaattggtgattgttccttttcgtcctgtctagaaacccaaggcggcaattactgtatgggcact

SEQ ID NO: 9477 - DNA, 906 bp, Aquilegia formos X Aquilegia pubescens
  Predicted polypeptide sequence is orthologous to G962
ctgttttgcagctaccatatacatatatatgacaatactccagatcgaccttaaataaatagtactagctacttcaattcgttactactactaattactgcaagttcattattagtttatggcaattgcagcaaccatgagccaaaacaacgacgacaaggataaccacgaccacgatatggtcatgcctggcttccgttttcacccaaccgaggaagaactcattgaattctatctccgccgtaaggttgagggcaagcgctttaatgtggagcttattactttcctggatctatatcgctatgacccttgggagcttccagcattagctgccattggagagaaagaatggttcttctatgtgccacgagaccgaaaatatcgtaacggagatcgccctaaccgggtgacaacatctggctactggaaggctactggtgcagacagaatgatccgaaatgataacttgagatccattgggcttaagaagacactagtcttctattccgggaaagcacctaaaggcatcagaaccagttggatcatgaatgagtaccgtttacctcagcaagacactgatagataccaaaaggcagaaatttcgctttgtcgagtctacaagagacctggagtagaagaccacgccagagttcccggctcctctcattcttctgcaccatcttcatcaagaggaactcagccggataaaagacagcagaacctgatcacttatggaatttcaagctttcaagcatacgatagcaacaactcacccgcaactactactactactactactgagatggaaaagctgaatgaagcagatgcaagcagtactagcaatgataccggaactgctcttgggatggccaatgtttctccaatgatcagttccgcagtattgtc

SEQ ID NO: 9478 - DNA, 963 bp, Aquilegia formos X Aquilegia pubescens
  Predicted polypeptide sequence is orthologous to G979
aaagaagaacaaagaaccattcttgggatcaatagagtagcaaacaaagtgaccatatacataacattatacagtgttgcatcaaatgatctttttctattaacattccaaattatctggaaataatatcacacggaagattatcagcctagcctataacatataatgttttcccaactatatcctcccccacacattagtattccagtacaggactcatcaccattagcaggagtgttcagtttgaatttgtgtcacgggggaaactaacatacaagtaatacaacaatgcagtgagttggcttccaattttaacttctgcatgtggggagtaggcttccaaatgtgtcccgagtcttgttcctggaagaattctgcaatgtacccaactcacttttcgcatatcacatttcaactacaagggtgacatcaggatgcagatgatgcatactaattccttaactattgatgtgactgcagaatgctcattgtgtcataacagcacatccttttttgcatgtcccattagccatctgggtctaaactcgccaaacataagcattcagactgttttcagcttcaaattgaatgaagaacatccagtcagatgagacaatctgctctctttaaatgctacgtcttagcattcacgtgcaacactgagcagagcagagcttgtcaaatttagcttagttgcaaaccagtcatgtcctaatccttcttcatcaagggaccagggcgctatttctagccttctacagggacatctggttcccaagtagctcgcatgactttagggggagcataggactagcagaatcatgcggtcaccatcatgtaacaatctttggacattcacattttctatacatgaacaatactcgggatgactttttgaagtaatctatatgatggacttgacgtttgatcaccatcacatggaagacatgcaagttcattctc

SEQ ID NO: 9479 - DNA, 908 bp, Aquilegia formos X Aquilegia pubescens
  Predicted polypeptide sequence is orthologous to G979
aatacattctgcaaatcaaaagatccaaatttaaaagctacctattctttctattggcatttcaaatcattcataatcattcagaatagatacagagaagtgagacaaaaaaaataagaggatacagaactcactcagagacaggaagaaagaaccctttttcgccggcaccctatcattttccagcacattctaaccttcccataacaccctcaccttctcctttaaaacttaaaggagaaaccccaccattggagaacagacatatccttgtagtttaatggcgaagatatcacagcagaatcagaagatcactgtaaataacattaaaactaatgatgagactataaccaaagtgaagagaaagcgaaagagcgttccaagagactctcctcctcaacgcagctcaatatttcgaggagtcacaaggcatcgatggacaggtcgatatgaagctcatctctgggataagagttgttggaatgagtcgcagaagaagaaaggaagacaagtctatcttggtgcttataacgacgaagaggctgcagcacatacatatgatttggcagcactaaagtattggggacctgaaaccatccttaacttcccggtatcaacttaccaaggggagctagaggaaatggagagtcagtcaagagaagaatatattggatcattgagaaggaagagtagtggattttctcgtggagtttcgaaatacagaggtgttgcaagacatcatcacaatggaagatgggaagctcgaattggcagagtatttggcaacaaatatctctatcttggaacttatgcaactcaagaagaagctgcaacagcatatgacatggcagcaattgagtaccgtggactcaatgcagttaccaactttgacctcagccgttacatca

SEQ ID NO: 9480 - DNA, 710 bp, Brassica napus
  misc_feature (574)..(574): n is a, c, g, or t
  misc_feature (602)..(602): n is a, c, g, or t
  misc_feature (677)..(677): n is a, c, g, or t
  Predicted polypeptide sequence is orthologous to G1033
gaacaacacacgtacgatccttttgctctcctctctctctctctctagaaaccctgcaatcctcttcctcaagattcgagtatgaaaggaggtaaatcgaagactgaaaccaggagctccaagctctctgtggccaagaagcctgctaaagcagcaggtcgcagcaaagcggcggctaaggatcctaacaaacctaagaggccagccagtgccttcttcgttttcatggaggactttcgccagacttacaagaaggaacaccccagcaacaaatctgttgccgctgttggtaaagctggtggagaaaagtggaagtccttgtccgactctgagaaggctcccttcgtagctaaggctgataagcgcaaggttgagtatgagaagaccatgaaagcctacaacaagaagctggaggaaggtccaaaggaggacgaggaggaatctgacaagtctgtgtccggggtgaatgatgaggatgatgccgatgatggtagtgatgaggaggaagacgataactaaagaagttgaagctggtagcactatataggacgctacatcaaggatctcggatgtnttttattttctttctttttactgatgtnttcaacttagtaaagctgccactatctctctgattatgattctaccggtaatggaaaaagtgtgtgtagaatgtntgaattagagatatgcacctctatgtaacgatt

SEQ ID NO: 9481 - DNA, 358 bp, Brassica napus
  Predicted polypeptide sequence is orthologous to G1033
gcccttttttttttttttttttgaacaaaaaaaccctaaagcgactttaaaaaaaaacagcccccacctaaaaaaaaaacctgggattcattggataaaacaaagggggggatccccttttggcaaacttgtttttttcttggccaaaatcaaccttagggggaggggagggaaataaaacaaaccatcaaccgcctttgggcctttttttttttttttatgttggggaaacaaaaaacccccccaaaatcaaaaaacaggaaacccttccaaaaaaaatccccaattttttttttttgttcaacaacattttttttttttttggggggaaaccaaaccccaattcattgaaaaaaaa

SEQ ID NO: 9482 - DNA, 730 bp, Brassica napus
  Predicted polypeptide sequence is orthologous to G1033
gagcctgcaaaaaaaaaaaacttccaacgttatggagttcgtctgaatcaaagtgtcgtcttcaacggattcatttacaattgttctccgcacctcacacaatctatcattgaatgcatcccattttacttcctttctcagaatataaggtaagtcatatccagtaaatttcattagttcattctctcaatcacaatcataagctttcaaaaatcccattgataaaaatggttaattaagctatattttaagtccaaacaggtgccttcttcattttcatgtactcattgcctactgattcttcaatttaatgtgttcagtatcttccaaggattaaactttttggctgtccaaaacttttttatttggctaatgtgaaatttactgaaggttagaagagtagactttttgtgatcccaagggagtacttcccctagactttcaagaagaacatcctacggaacaaatataatagcacaaatataatagcacaaatatactgctgatggctggaggttcttttgtaacttagcctcttgatcttgaaaggcacactgacgttgaattcgaatgaaaaacagaagaagacaccttatgttgctaaggctaaaaagtgtacagttgactacaagaagaacattaaagaaaaggggcagaggattcagaggggcagaggattcaaaggaaggagttgatcttgatccagcaaaaaaaaaaaaaaaaaaaaaaa

SEQ ID NO: 9483 - DNA, 335 bp, Brassica napus
  Predicted polypeptide sequence is orthologous to G1062
ggtttgccttgaatgtgttccgcgctgagcaatgccaagaaggacaggagatattgccatgatcaaatcaaagcagtgcttttagatacagcgggctatgctggtctgatctgatcatgaggttcttgagcatctgatgaagaaactaagcctttaaatatgcaattttctttactttctttcttcaagttaagcatgtatgcaactgtacatgagacatgtttaaattaacctttttgaacttggggggttgttcgatatattacttcagcctttattatcatgtgtgttttaagttagaaaaaaaaaaagaaaaaaaaaaaaaaaactctgtc

SEQ ID NO: 9484 - DNA, 511 bp, Brassica napus
  Predicted polypeptide sequence is orthologous to G1249
gaattacatggcggaagaagaagagacgacgacacgaccggagtttccaatcacaagagtgaagaagataatgaaagtcgacaaggacatcaacaaaatcaactcggaagctcttcacctcgtcacttactccaccgagctcttcctccgcttcctcgccgataaatcttccctagttgcggcggagaagaggcgaaaaacggttaccctcgatcacctgagaatcgccgtgaagagacaccagcccacgagggattttctcctcgactcgctccctctcccttcctctcagcccgtccgagtcaccaaaacggcgtcggagaagaagccgccgcctgctgggacccgtcgcatcgacgctttcttcagtaaaggcaaggcgaaagttgattccccttaagaccccaaacttcttctttgctccatgtttatgagtttttgttatgttaaaagtagttaatgttatgtttcaatagaaaaaaaaaaaaaaaaaaaaaaaaaaaaacgtgtc

SEQ ID NO: 9485 - DNA, 765 bp, Brassica napus
  Predicted polypeptide sequence is orthologous to G1335
ggtagacaaagaaataaagaaagaaagagagagagagagaagatgagtggagaaaacgacaacggcggtgctaagcgcaggggctcggtcaagtggtttgctgccgagaaggggttcggtttcatcacccccgaagacggcggcgaagatctcttcgttcaccagtcctccatcagatctgagggataccgaagcctcgctgaaggagaatctgtcgagttccttgttgaggtcgacaacaacagtggccgtaccaaagccatcgaggtgaccggacccgatggcgctccagtccaaggtaccagccgtggttcatctggaggacgcggaggctttggcggcgacggatacggaggaagaggtggaggccgtggaagttacggtggacgaggtggtggtggtggtggccgaggaggaggaggcgactgctacaagtgtggtgagccaggtcacatggcgagagagtgttcccaaggagggggaggatacggcggtggaggtagaggaggtggcggcggtggaggaagctgctactcctgtggagagtcgggacatttctccagggattgtactagcggtggacgttgaaacggacagctgtcaggcggttggtaaggctgagtttgttatgatctggtggacaagtcttgtcgatgcgtactatctctttattttccacttctttttgctcctgacggatggatctttgtcgttttctatgttttgttttcggttaacgcctgatgggttcgattttacgatatg

SEQ ID NO: 9486 - DNA, 581 bp, Brassica napus
  Predicted polypeptide sequence is orthologous to G1364, G481, G482, G485
cccacgcgtccgcaccagcgaggcaagtgataagtgccagaaggagaagaggaaaactgtgaatggtgaggatttgttgtgggcaatggcaacgttggggtttgaggattaccttgaacccttgaaggtataccttgcgaggtacagggagttggagggggataataaggggtcagggaagagcggtgatggatctaatagagatgcagctgctggaggtgtttccaatgaagatatgccgagctggtgaaagaagtcgcaagtaagctctctagagataaagaacaacgccaaaatgatcagggaaacttagagatcagtgtggtgtttgacaataaagttagagatccggttttagttggttgtagttgaagatttctcttattagatatgacaactctttgaaagaaggaaaaaaagtttgtccacaagctctctcatctcttagcttcgtttatggatttcaaaacttgaatatgaatggactcacttgtgcttccaagtaagcaagaggaggttgtaacttacattgtcctcattaacttcacgtagaatgtcgtttaaatgaaaaaaaaaaaaaa

SEQ ID NO: 9487 - DNA, 443 bp, Brassica napus
  Predicted polypeptide sequence is orthologous to G1389
tcatgggatgatgatgatgcaaggcctcagcttccccatccatggagaagaacctactcaaccaaactcttcttcttctcctccaaactcacatctctaaacacagaagaaaagggtaagaacaatggaggtttctcatctatcaggacacggaggaagaaggatgaattaatgagatggaagaagagtacgcgatatattaattgttttaccatccatgatctatccatatgtttatagatatgtggtttcagttattatgattcaagactacttctactactctctttttagtatttttattattcagttttgcttatttactttatggttctgcattgatcatcaagactatgatactgaatgagatgggttctatgtgtgtgtttccaaaaaaaaaaaaaaaataaaaaaaaaaaaaaaaaaaaaaaaaaaaacatgtc

SEQ ID NO: 9488 - DNA, 450 bp, Brassica napus
  Predicted polypeptide sequence is orthologous to G140, G146
gaaaacagaaataacaaaaataaagagagatatttttacaagaacaacataatttttagaaaagcagaagcagcaattaagtgatactgagattaataataatatattatctcttcaaaagagtttctcattagtaacttcccctttgtgctgatctatcatataatcttcaaaacccagaatcaatggaggaaggtgggagtagtcacgacgcagagagtaacaagaagctagtgagagggaagatagagataaagaggatagagaacacgacaagtcgtcaagtaactttctgcaaacgacgcaatggtcttctcaagaaagcttatgagctctctgtcttgtgtgatgcggaagttgcacttgttgtcttctccactcgtggccgtctctatgagtacgctaacaacaggtacaaaaaaaaaaaaaaaaaaaaaaaaaaaaacagtc

SEQ ID NO: 9489 - DNA, 789 bp, Brassica napus
  Predicted polypeptide sequence is orthologous to G140, G146
tcggtggtttattcatttggtgacgatatcacagaagcaatggatgaaggtgggagtagtcacgatgcagagagtagcaagaagataggtagagggaagatagagataaagaggatagagaacacaacaaatcgtcaagtaaccttctgcaaacgacgcaatggtcttctcaagaaagcttatgagctctctgtcttgtgtgatgctgaagttgccctcgttatcttctccactcgtggccttctttatgagtacgccagcaacagtgtgaagggtacaattgaaaggtacaagaaagcttgttccgatgccgttaaccctcctactgtcactgaagctaataccaagcactatcagcaagaagcctctaagcttcggaggcagattcgggacattcagaattcgaacaggcatattgttggagaatcacttggttcattgaacttcaaggaactcaaaaacctagaaggacggcttgaaaaaggaatcagccgcgtccgatccaagaagagtgaacttttagtggcagagatagagtatatgcagaagagggaaatggagttgcagcacgttaacatgtacctaagagctaagatagaacaaggcgcgagattgaatccggaacagcatggatccggtgtaatacaagggacggcggtttatgagtccggtctgtcttcttctcatgatcagtcgcagcattataaccggaattatattccggttaaccttcttgaaccgaatcaacaattctccggtcaagaccaacctcctcttcaacttgtttaa

SEQ ID NO: 9490 - DNA, 1098 bp, Brassica napus
  Predicted polypeptide sequence is orthologous to G140, G146
caatcaacaacttcacccttccattttctgcaacttctccaaatctcatactttccagaaaatcattttcccaagagaaataaaactttcctctttgttcatctctcttccccccaacagcaaacatggcttaccaaatggagctaggaggagaatcctctccacaaaggaaagctgggagaggaaagatcgaaataaaacggatcgagaacacaacgaaccgtcaagttactttctgcaaacgcagaaatggtttgctcaagaaagcttacgaactctctgttctttgtgatgctgaagtcgcactcattgtcttctctagccgtggccgtctctatgagtactcaaacaacagtgtaaaagggacaattgagaggtacaagaaagcaatatcggataattctaacaccggatccgtggcagaaattaatgcacagtattatcaacaagaatctgccaaattgcgtcaacaaattatcagcatacagaactcgaacaggcaattgatgggtgagacgattgggtcaatgtctcccaaagagctcaggaacttggaaggcagattagacagaagtgttaatcgaatccgatccaagaagaacgaactcttattcgccgaaattgactacatgcagaagagagaagttgatttgcataacgataaccagcttcttcgtgctaagatagctgaaaatgagaggaacaatccaagtatgagtctgatgccaggaggatctaactacgagcagatcatgccaccgcctcaaacgcaacctcaaccgtttgactcacggaactatttccaagtcgcggcattgcaacctaacaatcaccattactcatccgcaggtcgcgaagaccaaaccgctcttcagttagtgtaatattggctgaagcatgaaggagcaaggactgaataaaaaccagaactgggttaaggaacgagcgatataaagctgatgcactgttataaaaatatttatatatttatttcacgaatgttgtgtccatgctttctacattttatttaaattgcttatgttgatgtgaaattaatatcttaaaagacatgtgattaatgtgctttaatttgtttcg

SEQ ID NO: 9491 - DNA, 577 bp, Brassica napus
  Predicted polypeptide sequence is orthologous to G1510
gcatcttcgttggtgatgaagttggttaagccacccctccatttcctgtagcgaaggagtcctcgtcgcatctttcagtaaggatctttcccggtttgtttcgctaccctcttaattcctcagtggcttcgtattgtatgtttgaagcaatataaagaggtcgatgtgtgggatcaaccggatgaagatgcgggggagcggtttgtcccgggtggttcagttcttttggttctagggttcaggggtcagtatcgtgtgggatctgactcgggtgtgatgctaatttgtgtggttctggctcttcatctcttcatcgtgaacagaggttcagatgagtttcggtcgtttatgtctttcacgtcgcttgctcacttgtctgaatgttgttctccgcaagttatccggctgctttaggctccttactattatctttggcctttgtacattaatgtatgtgggtgtagaggtatgatcttgctttagtcttttaagttagcattcagtttgttggtagttgcctgtgtttgggcttaagttacccttgtatgggttctagttccgaggattcactttgtcc

SEQ ID NO: 9492 - DNA, 649 bp, Brassica napus
  misc_feature (628)..(648): n is a, c, g, or t
  Predicted polypeptide sequence is orthologous to G1535
cggcaaggcttgagcttccttctggcttcactcctctgagacagacctcttttaccaggacgtgttatcccgtgggaggtgacgaaggtgacggaggtgagggagggtggcttgtgcttgatctccccctcccttcaagattcggccaagaagagcttccttacgtgagaagctttcttgcgtttcctgctaggtcccatgggttctcgcgagtcatctcgctcgagattgggctgatctacaaaaaagattcccaaacccagtccgatcccaattacgatggtacaaacttttggtcatcgctttggttttggacactttctcgtgagtgtcaacgtcgtagccttcatttctcagcagggactgacaaagcggtggtggagtaaagcggtggtggagtagtagaagaagacaactaaagacctatactactccatattttatgtttatccccaggctctctctctatctactatttagaactgctacataagtttcttgcacttcacactctctttttctattattatataaaaaaatcttcatcaagtgatgatgataaacagatggctttacatttgattccactagtaaataaatctatgattatgttgttgtcaaaaaaaannnnnnnnnnnnnnnnnnnnnc

SEQ ID NO: 9493 - DNA, 847 bp, Brassica napus
  misc_feature (742)..(742): n is a, c, g, or t
  misc_feature (844)..(844): n is a, c, g, or t
  Predicted polypeptide sequence is orthologous to G157, G1759, G1842, G1843, G1844
ggcgactttaaccgtacctcagaatcaaattagggcacagagacctctcggagacagaagctatgggaagaaaaaaactagaaatcaagcgaatcgagaaaaacagtagcagacaagtcaccttctgcaaacgacgcaacggtctcatcgagaaagctcgtcagctttctgttctctgcgaggcatctgttgggcttctcgttgtctccgcctccgacaaactctacagcttctcctccggggatagactggagaagatccttgatcgatatgggaaaaaacatgctgatgatctcaatgccctggatcttcagtcaaaatctctgaactatagttcacaccatgagctactagaacttgtggaaagcaagcttgtggaatcaattgatgatgtaagcgtggattccctcgttgagctagaagatcaccttgagactgccctctctgtaactagagctcggaaggcagaactaatgttaaagcttgttgaaagtctcaaagaaaaggagaatctgctgaaagaagagaaccaggttttggctagtcagattgagaagaaaaatcttgagggagccgaagctgataatatagagatgtcatctggacaaatctccgacatcaatcttcctgtaactctcccgctgcttaattaaccacctttactcggcggttaatcaaaataagaaacatataatctaaagataacctatgtaggttttacttttcgcagcttaattaaccncctttactcggcggttaatcgaaattaaaaacatataattaacaaataacctatgtcagtttaaccccaaaaaaaaaaaaaaaaaaaagaaaaaaaaaaaanaaa

SEQ ID NO: 9494 - DNA, 908 bp, Brassica napus
  Predicted polypeptide sequence is orthologous to G157, G1759, G1842, G1843, G1844
aaaagaaagaaataaaagcaaaaaagagagaaaataaaagcaaaaataagaaagaacaaaaaacgctcagtatctccggcgagagctgaaccgaaccgaacctcaggatcaaattagggcacaaagggttctcggagacagaagccatgggaagaaagaaactagagatcaagcgaattgagaacaaaagtagccgacaagtcaccttctccaaacgacgcaatggtctcatcgagaaagctcgtcagctttcagttctctgcgatgcatccgtcgctctcctcgttgtctcagcctctggcaagctatacaacttctccgccggcgatgacctggtcaagatcgttgatcgatatggaaaacaacatgctgatgatcgtaaagctctggatcttcagtcagaagctccgaagtatggttcacaccatgagctactagagcttgtcgaaagtaagcttgtggaatcaaattctgatgtaagcgtcgattccctcgttcagctggagaaccaccttgagactgccctctccgtaactagagctaggaagacagaactattgttgaagcttgttgatagcctcaaagaaaaggagaaattgctgaaagaagagaaccagggtttggctagccagatggagaagaataatcttgcgggagccgaagctgataaaatggaagtgtcacctggacagatctctgacatcaattgtccggtaactctcccactgctttattagccccttaagtccaaaacttgtgactaaaaacaaaaataagttaccgaactattcccctataagggtgagcgttgtatatcttcacactctcttggctgagagaccctgtgtgtaaaaactacggtttgatttgagtaaaaatatatatttaagaaaaaaaaaaaaaaaaaa

SEQ ID NO: 9495 - DNA, 969 bp, Brassica napus
  Predicted polypeptide sequence is orthologous to G157, G1759, G1842, G1843, G1844
ctctggatcaaattagggcacagagaccacttggagacagaaaccatgggaagaaaaaaactagaaatcaagcgaattgagaacaaaagtagccgacaagtcaccttctccaaacgacgcagcggtctcattgagaaagctcgtcagctttctgttctctgcgatgcatccgtcgcgcttctcgttgtctcctcctccggcaagctctacagcttctccgccggtgataacctggtcaggatccttgatcgatatggaaaacagcatgctgatgatcttaaagccctgaatcttcagtcaaaagctctgagctatggttcacacaatgagttacttgaacttgtggatagcaagcttgtggaatcaaatgtcggtggtgtaagcgtggacaccctcgttcagctggagggtgtccttgaaaatgccctctctctaactagagctaggaagacagaactaatgttgaagcttgttgatagcctcaaagaaaaggagaagctgctgaaagaagagaatcaggctttggctggccagaaggagaagaagaatcttgcgggagccgaagctgataatatggagatgtcacctggacaaatctccgacatcaatcttccggtaactctcccactgcttaattagccaccgttagacggggctgatcaaattaaaaaatccaaaacatacaactaaataaataagctttgttgtttttcacccttgaagggtgcacgttgtatatctcaatactcccttggctgagagattgtgtgtttactcctatgttagatataatgagtaaaataaaaataaaaagatctttgtaccttcgtcgagagagaattgtagtgagtgtgcttgtgtgttctttttctcttctttgcttcatggcgaagaagcctaccgtctaatttgtaacggagacgtggccctctctgcccttttgtattcgtaattcctttgtattaaaaa

SEQ ID NO: 9496 - DNA, 780 bp, Brassica napus
  misc_feature (748)..(748): n is a, c, g, or t
  misc_feature (769)..(769): n is a, c, g, or t
  misc_feature (779)..(779): n is a, c, g, or t
  Predicted polypeptide sequence is orthologous to G157, G1759, G1842, G1843, G1844
ttagggcacaaaggcttctcggagacagaagccatgggaagaaagaaactagagatcaagcgaattgagaacaaaagtagccgacaagtcaccttctccaaacgacgcaatggtctcatcgagaaagctcgtcagctttcagttctctgcgatgcatccgtcgctcttctcgttgtctcagcctccggcaagctttacaacttctccgccggcgataacctggtcaagatccttgatcgatatggaaaacaacatgctgatgatcttaaagctctggatcttcagtcaaaagctccgaagtatggttcacaccatgagctactagagcttgtcgaaagtaagcttgtggaatcaaattctgatgtaagcgtcgactccctcgttcagctggaggaccaccttgagactgccctctccgtaactagagctaggaagacagaactaatgttgaagcttgttgatagcctcaaagaaaaggagaaattgctgaaagaagagaaccagggtttggctagccagatggagaagaataatcttgcgggagccgaagctgataaaatggagatgtcacctggacaaatctctgacatcaatcgtccggtaactctccgactgctttattagccaccttaagtccaaaacttgtgactaaaaacaaaaataagttatcgaactattcccctataagggtgaacgttgtatatcttcattctctctggctgagagacccccgtgtgtaaactatggntagatttaagtaaaatatatntttaagacana

SEQ ID NO: 9497 - DNA, 845 bp, Brassica napus
  Predicted polypeptide sequence is orthologous to G157, G1759, G1842, G1843, G1844
ctccggctagtggaaaccggacctcaagatcaaattagggcgcaaagcactgttggagacagaagccatggggaggaagaaacttgaaatcaagcgaattgagaacaaaagtagccgacaagttaccttctctaaacgacgcaacggtctcatcgagaaagctcgtcagctttccgttctctgtgacgcatccgtcgctcttcttgtcgtctccgcctccgggaaactctacagcttctcctccggtgataacctggtcaagatccttgatcgatatggaaagcaacatgatgatgatcttaaagccttggatcgtcagtcaaaagctttggactgtggttcacaccatgagctactggaacttgtggaaagcaagcttgaggaatcaaatgtcgataatgtaagtgtgggttccctggttcagctggaggaacaccttgagaacgccctctccgtaacaagagctaggaagacagaactaatgttgaagcttgtcgagaaccttaaagaaaaggagaagttgctggaagaggagaaccatgttttggctagccagatggagaagagtaatcttgtgcgagccgaagctgataatatggatgtctcaccaggacaaatctccgacatcaatcttccggtaacgctcccactgcttaattagtcacctttaatcggcgaataaataaaatccaaaacatataactaaaacaaacaagatgtgtaattatccccttgtaaagggtgtacgttgtataatctatactctctctccggctcgagaggcttcgggtgtaaaactatttcagatttatgtaagatagaaaatctatgcaagacactttcaa

SEQ ID NO: 9498 - DNA, 770 bp, Brassica napus
  Predicted polypeptide sequence is orthologous to G1821
acaaacacaagctcgtgtgagtttgaagaaaggatatggaacgaggaggcttccatggctacggcaagttctccctcaacaccaccaccaatccagagagcggcatgcagctatcagaactcaaccagcctaccaaaaccgctgacggcggccaagaggagtgcacggtgagagagcaagacaggttcatgcctatcgccaacgtcatacggatcatgcggaggatcttacctgctcacgccaagatctctgacgactccaaggagacgatccaagagtgtgtctccgagtacatcagcttcgtaacaggggaagccaatgagcgttgccagcgggaacagcgcaagaccatcactgccgaggatgtcttgtgggcaatgagcaagctcggttttgatgattacattgaacccttaacattatacctccaccgctacagagagctggagggtgatagaggagtaaactgcggtgctggatccgtttgtatgaccaatggcatggtggtcaagaggcctaatggtaccatggctgagtatggagcctacatggcaccgtaccattatcgtcatcagaacgggtttgcttacagtggtaacgaacctaattctaaaatgggtggttcatcatctagtttttgaacacagttttcaagcaaaaaaaaacaatgatgctttgtctctatgtatcttctccttgaacgaacctagtgttttcaattgatcttttcttgtgataaaaaaacaaaaaaaaaaaaaaaaaaaaaaaaa

SEQ ID NO: 9499 - DNA, 835 bp, Brassica napus
  Predicted polypeptide sequence is orthologous to G1821
gaatgcaacaaatcactcaaataattaatttattaagatcttaaaaaacggcagagaaacaatggaacgtggagctcctctctctcactatcagctacccaaatctaactcgggactgaacttggaccagcacaacaactcaatcccgacaatgaccggctccatcagtgcatgcgacgacaagaacaagactatcttgccgcagcaacaaccaagcatgcctcgtgagcaagaccaatacatgccaatcgcaaacgtgataaggatcatgcgtaaaatcttaccgccacacgccaaaatctctgacgacgcaaaagaaacgattcaagaatgcgtctccgagtacatcagcttcgtgaccggtgaagctaacgagcgttgccaacgtgagcaacgtaagacaataacagctgaagatatcctttgggccatgagcaaacttgggttcgatgattacgttggaccactcaacgtgttcattaaccggtaccgtgagttcgagaccgatcgtgggtgttcacttagaggtgagtcatcatttaaaccggtctatggaggaagtggtatggggtttcacggcccacctccgccgggttcgtatggttatggcatgttggatcagtctatggttatgggtggtggtcggtactaccataacggatcgggtcaggatggatcagtaagtggtggtggtggatcttcctcttctatgaatggaatgccggtttatgaccagtatggtcagtataagtgaagatgaaaattcttgattttctgcatgtctattcaaaacatgttttggatagttattatgtatgccaacatatctattggt

SEQ ID NO: 9500 - DNA, 696 bp, Brassica napus
  Predicted polypeptide sequence is orthologous to G1821
ggtggctttgaagaaaggatatggaacgtggaggcttccatggctacggcaagttctccctcaacaccaccaccaatccaggggaagcttttgatggcagagagcggcatgcagctaccagaacccaaccagcctaccaaaaccgctaacggcggccaagaggagtgcacggtgagagggcaagacaggttcatgcctatcgccaacgtgatacggatcatgcggaggatcttacctgctcacgccaagatctctgacgactccaaggagacgatccaagagtgtgtctccgagtacatcagcttcgtaacaggggaggccaatgagcgttgccagcgggaacagcgcaagaccatcactgccgaggatgtcttgtgggcaatgagcaagctcggttttgatgattacatcgaacccttaacattgtatctccaccgctacagagagttggagggtgatagaggagtaaactgcggtgttggatccgttagtatgaccaatggcatggtgctcaagaggcctaatggtaccatggccgagtatggtccctacgggactatggcgccgtaccgttatcatcatcagaacgggtttgcttacagtggtaaccgaccctaattctaaaatgggtggttcatcatctagtttttgaacacaaagttttcaaagcaaaaaaaacaatgatgctttgtctct

SEQ ID NO: 9501 - DNA, 842 bp, Brassica napus
  misc_feature (738)..(738): n is a, c, g, or t
  Predicted polypeptide sequence is orthologous to G19
gaaaaaaagaaagaaagcaaacagagaaaatgtgtggcggtgctgtaatttccgattttgcccctaacgtcaccaaggctaagggtaggaaactcacggcggaggaactctggtcagagctcgatgcttccgccgccgacgatttctggggtttccattccacatccaagactcaatccaccaaccaacaagaggaggcggcggagaaggagaaggaaaaggagccggtgacggagaaaaggaggaagaggaagaacgtttacagagggatacgtaagcgaccgtggggaaaatgggcgtcagagattcgagatccaagaaaaggcgccagagtctggctcgggacgttcaacacggcggaggaagctgccatggcttatgacgttgcggcgaagcggatccgcggcgataaagccaaactcaacttcccagatcttctccaccatcctactcgtagtcctgcgactcctctagcatcgtctccagtttcagaagttcagcctccggcgaagaagcactgcgttgtctctcagagcgagttgactcagccgagtttcccggtggagtacagtggagtggggagcggggacgagtttcaactggactacgatctgaaacagcagatatcgagcttggagtcattccttgagctggatggtgacacggtggagcaaccgagtcagctcgacgagtccgtctccgaggtggatatgtggatgattgatgatgtcttcgcgncgtatcagtaataaacgtaatataagtagaaatattaaataaagtttgtaatataactgccgttacgttctaaggtttgtaatgtgatgacatgagcgactgat

SEQ ID NO: 9502 - DNA, 665 bp, Brassica napus
  Predicted polypeptide sequence is orthologous to G19
agcataagagtgaaataaaagaaacagagaaaatgtgtggcggtgctatcatatccgattttgttcctatcctcaccaaggccaagggtaggaaactcacggcggaggaactctggtctgagctcgatgcttccgccggcgactatttatggagtttccatcccacctccaagcttcaacccaccaaccaacaagaagtggcgttgaaagatgaggcggtggtgaaggagaaggagagggagccagcgacgacggagaaacgggggaggaagaggaagaacgtttacagagggatacgtaggcgtccgtggggaaaatgggcttcagagatacgagatccacggaaaggcaccagagtctggctcgggacgttcaacacggcggaggaagccgccatggcttatgacgtagctgctaagcgtatccgcggcgataaagccaagctcaacttccctgatcttattcctcctccgctgacatcacccccagtgtcagacgatcagcctccggcgaagaagctctgtgtactctctcagagcgagttaactcagccgagtttcccggtcgagtgcattgggttcgggaacggtgaccagttttcagaaccggagttacgggtttgagcttgatttacgatctttaaacaggcagattatcgaggctcg

SEQ ID NO: 9503 - DNA, 780 bp, Brassica napus
  misc_feature (11)..(11): n is a, c, g, or t
  misc_feature (603)..(603): n is a, c, g, or t
  misc_feature (671)..(671): n is a, c, g, or t
  misc_feature (684)..(684): n is a, c, g, or t
  Predicted polypeptide sequence is orthologous to G19
ggttctctctngaaacccagcatcagagaaagaaaagaaacagataaaaggtgtggcggggctatcatttccgatttggttcctatcctcaccaaggccaagggtaggaaactcacggcggaggaactctggtctgagctcgatgcttccgccggcgactatttatggggtttccatcccacctccaagcttcagtccaccaaccaagaagaagtggcgttgaaagatgaggcgggggtgaataagagggagcctgcgacggagaaacggaggaggaagaacgtttacagagggatacgcaagcgtccctggggaaaatgggcgtcagagatacgagatccgcgaaaaggcaccagagtctggctcgggacgttcaacacggcggaggaagccgccatggcttatgacgttgcggctaagcgtatccgcggcgacaaagccaagctcaacttcccagatcttattcctcctcctgccactccggcgctgacgtcatctccaccatcagacgatcagcctccggcgaagaagctctgcttactctctcagagcgagttaactcagctgagtttcccggacgagtgcatggggttcgggaacggnggccagtttcagaaccatagttacgggtttgagcctggttacgatcttaaacagcagatatcgagctnggagtctttcctngagcttgacggtaccacggcggagcaaccgagtcagctcgacgagtcaggggatatgtggatgatggatgatgtcatctcatcgtatgcataaaat

SEQ ID NO: 9504 - DNA, 713 bp, Brassica napus
  Predicted polypeptide sequence is orthologous to G2057
gtacacagaatttaaacgaggcagagagagagagagagagagagattcagacatgggctagtctgctgcttttgataaatcatcttcctcctaggctttatctatctctgctttttacggttagagtttttttgaggtgagactatgcgtgagtaagagttacatccatttcgaattattactctggattccccaccgtctaaccctgccgccgccgcctcgacgaacaagactccgaccttcctcaatatgctcaaccaatggcagacgaccacgacgaagctcaccacttcctccaccctcaacccccgccgccttcttcaatgaggcacggcgctgcgtcagacgagatagtggaggttcaaggaggtcacattgtgcggtcgacggggaaaaaagaccggcacagcaaagtctgcacggccaaagggccacgtgaccggcgcgtgaggctatcggctcacacggcgattcagttctacgacgttcaagaccgcctgggcttcgaccgtccgagcaaagccgttgactggcttatcagaaagtcttagacttccatcgacgagctcgctcagcttcctccggggagtcccgccgatgctattcgcaaagccgccgcaaacgctaaaccgagaagaaccgccgccaaaaccaaaatctcgccgtcgccgccgccgccgcaacggggacagcttcagttggggggtgcacgg

SEQ ID NO: 9505 - DNA, 725 bp, Brassica napus
  misc_feature (125)..(125): n is a, c, g, or t
  Predicted polypeptide sequence is orthologous to G2084
tcagagagtgtgagcgaatgggaggacgtcaggtgtgtgatctgcatggagccgccgcacaatgccgtcctcttgcaatgctcttccttctccaaaggatgccgtgcttacatgtgtcacactancgcgcgtcactccaactgcttcaagcagttccgcagaaacaagaacacaagccgatgcagtgtcaagactcttagctgtccctactgcagagaagaggttcacgggacggtcaagtcaacctccgcgcggagattcatgaatgcgagaccgaggtgctgttctatggacaagtgcggtttctctgggagctattctcagctcaagacacacttgaaagctgagcatccgggttctacgcctccgaaagtggaccctttggagaaacgcaagtgggatgatttggagagagcggagttcattgagatgatcaacgctcgtcagagatgggaatcagaacagagatctctctatcagcttccgcatcaccatcccttgatagatctcaactttgatgctttcatgcacaatctttttattggtgtaaggggtggtcaagcaagtgatgctaatacttcagtgccccggttggagttcgatggtaccagatggactccgtgaagattattccaagtgccgagtttagtcaagtgttgttccatagctgctctcttatatatcaaaaaggcgtttcccccgggaggaaaaaaaaaaaaaaaaaa

SEQ ID NO: 9506 - DNA, 648 bp, Brassica napus
  Predicted polypeptide sequence is orthologous to G2107
atgacctcattttctaccttctctgaactgttgggctccgggcatgagtccccggttacgttaggcgaagagtattgtccgaagctggccgcaagctgtccgaagaaaccagccggtcggaagaagtttcgagagacgcgtcacccagtttacagaggagttcgtctgagaaactcaggtaagtgggtgtgtgaagtgagggagccaaacaagaaatctaggatttggctcggtactctcctaacagccgagatcgcagcccgtgctcacgacgtcgccgccatagccctccgcggcaaaacagcttgtctcaattttgccgactccgcttggcggctccgtatcccggagacaacatgccccaaggagattcagaaggcggctgctgaagccgcggtggcttttaaggctgagataaataatacgacggcggatcatggcattgacgtggaggagacgatcgttgaggctattttcacggaggaaaacaacgatggtttttatatggacgaggaggagtccatgttcgggatgccggccttgttggctagtatggctgaaggaatgcttttgccgcctccgtccgtacaattcggacatacctatgactttgacggagatgctgacgtgtccctttggagttattaa

SEQ ID NO: 9507 - DNA, 1185 bp, Brassica napus
  Predicted polypeptide sequence is orthologous to G2107
tgctgcatgaattcggcacgaggagagaaataaatatcttatcaaaccagacagaacagagatcttgttacttactatactacactcagccttatccagtttttcaaaagaagttttcaacgatgaactcagtctctactttttctgaacttcttggctccgagaacgagtctccggtaggtagtgattactgtcccatgttggcggcgagctgtccgaagaagccggcgggtaggaagaagtttcgggagacacgccaccccatttacagaggagttcgtcttagaaagtcaggtaagtgggtgtgtgaagtgagggaaccaaacaagaaatctagaatttggctcggaactttcaaaacagctgagatcgcagctcgtgctcacgacgtcgccgccttagctctccgtggaagaggcgcctgcctcaacttcgccgactcggcttggcggctccgtatcccggagacaacctgcgccaaggatatccagaaggctgctgctgaagccgcattggcttttgaggccgagaagagtgataccacgacgaatgatcatggcatgaacatggcttctcaggttgaggttaatgacacgacggatcatgacctggacatggaggagacgatagtggaggctgtttttagggaggaacagagagaagggttttacatggcggaggagacgacggttgtgggtgttgttccggaggaacagatgagcaaagggttttacatggacgaggagtggatgttcgggatgccgaccttgttggctgatatggcggcagggatgctcttaccgctgccgtccgtacaatggggacataatgatgacttcgaaggagttgctgacataaacctctggagttattagtactcgtatttttcttaaaattatttttggaatgataatattttattgaattcggattctacctattttttttaatggatatcctttttttctggtagtgtgagaaacgattgtgaatgtttccacaaaagtgttggcaatgttgtcaaatgctgggtattttgtgcagcatagtcatcttggtttccttatatgcagcaactaaattttagtttttaagtaaaaacagaagaggaaagagaatgaatgttattaaataaagaaagaaaaatctaaaggtgggtttagtatgaaaaaaaaaaaaaaaaaa

SEQ ID NO: 9508 - DNA, 945 bp, Brassica napus
  Predicted polypeptide sequence is orthologous to G2107
aattcggcacgagctgagagataaattaaacatttatcaaaccaacgaaacatagatctttgtacttactatacttcaccttatccagttttatttttttatttataaagagttttcaacaatgacctcattttctaccttttctgaactgttgggctccgagcatgagtctccggttacattaggcgaagagtattgtccgaagctggccgcaagctgtccgaagaaaccagccggccggaagaagtttcgagagacgcgtcacccagtttacagaggagttcgtctgagaaactcaggtaagtgggtgtgtgaagtgagggagccaaacaagaaatctaggatttggctcggtactttcctaacagccgagatcgcagcccgtgctcacgacgtcgccgccatagccctccgcggcaaatcagcttgtctcaattttgccgactccgcttggcggctccgtatcccggagacaacatgccccaaggagattcagaaggcggctgctgaagccgcggtggcttttaaggctgagataaataatacgacggcggatcatggcattgacgtggaggagacgatcgttgaggctattttcacggaggaaaacaacgatggtttttatatggacgaggaggagtccatgttcgggatgccggccttgttggctagtatkgctgaaggaatgcttttgccgcctccgtccgtacaattcggacatacctatgactttgacggagatgctgacgtgtccctttggagttattagtacaaagattttttatttccatttttggtataatacttctttttgattttcggattctacctttttatgggtatcattttttttttaggtaacgtggaagctgagtgtaaatgtttgaacaattgtgttataaaatgctagtatttttgtgtgcaaaaaaaaaaaaaaaaaaaaaa

SEQ ID NO: 9509 - DNA, 1061 bp, Brassica napus
  Predicted polypeptide sequence is orthologous to G2107
aaattatacaaaaagagttcgagctcttgattacttaattaaaaacaaattttacttctcttttttttatggtcttttgtcatgatctgaaatacggtctttgttgataaatcatatatgccgattttgatttttaatccacctgagagataaattaaacatttatcaaaccaacgaaacatagatctttgtagttacttatccagtttattttttaaaaaattataaagagatttcaacaatgacctcattttctaccttttctgaaatgttgggctccgagtatgagtctccggttacgttaggcggagagtattgtccgaagctggccgcgagctgtccgaagaaaccagccggtcgtaagaagtttcgggagacgcgtcacccagtttatagaggakttcgtctgagaaactcaggtaaatgggtgtgtgaagtgagggagccaaacaagaaatccaggatttggctcggtactttcttaaccgccgagatcgcagctcgtgctcacgacgtcgccgccatagccctccgcggcaaatcagcttgtctcaattttgctgactcggcttggcggctccgtatcccggagacaacatgccccaaggagattcagaaggcggctgctgaagccgccttggcttttcaggctgagataaataatacgacgacggatcatggcctggacatggaggagacgatcgtggaggctattttcacggaggaaaacaacgatgtgttttatatggacgaggagtccatgttagagatgccggccttgttggctagtatggcggaaggaatgcttttgccgccgccgtccgtacatttcggacataactatgactttgacggagatgctgacgtgtccctttggagttattagtgcaaatttttttttcaattttttcgtataatattcttttggattttcggattctgcctttttatgggaatctttttttttttggtaatgtggaagctgagtgtgaatgtttaaacaattgtgttatcaaatgctagtatttttttgtgcagcctcgtgccgaatcctgcagccc

SEQ ID NO: 9510 - DNA, 879 bp, Brassica napus
  Predicted polypeptide sequence is orthologous to G2107
cccctcgaggtttgttcgcctctagttccagaggccagtataaaaaacaccaactctcactcccaacttttttatcgaactacaaactttagaatccacctgaaagataaaataaacatttatcaaaccatcagaactgagatctttctagtctcttactatacttaaccttatccagttaacaatgacctcattttctgccttctctgaaatgatgggctccgagaacgagtctcctgcattaagcggggagtattgtccgacgctggccgcgagctgtccgaagaaacctgcgggtcggaagaagtttcgggagacgcgtcacccaatttacagaggagttcgtcagagacactcaggtaagtgggtgtgcgaggtgagagagccaaacaagaaatccaggatttggctcggkactttcctaaccgccgagatcgcagctcgtgctcacgacgtcgccgccatagccctccgtggcaaatccgcctgcctcaatttcgccgactcggcttggcggctccgtatcccggagacaacatgccccaaggatatccagaaggcggctgctgaagccgcggtggcttttcaggctgagataaatgatacgacgacggatcatggcctggacgtggaggagacgatcgtggaggctatttttacggaggaaaacaacgatgggttttatatggacgaggaggagtccatgttcgggatgccgtccttgttggctagcatggcggaagggatgcttttgccgccaccgtcggtacgattcgaacataamtatgactttgacggagatgccgamgtgtccctttggagttattaatacagagattttttatttccagtttttgtataatactttttttttggatt

SEQ ID NO: 9511 - DNA, 898 bp, Brassica napus
  Predicted polypeptide sequence is orthologous to G2107
aataaatatcttatcaaaccagtcagaacagagatcttgttacttactatactacactcagccttatccagttttcaaaaaaagtattcaacgatgaactcagtctctactttttctgaactgctccgctccgagaacgagtctccggttaatacggaaggtggtgattacattttggcggcgagctgtcccaagaaacctgctggtaggaagaagtttcaggagacacgccaccccatttacagaggagttcgtctgaggaagtcaggtaagtgggtgtgtgaagtgagggaaccaaacaagaaatctagaatttggctcggaactttcaaaacagctgagatcgcagctcgtgctcacgacgttgccgccttagctctccgtggaagaggcgcctgcctcaacttcgccgactcggcttggcggctccgtatcccggagacgacctgcgccaaggatatccagaaggctgctgctgaagccgcattggcttttgaggccgagaagagtgataccacgacgaatgatcatggcatgaacatggcttctcaggttgaggttaatgacacgacggatcatgacctggacatggaggagacgatagtggaggctgtttttagggaggaacagagagaagggttttacatggcggaggagacgacggttgtgggtgttgttccggaggaacagatgagcaaagggttttacatggacgaggagtggatgttcgggatgccgaccttgttggctgatatggcggcagggatgctcttaccgctgccgtccgtacaatggggacataatgatgacttcgaaggagatgctgacatgaacctctggaattattagtactcatatttttttaaattattttttgaacgaataatattttattgaa

SEQ ID NO: 9512 - DNA, 874 bp, Brassica napus
  Predicted polypeptide sequence is orthologous to G2107
gtaattcgattaccgctcgagtacttactatactacactcagccttatccagtttttcaaaagaagttttcaactatgaactcagtctctactttttctgaacttcttggctctgagaacgagtctccggtaggtggtgattactgtcccatgttggcggcgagctgtccgaagaagccggcgggtaggaagaagtttcgggagacacgtcaccccatttaccgaggagttcgccttagaaaatcaggtaagtgggtgtgtgaagtgagggaaccaaacaaaaaatctaggatttggctcggaactttcaaaacagctgagatcgcagctcgtgctcacgacgtcgccgccttagctctccgtggaagaggcgcctgcctcaacttcgccgactcggcttggcggctccgtatcccggagacaacctgcgccaaggatatccagaaggctgctgctgaagccgcattggcttttgaggccgagaagagtgataccacgacgaatgatcatggcatgaacatggcttctcaggccgaggttaatgacacaacggatcatggcctggacatggaggagacgatggtggaggctgtttttactgaggagcagagagacgggttttacatggcggaggagacgacggtggagggtgttgttccggaggaacagatgagcaaagggttttacatggacgaggagtggatgttcgggatgccgaccttgttggctgatatggcggcagggatgctcttaccgccgccgtccgtacaatggggacataatgatgacttcgaaggagatgttgacatgaacctctggaattattagtactcatatttttttaaattattttttgaacgaataatattttatt

SEQ ID NO: 9513 - DNA, 623 bp, Brassica napus
  Predicted polypeptide sequence is orthologous to G2141
gccaagttgagtttttatcgatgaaacttgccactgtgaacccacaaatggactttaaccgtgaaggtcttcttgccaaagatgcacttcaactacgagctggtacgtcatctgcaacaccgtttcctccaaatatgccaatggtttatcctcctctgccacatggattcatgcaacagaccctttcatgcatgggaaggaccgttagctctccattgtctcccccaataaatggtggatacaagcgacaggaagcaaatggatgggaaggtgatcttcaaaatgtgatacagattaactatggagctggtgatgtcccacctgactctcaagcagcagctacagatgcatctcttccatcttcaaacatgaaggttgagccatgagattttctttctgttagatagaatgttatattcttgtaatctttcttttaaatttactgtgtactatatgatgtattaacgagtactactagtctactactactactaataagcatttaagattaggtaaaaaaaaaaaaaaaaaaaaaaaaaaaaaaaaaaaaaaaaaggaaaaaaaaaaaaaaaaaaaaaaaaaaaggaaaaaaaaacaaataaaaaaataaaaaaaaaaaaaaa

SEQ ID NO: 9514 - DNA, 727 bp, Brassica napus
  Predicted polypeptide sequence is orthologous to G217
gagctccgtcctctgttcttcgttctgccgatttgcgcgagcattagcttcctttaagcttgagtgcgttggggagaacaaacagttgagcgaagatgaggattatgatcaagggaggtgtgtggaagaacaccgaagatgagatcctcaaagccgccgtcatgaagtacggtaagaaccaatgggctcggatctcctctcttctcgttcgtaagtccgccaaacagtgtaaagctcgttggtacgagtggctcgatccttccatcaaaaagacagaatggaccagagaagaagatgagaagcttctacatcttgctaagcttttgcctactcagtggagaactattgctcctatcgtgggacgaacgccatctcagtgccttgagaggtatgagaagcttcttgatgcagcttgcaccaaggacgagaattacgaagcggctgacgatccgcggaagctgcgtcctggcgagattgatcctaatccggagtcaaagcctgctcgtcctgatccggtggacatggacgaagacgaaaaggagatgctttccgaagcgagagcgaggttggccaacactaggggaaagaaggcgaagagaaaagctagagagaagcagctcgaggaagctaggaggcttgcttctctgcagaagaggagagagttgaaagcggctgggattgggaacagccataggaaaaggaagcgaaaggggattgattataatgc

SEQ ID NO: 9515 - DNA, 737 bp, Brassica napus
  Predicted polypeptide sequence is orthologous to G227, G242
ggacttcttattgaaagatcctctcgcctggtttcaatggcggatcgtgtgaaaggtccatggagccaagaagaagacgagcagctgaggctgatggtggagaagtacggaccgagaaactggtcggcgattagcaagtcaattccaggtcggtctggtaaatcgtgtcgattacggtggtgcaatcagctatctccggaggttgagcatcgaccgttctcaccggaggaagacgagacgattgtctctgctcgcgccaagttcggtaacaaatgggccacgatcgctcgtcttctcaacggccgcacggacaacgccgtgaagaaccactggaactcgacgctcaagcggaaatgtttagatggtaatccgacgacggaggaggatcaagatcgggcgaagaagaggagatcgatgagctctgaatctgtccctccggtggacactggattgtacatgagccctgagagtcccacccacgttgctagcgactccagcgcggttcctcctcagctttttaaaccaatgccagtttccggcggattcacggtgccgtcgccggtggaaatgacgtcatcgtcggaggaagatccggcaactacgttgagtctgtcactgtcgcttcccgtaagccaggagtcgaggaacacgggttcgagcgacaactcgttgccgtttccgaagtttgagagtcagatgaagattaatgtaaaggagagaggaaaagcgcgtagagc

SEQ ID NO: 9516 - DNA, 389 bp, Brassica napus
  Predicted polypeptide sequence is orthologous to G227, G242
gcagcgagtttatggtgatggtgcaggagatgattaaggcggaggtgaggagttacatggcggagatgcagagagaccatagtggtattggtggtggtgtatttgtgggataatggaatgtttccgattaagtcgagttggagttgggagaacggagtagacaagtgagagcttagaaactgttacaatgaatatcacaaactcttttaagaaatgtatagagaaaatcgagtgagcaatctcagtccatgaacctagagacgatgataaaatactcgaaataagcttttttttctttataagaatgttaatgatcatcgataaagtatgtgaatgattcactaaactggtgccgaaaaaaaaaaaaaaaaaaaaaaaaaaaacatgtc

SEQ ID NO: 9517 - DNA, 649 bp, Brassica napus
  Predicted polypeptide sequence is orthologous to G2291
taggatccatgcaacagactggctgctgcaggagctctattcagccccaagtgttttgtagacggctttttcaaatacttctgagtttagagcagagtgatctctgaccaaaacagtttcttatacatctggaaaaccaacctggctgagccaaggaagaagtaaggccaaaaagaaaatgaaaagacatgtgagggcatatcaaaacatcatctttgatctttcagaaccagaagttatccctcaagaatcccaccaagagtctcatgcctccactggaacaacttcttttttgtacgttgtcctttcctgaagaattatggaagattcaagagagagagagagagcaagagacgtgagtgcaggtaaaaaagaagaagatcaagttgcatacgttgaactgcattaaagtacttaaatgctcccaccggttccttttgtgttgtttttattttggatgaagaatagagagttccatcaatagttgtgttgtaagaaaagagattcgcttagaaaagtgggttgatgtgtaaattttggttaacaattctattttaacacaaatgtaaaagatgaactaaataaaatgtataataaaaaaagatagtttaacgaagcaaaaaaaaaaaaaaaaaaaaaaaaaaaaaac

SEQ ID NO: 9518 - DNA, 587 bp, Brassica napus
  Predicted polypeptide sequence is orthologous to G2425
tatagtcgagtcgtatgagccggcgaagcctcctttttattaagcgagagtgtcatagagcctcacatatattgttaaaagtctcttgaataaataaataaatagtaagagtaatcaataattcacttgttctcaagctcagtcatcaccatcatcatctgacttcacgttgggctcgaattgatcagagagaagtgatacgtgacgagatctgattagttcaccggaaataaaatggggaggacgacttggtacgacgacgagggtttgaaaaaaggagagtggacggctgaagaagacaggatgctcgtcgcttacatcaacgaatacggtcttggggactggcgtgctatgcctaagagagccggtctgcaaagatgtggaaagagttgtagattaaggtggttgaattatttgaggcctggaattaaaagaggcaagttcactcctcaggaggaaaaagatatcatcaaatttcattcccttcttggtaacaggtgatttaatttgtattaaatgcaaaccaatagacattaatcttgccaaattaaataaatcaataatcatgttatattcataaaaaaaaa

SEQ ID NO: 9519 - DNA, 720 bp, Brassica napus
  Predicted polypeptide sequence is orthologous to G2510
cccacgcgtccgcccacgcgtccgcccacgcgtccgcccacgcgtccgagaaaccttctcgacgacgaggcatccagtgtaccacggagttcgcaaacgccgatggggaaagtgggtttccgagattagagagccacggaaaaaatctaggatttggctcggatcttttccggtgccggagatggcagctaaagcctacgacgtggccgcgctttgtctgaaaggaagaaaagctcagcttaatttccctgacgaaatcgacgatctacctcgaccttcgacatgtacggccagagatatccaagtcgcggcggccaaagctgccaatgccgtcaagatcactaaagcggtagatgacgtggcagacgtcgacgacggagatgatttctgggaaggcatagagctgcccgagcttattatgaccggaggtgggtggtcgccggagcttttcgttgccggagaagatgccacgtgggtggtcgacggtgactcgtatcagtatcagttcatggcgtgtctgtgagtgtagttgtcttgtcgactgtgtcgtattcgctatacgtgtgcgctgtattgttattgtgttggatagatcgatttaatgcaactatatttttatgcattttcattttatttgtttctagttttattgttttatgtgatttataaatatataccctgttaagtttgtaaaaaaaaaaaaaaaaagggcggccgctc

SEQ ID NO: 9520 - DNA, 1222 bp, Brassica napus
  Predicted polypeptide sequence is orthologous to G2632
gaaaacttgctcagatcgttcatcttccaagcggaagcgtctccttccatcaccgtagacgccttccgtgacggtctctactcgctctttccctgaatggaaactgaagacatgcattcaaaatctgaaagtgggaatcagatcgtttcagaggctcatcatcatacatcatcaacgtccattaacagtttaaacccttggctgcgtgctgctgcttcctgcaatgcaaactcttctgtggaagaagctggagataagtcgatagcattggagaaccaaaccaatttggaatcatcaaacgggtccaagtcaccatctaaccgagatgaaaatggtaacaaggagtcacaagtcacagcctctccccaacagtcagctgcggattacagtgaaaaaagccaagaacttgtgcatcctggcagtacaccacctcctcaccctcaacttgttagccacactgttggatgggcatcctcaaatccataccaggattcatattatgctggaatgatgggagcctatcccttgacttatgttccacacggtgggatgcctcattcaagaatgcaactgcctcctgagatggcacaagaacctgtttacgtgaatgctaaacagtaccaggcgattatgaggcgaaggcaggcacgcgccaaggctgagctagagaagaagcttatcaaatccagaaagcgttatctacatgaatctcggcatcagcatgctatgaggaggcctaggggtactggaggacggtttgcaaagaaaactaacaccgaagcttcacagcaaaaagatggagaaaagagaaatgcttgtgctactcagtccccgacgtcatctcattctgatcagcatgaaggttgtagtgatgagtatagaacaaatcagtccgatgagatgcagagttcagcttataagataagggaagaagcagactgttcagggcagcagtggaacaacatttcctcaaaccatccttctcaacctcttttagctatcaagtaacctctacgctggcaaatcattcttggctctatctttgttggcttatgtgttagcagccattgaagagttatctcagttttcttctttcttgttttgtacaaacactagtgtgcttatgttagaatgcttctttgtcaacaccctttaggtttaataacaaacttgaagttttgaatccgaaactatgtgattgagaactaaaaaaaaaaaaaaa

SEQ ID NO: 9521 - DNA, 612 bp, Brassica napus
  Predicted polypeptide sequence is orthologous to G264
ctgatggtagcttttcatgtcatttaaatcttacattggcttctgctccattaccagacaagacagcttcgcagatagctaaggcaactcataaaagtcaggagattggaagagttaccgagttaaacttcaactcaatagaaacaagttcaagtgagaaaaatcgaggtcaacaagaggttgcagctggaggtaaacaagcaaatgcagcacctccggctagggtgaatgatgtattctgggaacagttcctaacagaaaggccagggtcttcagataacgaggaggcaagctctacttatagagaaaacccatgtgaagagcaagaggagaaaagaaatgggcatgtgatgtcacgtaatacaaagaatatcgagcagctgaccctgtgacgtaacgacaccggtcatatcaacgataatagtctgtggttttggtatatgtatggatggagtgagtattgaaacattggactgaaacagcgtctaaagagtaagtagccttggcgtaaacgtatgtatctctcacctttttgtttgtttcgacaacttgtaattgactctagatttaagaaatattgacttattagtttggtaacaaaaaaaaaaaaaa

SEQ ID NO: 9522 - DNA, 950 bp, Brassica napus
  Predicted polypeptide sequence is orthologous to G280
tcggcacgagctctctcctacctcactcctctctctctcttcctctccctgcaaaatcatggcgacggagaccgagcttgaacctcaacaatcaccaatggcggaggagcagcagccgagtcccttctctctccctccgtatcctcagatgatcatggaagcgatcgaagcatcgaacgacgcgaacggttgcaacaagacggcgatcgcgaagcacatcgagtcaactcaaacctctctaccaccgtctcacatgacgctcctcagctaccacctcaaccagatgaaacagtccggccagatcgcgatggtgaagaacaactacatgaaaccagatccgcaagctccgcccaagcgcggccgtggccgtcctccgaaggcgaagcctcagggagagtcaagccacgtggcggtcccggctccttccgtttcctcgccgaggcctagaggtcgtcctcctaaggcgaaaggaccttcctcggaggtggagacgaaagttgcggcaccgagtggctccgggaggccacgtggacgaccgccgaagaagcagaagacggaatccgaggcggttaaagccgatgttgaacctgcggaggctccggctggggagcggagagggcgtggaaggccaccgaaagcgaagcctgcgatggtgcctgttggttgctaaagttgacgctgtagcaaatcgaataagctttgattagaagcttaagcaacaaaatcctaaaagagagttcttttaaaaataattagtatttttctaagtcgagtttaatggttaattgtctgttattttaatttttaggggttggtggaaaaaaaaatgtcgtctgagaatgagagactgtaattcgggtttgcatgtggtggtgtgatgtataaatttcgggtatttctttaccctttttctaaagtaacgctttggtgaaaaaaaaaaaaaaaaaaaa

SEQ ID NO: 9523 - DNA, 706 bp, Brassica napus
  Predicted polypeptide sequence is orthologous to G2990
ggaaacgtgtcgaagacctacacaccaaagagacgcatggcgaaggaatgaattgtccccatctctaccgactgggaatagccgtcgggaccgcagaccgtcactccaccggaaacacgagccaccaacatcatccacgacttaaagctgtcactggaacagacaaagcactttaccaccggaatccaccgggacactaaccacaaccaccgaaaaccacctccaacgattgtattggagatataggaattcgatatcttccacacttgcgccagagctttggagagcatcaattgattgaatcaatatctcatccaaactcggccatcaaaaacgagaacagaacgtttcacacggctcgaacacttccaagggaacgatagccggcgacctccacctaagaagaaacggtgcagctccagagtccaaagccagatatccatcgaacgggagatgcgatactggaaacaaatacggacaaaaaaaaatgtagtttattatcccatggactacattcggaggaagcaaaaagaaaaaaaaactaaaaaagtataaagatacttaaaagcatgttacttacttcctttccgttacttccgttttgttatggataaaaaaattagaaaaaaatcgtttcatctttctatgttcttatgaaattttaatttgttaataataaacaattgtaaaaaaaaaaaaaaaaaaa

SEQ ID NO: 9524 - DNA, 651 bp, Brassica napus
  misc_feature (595)..(595): n is a, c, g, or t
  misc_feature (600)..(600): n is a, c, g, or t
  Predicted polypeptide sequence is orthologous to G2998, G2999
tatctctctccattaaaaccattcacaagcaaaaagctttgagcttttaatgagtttaagatcctcttcggttcctcctgcaaaaaactgggttgttcctcgtgtacttgctcttatctggttctaattttaatcaaactccaagaagaagaaaaaaaaaatggatatgagaagccatgaaatgatagagagaaaaaaagatgacaatggcaacaatggtgttggtagcattgcaaatgaagataatgtcaacggtaatcacaacaacactcgtgtctcttctcaaaccctagatcatcaccaccagtccaagtctccgtcttcttttgccatctccgccgccgctaaaaccgccgtacggtaccgggagtgtctcaagaaccacgcggcgaacgtcggcggaagtgtacacgacggatgcggcgagtttatgccgagcggcgaaaaagggacgatcgaagctctcaaatgcgctgcttgcgactgccaccgtaatttccaccggaaagaagtcgacggtgtgggaagctcggatgtgatcgctcaccaccaccgtcatcaccaccatcagtacggtggaggaggaggaggaggnagaanaccgccgccgccgaacatgatgcttaacccgctcatgcttcctccgcctcc

SEQ ID NO: 9525 - DNA, 718 bp, Brassica napus
  misc_feature (685)..(716): n is a, c, g, or t
  Predicted polypeptide sequence is orthologous to G354
acaactatcacacaaacacataaactcaaaaatcttattctatttgtttcgttttatcatcagaaaaacataaacatggttgctatttcagagatcaagtcgacggtggagactacggcggcgaactgtctgatgctcttatcaagggtcggacaagaaaacgttgacggtggaagcgcaaaacgcgttttcacatgtaagacgtgtttgaaggagtttcattcgtttcaagcgttgggaggtcaccgtgcgagccacaagaagcctaacaatgagaatctctctagtttgatgaagaagacgaaagcttcgtcttcccatccttgtccgatatgtggagtggagtttcccatgggacaagctctaggaggacacatgaggagacacaggaacgagagtggcggcgccggcgcgttggttacacgcgagttactgtcggaggcagcgttgacgacgttgaagaaatcaagcagtgggaggttggcttgtctggatctgagtttgggaatggtggagaatttgaatctcaagttggaacttggaagacctgtttgttgatttgttttttctttttcctttgtgttcttttttcctggatatattaattagtttctctcattctttgatttgtttccttaatattttagattcatacatatacatctgcagatttaggaaaaaaaannnnnnnnnnnnnnnnnnnnnnnnnnnnnnnnaa

SEQ ID NO: 9526 - DNA, 735 bp, Brassica napus
  Predicted polypeptide sequence is orthologous to G354
gaaacaactcacaacaataacaatcacaccaaacacatacacaaacctttaatcgtttcgttttatcatctgaaaaaaaaaaaaaaaatggttgcaatctctgagattaacccgacggtggaggctacggcagcgaactgtctgatgcttttatcaagagtcggacaaaaaggtgcggatcagaaacgcgttttcacatgtaaaacgtgtttgaaagagtttcattcgtttcaagcgttgggaggtcaccgtgcgagccacaagaaacctaacaatgagagtctctctggattggtgaagaaagccaaagctccttcgtcgcatccttgtccgatatgcggagtggagtttccgatgggacaagctctaggaggtcacatgaggagacacaggaacgaaagtggcggcggcgcagcgttggttacacgggcgttattgccggagccgacgatgacgacgttgaagaagtcgagcagtgggaagagggtggcgtgtttggatctgagtctggggatggtggagaatttgaatctcaagttggagcttggaagaacagtttgttaattttttttttttaatggatataataattagtttccttcattctcttgaatttttccttaatagtttagatttgtatatctgcagatttaggaaactttcatagggtgtaatcttttctttcctagtgaatatatttacttagcattggagatcaaaaaaaaaaaaaaaaaa

SEQ ID NO: 9527 - DNA, 1177 bp, Brassica napus
  Predicted polypeptide sequence is orthologous to G4
atccctccgccgaagtcccgccgcgtcaccagcgagttcatctggccggatctgaaaaatctgaagaagaagtcgaggaagcgatcccatttcttcgatctggacaacgagttcgaggctgatttcaaagggtttaaggatgatgattcgtcttttgagtgtgaagatggattcgatgtgaagccctttgccttcaccgcagctaccaaacccgtagcttcccttcccaccaacgtcgccacgactggttcagtttctgacaagaaagctgtggagtccgatgagaaatctggcaagaggaagagaaagaatcagtacagagggattaggctgcgcccctggggaaaatgggctgctgagatccgtgatcctaaaaaaggctcacgagaatggcttggaacgttcgaaaccgctgaggaagcagcaagagcttatgacgcagctgcgcgcaggatccgtggcgataaagctaaggtgaacttccctgaggaggtgatcagtagtcctaagaagccagtggctaaaccaaaccagaccccagctttggttcagcagccaacgcatgtgagtcagtactgcaacaactcctttgacaacatgggacatgactccttgagtttcatggaagagaagcctcgggtttacaacaatcagttcttcgatgttggacagtatttcggttccgaccaggggagtaactcatttgactgctctgagtttgggtggagtgatcacgcccccaagacaccaccagagaattcttcaatggtagttaacaacaaccaagctacctttgctgaagaaaccattgcagccaagaaggtcaaactcagctctgaggacgagacaagcgacaatgatgatctgatggcgtatcttgacaacgccctgtgggagtctccgttagaagtggaagctatgctcggcgtagatgctgctgctgctgctggtgtggctcaggaagaggcaaacccaatggagctgtggagcttagatgatatcaactttatgctggatggagacttctgaagtgagtgatgggttgcctagtttgtaaatatactcagagccatttgtgtataagattgtgaagacaaacagccgtaacttttacttaatcttcagtttggtttttgtgtttgttgtcttgttttgtatccctaagacttgtttaaca

SEQ ID NO: 9528 - DNA, 366 bp, Brassica napus
  Predicted polypeptide sequence is orthologous to G4
gaagctgatccagctaagcagctcaaggtcatggattttgagacaacttacaacggcactgaatgggattcttcacttgatttcttcagtggagacgctgtggcgactcaggacaatggtgcaaatcctatggagctatggagcattgatgagatcaattccatgattggaggagtcttctaaagagatccattgtcatttaaagagttttaaaaacattttgaactctttcttgttgtcttttgtgttttggttttgttactttgtgcccctaaacatcttctttaacattgtcataagttaatatgttgaaccattgttctcttttgtaaaaaaaaaaaaaaaaaaaaaaaaaaaaaacatgtc

SEQ ID NO: 9529 - DNA, 500 bp, Brassica napus
  Predicted polypeptide sequence is orthologous to G489, G714
gaggatctgagggatgaggtcttggggagtattccgagagggactgtccctgaggctgctgctgctggatatccgtatggttacttgcctgctggaactgctccgatagggaacccggggatggttatgggtaaccctggtggtgcgtaccctcctaacccttatatgggtcaaccaatgtggcagcaacagggacctgatcagcctgaccaggagaattagctttgtcagagaaactagttctggaattaagaaaggaggagacttttagtgaagaaaatgaaaaagaacatatcagaagaatttcaaatcagtgtggtagaagaatcttaaagtgttttgttttatgtctattcaatcctttcttttaaggataaatttagatatgaaccagaagaatgtataaaactataactctgtaagggaacaagtgtgtggttgacaaggtttttaatttctatgttattgtttcttattatctttaaaaaaaaaaaaaaaaa

SEQ ID NO: 9530 - DNA, 849 bp, Brassica napus
  Predicted polypeptide sequence is orthologous to G519
acaaaatgaaggcggagctaaatttaccggcgggattccgatttcacccgacggacgaggagctagtgaagttctatctctgccggagatgcgcgtcggagccgatcaccgttccggtgatcgcggagattgatctgtacaagttcaatccatgggagcttccagacatggctttgtacggagagaaagagtggtacttcttctcacaccgagaccggaaatacccaaacggttcgcgtccaaaccgggcagcgggaaccggttattggaaagcgactggagctgataaaccgatcggtaaaccgaagacgttggggattaagaaagcgctcgtcttctacgcagggaaagctccgagaggagtgaagacgaattggattatgcacgagtatcgtctcgctaatgtcgaccggtctgcttcttcgaacaagatgaacaacttaagacttgatgattgggtgttatgtcggatttacaataagaaaggaacggtggagaagtattatccggcggatgagaaagagagggtgatgatggtgattactaatactactacgacgtcggattcgaaatgctcgagtcacgtgatttcaccggacgtcacgtgttcctccgaggttcagagcgagtcgaaatgggttgatcttgaggacgcgtttgatgcgtccatgtttggttccttgttgcaaaatgacgcttttgtccctcagtttccgtatcagtctgatttcgccgctatgttcgaggacccgctggagcagaaacccttcttcaattggagttttggttctcaggggtaaagttgtaaagagcatagagtttgaaagctttctcagagtacccggcaaa

SEQ ID NO: 9531 - DNA, 1051 bp, Brassica napus
  Predicted polypeptide sequence is orthologous to G519
gaaacaataagaagaagaagaaaaagtgggatatggtgaaagcaggggctgatttgcaatttccaccgggatttagatttcatccgacggacgaggagctcgtcctcatgtatctctgccgtaaatgcgcgtcgcagccgatcgctgctcctatcatcactgaactcgatttgtatagatatgatgcttgggaccttcccgacatggctttgtacggagaaaaggagtggtattttttctcaccgagagaccggaagtacccaaatggttcaagaccaaaccgggcagctggtactggctattggaaagctacaggtgctgataaaccaatcggtcgtcctaaaccggtcggtataaagaaggctctagtgttttattccggaaaacctccgagaggagagaaaaccaattggattatgcatgaataccggctcgcagacgttgaccggtcggttcggaagggaaacagtttaaggctggacgattgggtgttgtgtcgtatatacaacaagaaaggtgtcatagagaagcgacggagtgaggtagcgaacggtcatgtgatggctccggttatgttaaacttcgacaaaccggaattgatcggcggcgggtcgagctgctcggaccaacgagtagtgtctccggagttcaggtgcgaggctaagaccgaaccgagtagatggagcaacgccctcgaagttccgtttaattacgtagatgccatcgcagataacgagattgtgtcgcggctattgggcgggaaccagatgtggtcgacgcttgatccacttgttgttcggcagagaactttctaagctgtcacgtgcgagttggtggaaactaccaaccacgggcatcccacgtgccggtaaaccggtttgaatccactatgctgaaccggaagggaacggattgggttttttttggcaataattaagccttcgttttgctccttgattaatacgagatacacagcctactctatgtatgacccagcatagcaatataatggttctctacataaattttggaataaattcattttaaaatc

SEQ ID NO: 9532 - DNA, 1211 bp, Brassica napus
  Predicted polypeptide sequence is orthologous to G519
atttcattaggattatattactagagacagatcctcgaatagaaaagaaaatgtcagaactacagctgcctccaggattccgatttcacccaaccgacgaagagctggtgatgcactatctctgccgcaaatgcgcctctcagtccatcgccgtccccatcatcgctgagatcgatctctacaaatatgatccttgggagcttcccggtttagccttgtacggtgagaaggaatggtatttcttctctccaagagacagaaaatatccgaatggttctcggccgaaccggtcagctggttcgggttactggaaagctactggagctgataaaccgatcggacttcctaaaccggttgggattaagaaggctctggttttctacgccgggaaagctccaaagggtgagaaaaccaattggatcatgcatgagtaccgtcttgccgacgttgaccgatcatcggctgctcgcaagaagaagaatagtctcaggctggatgattgggttctttgtcggatttacaacaaaaaaggagccatcgagaagcgaggaccaccaccaactccggttgtttacggcgacgaggtcgtggaggagaagccgaggctgtcggagatgggcatgcctcctccgccggtgatgccgaatgatttcgtgtactttgacacgtcggactcggtgccaaagctgcatacgacggagtcgagctgctcggagcaggtggtgtcgccggagttcacgagcgaggttcagagcgagcccaagtggaaggattggtcgggtgagaaaagtagccttgattttgggtttaattacatagatgccaccgcgttcgggggaggaggagggagcaatcagctgtttccgctacaggacatgttcatgtacaacatgcccaagccttattaggtgaaggcaaacgctcgtctatgggtatcacgagatcggttacggttacggtcggtcaatgagtgtgccgccattagatatttattaccatgatgtttgttgttcagtgttacttttattttctaagcggtcagattacgggaaatctctaatcggatggcggtcgatgtgtcattgtactagtgttgtttggtagaagaatccacatgtcttttcttttttgggctttagtggggcataaaagtcaaaagctaaggatatttgttattatctccttcgtaataatcaattaaatatttcttg

SEQ ID NO: 9533 - DNA, 1229 bp, Brassica napus
  Predicted polypeptide sequence is orthologous to G519
atttcattaggattattactgcagacagatcctcgaaatagaaaaaaatgtcagaattacagctgcctccaggattccgattccacccaaccgacgaagagctggtgatgcactatctctgccgcaaatgcgcctctcagtccatcgccgtccccatcatcgctgagatcgatctctacaaatataatccttgggagcttcccggtttagccttgtacggtgagaaggaatggtatttcttctctccaagagaccgaaaatatccgaacggttctcggccgaaccggtcagctgggtcaggttactggaaagcaactggagctgataaaccgatcggacttcctaaaccggttgggattaagaaggctctggttttctacgccgggaaagctcccaagggtgagaaaaccaattggatcatgcatgagtaccgtcttgccgacgttgaccgatcggctgctcgcaagaagaagaatagtctcaggttggatgattgggttctttgtcggatttacaacaaaaaaggagctatcgagaagcgaggaccaccaccaactccggttgtttacggcgacgaggtcgtggaggagaagccgaggctgtcggagatgggcatgcctccgccgccggtgatgccgaatgatttcgtgtactttgacacgtcggactccgtgccaaagctgcatacgacggagtcgagctgctcggagcaggtggtgtcgccggagttcacgagcgaggttcagagcgagcccaagtggaaggattggtcgggtgctgctaatgataagaatagccttgattttgggtttaattacatagatgccaccgcgttcggaggtgtagggagcaatcagctgtttccgctacaggacatgttcatgtacaacatgcccaagccttactaggtgaaggcaaacgcttgtgtttttcgtctatgggtatcacgagatcggttacgatcggtcaatgagtgtgccgattcggcggagcctccattagatattttattatcatgatgttgttcagtgttacttttattttctaagctgtcagattacgggaaatctctaatcggacggcggccgatgtgtcattgtactagtgttgtttggtagaagaatccacatgtcttgttctttttgggctttagtgggggcataaaagtcaaaagctaaggatattttttattatctccgtcgtaataatcaattaaatatttcttgatc

SEQ ID NO: 9534 - DNA, 1060 bp, Brassica napus
  Predicted polypeptide sequence is orthologous to G519
cgaagaaaagagaagacttttgaaaaaaaaaatgaaagcagggctaaacttaccagcaggattccgattccacccaacggacgaagagcttgtgcaattctacctttgccggaaatgcgcatcggaggagatctcagctccggtcatcgccgaaatcgatctctacaagttcaacccctgggagcttcctgagatgtctctgtacggagagaaagagtggtacttcttctcgccacgagaccggaaatacccaaacggttcgcgtcctaaccgggcggcgggaaccggttattggaaagccaccggagctgataaaccgatcggtaaaccgaagacgctgggtattaagaaagcgctcgtgttctacgcagggaaagctcccaaagggattaagacgaattggattatgcacgagtatcgcctcgctaatgtggacagatcagcttctgttaacaaaaagaacaaccttcgacttgatgattgggtgttatgtcgaatctacaacaagaaagggaccatggagaagtactaccctgctgatgagaaaccgatgaccgtgacggcggcttcatcgcctttcgatgcgtcggactcgacttacccgacgttgcaagaggatgactcgagcagctcggggggtcgcgtggtgtcgccggatgcgcgggaggtgcagagcgagcctaaatggggggagtttgagaatgcttttgatgcttccatgttcggtggtggctccatggacttgctgcagagtgaagattttgtgcctcagttcttgtaccagccttcttatgatttcaactcctggcaggaggatccgccggagcagaaaccgttcttgaattggagttttgctccacaggggtgaaaaaggaagagagtgaaaggttttttggtctgtgttgtgatatgtgttagagagaagttctcaatcatcttttgtttcttagtagtgagagaaagattgtagagtgttgatagtttcttagcatcttcaatgtttcattggcaggtgaattcttgttatttcatcagaaatttatatgaaaaattatacctt

SEQ ID NO: 9535 - DNA, 1066 bp, Brassica napus
  Predicted polypeptide sequence is orthologous to G519
ccagatactcgaagaacgcaacgagagaaaaaaaaaagaaagaaacttttggagaatgaaagcagagctgaacttaccagcaggattccgattccaccccacagacgaagagctagtgagattctacctgatccgtaaatgcgcgtcggagcagatctcagctccggtcatcgccgaaatcgatctctacaagttcaatccttgggagcttccagagatgtctctgtacggagataaagagtggtactttttctcaccacgagaccggaaatacccaaacggttcgcgtcctaaccgggccgcaggaaccggttattggaaagccaccggagctgataaaccgatcggtaaaccgaagacgttggggataaagaaagcactcgtcttctacgctgggaaagctcctaaagggattaaaacgaattggattatgcatgagtatcgcctcgctaatgttgatagatcggcttctgttagcaaaaagaacaacctacgacttgatgattgggtgttatgtcgaatctacaataagaaaggaaccatggagaagtactaccctgctgatgagaaaccgaggatcatgacggatcagtcatcatctccttttgatacatcggtttcgacattgcaagaggaggattcgagcagctcggggggtcacagtcatgtggtatcacctgatgctaaggaagttcagagcgagcctaaatggagagagcttgaggatgctttggaggcttttgattcttccatgtttggtggtggctccatggatatgttgcagagcgatgcttatatacctcagttcatgcatcagcctaccgattgtttcacaaccttacaggatccgtttgagcagaaaccgtttttgaactggagttttgctccacaggggtgaaaaggaagagatgttggtgttgtgatgtggtagagagaagttctcaatcatttgtttcttagtagtaaaaaaagattgtatagtgttgatagttcttagcatcaatgtctcattgataggcaaattcttgtaatttccttatatgaaaatatacacattcttcaggat

SEQ ID NO: 9536 - DNA, 1173 bp, Brassica napus
  Predicted polypeptide sequence is orthologous to G519
caaaatgaaggcggagctaaatttaccggcgggattccgatttcacccgacggacgaggagctagtgaagttctatctctgccggagatgcgcgtcggagccgatcaccgttccggtgatcgcggagattgatctgtacaagttcaatccatgggagcttccagacaaggcgttgtacggagagaaagaatggtacttcttctcacaccgagaccggaaatacccaaacggttcgcgtccaaaccgggcagctggaaccggttattggaaagcgactggagctgataaaccgatcggtaaaccgaagacgttggggattaagaaagcgctcgtcttctacgcagggaaagctccgagaggagtgaagacgaattggattatgcacgagtatcgtctcgctaatgttgaccggtccgcttcttcgaacaagaagaacaacttaagacttgatgattgggtgttatgtcggatttacaataagaaaggaacggtggagaagtattatccggcggatgagaaagagagggtgatgatgatgactactaatactactacgacgtcggattcgaaatgctcgagtcacgtgatttcaccggacgtcacgtgttcttccgaggttcagagcgagtcgaaatgggttgttgatcttgacgacgcgtttgatgcgtccatgtttggttccttgttgcaaaatgacgcttttgtccctcagtttccgtatcagtctgatttcgccagtatgttcgaggacccgctggagcagaaaccgttcttcaattggagttttggttctcaggggtaaagttgtaaaggggatagagtttgaagctttctcagagtatccggccactgaaccggaggggggaactcggtgtcggatcctgacccgggaaccaagctgggctaaacaagttactgagactttcaacatctgatgaagggacaaatggtgtgtccattggtctctatcagactcatcagcaaggttgacttatgttttttttgttttgtttataaagtgatatttaaagaaacagaactgtaaaagaaacagtgactatttcaaatcacatatgtattcatatatatgttgtatataacaatttttttttctagtagttgtttaatatctttgtaatcacatttttaattaatgaaaatttatttgccttt

SEQ ID NO: 9537 - DNA, 1114 bp, Brassica napus
  Predicted polypeptide sequence is orthologous to G519
aaaaaaattgaacgaagagatttgaagagagaaaagagaagagaatgatgaaagcagagctaaacttacctgcaggattccgattccatccaacggacgaagagcttgtgaaattctacttgtgccggaaatgcgcatcggaggagatctcagctccggttatcgccgaaatcgatctctacaagttcaatccttgggagcttccagagatgtctctgtacggagagaaagagtggtattttttctcacatagagaccggaagtacccaaacggttcgcgtccaaaccgggcagctggaaccggttattggaaagcgaccggagcggataaaccaatcggtaaaccgaagacgttgggtattaagaaagctctagtcttctacgctgggaaagctcccaaagggattaaaacgaattggataatgcacgagtatcgtctcgctaatgtcgatagatcagcttctcttaacaaaaagaacaacctacgacttgatgattgggttctatgtcgaatctacaacaagaaaggaaccatggagaagtactaccctgcagatgagaaaccgaggaccacgacatcaatggcggatcaatcatcatcgccttttgacacatcggactccacttaccagaatgattcgagcagctcggggggccacgtcgtgtcaccggatgccaaggaggttcagagcgagcctaaatggggagagcttgaagatgctttagaggcttttgatacttcaatgtttggtggttccatggacttgttgcagagcgacggttttgttcctcagtacttgtaccagcctgattatttcactcccttccaggatccgcacgagcagaaaccgttcttgaattggagttttgctccacaggggtaaaaagggaagaagagagtaaattgtggtttaactgtgtggtgaagtgcttagagagaagttctcaatcatctttgtttcttagtagtaaaaaagatcgtagatgttaatagttgttagcatcataggcaaattcttgttatttcatcataattttatatgaaaaatattcaaatttttcacgatgttgcacctatgtagatactgatatataaagagatattaagattcag

SEQ ID NO: 9538 - DNA, 1079 bp, Brassica napus
  Predicted polypeptide sequence is orthologous to G519
aaagaacctttccacataaataatgaaggctgagctaaatttaccggaggggttccgatttcacccgacggacgaagagctcgttaagttctatctttgccggagatgcgcatcggagccgataagcgtcccggtaatcgcagagattgatctgtacaagttcaatccatgggagcttccagaaatggctttgtacggagagaaagaatggtacttcttctcacctcgagaccggaaatacccaaacggttcgcgtccaaaccggtcagctggaaccggttattggaaagcgactggagctgataaaccgatcggtaaaccgaagacgttggggattaagaaagcactcgtcttctacgccgggaaagctccgagaggggtgaagacgaattggattatgcatgagtatcgtctcgctaacggtgatcgatctgcttctttcaacaagaagaacagcttgagacttgacgattggggtttatgtcggatttaccataagaaaggaacaatggagaagtgttatccggcggtggtgactactacgagtacgtccgactctaaatgctcgagtcacgtgatttcaccagacgtcgtcacgtgttccgacaactgcgagtcgaaatgggttgatgatctcaaggacgagttcatgtttggttccacgttgcaaaatgactcttttgtccctcagtttctgtatcagtcggaattcgccacaccgtacgaagatccgcaggagcaaaagccgttcttgaattggagttttggtcatcaggggtgaagttacaaagagcataaaggttgaagctttctcagagtatccagccaccgcacacgaggggactcggtgtcggattctgacccgtaaaccaagttgggccatacagttacagaattggtgtccactggttgttctgactcttcagctagattcgatttttcttttgttataaatgtctaaaaagatatcgaagtagaaacagaggaactgtacaagcaacagtgaccattataaatcatatatatatatatatatatatatatatattcatcataatcaatgagcatgagcttatttc

SEQ ID NO: 9539 - DNA, 1749 bp, Brassica napus
  Predicted polypeptide sequence is orthologous to G562
tctctccctctctctcgtcttcctccttcaaaaaaaactgaactctttttttctctctgttttttctagagagagagagagagattggaatgcgttaaaatttctctttagttttcaagttttctcgatttggatctctgagctagcttacagatttttggagaaagagacaattgttgttaagtgtggaaacgttaagaccatgggaaaaagcgaggaaccaaaggttaccaaatcagacaacaaaccatcttcaccacctgcggtattttttttttttttttttttttattaatttcagaccataactctcaagtcaatagtgttcttgtaatagagtcaaaaccagtgttatcttgatgtgttgacaggatcaaacaaatgttcatgtctaccctgattgggccgctatgcaggcttattatgggccaagagtagcaatacctccttattacaactcagctatggctgctgcatctggtcatcctcctcctccttacatgtggaatcctcagcatatgatgtcaccatatggaacaccgtatgcagcggtttaccctcatggaggaggagtctacgctcatcctggattccccatgcctcaaagtcaaaagggtgctgctttatcaactccggggacgccattgaacatagacactcctagtaaatcaacaggaaacacagagaatgggctgatgaagaagctgaaagagtttgatggacttgctatgtctctaggaaatggtaataatggtgatgaaggtaaacgctcacggaacagctcagaaacggatggttctagtgatggaagtgacgggaataccactggggctgatgaaccgaaacttaagagaaggcgagaaggaactccaaccaaagatgaggagaaacatttggttcagtcaagctcatttcggtctgtttctcagtcaagtggtgataacgttgtaaagcatagtgttcaaggaggaggtggagctatagtctctgctgctggtgtaagtgcaaattcaaacccaaccttcatgtcacaatctttagccatggttcctcctgaaacttggcttcagaacgagagagagctgaaacgggagagaaggaaacagtctaatagagaatctgcaagaaggtcaagattaaggaaacaggctgagactgaagaactggctaggaaagttgaagccttgacagcagaaaacatggcgttaagatctgagctaaaccaacttaatgagaaatctaataatctaagaggagctaatgcaaccttactggacaagctgaaaagttcagaacctgaaaagagagttaagagctcaggaaatggagacgacaagaacaagaagcaaggagacaatgagactaactctaccagcaaactgcatcaactgcttgataccaagcctcgagctgacggtgtagctgctcgctaatcataacactcttgtgtgtcgacttctacttaatttgtcgacagaaacaaagaaaaacaagtgtatgctaattccagaaaacttgttagatagtatagaagagatggagatggagatggagatgatttgatcttatatatatagattttccagagaggggtgattgttaatatggagaggctctatttttatatatggcttcctttgttgcattcagtattgacctcatgagtgtagtgtatgtatgagagacatctctcagatcggtgtttgttgctttgcttggataagaaaatcaataacaaacattttctac

SEQ ID NO: 9540 - DNA, 1292 bp, Brassica napus
  Predicted polypeptide sequence is orthologous to G562
agagagacaagttactgtgtcagtgtctgaatcgagcaatgggaagcaacgaagaaggaaagaccacacagtctgacaagccagcacaagtacaagctcctcctcctcctcctgagcaaagcaatgttcatgtgtatcatcatgattgggctgctatgcaggcgtactatggaccaagagtagccataactcctcaatattacaactcaaatggtcatgcagctccacctcctccttatatctggggctctccttcgccaatgatggctccttatggaacaccatatccaccgttttgtcctcctggtggagtctatgctcatcctgctcttcaaatgggctcacaaccacaagggcctgcttctcaagcaacacctgttgttgcaactccgttgaacttggaagctcatccagctaactcatctggaaacacggatcaggggttcatgacaaagttgaaagaatttgatggacttgcaatgtctataagcaataacaaatctgggagcggtgaacatagcagtgaacctaagaattctcagagttctgagaatgatgattccagcaatggcagtgatgggaatacaactgggggagaacagtctaggaagaaaagaagccgggaaggatcaccaaacaacgatgggaagccttcatctcaaattgttcctcttctaagagatgaaagtgagaaacatgcagtgactatggggactcctgttatgcccacagctatggacttcccacagccattccctggtgcgcctcatgaagtctggaatgaaaaagaggttaaacgagagaagagaaaacagtcaaacagagaatctgctagaaggtcaagactgaggaagcaggctgaaactgaagaactgtccgtcaaggttgatgcactagttgctgagaacatgactctgaggtcaaaactaggccaactaaacgatgagtctgagaaactacggctggagaaccaagctttattggatcaactgaaagcgcaagcaactgggaaaacagagaacctaatatctggagttgataagaacaactctgtatcaggtacagtagtagtaagaatgcggaacagcaactcttaaacgtaagtctaagaaccgattctgtcgcggctagctgactgtgacgcaaaaggaagaacccacttcatgtcttctaatggattctgattgtaacttcttaaaaagatttttttttccttagatttatagctctctgcatggtgaacagaaactgatgtatatccttaagcagaagagactcagagcgtgatctga

SEQ ID NO: 9541 - DNA, 672 bp, Brassica napus
  misc_feature (591)..(592): n is a, c, g, or t
  Predicted polypeptide sequence is orthologous to G635
atgaaaccaaaaacgtggataagtcacctgatgcagagactaaaacagaggatagcgaaagcagcagagaagaggaggatgatgataatacatctgattctcaaaccaagtcgtcaacgaaacgtgtgaggaggaacaaatggaagcctgaggaagttaagaaggtgatcaggatgcgtggagagttgcacagcaggttccaagtggtgaaaggtagaatggctttgtgggaagagatctcttcaaatctatctgctgaaggaatcaatcgaagcccgggacagtgcaagtctctgtgggcgtctcttattcagaaatacgaggagtgcaaggcggatgaaagaagcaagacgagctggtcacattatgaggacatgaacagcattttgtctgagttagacacacctgcgcctaagtaatgtgcttacattacatgtatcttgcgaaaagagtcatctccaaaatattaaatcgaacagagacattcattatgttatgtaacatgtaagatgtttttttttttgtctgtagaagccattaaaacatgaatgccgagaaagaaaaaagccttgagtcaaatgtttagactcnnaaaaaaaaaaaaaaaaggggaaaaaaaaaaaaaaggggggggccccccttaagggaaccaattttaattacggggggggg

SEQ ID NO: 9542 - DNA, 768 bp, Brassica napus
  misc_feature (9)..(9): n is a, c, g, or t
  misc_feature (17)..(17): n is a, c, g, or t
  Predicted polypeptide sequence is orthologous to G666
taattgaanttaccgangggaaattaaataaaattattaatattagctcaggttatctaagctagttaattcggaaagccaaaaataaacaaattataaaaagaaaaagagatgatgatcctaaaattagaaccatctgattaggcaaattcttcagaagaaattagggttttcatccaacacaatatcaccaatcggtccaccagaatcctcaaacagccacttttcaaacaaagaccattgactttggttactgcatccagttatgtctggtttggtctcatgatccggtgatactccagcctgatgatatgatgagtcacaatctttcaagtgatcaaaccccgaaaatgactggaattcccctgcacagtcctcgacatcactcttgagcacatcttttgtctcagaatctggagaaaccattaaatccgcagagttcgaaatcttcggagagttcttcacccaccctttgagcaattttgctatattctcggtgctcgaggcataagcggtagatgtttcttgcgtcctaagaaacctgcaagctgaggaagtagaacgtcttgattcagcagaagaagatgttgtggccgtggtggcaaatgtagaggtaatgattggcgccacagcaggagacaaagcctcagagagagccttcttcgccaagtgaatatcagtttgaagccttctttcccattggcctcttgagatgtttgagttggagttagcagaagaagatgatggagaagaagagaggtctcttga

SEQ ID NO: 9543 - DNA, 810 bp, Chlamydomonas reinhardtii
  misc_feature (643)..(643): n is a, c, g, or t
  Predicted polypeptide sequence is orthologous to G1033
ttttttgggaagcgcatagcgttacaggccgtcccaagcgtcctggacttgggctttagcaattatgtacacggttggtgtccggcacgcgcacgcagcaatggctgcgttggtactattccgcactcagtcaacagtcaatatgattgtccgtgtaggagtccacacccgagcaaaaaacggtcaggagcatcacaaacaccgttctgtaacacaagtcacgtccacacagcagtatggtgcagtgtggagtacatgcgcagtgacagcggctgtcacgcagcgtccaaagcagtcgtagcgttagaagcgaagaattcagttagcggtacatacgggtacaagtagagcccacaaaatgccacctacggatagctagcctccgtacagactagcgacccttgccatgcccacgcaagattccgctgcttgtggtcgcagtttactcatcgtcatcaccatcatcgtcctcgtcgtcgtcatcaccatcgtcatcggcctcaggctcgtcctcctcctcctcctccttagccttcttcttgggcgcagccttctccttcttggccgcgggcttcttggaggcacccgacgagccgccgtaagactccatctccttctggtagcgctccttgtccttagccgncttctcatcgaactccttcttgtcgtcagcggacaggccctaccacttctcgccgatcaccttgccgaccttcgccgaggcaatgccagggtttttcggacttcacgctctcacggatggcggtcgaagagtacatgaaggaagttgagggcttctttggggcgttg

SEQ ID NO: 9544 - DNA, 373 bp, Chlamydomonas reinhardtii
  Predicted polypeptide sequence is orthologous to G1078
gcacgagggttttatgacaccaagggcaagggcaagggtaccttgcattgagacgagttgtgaagacagatcagatgaggcgcctgcgtgcgtgtagtatcatatgcctggttgcgaactgaggatgtgctagattgtacttagtgctaggctaaagggtggatcgggctttcgttgatggttcggggatgttgagtgccacgaaacggacgcagactggataacatcgactaacacttttgagcccttggcacatcacatgagagcttaggacggcccgggaggtgcggcggatacggctggtgcctgcttggctggtgcctgctcttgcggcgttgcgggtggggagtggatgtgaaaccgcgtgtgtcct

SEQ ID NO: 9545 - DNA, 773 bp, Chlamydomonas reinhardtii
  misc_feature (773)..(773): n is a, c, g, or t
  Predicted polypeptide sequence is orthologous to G1335
ccggcgttccagcagcatgcattgaaatcctgtcgggctttccgcccaagcaaattcaggtacccagcgagggagctgtgtcggcgctgggacttgcaaacggcgacacgctaacagtgcgccaaggcgcggcgccggcgcttcccccggccgccgcgctgccgccagtggccccccagtcagagccatcctcctcgggcgcgggcgcagccacgcactcagcagcagcgggggcaggggcgggggcgctcgggggctttgcggacatggaggatgaggacgagatgctggcacgtgccattgcagcctccctggagtcccagcagtcgggggcgggggcgggggcgtcaggcgcgggggtgtcaggagcggggccagctgccacgccacggccagcaggggcggcgccaggagcggcactggctgcgccctcgagcggagcgccgcggtccgtgaccaacgcgccggctggaggccccgcccccagctccgtgcctgtgccgggcggagacgggtcgagtgtggtgcggttgcttggaggacaagtgacaacagatgtttggttaacgcggtggggcactctatgatggatagtatcatctgcttgtagcatatgatgctgtatgtagttgaaaataagcttccagagccgtctattttaagagtacattgcgagcttgcccatcctcgctcactttatgtaagtaatttttcaaagcgggtggcgccgtaattattcttttttctcaatgtaacgtacccaaggagctcgn

SEQ ID NO: 9546 - DNA, 443 bp, Chlamydomonas reinhardtii
  Predicted polypeptide sequence is orthologous to G1335
catctacctgggcatcgcgtgccctgcgtgctgccacaaagctggccccccagaccgccgactgagcgaggagggtcgcgggaatgggcgagcagctgaggcaacagggaaccgtaaagtggttcaacgccaccaaaggcttcggcttcatcacgcctggtggtggcggcgaggacctctttgtgcaccagaccaacatcaactcggagggcttccgcagcctgcgggagggtgaagtcgtcgagttcgaggttgaggctgggccggatggacgctctaaggctgtgaacgtgacgggccccggaggggccgcgcccgagggcgctccgcggaacttccgcggtggcggccgcggccgcggccgcgctcgcggcgcccgcggcggctatgctgctgcgtacggctacccgcagatggcgccggtctaccccggctactacttc

SEQ ID NO: 9547 - DNA, 774 bp, Chlamydomonas reinhardtii
  misc_feature (674)..(674): n is a, c, g, or t
  Predicted polypeptide sequence is orthologous to G1364, G481, G482, G485
gcacgagggcaaactcaccttgagctgcaaagcaaccaattgcttgagttacgaagaatagctcttaggggcgctttactgacgtgtttttcgtcgaggttgtgttggacgggccttcaccgggcgcctgcttcgcggcttctccgcgatgagcggggacgagggcgacggtcgagatggcaacagcaatgcgcgtgagcaggacaggttcctgcccatcgccaacatcagcagaattatgaagaaggcgctcccgaacaacgcgaaaatagccaaggatgcaaaggagacggtccaggagtgcgtctcggagttcattagcttcatcacgtcggaggctagtgacaagtgccagcgggagaagcggaaaacaattaacggcgacgacctgctgtgggccatgacgacgttgggctttgaggagtacctggagccgctcaaactctacttagccaagttcagagaggctgaggcggcgacatccaataagccagggggcggctcaggtgccaacgcggaggcaaagcgtgaggcggccgcggcggctgcggctgcggccgcagctgcggctgcagtttcgcagcaacaggcggcgcagcagcagatggcggcgcagctgcaagctggcatggcgttcccggggctcatgccggcgcagttccaggggctaccgnccggcatgattcccgctggcttacccggactgccgcttgcttccggcgtgccgggcctgatgatgcccagtggcgttgtgcccagcaggagctccctagt

SEQ ID NO: 9548 - DNA, 785 bp, Chlamydomonas reinhardtii
  misc_feature (785)..(785): n is a, c, g, or t
  Predicted polypeptide sequence is orthologous to G1389
gtgcatgtgcgttggcgtttgcatgctgttcgtttggttgccaccagctgttttgccgtggttaaggaggtacggagagatttaccgtcggtcggatatatagctgcaggcctttgggcgggcacgctcgcaaccgagtaccgacccaaatggcgctctctacgatgctctccgaatcgcattgacttgtattggggatgacaaaagcacgctgccgaaaagtgtgtgttgccgaggcgcgtacatgagcaactggggaggaggacgaacatggggctgttgcgctgaacgtgtgctcgcagcgcgtgttgatgtgaaagagcgtgtgtatgtgcgcaccaggcacagatgtagacatcatcggtgagcttgggtatgaggcgtgatggtcataagattgttttgtaccgcgcgtgtgcgtgacttgtttttggtgtgagccgtagctctcgtgcaggtggagtggttagcttgaatttatcgtccatatgacttgacatgctgtcggtgcacggattgcagttgatatatttctgtccaggcattttgcagcactacacctgctattgtgtcaggatcatttctttcttttgtgctatgagcgtatctctgctaacttggcaaatgtttagctctatttacggtacacctgatgagtgtattctctgggtaattttcttattctctctcttgtggtgcctttgccactcccagcatctgcgtaattttctgctacgttatattcgtgcgtaggtttttacttcctgttatatatgtcttcttan

SEQ ID NO: 9549 - DNA, 663 bp, Chlamydomonas reinhardtii
  misc_feature (640)..(640): n is a, c, g, or t
  Predicted polypeptide sequence is orthologous to G1488
gcacgaggccggtgcagggcgtggggccggtaccgcctggcatgatccctggcctggtgcccggcactttcatggctcctggcatggccttccccgaggccaagcgccctgtgccgtcggtgccgaagccgcgcaagcgcgcctcgcccaatggcaacccgccgaaggcgcctgcacccaacccgaacggccactgctgcacccagtgcggcacgcagaccacgcccgtttggcgcgcgggcccgcacggccccaagacgctctgcaacgcctgcggtgtccggtatatgaaggttgccaagtcgggcgccacgcagccggctccgaggcggcagcagcagcagcatcaccagtagcacgctgtggcgggctacatggccggcagcgatagtacggagcgtgcggcgtcctgcgggcagcggcacggcttcccaaatgcacagcggttgtcctccgcgacatgcccctgaatgggtgctggtcaaggcagagcaactgagcgcgcgttgtaggttacgggatgtgcatgtggactaaactggtgaggcctgaatggtgggttgtgccaaaggccgtgcaggagtgcttgacgcgcgctcccacgttgatggtcgtgcaccgacaatacggtggggccggngcacatgtgttgttggttgccgc

SEQ ID NO: 9550 - DNA, 415 bp, Chlamydomonas reinhardtii
  Predicted polypeptide sequence is orthologous to G1506
aaatacatacacatactcgcacggaaccggcagtgaaacctatcctgcgacagattttgagaccgcgccatatcaatcgagcttccgcttgcctgcgcttccgacttgcagtcgaccggtctgcaccacgaaatcgtgtagtgttgctgccatagcctgacacaatgcgaggctccactggcggcccctgctgccactgcggcaccgtcgcgactccctgctggcgaaaggggccctgcgacaagccggtgctctgcaatgcgtgcggcagccggtacctggtcaagggctcactcgctgggtacttccctggcgcgcgccgggcgagtgcgggcacccgtagcgaggcgcctcacattcaggcgaccgtcgtttccgcggacggcaagtctgctgcgcggaaatccgccgcgct

SEQ ID NO: 9551 - DNA, 776 bp, Chlamydomonas reinhardtii
  Predicted polypeptide sequence is orthologous to G1521
ttttttgagtcgggtccaacttcaaagccataggacggccagggttgtgactgcggtacgcacgcctgctacgagcagggcgtgcaaaagacggcaatattgtaacgactggatgagcgctatactgccctcgaaaccgccaccctacggccttagcctcgttctttcatttgacgtgcacgtcatgagcaatcgctaacgctagtcacagcccgcagtcctgatcacctccaccaattaactgggcagatcagcgcaagccagctttggtgctgaagggcgaccataagttattagtacccttggtgccacatcaataccgtacatcccggaatcctttgcactcgtggtcagtgcaaggcctctgtatcccccatctatgcaccttacagcacacaatggtgcttccctgagcgccatgtccgaacacattatgcgcagtaacctcaacccttatgcttggagccctacccgtgggacacaaactgttgacaagtatatgtccctccagcaacatgacaagatgctgccgccgacgtcctgatcctaaacatcctacgggctccaccaacatagggcttatattttgccgtcagctgttgagtcttgaccatgtagcacccacacgtttgtggtaggcctcatgaatacgccaactaacgttttcttccaatcgttaggtattgattgtgacattcgcaacgacctttctctttcgatgtggcggtttgattagtcttattttctacttacttacgtttgttttagattctcta

SEQ ID NO: 9552 - DNA, 638 bp, Chlamydomonas reinhardtii
  Predicted polypeptide sequence is orthologous to G1950
cggaggtggtcaaggcactacttgcggctggtgccagcacagatgtcgctgacatgtactacgaattgacgccactgcacaaggccgctggcaacggccacacggaggtggtcaaggcgctacttgcggctggtgccggcactgacatagccgacaagaacggactgacaccgctgcacaaggccgcttccaatggccacatggaggtgattaaggcgctacttgcggccggtgccagtaaggacatcgctgacaagaatggactgacgccactgggcatggccgcttccaatggccgcgcggaggtggtaaaggcgctagttgcagctggtgcccgcgcggacaccgctgacaagaacggattgacgccgctgcacaaggccgctgacaacgggcatacggaggtggtcaagatgctgctggcggcaggtgccagcaaggacattgccgagaagcagaacggagaaacgccactgcacaaggccgctgacagaggctacattgaggtagtcgaggtgctgctggcggctggtgcggacaaggacatcgctgacaagaacggattgacgccgcttggcatggccgcttacagcagaggcggcatgggtgtattgaaggtgctacttgcggcaggtgcc

SEQ ID NO: 9553 - DNA, 588 bp, Chlamydomonas reinhardtii
  Predicted polypeptide sequence is orthologous to G1950
gggatttcatataactacaagccgtgctgaggagcctatctaagtcctgggcccgctgggcctcgctcacactatgggctcggcgtggtctgcgcctgcatttagggccgtgcgaaacggagatatcgccgagattgaaagacagatacgagcatacaatggtagggacaactggcgcgacctgcgcgacggcaaggaccgcaattcgctgctgcacatcgctgccctccacggcaaaccccaagtcgtgaagctcctgaccaagcagcacagttttccaacagagatgattaacggcaggaacaacactgcgttgctggagcttgcacgtgtgtccggcgtggactctcaggcctgcttcgcggaggtcgtgcatacgctgctcacgagcggcgcggacgtcaacgccattggcgagaacggctggtccgtgctgcactgcctcgccatcaaccccaacccccgcctgcgcgtgccgcggcagcgtgacgtggcgcgccacctcatccagcacggcgccaggcctgacgtcaaggacagctctggccgcctcgccctccaccatgccgtcgacacaggccacctgca

SEQ ID NO: 9554 - DNA, 642 bp, Chlamydomonas reinhardtii
  Predicted polypeptide sequence is orthologous to G1950
tacgcgcttaggcattctagaggcttgtctcgaagcactcgttttgcacgcttccgcctcactcgccttatacaaagccatcaactacatttcttgtatcagctaccatcgttcactttgcataatctagcctagcccagggcgccatggatggggaacagcaacttgaggagcaagcggaagcgcagcccgttgcccattctccagaggaggaggaagaggagcccatcgacatctttcaagctattaaagagggagactatgaggcggtgcagattgctctggaccggggggccgacatcgagcaaacctcgtcagggggagtgacgcctctgatccaagctgtacaatgtggggccgagcaagccgtggaaatcttggtacagtccggcgccgacgtgcacgccgccacccgctccggcgacaccgcgctgcactgggctgcctacggcggcggcggggcgcttgtgcagctgctgctggaggcgggcgccaacgtggacgccgtgggcgacctgggcaacaggccgctgcacgtggcggcaagcagggggcacgaccaggtggtgggtctgctgctgacgcacaacgcacacacggcgttcaagaacgcgtacggcaacaccgcgctgtcgctggcca

SEQ ID NO: 9555 - DNA, 591 bp, Chlamydomonas reinhardtii
  Predicted polypeptide sequence is orthologous to G1950
cggatgtataaaacacttcatcgaggttgctagtgctgagaccagagccagttccaggcgtagctattcttgccagactgcctgcaagactaatcacaattactcgttcctgatcatgtctaacccgctggcactacttggcttggctcgcgacaacaagtcggatgacatccggcgcgcggtgaaggacgaggggctgaagccgaatgctgcaaatgagttcggtcagacggcgctacatgtggcttccctgtggggcaacgtggaggccatccgtacgctgctggactgcggcgccgacgtaaacatcactaacagccggggctccacgccactgcatttcgcagccagcgccaagaagagcgcgctggcggcgtgccaggccctgctggacgcgggggcggacacggagaatgttgacttgatgggccgccagccctacgagatggcggaggacgaggcggtgcggcagctgctgggcgggccggacgcgcgcatctttgagttcgccagcaagggcgacgcggccgggctccggaagctgctggaggaggctgccaaggaggacgccgacacgccggtgagcctgcg

SEQ ID NO: 9556 - DNA, 577 bp, Chlamydomonas reinhardtii
  Predicted polypeptide sequence is orthologous to G1950
tcggcacgagggacaacactcgcctgtttccgcccgttctgaagatcaattctaggtttcccaccttgaacatattacgcggctggccaagcccaccgctgccgaattgcactgttagggagctctgtccagacaaaacatcagtaaaccctgcggaagacggccggctttcccgcgcgttggagcggctttcggcccacgctggcaggtagcctctcgagaggcgggtaggcgcaggtggtcaaacgcctgcccatggagaaggccgctgagaaggcacgtgagggcgacctcgcctactttgaggcgctgagccctgaggagctcacgcggttatgtaaacgaaaggacgaggacgagcgctcgctgctccacaacgccgtcacgtccggcaacctggagctgtgccagctgctggtgggccgcggcggcagcgcggaggcggtgaacgaccaggacgaagagggctggacgccgctgcagtcggccgccagctgcggccacgaggcggtggtggacctgctgctggcggcgggcgcggacgtggcggcggccaactcgggcggccgcaccgcac

SEQ ID NO: 9557 - DNA, 711 bp, Chlamydomonas reinhardtii
  Predicted polypeptide sequence is orthologous to G1950
gcacgaggctgatgcggccatgacaacgtaaaagcaaggtcagcgttgcaagcccatatgcaccataaccgttggcaactgcaaaccagaagcacaggagcgtacggaaggagctctaatatatcgtctgcaccagcaccgggcaggcatggtggcctaccttgttggtcgcctccagttttgcgccagattccgcaagcaccttcaccaccccggcatggcccttgcccgcggcgatgtggagtggccttgagccgtcctgtacgcgcagatagcacatgctggggttgtgccatcacagcgcagactaagctcaattctgtactttacagtgcagcttgcttgcaagaccattcccagggcggaaagtgcacccacctcgtcagtgccgtcaacggcatccttgtcggcgcccctggcaaggagcaaccgcgccacctccacttggcccgcattagcagcgaaggcaagtgcgctcgggttgctctcctgcagcgacatgggcacattaatcaccgtcatggcacttcgcggggaaacggctgcaagtgctatgcccgcagcgacaaaggcacgcaccccgcatgcgtcgacgtccaagcccgcgtccagcagcgctgcgacggcctccacgtgtcccaatccggcggcaatgtgcacgggtcgcatggtgccctgcacgccgcgggacgaagcaagccgctacatgta

SEQ ID NO: 9558 - DNA, 480 bp, Chlamydomonas reinhardtii
  Predicted polypeptide sequence is orthologous to G2147
gcagcagcagcagcagcagcagcagcagcagcagcagcagcagcagcagcaggacaaacggaacctcttccagcgtctgcttggtggctgctatagcggcttgggcgctgacgcccctggcagcagcagtgacgacgctctgcgcgagcctatgcccacagcccctgccggcactgctggtgcggcgcccgccgccaatgggcagatccgcagccatgcggccatcctgactgacgccgcggtcatcttcaagatcgagctcgtcgtagaagcggacaaacacaggatggcaaagtcaggcggagatagttcatgctgcgctactgcggctggctcttgaagagacgcatgcgctcatcgcgcggatacagagtaagagcgacaccatgagggcggttgcggcagccgacctgatcgtggagttaaaggcggcggcggagtttctcgcatatgcgcgtgaacgcatctgtgaggccatca

SEQ ID NO: 9559 - DNA, 670 bp, Chlamydomonas reinhardtii
  Predicted polypeptide sequence is orthologous to G2147
cgactccgggcagtgggactcgcgctcgctgacgtccatgaacctgccccagcaacagcagcagcagcctgggagcgcgaccatggcctccgcacaggcgcaacagcagcaacaacagcaggcgcagcaacaggcgcagcaacagcagcagctcactgtgtcgctcaattcacagcagttgggcgcggtaaaccagcacctctatagcgtgcaggtaaggccgccgcaacaataccatttcaacctgtcgccaagtattgtgctctcggtttgtgggcttttggccttatatctggaaggcctttctcaccccatgcctcgcttacacagccacacactgcaataccaacacgcacctgcgcctctgccacccctgcttgcagacggtaagcggtgctacgctgcagctgtccccgggtgcgggcggcatgtttgcgctggtcatcaacggcacaccgccgcaggtggaggcggcacgcagcctggtggccacagtggtgggcggccagatttgagcgctgggaaatggcggtgtggccgcgcacacgtgcaacgaggcacgtgagggcgcgccgcgctgtatgccgtacgggcccggcggcatggatgtgccgggagcgtcatgaagccgttgatgcagcactgtcagcagccacgcaagcagcagcac

SEQ ID NO: 9560 - DNA, 503 bp, Chlamydomonas reinhardtii
  Predicted polypeptide sequence is orthologous to G217
ctgcagctgcgccaagcgccgcgcctcctccagctgcttttcacgagccttgcgcttggccttcttaccacgtgtgttggccagacgcgcgcgtgcctcgctgagcatctccttctcgtcctcgtccatgtccaccgcgtcggggcgcgcgggcttggcctcggggttggggtcaatctcacccggccgcagccgccgcgggtcatcacgcggatcgtagttgacgtccttggcgacggcctggtccagcagacgctcgtatcggtccaggcactgcgcgggcgtgcggcccacgatgggcgcgatggtgcgccactggcacggcatcagctttgccagatgcagcagcttctcatcctcctcgcgcgtccactccgtcttcttgatggccgggtccagccactcgtaccagcgtgctttgcactgcttggcagacttccgcaccagcagcgacgaaatacgggcccactggttgagcccatacttcatcactgccgccttga

SEQ ID NO: 9561 - DNA, 485 bp, Chlamydomonas reinhardtii
  Predicted polypeptide sequence is orthologous to G217
gaaaagcgcgagctgaaggcggcgggcattgacgtgcgcgcccggaacaagaactcgcgcgccgtggactacagcagcgaggtcgccttcgagctcaagccgcaggccggcttttactcgactgcggatgaggagaagaccactcgctccatgcagcaagagttccgccctgtgacggtggaagagctggaggggcggcggcggaaggacattgaggaggcgctgatcaagaaggacgtcaagcgacagaagatcaacgagatgcatgacgcgccgaatgccgtggccaagcacatggggctggaccaggaggggccgcgccgccgcggcaagctcatgctgcccgcgccgcaggtgagcgaggcggagctggagcagatcgcccgcctgggcgtggacggagctctggaggccagtgtgtcggagggcgcaggcggcgacgccacgcgcacgctgctgggtcagtacaaccagacgccggcggc

SEQ ID NO: 9562 - DNA, 480 bp, Chlamydomonas reinhardtii
  Predicted polypeptide sequence is orthologous to G227, G242
ctcagtcagcccgtcacacgaagcaaagcctgctgcgttcacgcccagcactcagacacgtctcgcttatgaccggacgcaagtccgcagagggcggccgttctggccgcccgcgtacccacgcgaagcggtcatccagctttagggaggacgacctcgacgcgcagggcgagaaacgaggaccctggaccccggaggaggacaagcagctgacggacctggtgctcagctgcggtgcccagcgttggagcacaatagccgagtccattccaggccgttccggaaagtcgtgccgcctcaggtggtggaatcacctgagcccgcaagtgaaaaagggtcctttcagcgatttcgaggacgccgtcatcgtgcggtcgcacgagaagtatgggaacaagtggtccgttatcgccaagctgcttccaggccggacagacaacgcagtcaagaaccgctggaactccacgctaaaacggaagc

SEQ ID NO: 9563 - DNA, 185 bp, Chlamydomonas reinhardtii
  Predicted polypeptide sequence is orthologous to G2334
tcggcacgaggggcactactaaggatgtgaagtccagactcccgcgtcacatcgccctgtgcagacatccgaccagcgctctgcaccaagccacatcacgccacgtgcgcacgccgcactgcatgaggaggtgggacacgggccgcaaaagcggcaccttgttaatgacgagtggtgtgaaaaaa

SEQ ID NO: 9564 - DNA, 747 bp, Chlamydomonas reinhardtii
  Predicted polypeptide sequence is orthologous to G2574
atggttttacgccaagactacgacattaattcctcactaaagggaacaaaagctggagctccaccgcggtggcggccgctctagaactagtggatcccccgggctgcaggaattcggcacgaggcgtgttctacagctgagccaaattcatggcctatgtagttgttgctctacaaaggctgttacttgacgacttcgtcattcttcaacatagctccttctgtcgttccgatacccgaagcactatatagatggcatcccaaggctttgcgatgccacgactcactttcgggcgcgacattgtggcgagtaagccctgcgcagcactgggcttgcggcgggctcccgcatgcccccgagtagcgcccggccgggctgagcagcagccgcgcaagcacctggagcccgtgcacgtagctcaggcacccctctcgtcttccacaacgacaaatggcacacacagcgcacccgccccggttgcttcgacctcatctcgggacgcgagcgaggctgccgctgcttctgcgctctcggcaaaccttctactgatctgccctgaccagaagggcgtgattgctgctgtgagccagcttctgtatggcttcggctgcaacatcgacgcttcggaccagttcacggacagcagcaagcgaaatgttcttgcagcacatcacctttggcttctcgaagatcgaaattggacctgagtacgccacggaaactgttacatgacgttaaaataactat

SEQ ID NO: 9565 - DNA, 716 bp, Chlamydomonas reinhardtii
  Predicted polypeptide sequence is orthologous to G2574
gcacgaggagctgcctggggcgtgcgggtacttacatccaaccaggtctgtaagttttgtgtcgttgcctgacattgaattaagaaatactagtcagatcggtccggcccgcgttcggtgtgcacaacctgcaagctttgatcggcgacagagatatgattcaacgtggccctaaaacactgcttgcatgtactgcacagcacgtcgacatgtcacaggaacggtgagagagcagcatggagcaatgtggaaacccattctgccccaaataggatagttgtagggccacgaaagaatccatatcataagtatggcgcatttaaatgcttatcaaggaaacgaagacaccggggtcctcgggccggcacgaattctcgaaactcttttgcaatatggagccctgccacctgctgccgctctcacacctttgaacagttgacatgttaccgtgtatgcgcagaggagtagcagggggaaacacaccgtggggcttcacagcggggccaaccccccttcattagcccgcaacccgcctctgagtgtatcctactagggacagctcagacgctggcagaggcacggcatgtgagtggaggtggccgatggaaacttgcaggctggagggctgtccggcacaccggtgcgggcgctgcgtgtcgcgccgaatttcacagcatggcatggcggcggccggcatcagcgggacacccacgcac

SEQ ID NO: 9566 - DNA, 755 bp, Chlamydomonas reinhardtii
  misc_feature (17)..(17): n is a, c, g, or t
  misc_feature (27)..(27): n is a, c, g, or t
  misc_feature (43)..(43): n is a, c, g, or t
  Predicted polypeptide sequence is orthologous to G2993
gactttgggtacgactncctatagttncgaattgggtaccggngccccccttttttcgcataatactgttacaggtcaagagcccgtcgcacaaatagtccgagggccgtgaacaccaattagttgggaggccccacggcacccttggcactatgtatgtatgccgaatgactgggaacgtcagcttaaaaatgggccctcgctgcattgcatgatgggtgttgcaaaccctgctgccgcacgcccagtcacgccccgtgtactcttacactgtgccaccggccaactcactgcgccgaaaccaggaaccgtcccagcaccaccctccaaacgcaaaagtcataatggtacaggtcacggtaaaacgtgtgcgtgggggcgcccctatctcaacaggcgccgcaaaggcgcgaacacgatagtcgaaggttcaacatccttcattgtacagccgcccacccatatgatagttgcaaaggaagtggaacagcctcagccgggcaaattatagctaccgcaaacagctgcgaatgcaaccgcagccggggaaacgcgcgcccgccgcaaacaattagggtttcgttggggctggtattaacaacccccaccaccaacaagcgttgggcgcgaccctctgttccaaccgctttcactaaagcagtaccagcccaaacaatttcgcacccccttccccagaagtccccggttgaaaaaacacaccttcctaactacttgggaacaatgtcgctcaatgg

SEQ ID NO: 9567 - DNA, 630 bp, Chlamydomonas reinhardtii
  Predicted polypeptide sequence is orthologous to G2996
ttttttggatagcggtcatttacacggatggcacggggcctgccaaagcgccagccttcctgctgcagtgaaacaacaccaccacgccgacgatggacatgaggcacgcccaatgtggctttcctacaccacgttgtacgcatgcaccggctcatcggctgcaagcacgggcagccgcacgccacagccgtctgccgtcaaggttcctcatgtgcagtggctggccccgccgcctaactttgggccctacatttcgcccagcttgccagcggatatcatggatcgtcctcacatgtccaacaccacaccggcaacacagcctaccggtggcactcggaacaaccatgatgggcaacgcagcgcatagcagaaagaattcctcggggcaagcattgtcacgcacgccagccagagcgggcgcgggttcagggatatggggcggaaatacggaattcaaaggtaaaataataaggcgcagctccgggaaacattgctgaaatatgggctgaaagttcttagggactaatcagaatcatgaagggtatgctgctacaacttgcagatgcagagctgacctaacacgcaccaaccttcctcaccagcgttcacattgctgcatcttacttgcct

SEQ ID NO: 9568 - DNA, 716 bp, Chlamydomonas reinhardtii
  Predicted polypeptide sequence is orthologous to G3032
ttttttaggaggcgcgatgtaacattacgtgacgggcggcaccgagacttcctatgcatgcgacacgcccggccttttgttaatagttggaaatgactcttgaagactgcaagtgcacaagagcacaggaaggcttgtacaccaggcagtggcgggcgggggttgtgtctttgtgcggtacaaagcgccgtttcgacggactccgctccctgagggcctccagaccttgctccagagtccagaccccttctctttgactcaaaaccgcgtcgctctcaccgccaatctcctgacccgcaacatgcacacaataaattttgaggcgcctcatagcacaaggcacctgcaagccggccacataacttgcgtccacagttctcaacggcggcggctgtggcgacaccactctcaagtctctacccagcgctcagcttctgcatcagcttggctttggcctcatagaactttacgatgtccgcgtccgcgtcagggttgcctgtgaggaacggccgcgccatttccagcacagccgcgtccactccctgcatgctcggcccgccactcgagtgcgctgcggcgtgctgctgcaccgccacaccgctgccggtgcgcgtcaccgctggactggcggcgccgttgcccggccccggacccggccctggccctaacccgtgcatgccttgaggatgcccgttcccgtacccatgcgagcccag

SEQ ID NO: 9569 - DNA, 698 bp, Chlamydomonas reinhardtii
  misc_feature (173)..(173): n is a, c, g, or t
  misc_feature (698)..(698): n is a, c, g, or t
  Predicted polypeptide sequence is orthologous to G3032
ttttttggcctccatagttcatactcacggcgtcgcgcctcgggcgctttgctcgcgacagtcaattggccatcgatccgcgaagttgcttgtcaatccggctgctttggacccgccgcctacttgcaaataggctttttgtctgcaccacactgcactcgggcaaaggcggncctttgcccacccaagcattggcctagcgcgcagccacaatccgtatgtttgaggcataatgttcagcacgctgcccacacatccatgcgcactgccgggctcataggaccctcagcagccagcacctgccaagcgtccgaccaaggcccttcccgcagcaagctttcgcccagttacacggaccacacccactcacggacacgccaggacaccaacctggcaaggcagctgtgttatttaccccacatccacactctgggggtgctgtgcttacctccatacacacacacacacacatacagacagacacgcaatgccaatgcacaaccacgctctcaatatccatgcggccaccatgaccatggaccgccacgccgacaaccaccctgcaaccagacaacacaacactggcacagaggataccgcagtgctcacaggaaacgaacacagccgcctcaactagacgtggggaggagatgcggtcgcagccgccgcgtccgcacttgttgtggagtccacagcan

SEQ ID NO: 9570 - DNA, 666 bp, Chlamydomonas reinhardtii
  misc_feature (631)..(631): n is a, c, g, or t
  Predicted polypeptide sequence is orthologous to G3074
gcacgaggcaacaatcagcttctcacgttctacacacacaagcgagcaccagaatcaccgctgctcaagagggctgcaatttaactcgcactatggtctccacgcgccgcagcggccagcggcaggagaccactcctgagccgcagcatcaagtacaggattcgcccggccccagcggcacctcgtcgcaacgttccggcggccgctcggccgccggccgagggagaggcgcgaaggcggccaagaagctcgagccgattgaagaggacactgctcaccatggcgctgagcaacaacaagcaacggcagcaggttctcagcgtgaagcggtggtggcacctgtgaccagcacacaagatgaagagcggcgccaatctggtgccgccgcctcggcgcgagatgaccacgccacgtcacctcttctacgcacaacaacaaccaccacgcggcgaggacaatccgcaacaacaactactactacattaacaacagcagcagctccctctggaccagctgcgagcggctcgcaacagccggccccgccgaaggcccagcccgtccacttgggcgacagcgatgaggacagtgatgacgaggacatcctagggcccaacctgatgggccagctggncgtcgtccctgcgggccgcacttcaagcgcgggcg

SEQ ID NO: 9571 - DNA, 664 bp, Chlamydomonas reinhardtii
  misc_feature (565)..(565): n is a, c, g, or t
  Predicted polypeptide sequence is orthologous to G328
gctacctggagaagaagaagaaccggcgcttcggcaagaccattcgctacgcagctcgcaaggcgtatgcggagatccggccgcgcatcaaggggcgcttcgcgcgcaaagacgagattgcggcgtggaaggccgccaacggcggcgacgatgccatcgtgcccgagtgcctcgacattgtgctttgagcgcgagtcagtgcgtgtaagcgcgagtgggcgcggggagcgcaggtgtccagtgagttccagtgccaaggcttgttccagagagggcttgcgggctacggattccgccgccggcgcggcgtacgtgccgcagtttttagttttgacgtcggttccgtctctcgtgcttaaagattgccgtttgcgcagggtgtggacgtgccgtgtggtgtgacgtgaaagtgcaagagagcgtttttgacaacgtgctcgcatgccgtacacatacactggcatataccacatatatcaaggcagtccgggccagcgttttggggttgactggagaccagtcaattcaggctggttacagcggaagcgctgctcttgcgacacanaaaggatagataacgccgattcggcaaatgcactagctagcagcgttgtttggggccttgtgcgctttcgcgccatgcgcttaggtcgccaaggcatgt

SEQ ID NO: 9572 - DNA, 590 bp, Chlamydomonas reinhardtii
  Predicted polypeptide sequence is orthologous to G328
taaacgcaatactccccaacaacacaaatataccacacctctatacgcgagaatgtcgagttgcgtcgtgtgcgcggccgcagcggtcgtttggtgccagaatgacaaggcgctgctttgcaaggactgcgatgtgcgcatccacaccagcaacgcggtcgctgcgcgccatacccgcttcgtgccctgccagggctgcaacaaggccggtgctgcgctctactgcaagtgcgacgccgcgcacatgtgcgaggcttgccacagctccaaccccctagctgctacgcacgagaccgagccggtggcgccgctgccgtcagtcgagcagggcgctgcaccggagcctcaggtcctgaacatgccctgcgagtctgtggcgcagtctgcggccagccccgcggcttggtttgtggacgacgagaagatgggcacgaccagcttctttgatgcgcctgcggtgctgtcgccctcgggcagcgaggccgtggtgcccgtcatgtccgcccctatcgaggacgagtttgcattcgcggccgccccggcgacgttcaaggaaatcaaggacaagctcgagttcgaggctctggacc

SEQ ID NO: 9573 - DNA, 785 bp, Chlamydomonas reinhardtii
  Predicted polypeptide sequence is orthologous to G489, G714
ttttttgatagcaaaacgtcacactggctatagagagcccaaggaacgccatgtgtgtagtgatgctcgcatctagggaaaggccacccacctggtcaccacgcctgcaatcggcctgggcaccgttattacacctcacagccacacactccttgcctctgcaccactgcgccagagaccaccactgcatccagcatcccttggcttcctctctgccaagtactaggtaattaggacaagttacggattgaggtaatcagttcgctctcccgggggcgcatcaggccgttttcatacctgccgctaaacacccgcccgtttggcaccgccggttacagcctaccctcgccggcggactgtctctgacagtctgaccagtcggccgaccggggccattcgaagctcttttgcactacagcaccgcaggccacaccaccggggaaccgagtttaccagtaccgccgttcactttggtaaataacggtagaaggctctccagggttttgtagagtatcactcatgccgctgctgctgcattttaagaccccgcaccctgccgtttagctacatgccacaaagccgcgacctgcttttgcagcccaccctcccaaccagacagcaaagttggtatcacccgagctacccagatcactagtttgagctcgggcgcttggacatgcacgcccaactcccagtcctgccgagggctttgttttcaggccggtttaacccatagcttggttctctcccagatgctttgcgcctaaccccacggaccttggctt

SEQ ID NO: 9574 - DNA, 693 bp, Chlamydomonas reinhardtii
  Predicted polypeptide sequence is orthologous to G896
gcacgaggcttcattagcaccaaggccaacatcttccggggcatccagtggctgatgacggaccagcagcccggtgactcgctgttcttccacttctcgggccacggctcgcagcagtacgaccgcaacggcgacgaggaggacggctacgacgagaccatctgccccaccgacttccggcgcgcgggccagattgtggatgacgagctgaaccgcatgatggtccagccgctcatgcccaacgtgacgcttcacgcggtaattgacgcgtgccactccggcacggcgctggaccttccctaccgcgcaaaggtcgaccacagcggccgctggtactggaagggccgggcgcgctacgacaagtgcacgcgcggaggcacggcgtttcagtttggcgcttgcaaggacagccaagtggcggcggacaccaataagctgtccggcaaggcgtacacgggcgccgccaccttcagcttcatcgaggccattgagaagtatggcgtgcagcagacatacggcgtgctactggggcacatgatgcagacgctgcgcgccatgaacggcggcatggtgtccagcggcgccaccggcattctggccagcctgttgctgggcagcagcatcagcagcggccaggagccggtgctcagctgcgacaagcaggtcgacctctatgccagccgccttacatct

SEQ ID NO: 9575 - DNA, 971 bp, Gossypium hirsutum
  Predicted polypeptide sequence is orthologous to G1006, G22, G28
gaaaaaaaaacatccccagacacaaaatttgaaaattttgagattagatttttagaggaaaaaaaataggttgactgttttgttttggctatggagatgtattcaagtgcaaacgactccgatttggctatgctggactcaattcggcaatacttactcagcgattcatcggaccttcgactcactgcttccactgattttacctcggctccccccatgttttgcaggagctcaagctttagccgtttgtacccctgtttcactgaaacctggggtgatctcccgctcaaagaagacgattcccaggacatgcttgtttacggactcttacgagatgctctaactgtcggttgggcaccgtccgataactctaagacgaatttcgcgccgatcaagccggaaccgcaagaatttttaccgcagacatcggtggaaaaagtggatacggtggcggagaggacggttcctgcggtggtgccggccaaagggaagcattacagaggcgttaggcaaaggccgtgggggaagttcgcagctgagattagggacccggctaaaaatggcgctcgggtttggttaggtacttttgagacggctgaggatgcggctttagcttatgatagagcagcctataggatgcgtggctcaagagctttgttgaattttcctctgagggtgaactctggggagcctgatccagtcagagtaacgtcaaagagatcgtcgccggagccgtcttcgtcttctggctccgaaaatgcgtcaccaaaaaggaggagaaaggtggctggctcagctccggcagtggttcacgctgggttagacatgggtgctgggaggtgaagttaattataaagttagtacgtgtgcacatggcgagcagctattagtcagtaatgctgacgtgtcagtggattaatttcagctgcagtaagcttatcttctaatgtacattctttcaatttataaac

SEQ ID NO: 9576 - DNA, 836 bp, Gossypium hirsutum
  Predicted polypeptide sequence is orthologous to G1006, G22, G28
caggagctccagctttagccgcttgtacccttgtttgactgacacctggggtgaccccccactcaaagagaacgattctgaagacatgctagttttcgggtaccttagagatgctttaaccgtcggttgggccccctccgatcactcttccccgactttcccgccaattaaaccggaacctcaggagattccgacggagacagcggtgaaagaggttcctacggtggcgaatgcggcggttcccacggtggttcctgccaaagggaagcattacagaggagtaaggcaaaggccgtggggaaagttcgcggcagagattagggatccggctaaaaacggggctcgagtttggctaggcactttcgagacagctgaggatgcggctttggcttatgataaggcagcttataggatgcgtggctcaagggctttgttgaatttcccattgagggtgaattccggggaacccgacccagttaggatcacgtcaaaaagggcaacaccggagccatctacttcttcgtcctcgggttcagaaaacgggtcaccaaaaaggaggagaaaagtaggtagcgcggctccggttgtagctcaagccggtttaaatatgggttttggagcgtaaagtattgaggtgggaccttgtacatgtggtgaacagctattagtcagtgaaatgctgctgaggtgttaatagtgtaatgtaagcagaagtaagcttatagttatggacaacctccatcccataggaattttgtagaatcggaaaaaaagttatttttgttcttaaaaatagtattaacagcgtggttaaaactaaaaaaaaaaaaaaaaaa

SEQ ID NO: 9577 - DNA, 807 bp, Gossypium hirsutum
  misc_feature (483)..(483): n is a, c, g, or t
  misc_feature (517)..(517): n is a, c, g, or t
  misc_feature (549)..(549): n is a, c, g, or t
  misc_feature (563)..(563): n is a, c, g, or t
  misc_feature (595)..(595): n is a, c, g, or t
  misc_feature (625)..(625): n is a, c, g, or t
  misc_feature (755)..(755): n is a, c, g, or t
  Predicted polypeptide sequence is orthologous to G1033
ttctgttctctttcttcccccctccccctttcacatcaaccctaaccctacctcaccaatcaggatacaacatgaagggaggtaaatccaagtcagatactaagggctctaggctcgccgtgaacaaaaaatctagcgccaaagctggaaagaaatcggggaaggcggctaaggatccaaacaagccaaagaggcctgctagtgccttcttcgttttcatggaggagttccgtgagcaatacaagaaggaacacccaaaaaacaaatctgtcgctgctgtgggcaaagctggtggagataaatggaagagcttgtctgatgctgaaaaagcaccttatatagcaaaggcagagaagcgaaaggtcgagtatgaaaagaacatgaaagcctacactaagagacagactgaggctcccaaagaaaaaaatcggagtctgagaagtcagtgtctgaggtgaatgatgaggaagatgaagacgatgnaaaaagccgcggagaagaagaaaatgatgactancaaagaaggaagacttgttggaagagatatancataacaagtatangctggtgcttaattggttatatgttaatgctnttgatgttcccatgttattctctctaaatnggcatatgcatgttcatttaagggaaaaaaaaattgtacctcttaatcttctgattttctttccaacgtttaatagattaatagcctcaaaaatgttcctttgattccaacgtcgaggaatggcttgtanacatatccttttagatgataacttgatgccttatttagaaaaaaaaaaaaaa

SEQ ID NO: 9578 - DNA, 836 bp, Gossypium hirsutum
  Predicted polypeptide sequence is orthologous to G1033
ttttttttttttttttttatcggactaattctctacaaaaggatttatctaagccattcaactttaaatcaaaaagtacatatagaagcagattatcccatctacaactattaatttcagaaggtcaaaaggaaccaacaggattcagaggtacatttctcccttagatggcatgcgcatctaaaagaataacatggaaacatcgaaagcattaacatatggttttgatcaaacactatcacagcctacattgattatgctatccaccacggaccttcctactcatcatcttcttcgtctccgctgccttcttcatcatcatcctcatcattcacctcagacactgatttgtcagactcaacatcttcgtctttaggaccctcagcctgtctcttattgtaggccttcatgttcttttcatactcgacctttcgcttttctgccttggctacataaggtgctttttcagcttcagacaagctcttccatttatctccaccagctttgccgacagcggcaacggatttgtttttagggtgatccttcttgtattgctcacggaactcctccatgaaaacgaagaaggcactagcaggcctctttggcttgtttggatccttggcagccttccccgatttctttccagctttggatttcacggatagcttggcactcttagtatctgacttagattttcctcccttcatgttgaatcctggttggtgaggtagggttagggttgaaaaaagagagagaaaaggggaaacaaaggagagatatgagattggggattgaggattgaggggtgagttgaaaggccgaaaggcggagatatt

SEQ ID NO: 9579 - DNA, 550 bp, Gossypium hirsutum
  misc_feature (7)..(7): n is a, c, g, or t
  Predicted polypeptide sequence is orthologous to G1033
aatatcngactttcacatcaaaacaattagtcgtgtgaacatgtccaaagaacatatcaaacagataaaccatatcacgcaaaaccactaccacttcaggaagcgataagcataaccacacgcacaaaaagaagaaaaaaaaaccccttagtcattcatctttaagagaaatttaagtacaatatccatgaaaaaagttactgcttcaactaacccgtttatatccttctcttacctaatctaaaagtacgactgttggatatcaatatcaagtcaactgttcatctctaagtagcaaaacaattcctgaatcaatctaaccacttctgcaaattagttcatctagtcttcatcctcatcctcatcctcttcatcctcgtcattgacttcagactttgacttgtcagattcatcatcgtttcctccgccagccagcttcagactatatgcctgcatcttcttattgtattcacttttgcgcttctctgccttctgtacaaaaggagctttctcagcatctgtcatgcttttccatttttctccaccagct

SEQ ID NO: 9580 - DNA, 834 bp, Gossypium hirsutum
  Predicted polypeptide sequence is orthologous to G1033
gcggccgcgtcgacattctcaacacatctctatttctatcgcacttttattcccctattcctctctccctctctcatccgtaactctaaccctagccctctatcaggtatttccccgtcgatttttatcgaatttccacttctttctatcgatttcatctgctttttcactcatctgcgatttcatttgcaggattcaaacatgaaaggaggtaaatccaagtcggatgccaagagcgccaagctctccgtgaataagaaatcaaccacgaaagctggaaagaaatcggggaaggcagctaaggatccaaacaagccaaagaggcctgctagcgccttcttcgttttcatggaggagttccgcgagcaatacaagaaggagcaccctaaaaacaagtccgttgctgctgttggcaaagccggtggagataaatggaagagcctttctgaagctgaaaagcgaccttatgttgataaggccgagaaacgaaaggtcgagtatgaaaagaacatgaaagcctacaataagagacaggctgagggtccccaagaagatgaggaggaatctgagaagtctgtatctgaggtgaatgatgaagaagaagatgatgatgaaggcagtggagacgaagatgatgagtaggaaaaatccagggaggatagcataatcaaactaggctgtgatagtgtttgatcatcttatgttaatgctttttaaatgcaaatttcatttaagcaaaaatgtaactctggatgctgttggtttcttttgacgtttcgaaattaatagttgtagatgggtaatttgttgctacatgtactttgcatttgaagt

SEQ ID NO: 9581 - DNA, 629 bp, Gossypium hirsutum
  Predicted polypeptide sequence is orthologous to G1033
ctcctaaggaccccctcacaaatatcttctttgctttgctttagttagtgttctcttttctgcaattctctgttttttctacatttcttttccattgaagaggaagctgtcttgtaagaatgaaggcaacaaggggcagagaagatgcaacaatgaaggacaagaaggaagcaaaaaagcctgctgagaacaaggtcgtcggtaagcgaaaagcggcgagccgggccgataagagtgaccgaaaacgcgcaaagaacatagcatcatcgaccaacaaggacccgaataaaccgaagagacccgccactgctttctttgtgtttatggaagagtttaggacaagttacaaacaagaacatcctaaagtgaaggctatctcagctgtgggcaaagcgggcggagagaaatggaagtcgatgtcgaatgcagaaaaagctccgtacaaagtgaaagcaacggaaaggaaatcagaatacgagaagctcatggcagcctacaacaagaaacaagaaagttcagatgatgaggaggaagctgagtccgaatcatcaaaggatgatgaagaaagtgaggacgatgattgaatccaggatggttttggattaggttctgtaaatgaaaccatgttt

SEQ ID NO: 9582 - DNA, 977 bp, Gossypium hirsutum
  Predicted polypeptide sequence is orthologous to G1048
caaagttcaaaaggtgtttgtttgtatattctgatcggttcaatttcatgtgtcactcactttcctttcccatcttaaacatgctccctcctctgtaaatcctattagacgtcaatttcccctttcataaatctttgggttttcatggaggaaatcaattgggatacccttctgctcgaggttgacttacccgatttcgggaatatcttagataatgaaccggtaacggaacctcctcctcaaccttgttcaacccagaatcccgatgaagaaccggcggtgtcttcgtggatcggggcgatcgagaaggttttgatggaggatgataattttgatcctagggttgagactcaacctgtctccgatgatgatttcttggccgatttactggttgattcacctcctagtagcggcggcgatgtggctggcgtcgacggtgctgatttgcacaaacagagccagacccacaccgacgtcgataaagacgatcccattattaagaaacagagaaggcagttgagaaacagagatgcagctgtgagatcaagggagaggaagaagatgtatgtcaaggatcttgagatgaagagtaggtatttagaaggggaatgtagacgactgagccgtgtgcttcagtgcttcattgctgagaatcaagctcttcgtcttacgttgcataagggttgtgcatttgatgcatcctcggccaagcaggagtctgccgtgctcttgttggaatccctgctgttgggttccctgctttggttcctgggcatcatgtgcctcttcaccctgccaatactgcccaagtcagttctggaggcagttccaatggcaaacgaggaaacacaagtcccgaaagagtggctccaagaggggcaggagtaaccgggtcggaccatcttttgtgagagtagagatgcaaggcgtctaggggaaagatgaaagaaatttcatgttttatgggaattttaatt

SEQ ID NO: 9583 - DNA, 804 bp, Gossypium hirsutum
  Predicted polypeptide sequence is orthologous to G1048
cagaatttcttggaagcctgcctgcctgcctgcctgagttttctcttttaattcattcaattcgaataaaattcaagcacctttgtaaattgtacatgatttctcttttcttcttcctctgcttgtaaatatttgataaaattgcaactttgtttgccttattctttgggtaatcatggaggaaaccaattgggaaagcctgttgtttgagtttgactgtcccaatcttggaaatatcttacaaaatgaatcagaatcggtaactccaccaatctccacccactctcccgatgaaaaaccgatttggacatcctccattggtgagatcgagaagcttttaatggaggacgatcgttttgatgacaaggttgagactcaacctatccccaatgagtttttggcggatttattggttgattcatctcctagtggctgcggcgatgaggtcatcgatgatactgcttttgacaaacaaaaccagacccttttcaacgttgataatgatgatcccattgataagaaacagagaaggaaattgagaaatagagatgcagctgtgagatcaagggagaggaagaagatgtatgttaaggatctggagatgaagagtaggtatttagaaggggaatgtaggagactgaactgtttgcttcaatggtccattgcggagaatcaagctcttcgttttactttgaaccagcgttgtgcatttgatgcttcctcggccaagcaggagtctgctgtgctcttgttggaatccctgctgttgggttccctgctttggttcctgggcatcatgtgcct

SEQ ID NO: 9584 - DNA, 550 bp, Gossypium hirsutum
  Predicted polypeptide sequence is orthologous to G1084
tgagaaaagaatcaataaaaaaattgatagactgaaagtatcaacagattctcccccaccaagattttttagttaaaaaaattataaaaaaggaaggctaacattttaccttaaaacctagtggcaaatacttaacattctttagttacaatcacattttctgttaacttcaacccaacacaaatctagaaacatactcccatcttctattttagaagattggggatgagggggtgataaaaaagatgagaacaggaataagggctctttcgcgcttcgggagggaggagagaaaaagggaataagctgccccacccaggaacaaacacaagttgcttcttcacggatctgtggcaaccatttcttgatattttgatacaatggcatgtgctatgggttttaggggcatctgaaagtgtgagaatcaacgtgtaacctttaactcaccagttttgggggaaaggaaaaaaggagcttttgccatcagcaacccaaacaaaaagttaaccatgcaaatacatttcttggaccatcttttatgcatagtaca

SEQ ID NO: 9585 - DNA, 746 bp, Gossypium hirsutum
  Predicted polypeptide sequence is orthologous to G1133, G1137
gcttagcgtggtcgcggccgaggtaccatgactgcccaggatgagcaatttgagggaggtagtgaagaggttgatagctctacaaggctaattaaaaagcgaaaactgcttgatggcagttatggttgtttgcccttgcttatggatactgctaattcagggaattttaacagatattctgaatacgaggatgatgcggattcaagctgtgccaaaggccaaaatcctggatcaggtgatacagattcgtcttcaagctacaagagaatgagaaaggataaaattcgagagacggtgactgttttgcgaagcataatcccaggcggagagggaaaggatgcagttgcggttcttgacgaagctatcaactacctgaaatccctgaaacttaaagccaaaaccttgggacttaacactctatgagctgcagcctgcagctgttctcacaagtagtattagttgttatttttgtcattgttagtggagctgtgttaaataagtgaagtatacacaatcttgaatggtgtttttcatatataatttggagcccttccaaaaatagaagatcgtagacaaagaacatgaacccttcccaatgatatgagttggaaaccagtagcataaggagtcgaaatctcatctctatttcctaaaggaagcaaaggatacatgagtgtatactatgtcccaataaaggaagatgaaccatcattagtcaacatcttgggttgtagagaaagtgaaac

SEQ ID NO: 9586 - DNA, 550 bp, Gossypium hirsutum
  misc_feature (46)..(46): n is a, c, g, or t
  misc_feature (237)..(237): n is a, c, g, or t
  misc_feature (335)..(335): n is a, c, g, or t
  misc_feature (459)..(459): n is a, c, g, or t
  Predicted polypeptide sequence is orthologous to G1136
tttttttttttttttttttttttttttttttttttttttgggctcncaatctcaaacactaagaattaaggtctgaaagtgaacaacagggtaccaagaacccagatcttcatctaggttctaatctatgtaacaacatatatatatactgtatacatggatgacatacactacaacattgaacaccaaaaataaggcctatttgagcttattacactactaagagaagagactagntgggatgatcgtctatctgggatctccaacttgggatgttagagcgatcctaagtggttctgggttgtaaaatcggttccccatcttcacattaaccntgtgtatcatcaagtcgttaacgacggaaacgctgcgtggtgtacgtcgaggtctaactctgtgtaaggagccattaaccgtgatgctggatgattctttttattgggatgggattcgaatcanggcgtctaatcggatagtcttaacgtcgatatccaattctagtaatttgtgggacgtggtgaggcctcctcgctgactttctttctggttt

SEQ ID NO: 9587 - DNA, 848 bp, Gossypium hirsutum
  Predicted polypeptide sequence is orthologous to G1136
agatttgtgggcatatgctatattatggcagacactgaacgatgacctgggtcgtctgttcttggcttggggagatggtcatcttcaatgcactaaagatgcttctccaaggttgagttccggcttccacagcgaacgaactaaggtgattaaaggaatccaagccctcattggagaccaacatgacatcgatttgtctatgatcgacggaaccgatatcactgatgtcgaatggttctatatgatgtcaatggctcgatccttctctgctggcgaagggattcctggcaaggctcttagtactgggtctttggtttggttaactggtgctcatgagttgcaattttacaattgtgaaagagctagagaagcccaaatgcatggccttgaaacactggtttgcatacccacttcttgtggtgttcttgaactaggatcctcagagattatcagggaaaactggggtttagtccagcaagtgaaatccctattcgaatccgatctcattggtctggttccaaaacaatcgactcctccaaatttaaccacagcttcggtccagttccttaacagaaatatctcatttgcagacatcggcataatagcgggtgttcaggaagaagacggtgcaagccaggatattaaaacacagcaagagcataacaataaccaaaccaagaaagattcctcaaaacttgggcaaccttcttatgtggactcagagcattcggattctgattttccattactagccatgaataacgtggagaagcgaaccccaaagaaacgaggaacgaaacccgggctcggacgagagacaccgttgaatcatgtggaagcggagaggc

SEQ ID NO: 9588 - DNA, 828 bp, Gossypium hirsutum
  Predicted polypeptide sequence is orthologous to G1146
gcggccgcgtcgacattgtatcctatgatggtctgttgacattttacattttatccgatgttattattgtttccctgtgatctttctggttgcctgtcatcgcaggaaggagcgacaatttaaggttgcaatcaaactggcctccaagccagaccttcattatctgagggagtttttgagcagaaggcattttgaatgccctcaagaagctattcaagttctgaatgttgttcttagagctaaaccatctcagatatatactgaggttggaaggtcttttttccatacatcattaggtcctagaggagatcttggtaatggaatagaatactggtctggatattatcagagtcttcgactcactcagatgggtttatctcttaatattgatgtgtctgctcgatcattctatgagccaattttagtatcagagtttgttgcgaatcattgcagactatcaaacctgtcaaagccgctgtctgttcaagatcatattaaagtgaaaagggccttgaggggagtaagagttaagctcatctacatgatttatgccaaaacttgcaagattattggagtatctagagaccctataagtcagttgacatttactctcgatgacaagagagcaaatgtctctgtggtcaagtatttccgtgagaaatacaatgttgtgcttaaatatccatccttgcctgcactttaaagtggaagtcaagctagacctgtctacctgccaatggagctttgtagtatcgttgagggtcagagatacacaaaaaaactaaatgaacaacaagttagatctctgcttagagcaacttgtcaacg

SEQ ID NO: 9589 - DNA, 1003 bp, Gossypium hirsutum
  Predicted polypeptide sequence is orthologous to G1146
caagcccttctattgcagctgttgttgcctctcaagattggccagaggttacaaagtatgctggcctggtttgtgctcaagctcatcgacaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctattatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacaagtttacagctgatgcattacagtcccttacaaataacctttgctatacatatgcaaggtgcacacgatcagtgtcgattgttccccctgcgtactacgcacatcttgctgcattccgagctcgcttttatatggaaccagaaacatcagacagtggatcaatgacaagtggcacagctgcagggcgtggaggtggagctgcagctgctggtgggcgtagcacaagaggacctggtgctagtgctgccgtcagacctctgcctgccctcaaggaaaatgtcaagcgtgttatgttctactgttaagggagtgcttgtattttgagcatctattttgttgggctttgcttattggtatttcgaacaatatctagtttgtttggtgttgcgtggattattgaactaaacttgttgaactttggtgttaaaactatgttaattttatgattatcgctgtg

SEQ ID NO: 9590 - DNA, 884 bp, Gossypium hirsutum
  Predicted polypeptide sequence is orthologous to G1146
actgtctaggccattgtcggattccgatcgtgtgaagattaagaaggcgcttagaggagtcaaagtagaggtgacacatagagggaatgtacgaagaaaataccgtgtttcaggattgacttctcagcctactagagaactagtgtttccggttgacgataactctacaatgaagtctgttgttgaatacttccaagagatgtatagcttcacaattcagcatacgcatctaccttgccttcaagttggaaaccagaagaaggcaaattatttacctatggaggcatgcaaaatcgtggagggacagagatatacgaaaagattgaatgagaggcaaattactgctctcttgaaagtcacatgccaaagaccgagggatcgagaaaatgacattttgcagacggttcaacataatgcttatgatcaagatccttacgcaaaggagtttggaatcaaaattagtgaaaaactcgcttcggtcgaggctcgtatccttcctgccccttggctgaaatatcatgaaactggaaaagaaaaggattgtttgcctcaagtggggcaatggaacatgatgaacaagaaaatgattaacggaatgactgtgagccgatgggcatgtattaacttctcacgaagcgtgcaagagagtgttgctcgagggttttgcaatgaacttgctcaaatgtgccaagtttctggcatggagttcaatcccgaacctgttataccgatctacactgccaggcccgagcaagtggaaaaagctttgaagcatgtttatcatgcatccatgaaaactaagggaaaagaactagagcttctattagctatattgcctgacaacaacggctcgctttatgggtgatctcaagcgaatttgtgaa

SEQ ID NO: 9591 - DNA, 682 bp, Gossypium hirsutum
  Predicted polypeptide sequence is orthologous to G1146
tactcgctttttccctactgatcgcaacaaaactgataggagtggcaacatattaccaggtactgttgtggatactagcatctgtcatccaactgagtttgatttttatctcaatagtcatgctggaatccaggggacaagcaagcccacacattaccacgttttgttggatgaaaatggcttcactgctgacatcttgcaagtgctcacaaacaatttatgttacacgtatgcgaggtgtaccaagtccgtttccatagttcctccggcatactatgctcacctcgctgcttatagggcacgctgttatattgaggatgagatgtcggatagtgggtctactggtggaggccgaaagccgaaagaccaggttgtagaggttaggccgctgcccagcataaaggataatgtgaaggaagtgatgttctacgtctgattaattatgtttggttgattgtgggaagttgcgcaagtatagttgcacggtttgtggaatgatggtggagtcttatttattccattggtggacttagtaatcatctaattttggagtttttgttttggtggttgggcgacttgttgtgtgaagtttgaattattataaatcacacactgtttgtggattacgaaaatttcataaatgtcctttatttttaaaaaaaaaaaaaaaaaaaaaaaaaaa

SEQ ID NO: 9592 - DNA, 484 bp, Gossypium hirsutum
  Predicted polypeptide sequence is orthologous to G1146
cagcctaccgagctcgattctacattgaacctgaaggttccgaaaccgctaaatcacgtcgtacacgcacaaccaatggttcaccggttcggcctttaccagcattaaaagataaagtgaagaacgtgatgttttactgttaaaaaacatcgaagggaaagagtaaccaaaaaaaacatatatgtacatgctttgttgtgttcacagtgtagagagactgccacatccctgactttttgaaagcgcaacaaacaaccgactgtaacagttactagcagactaacaaaaaaaaaaaaaacctcagctttttagagcatatataatctaaatgcatatacgtatatgtatatgtatgtgatacgagatttctaagctgaaaattcaacaacatttaatattactggtccgagagacacaacaaaacaactgttgaacaaaaacgatatatagctgtctttcaatccaaaaaaaaaaaaaaaaaaaa

SEQ ID NO: 9593 - DNA, 556 bp, Gossypium hirsutum
  Predicted polypeptide sequence is orthologous to G1146
cgcactaccatgttctttggggatgaaaacaattttacagcagacggaatacagtctctaacaaacaacctttgttacacatatgcaaggtgtacgcgctcagtctcagttgttcctcctgcatattatgcacatttagctgcattccgtgcacggttctacatggaaccagagatgcaagagaatgggttgaacagctgcagtaatggtcaagcgaaaggtacaagggcagtgggagaatcgggggtgcggccattgccagccttgaaggagaatgtgaagagagtgatgttctactgttagaatggatgagtggagtgggagatttgcaaccatgaatagaataacttttttcagcttattaaaatttccttgtacagtttaaatgaatgattgcaaagtcttccaaagtttagtttaagataaaaatgtgaaacgtgggaggaatgatccacagatgcaagaattgttaaaactaggttattatcttcatgtaaagaaatgctaatttagaatccttaatcatcttattctcaatttaaaaaaaaaaaaaaaa

SEQ ID NO: 9594 - DNA, 270 bp, Gossypium hirsutum
  Predicted polypeptide sequence is orthologous to G1150
cctgcgaaccgaagatcattgatatgatattttgatttaaatagtccagtcttctcaatcactaaacagaatttagagcataacattaagagtagtttaaagagggggatgggggaaatgactcctaagcgcttccatttgacttaaaacttattattacaacactaactgttacatttttggctcaattattgattgctcattcccaccgccactatctcctcatactctatctcaccctaaaccaaacataatatataaatttgactt

SEQ ID NO: 9595 - DNA, 550 bp, Gossypium hirsutum
  Predicted polypeptide sequence is orthologous to G1198, G1806, G558
acgtataattctttggcttccaaacaatataaatacaaaacaagaaaatctaactttgctgacctaaaattattcttgatacacagcaataaggattcatacttacatgtctcatgctcaggaagaatataagcttatatatatttattgatgtttcatacaacaagacccgcaaaagaccattttcttactggttgaggaacaaacttctggcgtctgcaacctagatataatattgatggtagtctaagtttctatcttcacttcagaatttaggaaggttcgcgtggacgtgcagaccaaagtgaactgagagcacgtaaacgatggaagtattcccccaaagcaagtaaacctcgagctgcttgacgggttgttaagattcgagccatctgttgcaaagtctgctggcgaaggtgatcagcctgtttcgggaaagaacacctgcttcacaaagccctctagggcctgcaatttatctattgcagcagctagttcgagctttgtagtttcctgaactcaaaatctgttgctaacactctcgggataa

SEQ ID NO: 9596 - DNA, 932 bp, Gossypium hirsutum
  Predicted polypeptide sequence is orthologous to G1198, G1806, G558
cactgggggtattaaggaagtggaataatgatgaatggatggtagaacagtgagatctagtgcaaaagatgagaaaaaagcagcaaaagggatgccgggttttgactcacaattaccagttaccaacatactttgctcagagagaagcacaatccatccattccctgtttcaaactttgggacattcgaccaatctgttggatttcgcctagaggttgctgttaacctgagtggaaacggcgctgtgtttgattcagcaaaagtaagtcggcaagaagttccttctgattgtgaccttattggcacttcagacaagactccaacttcatttactaattatccatccaccaaccaagttgaatctccgaggttgcagttagaaaaaggtcaagaaacaaacctagtctcaatacctagtggtaatacagaaaactggggagaatccaatatggctgatggtagtccaaagactgacatctctacagatgcagacactgatgaaaaaagtcagaggtttgatagaggaaaatctagtattgttgcggtttctgattctagtgacagatcaaagagtaatttggatcaaaagacacttcgtagacttgctcaaaatcgtgaagctgcaagaaaaagcagattgagaaagaaagcatatgtgcaacaactagagagtagtcgtttaaagttgacacaattagagcaggagcttcagcgggcacggcagcagggtatattcatatcaagctctggagatcaaagccattcgatgggcggaaacggtgccatggcatttgatgtagaatatgcacgatggttggaagagcaaaaccgacaaattaatgagctgagaacggcagtaaattctcatgcaagcgatgcagaacttcgtattattgttgatggtgtaatggctcactatgatgaaattttca

SEQ ID NO: 9597 - DNA, 916 bp, Gossypium hirsutum
  Predicted polypeptide sequence is orthologous to G1198, G1806, G558
caaaagataaaacagaccagaagacattgcgtaggctagctcaaaatcgggaggctgcaagaaaaagccggttaaggaagaaggcgtatgtgcaacagctagagagtagccgactgaaactgactcaacttgagcaagaactgcagcgagctcgtcaacagggtatattcatttcaagcacgggagatcaatctcattcgatgagtggaaatggtgccttggcatttgacgttgagtattcacggtggctagaggagcacaataagcatataaacgagttgagggctgcagtcaattcacatgctggtgacgccgaacttcgcactattgtcgacagcgtcacagctcattttgatgacattttccgtttgaaaggtattgctgcaaaagctgatgttttccatatcttatcgggaatgtggaaaacaccagcagagcggtgttttctgtggataggtggcttccgttcatccgagctccttaagcttcttgcaagtcagttggagcctctaactgagcaacagtttatgggtatccaaaacttgcagcaatcatcccagcaggccgaagatgctttgtcacaagggatggaagcattacaacaatccttggccgagacattggccaatggctcacctgctccctcgggaccatctgggaatgtggcaaattatatgggccaaatggcaatggccatgggaaagctaggaaccctcgaagggttccttcgtcaggccgataatctacgccagcagacacttcaacagatgcaccggatcttgacgactcggcaatcagctcgtgcccttcttgcaataaacgactatttctctcggctccgagctctgagttctctctggctggctagacctcgcgagtgagaagcaagataataaaatccatctcctatgaacaa

SEQ ID NO: 9598 - DNA, 982 bp, Gossypium hirsutum
  Predicted polypeptide sequence is orthologous to G1228
atttattacttgtattgatttgttagcttcaatatatggaatgttggtaactgagagagggacacagaaggagaaaaagaaagaatttaaggcatttacttcaactactgctaagctgttatggagaggctccaaggacccattaatccttatgaaaatactaacctctgctactgcactactgcttcttcttactctttcaacattctactctcattctgctttcattctctctttagatgctgagagagactgaaccatgtgccctccacccaattaaatgatattttccttttcaaatatctttacatggagagcatttggaggtggaatgcttagaacaaggttttattagctgtgagagattaaagcttggagaagaagaagaagaagcacacttttcaataccaagctttgaagagaaaatgccattccttcagatgcttcagagcgtggagtctcctcagctttttgcctttaaagaacccaacttccagacacttttgagactgcaacacatgaagccttgggagctaaacaacaatcctttcattcctgaaatggaaacccaagttcaagccctagagctggaaagttgtgtcacccatgaaacagtactcgacttacattcaccagtcaaatccgagaccaaagagcttaagaaaagcccaccttcaagctcatgcgttgaagttctcagctctaggtctaaccaacaccaaccaaagtctgacaattgtagcagagaacccaacttgggctcctcgcctcagaagattttcacaaagtcccctccgattactagagaacgaagaaagcgaaaacgaacgaaggcagccaagaataaagaagaagttgaaagccaacgcatgacccacattgccgttgaacgaaaccgtagacgtcaaatgaacgattatctaaattctctccgctctctcatgcctccatgttatatccaaagaggtgaccaagcgtcaat

SEQ ID NO: 9599 - DNA, 835 bp, Gossypium hirsutum
  Predicted polypeptide sequence is orthologous to G1272
gcggccgcttcgaccaaaagagcaaaccattgaccatatttatcacagtataaaaccaaacaggaaaaagccacaaaagccactgcagaagtgagcttagctagacaaccgttcataagttcagataacatacggaacacctaagagtgttgcaacccaaaagtctaaagacatgaaaaagcagcataaatagtttttggtagccaaaatccaaaagccctatacaaaaacatggttcaacggttttcagcagaagaacatggagctgctgacattatccttcaacctgggaagctgaggtacagaaatggctcccggagcagtcaccccaccatggctcgatgatgtctctgaagcatcctcaaacttcataaattgccccaactgtgaagctgccaaatgagcgtagcaaataggggccacaacagatatggctgtggtgctcctttgatacacgtaggatagagaatgaacaagctcctgcagatcatcagctgaaaacccaacctggtctaagagaacatgatagtgggtcggccttgtggtccctatcattccagcatgagcacaaaggtaaaaatcattgttcttcggatggcatactttgttgtcaattacagtaccaggtaaaacattgtcaggagatccctgctggaaaaacttggtatgatggtttttttgtgcaacaataaccacaaacttagggttccaattctcgtcaaggaacttgcaagcctcaataacttgatcaagttctttgttcaaaacttgattgaactgagactcgctaaccccatccctgaaaataatgatctgatcaggcttcctcttccct

SEQ ID NO: 9600 - DNA, 969 bp, Gossypium hirsutum
  Predicted polypeptide sequence is orthologous to G1272
cttgaggatgttacatctaacagaaacaacgggaatgcaagccctgatgtccatgatgactcaaatgggcaagacaggaagaggattaaacggccttatcagtcaaagacctttaaagtggagatcagctttgctgcaaagattcccatgcaagccattcaaaatgctctgcgtggacaggaatcagaaaactcacaagaagccctaagggtgttggatatcattttacggcagcatgctgcaaaacagggatgtctacttgttcgccagtcattctttcaaaataatcctgataattttacagacattggaggtggtgtcctaggctgcaggggtttccattctagcttcagagcctctcaagggggcctttccctgaatattgatgtctcaactaccatgataattcgtcctggtccggttgtggactttttgcttgccaatcagaatgccagagatccgtactccctggactggaccaaggctaaacgaagccttaagaacctgaggataaaagtcagtccatccaatcaggagtacaagatcactggattgagcgagcagttgtgcaaagatcagttgttttcattgaagcagaaaagcatgaagaatgataatggtgaagctgagaatctacagattactgtctatgattattttgtcaaccatcgcaacatacagttgcgctattctgcagacctgccatgcattaatgtcggaaagccaaaacggccgacatatattcctttggagctctgttccctggtgtctttgcaacgttacaccaaagcgctaaccactttccagagagcttctttggttgaaaaatcaagacagaagcctcacgaaagaatgacagtcttatccagtgctttacagagaagcaactatggtgctgagccaatgctgcgttcttgtggtgtttctatcagcactaatttcacccaagtcgaaggtcgtgttctgcca

SEQ ID NO: 9601 - DNA, 872 bp, Gossypium hirsutum
  Predicted polypeptide sequence is orthologous to G1274, G1275
gcggccccttcgaccaaaactctatcaaagaccaaaagtccagattttccttaaaaatggacttttctcatcaaaaccctaactctaaccctaattacactttcttccctgaaaacgtcaatcccatgcccgattttgaggtctccgattatctcgatcttgacggcagtatcttcgacgacgatacatcgtcggagaaaggcatggctgcagctactgaacttagtggtgcaacatcaaaaaatagtaacagaaaatgcaaaaatggagtggggaaaaacaaatcggaactgggggtacgagttgcgtttagaatgaaatcagagatggaggtgaccgatgatggatacaaatggaggaaatatgggaaaaaatccatcaagaacagccccaatccaagtgtaggatgcaatgtgaagaagaggatagaaagggacgtaaaggaccaaagttatgtggtaactacatatgaaggagttcacaatcatgagaccccatccatggtttactacaaccaaatgtccattatggctcctaatgcttggacctttcaagcttctcctccttcttcttcttctacatgaaaagaaaacttatatacatacatacatacatatatatatattatccttagaattatatatctgcttctttgccttatggtgttgcctaaaatggtgagctattactttttagttgacactaattttcccactatgcattttccgggctgacttagttaaaatacagtcgggccaaagctagtggattgactatccgtcgtctttgttgtaatttccatctctgttaattatcaaaactcagaactactttctctttcttttttttaaatgggatatattaataataaa

SEQ ID NO: 9602 - DNA, 547 bp, Gossypium hirsutum
  Predicted polypeptide sequence is orthologous to G1274, G1275
tcggcagagattcagacaagtctgaggttgaaatactggatgcatgggtacaggtggaggaaatatgggaagaaaatggtgaagaacagcccaaatccaaggaactactacaaatgtttgattgaaggatgccctgtgaagaaaagagttgaaagagatagagaggatccaagttatgtcattacaacttatgaggggatccataatcactaaagtgtatcttgaatcagtggttttgtttttgaccactacctaagtccggcagaagggccaacatcgatgatcgcatcagctgcatgatacttgagtcatgcattatgattaagaaacataaagatgatatcggaaaagccgaggttggttttattcatgtatgcatctttaaatttggccaactttattttgttcttgttttggttatgtacataatttgttggcttgtagaaccctgagtttcaactgatgtcttaagttgaaacacagggtatttactgaggttttaactgtttgatccagttttgtttaagagtaaaaaaaaaaaaaaaaa

SEQ ID NO: 9603 - DNA, 429 bp, Gossypium hirsutum
  misc_feature (117)..(117): n is a, c, g, or t
  Predicted polypeptide sequence is orthologous to G1335
tgaaactaaactttattattctgatgtatagtttgattgaacggtattgatacagaattgacttccttgaacaaattgatgataattaggggcttccctccccccctccttcccatnccttataccaaattcttccattagagcaaataactttacaaaaagtgcccattacaactattttaaaacatcacaatataactaacatttaaaagctttaataatccttggaaatactcaaaaacctaacaatacttcataatagactgcagggattaaggctcaacggttattgccaggacattcccgggcaaagtgaccggcgacaccacagttgtaacaagccaacccaccgtatccaactccgcacccccatatcttccaccaccgccgccgctgccaccttgtccacagtcccttgccaacaggaca

SEQ ID NO: 9604 - DNA, 700 bp, Gossypium hirsutum
  Predicted polypeptide sequence is orthologous to G1335
catttctgtggtttgtgagtgttgttttgggattttgaagatgggtgagaataggatgaccggcaaggtgaagtggttcgatgaccaaaagggttatggcttcatatcccctgacgacggcggcgacgatttgtttgttcaccagtcttccatccgttccgagggtttccgtagccttgctgatggtgaagaggtcgagtacgttgtcgagtcttctgaaggtcgccccaaggctattgaggtcactggccccaacggcaaccctgttcgtggatcatctagatccggacgcggtggcggtggtggtggtggttatggcggttatggcggtggatccggtggttatggtggagggggaaggagaggcggttatggtggaggaggcggtggtggaggcgccggatgttataagtgtggtgagatgggccatttagcacgggactgtgggcagggtagcggtggcggtggaggcagatatggcggcggagggggcggaggaggcggcggtgcttgttacaactgtggaggctctgggcatttcgctagggagtgtcccaacagtggtcgctaattttgaggggggatttaaatgtgtcattcgcatctcctccgatccatccttttttcctcttccgctactgtttgtgtcggtttcgttattatcgtatggtttgctttttatgttttccttttccagttt

SEQ ID NO: 9605 - DNA, 973 bp, Gossypium hirsutum
  Predicted polypeptide sequence is orthologous to G1341
ccattcgcacaagcagccactactgcttctcgttcagtcactgaagaagagtgggaagctgctacttctacatccgaaacggctgtcaccgccgttactggagctgcaaaagcggtaacgccgccttcgagtggtagtgagctagccatggttgtttgtaggaacagtaaagaactagtggagattgttaaagaagttgatgaatatttccttaaagctgctgatgccggtagccatctttcattactgttagaagcttcaaatcccaatctttcaggcaaagggtataataactatgcctgtaacttaaccccaacaacatggacatggaattggagccccaaaatagtggaaaacaccattgttggacatacaggaaatactagccattgttccaccatagagaggttatatgcttgggagaagaaactataccaggaagtcaagattgatgtgcatgtggagaagcatgtatgagatccaccaagttcacacacacatagttcaacaactcaagtaccttaatttcatcccttctaacgagccgacatccgagattcaccggcaatcaactctccagctcgaactcgaagtccagcaatggcatttgtctttctgcaacttagtcaaagctcaacgagactacattcagtcccttgctggttggcttcggcttagccttttccagttcagcaaaaacccgcttttaagaaacagtcaagaatcgaaaatttactctttttgcgaagagtggcatcttgcagtcgataggattccggataaagtagcgtctgagggaatcaagagcttcttgatggtaatccacgccatcgtagttcaacaagccgaggagtataagcaaaagaagaacgcagattctgcgtttaaagacttagagaagaagcagctgaacttagatcactcgaaagtaagtacagccctttttctgtactggaaacaaacaaagacccca

SEQ ID NO: 9606 - DNA, 2445 bp, Gossypium hirsutum
  Predicted polypeptide sequence is orthologous to G1341
gggattttcatgttcgaagaagctttgtttgctgtgaaagatagtttcttgaagatgaaagaccctccattggtgaaagctgcagtggtaaaagcaatagatctttagactaagtaaaattaactcacagctcattttgtttccctctttactgtttagttgcttcaaattttagaaaaaaaaagttgatctgtggcagaagggtgaagcaagaaaaaaaatggggtgttggtactcaaggatcgatagggaagagattgtttcgcgttgcaaggcgagaaagagatacatgaaacagttagttaaagcaagacaaactcttggtgcttcacattctatgtatctacgctctttacgaggcacaggctcagctcttcttcagttttccagcaatgaaactactacccactcccaccaccatactactccgccgcctcaacagccggcattgccgccgccaatgagtcctagttcagacacttggacatctgctaacacggcctcccctgttctgccgccgccttctcctcctcaatccagtaactgggacttttgggatccatttgttccagctacagagtcacggtcagccacagaggaggaatgggaggcttccacgtcagtgcctgaggtggcggtcaccgctacaaaccccacgaccagggctgcaagcatggcaccgcccccttctgtggtgagtgggttctcgaaagatacgggaagtgagcttgctatggtggtgtcgaggaatagtaaagaactggtggagatcgtgaaagaggtcgatgagtattttattaaagctgctgatgctggtagccagctctcgttgctgttagaagtttcaaattccaattttcctgctcaaagtaaaatgagttatttctctctcattcttttccttttctttttccctcttaacatttctgggtggggttttttttttttccttgttgcaggtaaagtgtataactatggttgtaatctgactccaacaacttgggcatggaatcgaaattcaaaaatggaaggaactgggaagttgggaggcgataggacgggagaaaatggaaatgtaggtggtactattcttaacagtagccattcttctactatagagagattgtatgcttgggagaagaaattatacgaagaggtcaagactgtggagactataaggatggaacatgagaagcgggtggcccaattgaggaagctggagttgaagagagctgactatgtcaagaatgaaaagactaagaaagaggttgaaaaattagaatcccaaatgatggtttcttcacaggccattgagaccatatcagcggaaatcatcaaactgagagaggcagagctttatcctcaactcctggaccttgtaaacgggttgatgtggatgtggagaagcatgtacgaaattcaccaagttcacacacacatagttcagcagctcaagtaccttaactttatgccttctaacgagccaacatctgagattcacaagcaatcaactctccagctcgagcttgaagtccagcagtggcattcttctttctgcaacttagtcaaggctcaacgagactacattcagtccctagcaggttggctccggcttagccttttccagttcagcaaagacccacttttaagaaacaatgaggaatcgaaaatttactctttttgtgaagaatggcatcttgcaattgacagaattccagataaggtagcgtctgaaggaatcaagagcttcttgacagtaatccatgccatcgtggtccagcaagcagaagagtataagcaaaaaaagaaggcagattctgctttgaaagattttgagaagaaggcagcagaacttagatcactggaaagtaagtatggcccattttcctccatgcctgaaatgaacaagtaccctgttgtagaaaaacgaacaaaggtggaaatgttgagagcaaaggctgaagaggagaagaataaacatgagaagtcagcgagtgtaacaagagcaatgactttaaacaacctccaaatggggtttcctcatgtcttccaggcaatggtaggatattcaagtgtatgtatgcaagcatttgaatctgtctacaatcaagccaacggtattgatcaggaacatgatgtgaagagaatacttccttgagaaaagactaacactctggaatcaaaatgatgctaccactgatacgtgttcggtattgggatcaaagtccagacacggaagaaaattccagtcaagtaggagtgtagaattgtataccttgttttatttcgtcattggaaagtgttgaatgctttgcaagtttctgtttaaaacccttttttgtttgccttttgaatcatgaaattatgttttggtaatgaattgctctgagagcaaccaagtgaagcacttgtattgcttgagattaaaaaaaaaaaaaaaaaaaa

SEQ ID NO: 9607 - DNA, 665 bp, Gossypium hirsutum
  misc_feature (490)..(490): n is a, c, g, or t
  misc_feature (502)..(502): n is a, c, g, or t
  Predicted polypeptide sequence is orthologous to G1364, G481, G482, G485
cccgtctctcccgcccttttttttcctttttatttttttatatataatatatatatttcaattttcatttctactaagggttttgtccatggcggaagcactggcaccggcgagtcccggcggaggaagccacgagagtggcgagcagagcccgaaatcgaatgtgcgagaacaggatcggtttctacctatagctaatatcagccgtattatgaagaaggctcttcctgctaacggcaagatcgctaaagatgctaaggagactgtacaagagtgcgtctctgagtttatcagcttcatcactagcgaagctagtgataagtgtctgagagagaagaggaagactattaatggggatgatctgctctgggctatggcgactttagggtttgaggattacattgatccgcttaggatttacctttcccgatacaaagagatggagggtgatgctaagggctcggctaaaggtggagatgcctctgctaanaaagatgtccanccaggcccaaatggccagcttgttcatcaaggttcattctcaccaggtgttttttatgggaattctcaagcccctctgatgcttcccattcaaggcgctgattaatgaatcctgatcaccgttctccaattcccttatctataccccgtaattatcctgttcc

SEQ ID NO: 9608 - DNA, 843 bp, Gossypium hirsutum
  Predicted polypeptide sequence is orthologous to G1364, G481, G482, G485
gtttctctttgttaaaagaataatttagtacaaagaattttttttatttgaggtttttgtatggatggtgtgtgaactgatggatagttgcattttggttatgttatatatatatataaatatgcatttggtttcactttacttgctaaaacttttataaaaaattgatggatactaatatgtttcattttcattttcccagtgatctaaggtcattcaaggacatggcggatggtatggcaagggggccaacgagtccagcaggagggagtcatgagagtggagagcagtgcagttctcactcaactgtgagggaacaagaccgttaccttccaattgccaatataagcagaatcatgaagagagcattgcctactaatggcaaaattgctaaggatgctaaagaaactgttcaagaatgtgtttctgagttcatcagcttcatcactagcgaggctagcgataaatgccagaaagagaagaggaagacaattaatggagatgatttgttgtgggcaatggcaacattaggctttgaagactatattgagccacttaaaatatatctggccaggtacagagagttggagggtgatgctaagggatcaatcaggggtgaagtgcctcttaaaagagatgcagttcgagttcttgctgtccccaacccacaggtgaaacaatgatatttactttagattcttgttcttggcctaaatttgatacacttggctgtttgtttaagcattctgtaaagtcctgaactgaattaccatgtctcttgtgcattggtggtgaatgaatcctgcagtttcctatcgaaggatcattgaactatattaattc

SEQ ID NO: 9609 - DNA, 700 bp, Gossypium hirsutum
  Predicted polypeptide sequence is orthologous to G1364, G481, G482, G485
catcagatctgatctgagtcattgtctttttcctttcttctccagcgtccgattttcccttgaaaatccaatctctttcactcccgcccttttccatttttcgttttaatcaatttcaattttttccccactttctggattctttacatggcgacgtcggcaccggttccggcgagtccaggtggcggtggaagtcatgagagcggcggcgagcaaagcccgagatccaacgtgcgagaacaagagaggtttctccctatcgctaacattagccgtatcatgaagaaagctctccctgctaacgctaagatcgctaaagatgctaaggagaccgtacaagagtgcgtttcggagttcatcagcttcatcactagcgaagccagcgacaagtgccagaaggagaagaggaagacaattaacggggacgatcttctctgggctatggcaactttagggtttgaagattacatcgatccgcttaagatttaccttaccaaatatagagagatggagggtgatacaaagggttcggttaacggtggagatacatttgctaagaaagatgtccaaccagagtcaaatggccagcttgctcatccacgttcggtctcgcaaggtgtttattttgggaattctcaacccagtcacaagccaattaagtggtttgttccaaaactgaaacgaaacaaatccattgaac

SEQ ID NO: 9610 - DNA, 886 bp, Gossypium hirsutum
  Predicted polypeptide sequence is orthologous to G137, G145
ccctaacacgcgtccgaataaaattactaaaaagagagtcttctcttgtttttccatatatttgctttgaaattcatgaatgaaattttttttacaaaaagggttttctcttgttttttttcatatatttgtttagaaattcatgaatgaaattattaaaataatgggttctctctctctcttttacctttcttttcagttcttaaatcactatataaaacatggccatcttccatctttgttaagcttcttagggttttatttactcttttcagctgaaaatctagtcttttttttaatctttgttgtgattgtgaaaagtttaaaaaaaaaaggagagcaagtttgaaaataaaacagacaaaaacccattggatctttgtaataaaagcaacaagctcaatgttttcttctgatccaatcaagtagtttcagatgtcatttatcaaatcaagcagcgaagacaaacaagacattttacatgatcaaaacattggagaggtaccaaaaatgcaactatggagctcctgagccaaatgtgtcatcgagggaggctgctttggaattaagcagtcggcaggaatatttgaagcttaaagcacgttacgatgccttacaaaggtcccaaaggaatttactgggagaagatttgggacctttgagcagcaaggaactcgagtcacttgagaaacagcttgattcatcattgaagctaattagatcgacgcggacccaatacatgcttgatcagctcaatgatcttcaaagaaaggaacatcttcttaatgaagccaataagaccctaaaacaaaggttggtggaagggtatcaagtaaattcgttacaattgaatccaaatgcaacggaagacgtcggctatggccgt

SEQ ID NO: 9611 - DNA, 962 bp, Gossypium hirsutum
  Predicted polypeptide sequence is orthologous to G137, G145
gtttgttggggggggcgggggggttaattctgattacttgatggatgaagttgttagcgaaagcgtatcatccatgacagaataaatagagagaaaagcaagaagaagaacaaaagtgttaaagagagagtgtttgggggtattgcaaagataatatttttattggggaaaaaaagaatggggagaggtagggttgagttgaagagaattgagaacaagattaacaggcaagtaacttttgctaagagaaggaatgggcttttgaagaaagcctatgagctttccgttctttgtgatgcagaggttgctctcatcatcttctccaataggggaaaactgtacgagttttgcagtagttcaagcatgatgaaaacattggagaggtaccagaagtgcagccatggagcaccagagacaaatgtttcaactagggaggctctggagctaagcagccagcaggaatatctgaagcttaaagcacgttatgaagccttacaaaggtcccaaaggaatttacttggagaagatctggggcctttgagcagcaaagagcttgagtcacttgagaggcagcttgattcttcattaaagctgataagatcaacgcggacccaatacatgcttgatcagctcactgatctgcaacgaaaggaacatctacttaatgaagctaataagagtctaaaacaaaggttgatggaaggctaccaagtacattcactccagctgaatccaaatgccgatgacgtcggctacggccgacaaccaacccatcagcctcacggtgatgtcttcttcatccattggactgcgagccaacgttacaaatcggatatcagcccgatacgatatcgcggtcacgggtgcccgagtgtgatattacatgacgggatggctaccatgactatgacacataagaaatagagcaaagcatgcagtgcaatgcatgatgcatgcatgca

SEQ ID NO: 9612 - DNA, 948 bp, Gossypium hirsutum
  Predicted polypeptide sequence is orthologous to G1382
gttttcctctttgacaatggaggaacaaatactagcttcttcttcagctgctgctgctgctgctgctgcttctgcttctgcttctgctactcagcacgatctatcggcttcagctgcttctagtggagctcgctacaagctggtggctccggctaagctaccgatctcaaggtcggcttgtattacgatcccgcctgggcttagtccttcttcttttttggagtctcctgttcttctttcagatgttaaggcagagccttcaccgactactggttctctcattaagcctcaggcagtgcatggctctgttaattctagtacatattcagtgactgctgcgtgttctaatgcttttgatgaaagaaatccaagctgctttgagtttagaccccatcctagatcaaatctggcacctgcagatttaaaccatcttagaagcgaacaatctctgcagatccaaggtcaattccagactatatcatataattcatcagctttggttaagagcgagatggcaggctcctcaaatgagttgagtctctcggtaccatttcatacagctacttctgtggctagtgcttctgctgaaatcgatgtagacgaattaaaccagagtgggaactcaaatagtgggatgctgtcagggcagactgatcatagagtaagtggctcatccacgatatcagatgatggatacaactggagaaagtatggacagaaacatgttaaaggaagtgaatttccacgcagttattacaaatgtacacatcctaattgtgaagtgaaaaagctatttgagcgatctcatgatggacagattacggagataatatacaaaggtacacatgatcatcctaaacctcaacctagccgccggtattcttctggaaatacaatgtctgtacagaggaaagatttgacaaggtgccacctttgactggtagagat

SEQ ID NO: 9613 - DNA, 761 bp, Gossypium hirsutum
  misc_feature (535)..(535): n is a, c, g, or t
  misc_feature (554)..(554): n is a, c, g, or t
  misc_feature (595)..(595): n is a, c, g, or t
  Predicted polypeptide sequence is orthologous to G140, G146
attaaatatatactctcaaaacactttgctttctttgggattcgtgattttccgaaagctgaattggccggaactcttaccaaaatacctcaggtacaagtgatcaaagagaatgggaagaggaaaaatagagataaagaggatcgaaaacacaacaaatcgtcaggttaccttttgcaaacgcaggaatggcctgctgaagaaagcttacgaactgtcagtcctctgtgatgctgaagttgctctcattgtcttctccagtcgaggccgtctgtatgagtactccaacaacaacataagatcaacaatagacaggtacaagaaggcttgctcagatacttctaacacaaacactgttactgaaatcaatgctcagtattatcaacaagaatcagccaagttgagacagcagattcaaatgttacagaattctaacaggcacctaatgggagattccttgagttccttaactgtgaaagagttaaagcaggtaaaaaacaggcttgaaagaagaattactaggatcaggtccaanaaacacgaaatgctactanctgaaataaagtttttgcagaaaagggaaatcgaattgganaatgaaagtgtttgtctccgaaccaagattgcagaaattgagaagcttcagcaggcaaacatggtgactggacctgagcttaatgctattcaagctttagcttctcgcaatttctttagccccaatgtcattgagcatccatctgcttactcccatctctctgact

SEQ ID NO: 9614 - DNA, 704 bp, Gossypium hirsutum
  Predicted polypeptide sequence is orthologous to G140, G146
aatacaaaaataaacctttcctgcaataaaacagttaaaaaggagtccagtgctgaaacctaagttccttacattcatcataatcaacaactaggctttcaactgtttataaaccatatataaatatatatatatatacttgcatggcttataagatatatatatatgcttaaccagagataaagttggtagaacattagaggctgctgcttgcatgtcagcttgaatagatggaggtggaagagagaagcttatacaagttgaagaggagtttggtcttggttggagtaatcattattactgggttccagcaggtttactggcagaaagttgcgattgtaggaggaggctgcttgcatcagctggtttgattgttgttgcgctctttcattttcagctatctgcatccatacagccatgcatctattttaatcatgatcaacacccaacatctccatctatagttgaaattcattaggcagagaggcttacttttgctcgcaggtacatgttatcgttctgcagttcaacttcctagaaattatatacccattttacagctgttaataattaagacgacgacctttatgctatcactcatatcttgtatagtgtctaacaaactaaagattctgaagatgaaactacaatggggtttgaggatatcaaagtatacaatcccggacgcgtgggcggacgcgtgg

SEQ ID NO: 9615 - DNA, 763 bp, Gossypium hirsutum
  Predicted polypeptide sequence is orthologous to G140, G146
tcaagttaggaagcatggtgtaccccaatgaatcccttgaagactctccccagaagaaaatggggagaggaaagatcgagatcaagcggatcgaaaacacgacgaaccgccaagttaccttttgtaagaggcgcaatggtttgctcaaaaaggcttatgagctatcggttctttgtgatgctgaggttgctttggttgccttctctagccgtggtcgactctatgagtatgctaacaatagtgttaaagcaacaattgagaggtataaaaaggcttctgattcctccaatactggatcagttgctgaagttaatgctcagttctatcagcaagaagctgacaaactccgaaatcaaatccggaatttgcagaatgcaaacaggcatatgctgggagagtccatagggggattgcctatgaaagagcttaagagcttggagagtcgtttagaaaaaggaattagcagaatccgttccaaaaagaatgagctgttgtttgctgaaattgagtatatgcagaaaagggaaattgacttgcataacaataaccaacttcttcgagccaagatagctgagaacgagaggaagcagcagagcatgaatttgatgcccggaggttcaagtgctaacttcgaggccctacattctcaaccatatgactctcggaactacttccaagtcgatgctttacaacccgccaccaattattataaccctcagctgcagcaagaccagatagctcttcactagtctaatgttatggg

SEQ ID NO: 9616 - DNA, 660 bp, Gossypium hirsutum
  Predicted polypeptide sequence is orthologous to G140, G146
atgatcacgcgtgcggcgtctaactatgatcccgggtgaggaatcggacgaggaacctttggccttctttggaattgaattttccgaaagctgaagtggccggaactgtggcctaacctcagtaggaatatataaaagggtgaagatgggaagaggaaagatagagataaagaggatcgagaacaccacgaatcgtcaggttacgttttgcaagcgcaggaatgggctgctgaagaaagcatacgagctgtcagtcctttgtgatgcagaagttgctcttatcgtcttctccacccgtggccgcctctacgagtactccaacaacaacataagatcaacaatagagaggtacaagaaggcatgttccggtacctcaaacacaaataccgtcacggaaatcaatgctcagtattatcaacaagaatcagccaagttgaggcagcagattcaaatgctacagaattctagcaggcatctaatgggagattcgttgagttccttgacagtgaaggagttaaagcagctagagaatagacttgaacgagggattactagaatcagatcaaagaagcacgaaatgctgctagctgaaattgaatatattcagaaaagggaagttgagctggaaaatgaaagtgtatgtctccgagctaagattgc

SEQ ID NO: 9617 - DNA, 822 bp, Gossypium hirsutum
  Predicted polypeptide sequence is orthologous to G1419, G43
ttttttttctgtaaaaataaaataataatttcattaaataaacaaatcaagaaacaaatacaattttaattaaataaaaaaccttaggctttggcattctctagtttatatacactaataatactcatactaatccaaaacacacacctcttcattaatccatttcttgacggccgttaacttttttccgtttatagtagatgattcaagccgtcacgtcaaccaacctttccttatttagtaaacgacaccaccatctttacataacggcgagtcctgaaatagaataaccgaacggagataaaggtgataatggaggaatactaaatattcccttcatatcttcactatcccaaaaccctttccaatttgacggcgtcaaacatactcccgtcgtcgttacgttttccgttatctcttcctttttcactactttcctctcttgttcttcttcttctctttttcttttattcgagggttgggattcagttgagttcgagtttccgatttcgagagggaaattcaaaattgctttacttccacgtagcttaaaagcagctctatcataagctttagcggcttcgatagcggtttcgaaagttccgagccaaattctagaaccttttcgattagggtctctaatttcggctgcgaactttccccatggtcgtcttcttacacccctgtaatgccttttctcgtcatgttcctcgatggctttcgtggcggtggaggttatttcaactttcgatggtggaattgtgacgttaatagaaggtcgacgttggcttagggtggattgtttatgaaactggggtcgac

SEQ ID NO: 9618 - DNA, 823 bp, Gossypium hirsutum
  Predicted polypeptide sequence is orthologous to G1419, G43
gcggccgcgtcgaccgcggccgcgtcgacatgacatcttctgaagaaacattagccttggaactcattcgaaaacatcttcttactgactttgcttccatggattcttttcttgccagtcttcatcatatagtggaaaccccacaattctctcaacttcatagccccaatcagatgaaacattctactctaagccaacgccgtcctgctataaacgtcgccattcccgcaccgaaagtgaacgtaagcgacgagcagaggcattacaggggtgttaggagacgaccttggggtaaatatgcagctgaaattagagaccccaacagaaaaggtgcgagggtttggctgggaacctttgataccgccattgaagctgctaaagcttatgatgaagctgcgtttaagcttcgtggaagtaaagctatattgaattttcctcttgaagctggaaaatcaagttcaacccactctgaattaagtaaagcttgtataaaaagaaaaagagaggaagaagaagaagaagggagagtggagagtaaagtagtgaaaagagaggagaagggaagtgtgacgccgggagtatgtttaacgccgtcaaattggacggggttttgggatagtgaagatatgaagggaatattcagtatccctcccttatctccgttatctccgtttgggtattccgggcttgcggttatgtgaaagtgaaacgcttttgatgggtttttggacgccgttaactaaaatcaggaatggttggctgacgtggctagttcaagttgtatcattagtgtacattgccttttgttttatttataacattc

SEQ ID NO: 9619 - DNA, 909 bp, Gossypium hirsutum
  Predicted polypeptide sequence is orthologous to G1419, G43
gaaaaaatttcaaattttttattatggaagcaagcagtgaagtaacaagtgcgcttcaatatatcaagcaatatttactcggtgagttttctccagtgggattagggagtgtttcaagtgaaaatcagtggttacctcagtcgaaacctcgagtttcgagctctggatctgaatctcatttgagctccgattcgtcttttacagtatcaaattttaattgcctcgacgatgatgatgatttctttcaattccctaccgatttccctggattccaatttgaatcaaaacctcaaattatcgatctgacgacacctaaatccctctcatcaaacgccggtgctttcgaatttgaagtcaaacctcagatcgctcaaatttcaacgacgaaacataaagtttcttcgaattcgagctctcagaatcggaaacggtcgctgaaaatctcgttgccgcataaaatggagcagattcagttcggtaaaacggatttagctcaggcggagccgaaagtctcaaattccgaagacaagaagcattatagaggagtccgacaaaggccgtgggggaagttcgcggccgaaatccgagatccgacccgacgaggttctaggatgtggctaggaaccttcgaaacggccatcgaagccgcgaaggcttacgaccgagcagctttcaagctacgtggctcgaaagcgatccttaatttccctctcgaagccgggacgtcggatacacgcgccgacgactgggagaggaagcggagcagagatgacggcgaaagagaagagaggcaagtaaaggtagtgaagagagaaaaggacgatgaggtgacaagaacgagagagaacggcgaagtacctttaacgccgtcaaattggaacggctttttgggttgggaataacgaccaa

SEQ ID NO: 9620 - DNA, 938 bp, Gossypium hirsutum
  Predicted polypeptide sequence is orthologous to G1419, G43
caaacccacaaacaaaaaaaatccttatcttctcattttctctcttgttttcagtttttggatatggaaagtagcagtgaagtgtcgagcaggcttcaatatattgaacaatatttacttgatgaaaatcaatttcctcctgtgggattgtggagcttttcaaatgaaaatcaatggacaaattatccgaaatccgaggtttccacctctcaatctcactctctttactctcaaacttccacctctgattcctgtcttacagcatccaattttaatagccttgacgaagatgatttcttcaacttctctaccaatttcccaggtttcgagtctaaccaaagtgatgttttcgaatttgactccaaacctcaatttatccatctcaccacgcctaagcctctcgcttccgacgccactgcttgtgaattccaagtgaaatctcgatcttcttcgaattcgactcccaattctcagagtcgaaaaccttcgctgaaaatctcgttgccgcataaagtggagtggattcagttcgggaaaccggatttaaccgaggtaaagccgaagaattcaaataccgaagagagaagtaagcattacagaggagtccgacaaaggccgtggggaaagttcgcagccgagatccgagatcctaaccgaaaaggttcacgggtctggttgggaacttttgacgccgccatagaagccgcaaaggcttacgaccgagccgcctttaagttacgtggctcaaaagcgattcttaacttccctctcgaagctgggaagttggatgtaatcgccgctgacggagagaggaaacggagcagagacgacggcgctggggatgagagagaagttaaagccgtgaagagagtaaatgatgatgtgactaaagcgagagataacggcgatgcgcctttaacgccgtcaaattggacatc

SEQ ID NO: 9621 - DNA, 888 bp, Gossypium hirsutum
  Predicted polypeptide sequence is orthologous to G1419, G43
tccccccaaggtgagtcccacatttgaaaaagctgtcaatttccatggcgatgggatagggagattttgatcttcactgtataaatagatcctcactcactcccacatttcaacttcatatccaatttcatcatatacaaattccttgtaaactttaacaatgccggctacatttgaagaatcaacaactctcgagttcattcgacaacaccttctcggtgactttgccaccgtcgatgctttcataaacaccctcgattttggcctttctcaccttcaaccccaaagccatcaactccctgaaatcttcacccatggtgtagaaccagcgccgataacaaaggagccattctgtgaagagaaaaggcattatagaggtgtacgaagaaggccatggggaaagtttgcggcggagatccgtgacccgaaccggaaagggattcgggtatggttagggacttatgatagtgatgtcgatgctgctaaggcttatgattgtgctgcgtttaaaatgaggggtcagaaagcaatactgaattttccacttgaagccggagagggaagccagccaccggcggttactaccgggaggaaaaggaggagagagaagagagtttggttgccggaaagtgacatcacatcgccgggaagtagtgaaatggcttgggaggtgaaggaagaagagggtgagcttgatgatgatgatcggaatggactgtctctcttaactagaaaacgtgttatagtgacatgttagataatgtattaaatgcccaaatgtattttataataacgtaatcaatattactaaatagtaattacgggagttagatgagatagtaaatgcttttcctcccttaaaaaaaaaaaaaaaaaaaaaaaaaaaaa

SEQ ID NO: 9622 - DNA, 627 bp, Gossypium hirsutum
  Predicted polypeptide sequence is orthologous to G1421, G1750, G440
gtcccactgagaagaatatcgttgagagaagtaaaacgacgtcgtcgttgtcaaaagcttctcggaaacggccggcggctgttgctgaagctaaaggtaaagcgccggcgaaagcaccggctggaaagaagttcagaggagtgaggcaacgaccttggggaaaatgggcggccgaaataagagatcctcttagacgtgtacggctttggttaggcacctatgacactgccgaagaggcggcaatggtttatgacaacgcggcaattcagctgcgtggaccggacgcgcttacaaactttacaactccccaacaaaaatcgattcaagaaaaaaccagccaaaaaccgttatccaactccgattataactccgacgaagaatctcataaaacagatccctgctcaccgacttccgttcttcgctgccattcgctttcccgtcgatgaagccgactctcaaagcgccaaagaatcgcgcgaaatcggaagcgaagctcgagatgttgtcgatgattcttgctgcttatcgggagaaaacctgtcgggtttctccgactattcctctttgttttccggcgacatgtttttgttcagtgcccgacttttttgacgatgatacgagtttaca

SEQ ID NO: 9623 - DNA, 781 bp, Gossypium hirsutum
  misc_feature (207)..(207): n is a, c, g, or t
  Predicted polypeptide sequence is orthologous to G1435
gcacgagcctatctggaatcagatattgcactttgccttttctcttcggtttccttattttccttctaccctcttacttcccaaacagcccccgatttccacgcaaatatttgaaaatctctacagtttttactctttcatttccgatccaaacaatcatctctgaaaagtcatttcttattatttttaaatccctattttcaaggncaaaagcaataaatatgggtcaagaagtgaagatgagggactttgaagctaacggcggagacgatgaagaagcaaccgcaaacgccatcaccaccatcgttgatgacgacgacgacgatgttgaagaaagagttatcgaatgggagatgggattacctaactgcgatgatttaactccattatcccaatccttaatcccgccggaacttgcctccgctttcagcatctcgccggagcctcgtcggaccactgttgatgtcaaccgcgcttctcgcaatactctctcttctctccgctctaccggggcccactcctcaaccaccaataacaataacagtaatagcaatttccgtgatacgatagtggttgaagcggaaggatatgggtcggggtcgggctccggatctgacccgaagaagatgaggaagatggatattgcagaggaagcggattcagcggttaggacgacggagaactcggacgatccgtcggggaggacattgaaacgacagcgtttagtgtggacgccgcagctgcacaagagattcgttgatgtggtggctcatctagggat

SEQ ID NO: 9624 - DNA, 822 bp, Gossypium hirsutum
  Predicted polypeptide sequence is orthologous to G1451
cacatagtttcatgtagttattgtaacttttattctagctaacaaaaagtgagaatcatacatatggtaggtatttataaattcagtgatttttataaaaagaaaacagaaggagctttaattctggtggaaccatttaagatctaacaatgaatccataagatatggaattcagaaccacacaagattcatgttcttgacattattaacacccatataaactctgcaatatttatgtctaatttctggcaatctgaagtccaaggaagaagagtaacctgctcaccgtggccttgaggaaaatacatcactcgactatcgatcgcaggcaatgaaacaagagagccggcacatgcatgccacaactcagaattcaggcacttgtgctcttcaacttgtgaaaaaggcaaaaacatttgagcataagacataactgaatgaagtttacaaataatctcataaattgagtggtagttgtagatctacaaagcatcttacaaacaaatcctagttcatgaaatggtactaagaaagtattattatgagcagaatggaaaggttttttagtataaaatggatataattgttaacaaaaaacatgtttctagaaaagaaattttctgaacagagtctgcatcaagaacctcatatttcattactaatttgcttacgctgaattagacaaagtgctgaacaagaataaaaacaattgcaaaacatgtcaacggcttaataaatcacccaacagaagagtgaggcaagctcagagcccaccacattggatcaaataatgaccgaggaatttaaatcaagaggcagaag

SEQ ID NO: 9625 - DNA, 731 bp, Gossypium hirsutum
  Predicted polypeptide sequence is orthologous to G1451
catgctagctgggcagttaacaccgcggtcctgggctccgaagtatacccattcagaggtaaatgcctttggtagctctacatcacttccacaagtgtttcctggaaaagatgctgtaatagagccagatattggcaactctggtgcccagaattctgctctttttggtaataacaattcatatggccttctgcttcctacaatgatgcctgctattgcaacatcttcatgtgaagctgatgtgccctcaattccattaggggactcctcattccagaatcctctgtatggttgcatgcaagactcttcagagctgtagagcagagggcaagttgacccaccaaccccaactccaacatttgtcaaggtttataaatcagggtcagtgggacgctcgttagacatctccaggttcagcagttaccatgaactgcgagaggagctggctcagatgtttggaattgaggggaagttggaagaccctttaagatcaggctggcagcctgtatttgtcgacagggagaatgatattcttctccttggagacgacccatgggaggcatttgtgaataatgtttggtacataaagatactttcaccagaggatgtgcagaagatgggcgagcaacgggcagagccttttagccccacaaccccaggtcaaagaatgaatagcaccggcactgacaccggcactggtagactctcatctgttggttcccttgaatact

SEQ ID NO: 9626 - DNA, 521 bp, Gossypium hirsutum
  misc_feature (15)..(15): n is a, c, g, or t
  misc_feature (29)..(29): n is a, c, g, or t
  Predicted polypeptide sequence is orthologous to G1451
cgatattcttctccnttggtgatgacccnatggcaggaattcgtgaacactgtgtggtatatcaagatactatccccacttgaagtacagcaaatggggaaaggtcagaatcctgctacttctattccgaaccaaaggcttaacgccaccaccaccgctaccaccagcagcagcaatggcaaccactgcggtgactacatgagcagacaggacttgagaagttctgttgcatcaatggggtctcttgaatactaaatgaaaatcctcaggactgaataaagtttttgatgaattgaaaatggaaagttgaaggagataaatcattaacgttgtaggtgttatatggtactgttagtaatatgtaagcatatgtattgatacaacatcaatttaagatttacccttactgcctgggacctaggttgatattgaagcttttatgtcaagaccactactgtactgttgggaaaattataagtggaaatatgattctccgactcaaaaaaaaaaaaaaaaaaaaa

SEQ ID NO: 9627 - DNA, 926 bp, Gossypium hirsutum
  Predicted polypeptide sequence is orthologous to G1474
cccttttcttttcaccccgtattgtaatggagcaaggaaggtattggatgtggacaaagaggagacatggtttgacttctcatcatcatcatcatcatcatcatcatcatcatgttgaatcatcaacaaaggagggtgcatattatgattcatgggaagaacaagcttttgcagaagatgcttgtggtactcttggtgggtgtatatggccaccaaggtcatattcttgtagcttctgtgggagagagtttagatcagctcaagctctgggtggtcatatgaatgttcataggagagatagagctaggctaaaacaatcccctccatctccatctcctccccaccatgagcaccatcatcatcagaataacattcaggatccctttttgcctttgggttttccgtgccagcctgatgaggtttgtaactttctttataaccctaaccctaattccaatcatggtactactaaacaggattgtccagggcctcctcttttctcttcaccaaaaccatggtcaaacttgacagctgacagatatggaggagacaagagtccaagaaccctagttgttcgagaaacacacaaagaagacatcactgtcggttgtaagagaaagagaaccgatgatcacacacccaccatgaccttattaccattcttcctcgagccgatttcaattcaaaagcaccatcatcatcacccaccagctgatgaagacaacaacatagatctggaactccggcttggtttaaacgcccagagctgaaaaaacatcagacggtcagttggaagagagaaataagatccatgaatgagagaaagacatttttgagagcacaaagaatgtcactattacaacagattctaatttgaagatcatttgaagaattaaatttatttatttgcgaaaaaaaaaaaaaaa

SEQ ID NO: 9628 - DNA, 694 bp, Gossypium hirsutum
  Predicted polypeptide sequence is orthologous to G1478
gcttagcgtggtcgcggccgaggtacttttttttttttttttttttttttggaaaaaacaaggctaattatgcattaatgatcaagtcaatctggtttacacaactctgggtgtctaatatatatatatagcttatatgtaataattcaggattctctttcatccataactatatctcagacagactaaaatacccccatcaccaaaagacggagaaaaaaaaatgacaatcaaagaaaaagaaaaggaattttaagcgttgttgaatgctccgtttccatctcaaagttacagtgtcgtctctcagaccaactcaccattgttggtagcagcacctcatgtgaagctcccatgaggtatctctgtgttaaattttgacaagtattgcaaaggaaacacctgatgtgtctttgagccaagaaattagcatcatgaacccatttgtcgcatttcctgcacaggtatgcatcatctgcttgacaatataaggttgccctggagttgcagaactcacacttcaccaaccttgttgaaaccctaggatttgcattaggtgagagtgagacaccctgtttcagacaagaacttgatgtgcttccttgttgtaagcctttgcacatggttggaggatgatggagaaaatttgaatgggaaaaatgggtcccgcgtacctgcccgggcggccgctcgaagc

SEQ ID NO: 9629 - DNA, 527 bp, Gossypium hirsutum
  Predicted polypeptide sequence is orthologous to G148
ataagtggtgctggagagaatagagaacaaaatcatcgccaagtaaccttctccaagagaaggaacggtttacttaagaagtcctacgagttgtcggtgctttgcgatgctgaggttgctctcatcatcttttccagtcgaggcaagctctctgaatttgccagtaatataagtgtgccaacaaccctggaaaaatactggcagcatcgatacagctccccagtcgatattcctctggacgaaacgcagacattgtatcaagaggtattgaggttaaaggcaaaatatgaatctctccagcgttcgcaaaggcatcttcttggagaagagcttgagtcacttaccgtgaaagagctctatagggcacaacacaaaataaaaattaattaccagcactcgcacagacgtagagggggaggggggagcaaagagaaaaaaaaagagaaacagaggaaggggagaaggagaagaagaagaaagcagaaacatcacataaaaaaaaaaaaccaaaaaaaaaaaaagaaacc

SEQ ID NO: 9630 - DNA, 946 bp, Gossypium hirsutum
  Predicted polypeptide sequence is orthologous to G1480
tccaaacccaaaatcaaaaacaaacacttcaaaccctccacgtttgatccaagcataatattttttatttccattgctttgatttgattcgcgattatgggaatcgaaataagcggcggcacgatcattccaggaggttggggcgccgccgccatggctgtcgcggctaagacatgcgacggatgtaaatcatcggcggcagctatcttttgtcgtactgattgggtctttttatgcttgaattgtgattccaatttccattccggtcacgggagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtacccatcgaacctttctacgactccgctgattccatagtcaaatcttccccttttagcttccttgtgccgacgacagatcataatggtactaattgtaaacaagaaattgaagctaacaaaggggattcgtttttcacagaaatggattcgtttatcgatttcgggtacccgaattcatctcaacatcttcatgatgccgccatggatagcgttgttccagttcaaactccaaaaccaatcattccactgatcaacgatggaaattgtttcgatactttcagctatcaaactcaatcatctctcagtcatagcgtttcatcatcgtcgcttgaagtaggaacagttccagatgggaattaccacgcaacacaagtgggtggttcaatcgatcgagaagctagggttttaaggtacaaagagaagagaaagaacaggaaattcgagaagacaatacgatacgcttcaagaaaggcttacgctgaatcaagaccaagaatcaaaggtcgattcgctaaaagaacagaaacccacaacgatg

SEQ ID NO: 9631 - DNA, 995 bp, Gossypium hirsutum
  Predicted polypeptide sequence is orthologous to G1480
ctgaaaagccttcccaaactcagctcacacccacagaaagagagaggaggagaaaagataacttctagcaaactgggttgttgaaatggcatcgaagttgtgtgactcatgcaaatcagcgacggcgactgttttctgccgggctgactcggcgtttctatgctccaactgtgactccaaaatccacgcagccaacaagctcgcctcgcgtcacgctcgagtttgggtctgtgaagtctgcgagcaagcgcccgctcacgtcacttgcaaggccgatgcagccgctctctgtattacctgcgaccgtgacatccactccgccaaccctcttgctagccgacacgagcgcctccctgtaacccccttctacgactccgtcaattcagtcccagccgtcaaacccaacggagttgttaagtttctggaggagcgttacttctccgacgtggacggagacgctgatgtcagccgggaggaagcggaggcggcgtcgtggctgcttccgaaccctaaccataaggctgtggacagcccggacgtgaactcggggcagtacgtgttctcggagatggacccgtttctggatctagattacgggcatggggatccaaaaatggatgcccaggagcagaacagctccggcaccgatggggtggtccctgtccaaagcaagaatgttcaagctccgtcggctaacgatcactgtttcgacttggacttcaccggatccaaatccttctcttatggctacaaccccaacttcatcagccacagcgtatcatcatcatcattggatgttgggggtagtcccagacggaagtacgatgacggacatatcaaacccgtacggaagagggcctgagtcaacacatcagacggtgcagctatcaccggcggacagagaagcaagggtgctgaggtacagagagaagagaaagaacaggaagttcgagaagacgatccgttacgcctccagaaaagcatacgcggagatg

SEQ ID NO: 9632 - DNA, 942 bp, Gossypium hirsutum
  Predicted polypeptide sequence is orthologous to G1521
ctcgtcttcaccgaaaccattggggaaatcggacatccagagattcatacgaagagtaatttgtccggccatcgtcgacgaaacatgtcccatatgcttgagaaccatcgacattcctggagcggcagttctcaccgtttgtttccacgcttactgcttggactgcatccgcaagtggagcgatttgaagaggaattgccctctctgcaattccaccttcgattcttggttctacaaaatcgatctctcctctctaagatacctcaaacagcagttacctgctatctctgactgcaaatcggctattccacgacctcggttcaccgtatctgatcgtcgacggatcatcgaaaggaccagaagagaaataaacgatgttaaccggagaacgagaccgttgccttggcggcgatcttttgggcgacctgggactgtgtcgcctcttgttatcgccgaaaggaagcttcaatggcgtgccagtgtgtataaccgacggctgcaagctgtgcctatatatcatggtaatggttttcagcagaatgttcctaggattaggaatgattttgagaaagagaaactactgcaaagaatagaaccatggattcaaagggagcttgaggctatccttggagatccagatccatcaatcattcttcatgttgtgtcctcgcttctcttctctagacatgaaggaaagcatgatgactcttccgcctcttcgacacagctcagttttgtcaatgacaactttcttgcttctttggaaccttttttacacgaccaaaccaacatgttttggcatgaactcagatgctttgtggagagtccacttaccatggaaacttatgatgcagtagttgagtatagatagatggagtagcggcgcttagccgagttgcatattattttaactgtctacccactatatctgtggcgttagag

SEQ ID NO: 9633 - DNA, 2702 bp, Gossypium hirsutum
  Predicted polypeptide sequence is orthologous to G1535
ttctttttctcttcatcttcttctgcaaaagaaaacaccgacaacattagttgtgcaaagactgtaagagcaacaaaaagagggagaaaaatgtatggagattgtgaagctatttcatcaatgggagggaatctggtggtgtcttcagaaactttatttacatcaacatttcaaaaccctaatttcagttacttgcctttggagcctttacctcctatgatccctaaagaagaaaatgggtcattgttgagaggaaaagaggagatgaaaagtggttccgaaagtgaattacaagaaaccactgagcagccattgaagaagaaacgttaccaccgacacactgctcatcagatccaagaactggaagctgtttttaaggaatgtcctcatccagatgacaaacaaaggatgaaactgagtcaagaacttggcctgaaaccacgacaagtcaagttctggtttcaaaaccggcgtactcagatgaaggctcaacaagatagatcggaggatgtgatacttagagctgagaatgattctttgaagagcgagttttacaggctacaagctgaactcagtaaactcgtttgtcctaattgtggtggtccacctgtgcctggtggggtttcttttgatgaacttcgtattgagaatgctcggctcggtgaagagttggaacgtgtgtgtgccatagcttctcgttacattggtcggccaattcaaacaatgggtgcattgatgccaccttcattagaattggacatgaacatatatccaagacaattccttgaacctatgcctcctaccttgtccgaaacaccctcttatcccgacaataacaacctcatcttaatggaagaggagaaaactattgcaatggaactcgctatgtccgccaccgatgaactcgcgaagatgtgtcgaacgaacccctttgggttcgtaaacaacgaaaccgggaaggaagtgcttaacctcgacgaacattcccgaatgttccactggccactaaatctgaagcaacgctcaagtgaattcaggaccgaagctagccgtgatagttcagtggttataatgaatagcattactttggtagacgcatttgtggatgccaacaaatggatggagctgtttccttcaatagtagctagagccaaatgtgttcaagttatatcacaaggtgtttcgggaaccaacggttgccttcaattgatgtatgctgaattgcattgtctgtcgccattggtgcccacgcgagaggcatatttcctacgatattgccaacaacaaaatgtggaagatgaaacatattgggcaatcgttgatttcccactcgatggctttcataacagtttacaaacatcatttcctttatacaaaagaaggccttctggttgtttgattcaagacatgcctaatggctactcacgggtaacgtgggtagaacatgcagagatagaagagaaaccaatccatcaaatattcagccacttcgtacacagtgggatggcatttggagcaaatcgttggttagctgttttagagagacaatgcgaaaggattgctagtctcatggccactaatatccccgacattggagtgataccatcaccagaagcaaggaagaatctaatgagactgtcccaaaggatgataagaacattctgtgtgaacatcagcagttgcagtggtcaggtttggacagctgttcctgattcctccgatgatactgttagaatcaccacaaggaaagtgagtgaagcaggtcaacccaatggtctcattctttgtgctgtgtccaccacttggctgccttatcctcaccaccatgtcttcgatcttttgagggatgaacgccgccgagctcagctggaggtgctatcaaatgggaatgccttacatgaagtggctcatattgctaatggttcccatcctggaaattgcatttcactccttagaatcaacgtttccagcaactcatcacaacacgtagacctaatgctacaagagagctgcaccaacaaatccggcagcctcgtcgtgtactcaaccgtagacgtcgattccgttcagctggcgatgagcggcgaggacccgtcgtgtatcccattgcttccgttaggcttttttataaccccaatgggactggtgaatgatggtgggtgtaaggacgaagcaaatgggcataatattacaacagggagtttactcaccgttggacttcaagttctagccagcacaataccatcagcaaagatcaatctgtcgagcattgcagccattaacaatcatttatgcaccaccgttcaacaaatcagtagtgctttgagtagcaattgcatcgggtcttgcaatgaaggtgacaatggtaaagaaaaatagggtgttggtgattcgtgaattacccataacatccttaattttgttaactaattgaggaagttattggtaattgtactgaaagtcgtgcactgggatttatagtaattttaatgtggtaaataaagagtgtaatgatgatggagggttaaatttgaaaacttgggggggtataggtgaagtcaagagcgcaccaattgtgaccctttgcttttaatggtaaaggccaccaattaacaagggtgggtggttcgggtatttacttcacctttctttcccttttttttttaatttttatagttataataaacctaaatattttactt

SEQ ID NO: 9634 - DNA, 824 bp, Gossypium hirsutum
  misc_feature (790)..(790): n is a, c, g, or t
  Predicted polypeptide sequence is orthologous to G1538
gcggccgcgttgaccttaaataaaaaaaattcatcatgacaacccaaatgaaagagcttgaagatccaatggctctaatcacccaaatgtacccttgcatatacactcaagttgcaccacaacaaggggaaatatcgaagcctcgacgacgacagaagaagaacaagggaggggaaagcggggcggcaaccgcggcggagacagctaagaaaaggaagcttagccaagaacaagttgatcttcttgaacttaactttgggaatgaacataaactcgagtccgagaggaaagaccgactcgcttcggagctcggtctggaccctcggcaggtcgcggtttggttccaaaaccgaagagctcgttggaagaacaagaagctcgaggaagagtatagcaagttgaagacaatccatgaaggtgttgttcttgagaaatgtcgccttgaatccgaggttttaaagttgaaggaccaacttcgagaggctgaaaaggaaattcaaggattgacagaacgagtagacggagtttcgagtaatagtccgagttcgtcgtcggttctttctatggaagccatggatccaccacctttcctaggggaatttggagtacaaggatttgaggatcaagatgttttctatataggcatggagtggatgaatctatatatgtgactttaactttaatatgtgtaaataattatgatatttaaaaatatattaaatataatgtaattatatcctaattatcctaattaactttaaatttagagattaatgttattaactactanaaaaaagtcgacgcggccgcggtcgacgcgccgc

SEQ ID NO: 9635 - DNA, 760 bp, Gossypium hirsutum
  Predicted polypeptide sequence is orthologous to G1538
ccgtttctcaatttaagtgaaagccagaggaaaaaaaaaacacacccgaaaagctagaaagaaagagaaaatgagccaagattatgaaatgatgacaagccaaatgaatgaacatgaagatcatattgctcttatctcccaaatctaccctggattttacacccaaattgcaacacaccaaggtactgatcaatgtggcatggacttaaaaccacaaacatatttattcttgcattgttttataattaagccaggcttttggttgagcaggggaaccgaagcctcgacggcggcggaagaagaacaagggaggggagaacagccagtgtgcggtggctaaaaaaaggaagcttaaccaggaacaagtcactctccttgaacttaattttggtaacgaacataaactagagtcagaaaggaaagatcggattgcttcagagctgggacttgaccctcgtcaggttgctgtttggttccaaaatcgtagagctcgttggaagaacaagaagctggaggaagagtatagcacgctcaagtctcttcacgaaactgttgttctcgacaaatgccgacttgaatccgaggtatgtaaatatacatatatcttttatttcccaaatgaaaatcattttaacttgcaaaaaaagaaaaaatccggttttaatcacacttgtaagtttatttggatgtttaaatgcaaaccctttgtttttcttatattttagacataattccttgtggtttcttagaaccaaacagg

SEQ ID NO: 9636 - DNA, 1002 bp, Gossypium hirsutum
  Predicted polypeptide sequence is orthologous to G156
cgctagcttcaccaaaagagctgcagatttacgagagcaaagcaaatagtttccttaactaggtagagattataaaggcaaagaaaagagataattatgggacgtggaaagataccgatcaagaggattgagaaccagacgactaggcaagttacgttttcgaagcgacgagctgggttattgaagaagacccatgagttgtctgtgctttgtgacgctcagattgggctcatcatcttctccactaccggcaagatgtgccagtattgcactgagggttacagaatggagcaaatcatagaaaggtatcagaaggtcactggaacttgcattcctgagcatgacaatcgggaacatttgtacaatgaattggcagtgttgaggaaagaaactcgtcgccttcaactaagcatgcgacgctacactggtgaagacatgagttctataccattcgaagagctcgatcaacttgaacacgaactcgaacgctccgtcatcaaggtccgagagcgaaagaatgagctcttgcaacaacaactggataacctacgtagaaaggagagaatactagaggaagaaaacagcaatatgtaccgctgggtgcaggaacaccgagcggcgatcgagtatcagcagggaggaatggaagctaagccagtggagcatcagcaagttgtggatcaattctctttctttggagaaccaagcagtgtgcttcagcttgctaccattcctcaacagttccaatcctatcagctccagcttgctcagcccaaccttcaagattctaatgtctagtattgtgccattgcagctatgattttctgagaagaaaagaagatggtatattacatagacagagagtcagcattattgggatcgaatcttgtgttcaaattatctattgaaaacatatttctgatattatttttgtttaagggagtgtgctatatgctttcatgtttctgaagttaaaacattcaaactcacatcatacccttt

SEQ ID NO: 9637 - DNA, 724 bp, Gossypium hirsutum
  Predicted polypeptide sequence is orthologous to G1638
cttaccctataaagattcatcacttataacactccccttctctatatcctctctgtttcttttctcgcttgatggatttcaagtattctttttccagctttaatctttcactttatgagttaagtttctgaattttaatttgcatatagattttcttgttattctgtatgattttagatctgttatggatgtctaaggctttcaagatttgatacttctttgctcatttaacaagtcacttccctgcatttttttacatctttgagttgctccatttcaaagtgggagagaagcaagtttttttttttaatcatgattaatcggggacttcaagttctatctcaaacctcttacttacaaacttggaattggttgtttcaagagagcaatggaacaaaatggagtgctgaagagaacaagtgtttcgaaaatgctctagctttatatgatacagacacacctgaccgatggtttaaagtggcagcaatggttcctggaaaaactgttgaagatgtcatcaaacagtatagagaattggaagaggatgtaagtgatatagaggcgggattgattccaattcctgtgtataacactgattctttagaattgacttgagttaagaatatcaaggatttaaggaattaaaacttttaactccttgtttgtaaaaattgtttggttcttacttctgatctgactgacaatgtttcctgcatgagaaaaa

SEQ ID NO: 9638 - DNA, 563 bp, Gossypium hirsutum
  misc_feature (51)..(51): n is a, c, g, or t
  misc_feature (352)..(352): n is a, c, g, or t
  misc_feature (433)..(433): n is a, c, g, or t
  misc_feature (500)..(500): n is a, c, g, or t
  misc_feature (553)..(553): n is a, c, g, or t
  Predicted polypeptide sequence is orthologous to G1638
caatttcgtgactacccgaacaccgactcaagtggcaagtctatgctcagnaaatactgtcatcaggcaggatcaccggggggtaaagacaagaggaggtccagtatccatgatatcacaacggttaacgtccctggatactccctcttcgtcaccggatcactgcaagcattcgtcttcaagtgattcttctgcagtcatacaggcacagcagcaagctaaactagccacaactaaagagatcgactttgaatgtaagcaacaaaatggagcagctatggttttcaaccggacgagtaattgcaatgctttcctgccccccttctgtgggatttcatcatacggacccaanctggaggaacaaaatttgcttggagaaactcttcccagatctcaattcggatcttacaacactcttttccagatgcagtcnatgcaacaacatcaataaactgagtgataatgtgggaagacttttctcaaggtattattattagttnaaagagatgaagatgaagcctactagtgatgtgtatatcttggagatgcattnttagtccata

SEQ ID NO: 9639 - DNA, 700 bp, Gossypium hirsutum
  Predicted polypeptide sequence is orthologous to G1638
gattttcactgatttttgatgttgtaatgattttgggtttttgaattttgatttatatattgatttttcagtgttttaattcagtgttttagttggattttggatctttttatgtatatctaggtttttttttcatcaagatctgattttcccttggattttggaacttgaggttcttttaaagagattccttcatggattccattaatgcttgaatgatttaaaagttaaaaaaacaaccatttctctgcaatttttttccttggattttctctctctttgaacaagagggagaaaaaaagcagagcttttatttttaggggcaaatcatctttggcaaagaacaatgaataggggacttgaaatcctttcaccagcttcttttttacagacatcaaattggttgttccaagagagtaaaggtactaaatggacaccacaagagaacaagtgttttgaaaatgctttagctttgtatgataaagacacacctgatagatggtttaaggtagctgccatgattcctggtaaaacagttggtgatgttatcaaacaatacagggaattagaagaagatgttagtgatatagaagctggtttgatcccaatccctggttatagtagtgattcttttacgttggaatgggttaatgatggtcaagtgtttgatgggtttagaaattattattatacacctggt

SEQ ID NO: 9640 - DNA, 976 bp, Gossypium hirsutum
  Predicted polypeptide sequence is orthologous to G1646, G715
cccatccatatctgacccttaaaaatatccaccgccgccaccaccacgacgatcaccaccgccacatcccaatctcccgccatttgttcaccagccaatggacagtaacctgcaaactcaatccaccccatacccacctcagcctcccacatccgccattacccctccttcatccgccacagcaacagcgcctcctttccaccacctccttcaacaacaacagcaacagctccaaatgttttggtcataccaacgccaagaaatcgagcaagttaacgattttaagaaccaccaactcccattagctcgcattaagaagataatgaaagccgacgaagacgtccgtatgatctccgccgaggctcccattctcttcgccaaagcttgtgagcttttcattttggaactcactatccgttcttggcttcacgccgaggaaaacaagcgacggacacttcagaaaaacgacatcgctgcggctattacgaggaccgacattttcgatttcttggtagatattgtgcctagggatgagatcaaggatgaaactgctttggctccgatggtcggtgctaccgccagtggggtaccttacttttatccccctatgggtcaacctgctggtggtggtcctggtgggatgatgattggccggcctgccgtcgatcccaccggagttatttacggtcagccaccttctcaggcttggcagagtgtttggcagacggcggggactgatgatggctcgtatggcagtggagttaccggtggtcaagggaatcttgacggtcaaggctaacctaaaatcatgggtccgatatcgtacagtggatggtgtggaaaacgcgtggaactcagtgatctactggggaatttatgcttttgtgcttattgatttatgaatgcagttgtgttggtattgtttatgggaaaaaagaaaagctaccttgaatttgatgacacttctatagtaact

SEQ ID NO: 9641 - DNA, 977 bp, Gossypium hirsutum
  Predicted polypeptide sequence is orthologous to G1646, G715
ctttgatcaagttcatccatctgccgttgattcttcatccaatggacggcaacaagcaagcccagtcctcctcttaccctcctcagcctcccactacttctattacgccttctcctccttcctcctccgccgccatcgccgccactccgcctgctcctttccaccacctcctccagcagcagcagcaacagctccaaatgttctggtcttaccagcgccaagaaatcgagctagtcaacgacttcaagaaccatcagcttcctcttgctcgcatcaagaagatcatgaaagccgacgaagatgtccgtatgatctccgctgaagcccctattctcttcgccaaagcctgcgagcttttcattctggagcttaccatccgttcctggcttcacgccgaggagaacaagcgacggacgcttcagaaaaacgacatcgcggcggctattactaggaccgacattttcgatttcttggtggatattgtgcccagggacgagatcaaggatgaggccggtctgggtgggatggtgggtcccaccgccagtggggtgccatatttttatcctcccatgagtcagcctgctggcgctcctgctggacctggcgggatgatgattggaaggcccgccgtcgatacaaccggtggtatttatgctcagcctccttctcaggcttggcagagtgtttggcagacggcgggggctgacgatgggtcgtatgccagtggaggtagcggcggtcaggggaatcttgacggacaagctaagcaattcattggtccaatttgggtgctcgatggcatggcaaatggcgtgatgcactggggtattgcactaggaattttggttgcttatgatttatgaatatggacctgtctgccattgtttgtggaaaactaccttttaaatgtgatttatttagaaacatctcaaagacacttaactcatttgatgtgcagcaaaacaaatagcttttgc

SEQ ID NO: 9642 - DNA, 962 bp, Gossypium hirsutum
  Predicted polypeptide sequence is orthologous to G1660
cttcagctctcaagcaacaagcatggtgtagtaataataatagtagcgatgctgccagttcagtgtttctagcttccgtttctatgttttatctgcggagtgtaatattgaaagtaaatcagttttcattttcatggattacgaaagaatccaaaagcctcagggtggaggtggattttcccctgctaaactaaggactatgctcctaggagtagaaaagaaaagaaaacaagaagaagaacaagttgaatcttcagtagatttaagatctgaactttctcaccttgatgacgattcagggaaaagtggctctgatagttgcaaagatgtagatgtggtgagtgttcttccagaatgttccacttctacaacagctagttctacagctgctatgcaaaatgggaacgagcgaagatcaaaggatcattctttaggcactgctcaaaaccggttcattgaggatcatcctggtttagattatgatagtgggcatgacaatatgagtgtgtcctcgtcgatctttgagtttcagaagactgaacgagcaccgcaaagggttccccttgggccgttttctaagcctgctccatcgaaatgggatgacgctcagaaatggatagccagccctactgcaaatcggccgaagacagggcagggtgggcaaggagtgggatcaagaaaaggaggtaattttggttacgggaggcaatcgtctactaaggtggtcattgaagttccagatcaaaggatggttgctttcgaagaaccggatacaaaacggattgatactaatcatgctaagaaggatgatgggctgcagaagtttgttaattggggagagtgatccatacccagttgtggattcatatgggaagcctgtactaatgatcgggaactctgttgctgagtcagctattagtcttagccagcatgattcatcatatcgatacatagttgctacg

SEQ ID NO: 9643 - DNA, 913 bp, Gossypium hirsutum
  Predicted polypeptide sequence is orthologous to G1666
tttgaatttgtctgtctgatctctcacctgttgctcttttttcttctgctacccttcctcgggctcctcttgtctacccttcttttccttttcctttttgctcctttttaaggggttttggggtttgggtaaagggttttttgtgattttcagctgcagatatcatgatatataggatgattttatgattctgcttctttctgtttcttcactagtatataatatcccattttttccttctcattttctgacattaatatccagctcaaatttggagtgaatggctgtgccgcctagtaacaggcttcggaatatgttgcaggcggcggtgcaatcagttcaatggacctacagccttttctggcaaatttgtccccaacaagggatcttagtatggtcagacggatactacaatggagcaatcaagacacgaaagacactgcaaccaatggaggtcagtgcggaagaggcggctttgcaaaggagccaacaacttagagagctctacgactcattatccgccggagagtcgaaccagacagtccggcgaccatctgcagcgttgtcaccggaggacttaaccgagtccgaatggttctatttgatgtgcgtctccttctcttttcctcctggagtagggttgcctggaaaggcatatgcaaggaggcagcatgtatggcttactggtgcaagtgaggttgatagtaaaattttctcaagagctattcttgctaagagtgctcgtatacagactgtgctttgcattgctgtccacgatggtgttgttgaacttggcactacggagaagctccaagaggatctagagttagtccaacatgtcaaaccttcttcacagatgatataattcgtaaccccaaaccggctctctcggacactccacttcgaacccgcc

SEQ ID NO: 9644 - DNA, 920 bp, Gossypium hirsutum
  Predicted polypeptide sequence is orthologous to G1666
attacaaaaaaaaaagtgggtctcatttcttcttaaaaagtcatctaatttgtctttcttcttcttttttctctgatatgtagcttcttttcttcggactttgcctgtcagacccctttttttgttggtggggattaaagggttttttctttttttaattttcaggtggagatcataaaaccttagtatctccaaagggaaagttgtgaattttgtttgtggttttttttttaacgtaaaaatccaagctttaaatctgaaagttaatggcggcgccgccgagtagtaggctacaaaaaatgttacaggctgcggtgcaatcggttcaatggacgtatagtcttttctggcaaatttgtcctcaacaaggtatcttaatatggtccgatggatactacaatggagcaatcaaaacaagaaaaacagtgcaaccaatggaagttagtacagaagaagcatctttacaaagaagccaacaactccgagaactttacgactcgttgtcttccggcgacaccaaccaaccggctcgacgaccgtctgccgcgttgtccccggaagatttaacggaatccgaatggttctatctaatgtgtgtctccttctcttttccccctggtgtagggttacctggaaaggcatatgcaaggaggcaacatgtatggcttacaggtgcaaacgaagttgatagcaaaacattttcaagagctattcttgctaagactgtgctttgcattcctattcttgatggtgttcttgaacttgggtatactgaaaaggtgcaagaagatttagggttagtccagcacgttaaaactttcttcaacgatggacaagcaccaaaccctccgccaccgaaaccggctctctccgaacattcaacgtcgaacccggccgcttcatcggactacactcgattt

SEQ ID NO: 9645 - DNA, 426 bp, Gossypium hirsutum
  Predicted polypeptide sequence is orthologous to G1750
tcttcactaagatggtgctcttcgagcctggaggaattcagccccaaaatctttcctcaactttgatttcaacgaagaaaggagaagaaatccatggcctgttcgcacggttcggttgtacggagaagataaccctggtgacgtggaggccgcacgcggggatctcacgtgggaagccaaccctctggccattccagtgtattccagaagcttctggcgctctcaggctgctgagcttctttttgggtcctgttgggcctcgggtttgggctatttgtaaactgggttagggatgtgggtttagtatttggattttgaaaattgtaagtggactttgtggactattttagtcatggactttattttaatttatttgggtttatttatttgacttatttattataaataaaaaaaaaaaaaaaaaaa

SEQ ID NO: 9646 - DNA, 860 bp, Gossypium hirsutum
  Predicted polypeptide sequence is orthologous to G1765
tttttgccttctacttagccagcaaaaagaataaaaaagaatcaaagatgaacatggtccatggcaccaccactactgtggaagaagatgttccacttcccggtttccgattccacccgaccgacgaagagctcatcgggttttaccttcgacgaaaagtcgacaacaaatccttaagaatcgaactcatcaaacagatcgatatctataaatacgacccctctgatctcccaaaaaccagcatgatgggagagaacgaattgtatttcttttgtagacgaggaaggaaatatcgaaacagcgtaagaccgaatcgggtgacgggatcggggttttggaaagcgacaggtatcgataagcctgttttttcggttggaagcagtgaagccatcgggctaaagaaaacgttggtgtattaccgtggaagtgcaggcaaaggaactaaaaccgattggatgatgcatgaatttcgccttcccaatcccacattgactgcacaagatgctgaagtatggacaatatgtcgaattttcaagcggcataaaaagaacaaacaagaatggagacaaggtgctactaaacgagcttcaactagcaatggcaatggtgtacatggctatgaacgttgcagtgtagaatccagcagccatgaaaattacattacatttggctctcaaagcattgaaaactatgatgataatgatgatgatgatggtgatggtgaaatggttatggatcatatgaagaatgacgggagttgcagaagggaatggtatcatggagagatgcaatgtatggtatcatcatcatcaccatcttcaagcttttctactgaaaatgatttcttcacaaatgctaat

SEQ ID NO: 9647 - DNA, 812 bp, Gossypium hirsutum
  Predicted polypeptide sequence is orthologous to G1777
gcggccgcgtcgacctttggaacatctcaaatctcgggttgagaaaattactcaaatattcaaaagcccaaggcttctgtacattaaatggattttcagttcacacaacctctgaaagacaaaagaacctatggacatccatgattcatcttccagactatctaaaatagaaaggaagtacaaaatgggggggggggacaaaaaagatgctaagcaggggaagtaaaagcatttaagcggttctctgctcaatccataaattatcaactcccattttagataaaatgagggtctctctagttagatatgtacatatgtacttatctagaaaaaaaagcctacttagagatcaattcctgtcaagaacttctgctggcaagttgagatcaaagaaaccacctccataactttccttcttaggttgctttggtgatgggcaacctttgtcgtctgaagtcccaaagctgaaagatcggtcacgtttgccgctagtgccacaatctgagggatggcatttaccagtagtagtactggctttaccattccaacagacagcaagctctgatgctttctcaatgcccttggatttgtatggagcgatattatgggtatttcgttggagagaacccagcaaatcattctcaatgcactcatacattttcttacaaagggaatcaatgatcacagaaagattgattacttgcattcgtatctccataactttatcatcagtatattgatcaaagggctcttccaaaaacttagaaagtttctcaacatttgcctcaagttgctgctgctgatcctcaaat

SEQ ID NO: 9648 - DNA, 550 bp, Gossypium hirsutum
  Predicted polypeptide sequence is orthologous to G1789
aatgattaatgcacgatatatatattcattaaaaacaggaacttttttatgtaccagtgctatgagataattaattggtacatataaggaagcacaactagtgtaaaccaagtatatagaatgaagatacaactttcaatttaagatacactttgagaagaaataataggcgacatatttgctgcttgttgcaccagacaactggctgcatttgctttattaaaggctaaggcctttgtttctaccggtttctgctcatatttcactgaagcctcagattcctcattctttgttctccatccgtgaaattgtatcctttgttccctccagctttcttgtaaggaggtaagggcacttggccagactcaatctgttggatgtcttcgacaaggttctggtaatgtagcttcacttcctccacggttttccctccaactgccctggctagattgtgccagcggtctggggtatctttgtcgtagcatactaaagcattctcgaacaacttgttttgctttggtgtccagctcgaacctgaggccattgcaat

SEQ ID NO: 9649 - DNA, 606 bp, Gossypium hirsutum
  Predicted polypeptide sequence is orthologous to G1789
ccttaaaacgcgtccgctctttttcttttcttctcttttctttggcctcagacccttaatttcgattgttaattatcactgttctgcaatggcgtcaggttcgaactggacgccaaagcaaaacaagttgttcgagaacgctttagctatctacgacaaggatacaccagaccggtggcacaagctagccagggctgtcggggggaagaccgtggaggaagtgaagttgcattaccagaaccttgtggatgacatcaagcagatagagtctgggcacgtgcctttgcccccttataagaaagctggagggaaccaaggatacaacaatttcatggacgatgaagaaccaaggatgaggaatctcaggctttagtgaagtatgaaccagaaatagctgtagaatatcaacctttcaataaaaggaaatgcaaagcagcaaacatataaattatctcttaatttcgtttacatttcctgctcatatatatgttttttgtgtgcttgaatgtaacaagcagccacaacgctcctatacttgcatgtgtcaagtatgaaattatagcattggtaccttgtttttattaatgttaacctatctttgttctt

SEQ ID NO: 9650 - DNA, 569 bp, Gossypium hirsutum
  misc_feature (454)..(454): n is a, c, g, or t
  misc_feature (515)..(515): n is a, c, g, or t
  misc_feature (532)..(532): n is a, c, g, or t
  misc_feature (536)..(536): n is a, c, g, or t
  misc_feature (559)..(560): n is a, c, g, or t
  Predicted polypeptide sequence is orthologous to G1838
ggaagagatgaagcatgcgaccaagcaagagtttattgcatccttgaggaggaaaagtagcggattttcaaggggtgcatcgatttacagaggtgtcacaaggcatcatcaacagggccgatggcaagcaaggataggtcgggttgcaggaaacaaggacttgtaccttgggacttttgctactgaagaggaggcagcagaggcatatgatattgcagccatcaagttccgaggtgtcaatgcggtgaccaacttcgatatgagccggtacgatgtcaaagccattgcccagagttctcttcccattggtggggcagctaagcgcttaaagctttcacttgaatcagagccaaaaccgatagtgaaccagaagcaacaaccaccaccaccccggtgcagctccaacagcaatattataagttttgctcccatgaaacagccggtttccactatnccttgtggaatccctttcgatgcagcagcagcaatggctgcatttatcacagaatatctancagcaccttcagactgncacncagtgttctgaccccagtcttcnnacacgtatg

SEQ ID NO: 9651 - DNA, 572 bp, Gossypium hirsutum
  Predicted polypeptide sequence is orthologous to G1850
caacggtgctgtcgccgtctttcactctcttacggtgttgaaacccgtttggattcaacgatcttatcgcatgacggacctggtttcttgtttggttactgagaaaattttcgttgccttttaagagcgttattattctttcgcttacgtttgatgtaaaaggaacgccaaagtgatctgtctccctctctctagagagttcggatctagaaacgaaccgtatggcaccattgccggccgatcaaccctgcgaatctcatgccagcggtgctgtggctgactcgcaacggtctttacctactccgttcctttctaaaacctatcagctcgtcgataattcatccgtcgatgatttgatttcatggaacgacgatggatcaactttcatagtttggcgcccagctgagtttgctcgtgatttgctccctaagtacttcaaacataacaatttctctagcttcgttcgtcaactcaatacatatggatttaggaaggtagtgcctgataaatgggagttcgctaacgattgtttcaaaagaggtgaaaaaggacttctccgagacatacagcgc

SEQ ID NO: 9652 - DNA, 906 bp, Gossypium hirsutum
  Predicted polypeptide sequence is orthologous to G1850
gcggccgcgtctacctgatagatgggagttcgctaacgattgtttcaaaagaggtgaaaaaggacttctccgagacatacagcgccggaaaataactcataatgcttctggttcggcgacggtgaccatcgcgccggttacttgtaagccatcgccgtcgaattcgagcgatgagcaggttatttcatcgaactcgcctcctgttgctaccgttttgaatcggaccacaagctgcacgacaacggcggagcttttggaggaaaacgagaggcttagaaaagaaaacatgcagcttaaccatgagttaactcagttgaagaggctgtgtaacaatattttaaatttgatgactaattatgcttccggtcaagtggagaaccattcaaacttggctgaagggaaggcattggatcttttgccagcgaggacgaggaacggtggtggttcgaagcctgtcctggcggagacggaggaggaagcagcggaggatttgaggccgaagttgtttggagtttcaatagggatgaagcgcgtgaggagagaaggtgaggaagaggaaggggtgatggatgaggagcagcagcaggagattaagcctggatctgacattaaatcagagccgttggatggcaataatgataatcaggactccacgtgtctggagcttggcaaatgatcgaatgggatttattattattatttatttgattttcttttaatcagtggatggcgatgttgatgatgagaatcggaaaggaacgcgccaacgtggtccctatggagcatgtttcgaagaatcacgtgttgggaaaacagacacgtggcgccatgtgaaatatttgttctggatgcttctagaatgtaaagcccacagacgacagaacatgtaaaatagactaaacgtgg

SEQ ID NO: 9653 - DNA, 954 bp, Gossypium hirsutum
  Predicted polypeptide sequence is orthologous to G1850
ctgatcatcactcttcccatccaacggctctgctttaaccccgggctcacactctatgtcctgctgttgttcttgattattattctgctcctccaccgaatcctctctcctcacgcgcttcatcccaatcgaaactccgaacaatttcggcgtcacatcctcctccatatccaccgcctccttcggacccacgcctcccgctttcgtacccgaattcttccccggcaaaagatccaacgccttaccttcggctgaatttgaattattttccgactgaccggaagcatagttcgtcatcaaagttagtatattgttgcacaatcccttcaactgagtcaactcgtggttcagctgcatgttctcttttctgagcctctcgttctcctctaaaagctctggcgtcgtgctgctggtggttcggtgcaaaacggtggcaacaggtggcgagttggacgaaatgacctgctcatcgcctgaattggatggggaaaccttgcaaggaatcgccgccacggtcaccgtcgcggcaggagcagtagtggtaggagtcattttccgacgttgtatgtctcggagaagacctttctcacctcttcggaaacaatcgttagcgaactcccatcgatccggcactaccttcctgaatccctaaaaaagataaaaagcaaaataacctgtctaaatcaactaattataatcgaaaacttatctctctctatacgactgatagtaattatagtattcaaatctacactttttcccacttacatatgtgttgagctggcgcacgaagctagagaagttgttatgtttgaagtatttagggagcaaatcacgggcgaattcagcggggcgccaaacaatgaatgttgatccatcttcgttccatgaaatcatgtcattaacggagggatcgtcgacgagttgataggttttggtaaggaacggagtagg

SEQ ID NO: 9654 - DNA, 831 bp, Gossypium hirsutum
  Predicted polypeptide sequence is orthologous to G1850
ctggtttcttctttggttactgagaaaattttcgttgccttttaaggtacggaatttatttgaacaattttgagtttttttaatggaatttaatctctatgctcatgtatggatgtttataatatttgttcataaagaaagcaagaaatcttttaatattattctgaaactgtctccgtttctgtgcttttgaataatctatataaaatttgatgttgaatttggtgaacttaaaaagatattttcagctctatgcatggaagatatttttttgtttcatttgtttattttctttttctaacactctctcggctgccaatcagagcgttattattctttcgcttacgtttgatgtaaaggaacgccaaagtgacctgtctccctctctctagagagttcggttttgtgtaaggttcggatctagaaccgaaccgtatggcaccattgccggccgatcaaccctgcgaatctcatgccagcggtgctgtggctgactcgcaacggtctttacctacaccgttcctttctaaaacctatcagctcgtcgataatccatccgtcgatgatttgatttcatggaacgacgatggatcaactttcatagtttggcgcccagctgagtttgctcgtgatttgctccctaagtacttcaaacataacaatttctctagcttcgttcgtcaactcaatacatatgtaagtgtttaaaaatttgaacgtgatagtactaataattagttttaattcaacttaattttattttttcttagggatttaggaaggtagtgcctgatagatgggagttcgctaacgattgtttcaaaagaggtg

SEQ ID NO: 9655 - DNA, 928 bp, Gossypium hirsutum
  Predicted polypeptide sequence is orthologous to G1850
aatcatcataaaatttgaactttctagaatttaacaatcagatttctcatctctggtgaacgaagcaaacaccttctttaaggaattattaattgttgtctctgatggctccgccgccggtggagcaaaacggagatgcaacgacgggaacggcggaatcacaaaggtctatacctacaccgttcttgactaaaacgtatcaattggttgatgatcacacgattgacgacgtgatttcgtggaacgacgacggatctacttttatcgtttggaatcccacggtgtttgctcgtgatttgcttcctaaatatttcaagcataacaatttctctagttttgttcgtcaactcaatacttatggatttagaaaagtggtgcccgatcgatgggaattctctaacgattattttcgacgaggtgaaaagcgacttttgtgcgaaatccagcggcggaagttgtcgtcgccaacagcagcagctgttacggtggctccggtgacggttgcggcgattccaatggcgaagcctattatatcaccgtcgaattctggagacgagcaatctccagtcatttcatcggcctcatcgccttcaaggctgaaccaagcaggaaccgttatggccgagctcatgaaagaaaacgaaaaattgaggaaagagaacgtgcagcttaacaaacaattatcagagatgaagagtttgtgcaataatatattcagtttgatgtcgaattacgcaagttctcagtcggagaacatttctccggtgcacaaaccgctagatttcttgccggcgaagcggttatcatgcggagaatcagtcgaagaagaacgagtccgagtattcggcgtcctatagagagcgcaaagcgcgcaggaagagagagcgtagcgacggagcgcgacgcagcagacgaacgcatacactgc

SEQ ID NO: 9656 - DNA, 903 bp, Gossypium hirsutum
  Predicted polypeptide sequence is orthologous to G1863, G2334
ggggctgagagtgccggtgtggggatggtagcaatgaggtcgtcatcatcaccatttacagtgtcacagtggcaggagctggaacatcaagctttgatctttaagtatatgatggcaggtttgccagtgccacctgatcttgtgctccctattcagaagagctttgagtccatatctcaaagtggggtattgttccttttatgggaagaaggtggatccggagccaggacgatgtaggaggaccgatggcaagaaatggcggtgttccaaagatgcgtatccggactcaaagtattgcgagcgccatatgcaccgtggccgtaaccgttcaagaaagcctgtggaatcacaaactatggcacagtcattatctactgtgacatcattgactgtttctggtagtactaccagtggtggtgggactgggacggcaagcttccagagccttccattacatgcctttggtggtacgcaagtcactgctttggcaaccggtcagtctaattatcatgtggagtcaatcccctatggaatcccgaggaaagattataggtctcaaggaataaaacccgacgcgggtgggcatagtttcatctctgaggctttgggaagcaaccgggacacatggcctctaatgcaatctagagtctcttcatttcctcagtcaaaatccgatggcaacccggtcttactgaatgattaccctcagcattcgtttttcagcgatttcaactcgggagaaactgtgaagcccgagggtcaatctcttcggccgttctttgacgagtggcctaaaaccagggacacctggtcagctcttgaagatgacagatccaaccagacctcattttctacaacacagctatcgatatccattccgatggcatcatctgacttctccac

SEQ ID NO: 9657 - DNA, 836 bp, Gossypium hirsutum
  Predicted polypeptide sequence is orthologous to G1865
cataacgcgtccgatcacccctttatgtatccccatgcatctagacctccaggggttggcctgtcacctcaagaaaacaccacacattctctcctcggctctggctcttactcccagactaacacggattacaggagaaacagttatgtttatgggttgaaagaagaagtagatgaacatgcttttttctctgaaccttccggtacaatgaggagtttctcaggttcatctgtggatgattcatggcaacttgcaccactaacaatgagctcctcttcctcaaagcagaggaactgttctggattacagagtgaatactcttacttgcagcttcaaagcctcactgatcacaacccgaaacaaaacaaacaggatgctgatgaacattcctatatcaaatatgaaatgactgatgaattggagaaaggcgaaccccaaaagacagtccatcgtttctttgatgaatggccaccaaaacatagagattcatggcttgatttggatgataaatcatcaaacagctcatcagtttcaacaaccagactctctatatccatcccttccacttcacatgacttccccattttcaattcaagagctcataatgatggttgaatgtccagtggtaggtttctgcattagaggccaaagatgtacgtagtggggatcacttctttctgtgaattctgactgtttagtctttcatttatttcttccttctcctttggctttttgttttattgttttttgttttctgttctctttttgctaaatatggttaaattgggttgtgtttcttttttcccttattaatgaatgatccaatgacttcttac

SEQ ID NO: 9658 - DNA, 452 bp, Gossypium hirsutum
  Predicted polypeptide sequence is orthologous to G189
tttttttttttggcattggaaactttaatttggaattgaattttcaatccctcaataattgcaaaatctaataccaaatctaacatctttttcttcccttttgatctcaaatggtctttcaattaaagaaagcacaaagcatataatttacaaggaaataaacgagcagatttgataatatcctcaaatcccgaacataaacagtaaaatcaacattaataatagaaaaaaatattgttcatctatgaagattcaagtatggtggtttctgcaacagatagagaatggttatgatcaccttcatatgtaactattagcattgaagcatcatctaaagctctttccacatgttttctagcaggacatcctcttacgctactgcacttatagtatccccttggatgtggtgaacccttgattggtttttgaccatattttctccatgaataatc

SEQ ID NO: 9659 - DNA, 802 bp, Gossypium hirsutum
  Predicted polypeptide sequence is orthologous to G189
aataaaacagatcaaacgacaatttatttattgaaaataggtcgaaaggtacagaaaactgacaaagcacatgaattagttcatggcatggatttattgtttaataaaccttctgaataaacctagaaaacaagtcacaggtagacaaacatgaagttatgccaacaatcaatcctattaaagggtcatatataaacatcagagagataacttgcaataagagtaaaaaacatgcttttttactttaaaatgacagtgcgaaatcttgctagaaaacctaccagacctatttttttgatatcggtagtaccaccatagagtgtagccatcctcttctttgagtttcgagtgcgaaaatggttgccatatcaggaagtcaggggtggtgggattttctgttcccgtcatcatcccttacagctgaactttgaagagattcggtcagcaagttgggtgaatatgagttgtatcttccagcagagttgttttgtggtgtaggaattggacctataattgcaaccacggcatgctgaacgagaaaagacattaccagctgaaggatatgaagaaacctaaaagttgccaggaaaaaatacacacaactaatgattgagaattgcacctgggctttggaggtaccgccttgtatcacatgcagtaagtaatgcgcagagtgtacaatccatgtgatgcaaatagttacactgtcaggccaagccaccattattaagattgaaaaatcggaaaatgatactcggttaaagctggcatggctatcttccgaacccaagtgactttaaac

SEQ ID NO: 9660 - DNA, 941 bp, Gossypium hirsutum
  Predicted polypeptide sequence is orthologous to G19
caacacctccaaatttcccttaaacccttcctttttacctcaatcaacgctgcttttcaagcccgcaaaaatagttcccttccttaagaaatgtgtggcggtgctatcatatctgagttcatcccacggaaaggtggccgccacgtgaccgccgccgatatctggcctaactcccctttcgtgaaaatcaatggcttttgctcttaccgcgaccactcagtctaccatttcaaaagatcccaacccgaaccgccatcgtcgttaggtgatgaacaagtggagaagaaaccgaaaaggcagaggaaaaatctttacagaggcataaggcaacggccgtggggcaaatgggcggccgagattcgcgaccctcgaaaaggggttcgtgtttggctgggcactttcaacactgccgaggaagcggcccgcgcctacgaccgtgaagctcgcaaaatcaggggcaagaaagccaaggtcaatttccccaacgaagacgactccttctccaccccgtacaatctgaaccgttccacgcccaattcgaacccttgcgtttatcaacagcatataaacagtaactatggattcaattacgatttgaatgaaatcggtgggtacgcaactgacccgatcgttatatctggagatgaaaataaagggtccgacgaccaaaatgtgaatctctgttacgtccctgtgaaggctgaggaacttgaagaagaagagaaacggcgagagccgatgaacaacgccgtgtcggctgtgggggttcaagaagaaaacaatgaagtggagaaactgtctgaggagctcatggcttacgagaattacatgaaattttatcaaataccttatctggacggggaatcgccgacccaaaacggcgtagctccgcacgatagtgtcgtcggtgaactttggagcttcgacgatgatggcgttgc

SEQ ID NO: 9661 - DNA, 1190 bp, Gossypium hirsutum
  Predicted polypeptide sequence is orthologous to G19
ataaccgtcggtctataaatcctagaccccaataccaaagctttttccatctgaaaaaaaaacaggttttcttttaagataacacccaaaaatgtgtggaggtgcaattatttccgatttcgtcgcccccaaatatgaccggaaattgaccggcgatgacctttggtctgaacttgacatattctccgacctcctaggtttcgacaacaatggcaaaagctttgtcaatcatcagtttcataacaacaacaacaacaagctcattaatccaaaagacaatcaacttaacaaagagagaagcgagacgattcagaagacaagccaagtcactaaaaaggttgaaaagactcagcgaactcggaaaaacttttacagaggaataagacaaagaccatggggcaaatgggcagctgagattagagaccctcaaaaaggcgtccgagtttggctcggtacctataacacagccgaagaagcggctcgagcctactatgaagccgccaagcgtatccgtggtgataaagccaagctcaacttccctcaaacgcccaccaaaaatcaagcagcttcaccagctcttactcagcttcctcctgctaagaaaaggtgcatcgttcccgagttaactcaaccgagtttccagactgactcaccaccttatcctatgggtcttgggtatggaagaagtgaagattataagccgattgaagtggtggagagtgagttggagttgaaagaacaaatctggagcctggaatcattcctgggtttggagactaaccatgagactatgactcagctgagtggtaacggtgggactgactcactggagctttggacacttgatgacctcgtaactcagtataagcaacggcgctaacatgttcattagtgggggcgaaaattaaataatagttagcgttaatcaatgtttttgtgttacttagggtttttttatttatgctatcatgcattatatatatatatatgagaataaaggattaacgctttgctcttgcatggattagttagcgttaatcaatatttgtgtgttaattagggttttttattatgttgttatatatgtatatgcttaaggactttcatgtttgtatcaatgcattagttgcattatatatattaagaataaagggattttacacgttgcagtttgaaaaaaaaaaaaaaaa

SEQ ID NO: 9662 - DNA, 916 bp, Gossypium hirsutum
  Predicted polypeptide sequence is orthologous to G19
atgagactatgcggccgctgttacaagtcgacgaatcaacttaacaaagggagaagcgagacgattcagaagacaagccgagtcactaaaaatgttgaaaagactcagcgaactcggaaaaacttttaccgaggaataagacaaaggccatggggcaaatgggcagctgagattagagaccctcaaaaaggcgtccgagtttggctcggtacccataacacagccgaagaagcggctcgagcctacgatgaagccgccaagcgtatccgtggtgataaagccaagctcaacttccctcaaacgcccaccaaaaatcaagcagcttcaccagctcttattcagcttcctcctgctaagaaaaggtgcatcgttcccgagttaactcaaccgagtttccagactgactcaccaccttatcctatgggtcttgggtctggaagaagtgaagattataagccgattgaagtggtggagagtgagttggagttgaaagaacaaatctggagcctggagtcgttcctgggtttggagcctgatgagacaacaactgagttgagtggaagtgctgagcctgactcagtggacctttggatgcttgatgaccttgtgacacatcatcaacaacagcctcagctcttttattagaaattaaaaagttttaattagggtaatgttatgtttgatatgattatgcttaagactttaatgtttgtattaatgaagggtaaatagttgtgacaataaaaagattggccacccagttttaatttatatttatttctaatttgggtgacatgtaaattggtttcgagaaacattgaagtacccataatgttagttcatgtatcagatatagtaaacactttggattaataaaaaaacctcctaatattttatttgtaaaaaaaaaaaaaaa

SEQ ID NO: 9663 - DNA, 1079 bp, Gossypium hirsutum
  Predicted polypeptide sequence is orthologous to G19
gcacgaggatctaagaacccgaaaagtagagctttggttctctgtctgctgcttctttcttctcttggtacttcattatttttcctttcacttcctttttgtgaaaaaacattgaaacccttttcaagacgcaatagaagatgtgtggaggtgcaatcatttccgatttcattgccgtgaaacgcggtcggaagttaaccgccgaggatctttggtctgaacttgacacattctccgacctgttgggtctggattacggaaatggaaaagaccctttcactcagttcgacaacaccaaggccggttccaaagccaagaaccttgaaaaagtgacaaacgagtcgactcagaagacaagccgggggagagagaaagaagggaagactcagcgaactcgaaagaacatttacagaggaatcaggcgaaggccatgggggaaatgggcggctgagataagagatcctcacaaaggtgtccgaatctggctcggtacatacaacacggctgaagaagcggctcgagcctacgatgaagccgccaagcgcatccgcggggacaaagccaagctcaacttccctcaaactccacgcctaactcagcctcctgctaagaaaaggtgtatgatggctcctgagttgactccaccgagttctgaaaccaagagcccaccaaccccacaaccttttatgggttttggttacgagaatggagtttacaggccgagtgaagcaatggaaagcgagatggagctgaaggagcaaatctcgagtctggagtccttcctgggtttggagcctgatgagatgacaactgagttgagtggaagcgctgagcctgagtcagtgaacctttggatgcttgatcaccttgtgacacatcatcaacaacagcctcagctcttttattagaaattaaaaagtttaaattagggtaatgttatgtttgatatgattatgcttaagactttaatgtttgtattaatgaagggtaaatagttgtgacaataaaaagattggccacccagttttaatttatatttatttcctaaaattctaaaaaaaaaaaaaaaaaaaaaaaaa

SEQ ID NO: 9664 - DNA, 927 bp, Gossypium hirsutum
  Predicted polypeptide sequence is orthologous to G1917, G383
tctcataccattgccccctttaaccccatcttagtagtgaaatgatgcataggtgtagcagtagctcgcaagggaacatggtgggtggaccttgttcatgcggtggcgtgttccatagccaaaacaactcgttctcgatgatgttttcaatggcggcgaaccagacatgttacgatgaaacggatgtgatgtaccctttcgcttcttcctcttcgtctgttgattgcactttgtctttaggaacaccttcgacccgtctcgttgaagaagacggttataagcgttcttcacgccgtgaaagccgctccggcggcggaggcggcggttcttgcatgtcgaacttgtgttgggacttggtgcgaaacaagaacacgacgaaagctggccgtaataatgataataataatagttcaggcaacgatcctcttttggctcgtcgttgtgccaactgtgacactacttcaacaccgctttggaggaacggtccaagaggtccaaagtcgctttgtaatgcttgtgggattcgattcaaaaaggaagaaagaagagcttcagctgcaaatgctaatgcttcatcaatagcggaacaacaacaataccatggctacaacaacagttcatggggttcaatgcaatgttattcatcgccggtgaatgaaatcaagttcatcgaagacggcgatcctttcctttcttggagactcaacgttaccgatagaccaacaaaccttattcacgacttcaccagataaacaaaaaaccaccaccaccaaccaaaacgccattgacggtgaagaccatggcggtgcctgcaaatcactgttcccttttttagtttgtgtaacttgttttgtcttctatagatggagtaagaacgggataattctatattcttagttgcttttttttctcttttttccttctccc

SEQ ID NO: 9665 - DNA, 954 bp, Gossypium hirsutum
  Predicted polypeptide sequence is orthologous to G1917, G383
ttcttccgttgattgcactctctctttgggaactccatccactcgtctttgtgaagacgacgacaagcatatccgccatgaacgtagtaacccttgcatttccaactattgctgggacatgttgcagaacaagagcgcaccttattcacaccaaaccaccaaagctagccgtggaagcaatggaaatagcagtaacggctcaggcaacgatcctctcttagctcgccgctgcgccaactgcgacactacttcaaccccactttggaggaacgggccgaggggtccaaagtcactttgcaatgcctgcgggattcgattcaaaaaagaagaaagaagagctacagcagcaaatgcaaacaactcatcgagtgcaacagcttcaatgctggaacagcaacaccatggctatcagtatcaccacaacaattcatgggttcatcagaaccaaaaaatgccatgtttttcccctcttaatgaattcaggttcattgacgatactgatcgagattctgatactggaatcccctacctttcttggagactcaacgtcacagacaggccaacaagccttgtccatgactttacaagataaaaaaaaatcaaagaataaagaagaaaaaagaaaaggaaaagaaaccctggttcccattgacggtcaagatcatgcaccaatgactgaaacgtatcacgatgatggtgacgcttacatggtcttcgtttcgtttagtcaaaaattctttttttatttatttatttaaattttgcttttctttgtttgtctcctttgtctgtcttcaatagatggtgtaagaacgggatcatcctatgttcttagttgcttttgattttgatatttttttttcatgttctttaacttttcctttcaccttcagttttatattagtaaaacatttctgttttagagttacaactttcttcacatatcatcccctt

SEQ ID NO: 9666 - DNA, 878 bp, Gossypium hirsutum
  Predicted polypeptide sequence is orthologous to G194
tgcatacattcatggagagaaaagaggctttaaaaatggaagactatgtaatgggaaactcaaactcatcgttttgtgattacacaggcaatggtttcccattacaaagtgtatttgattcatgtagtgaagatgataataataatttttcattagggtttatggagttgttgggtgttcaagactttacctgtccttcatttgatgtggctcaacaagttccagtttcgaccaagatggagtcacctgagcagggttttaatctgcctgctacaccttactcttcctcggtttcatcagcttcgagtgaagccatcaatgatgaacctgttaaagtagaagacgaccaagaagaagaagatgaccaacaaaaaaacaagaaacagtgagtatactttctttctgttcttttttaagtttaacccccttttctcacaagacaaagatgggttttttatgtttatgatggggttttgggtgtgtaggttgaaagtgaagaagacaaaccagaagagacagagagagccgagattcgcgttcatgacaaagagcgaggttgatcatctggaagatgggtacagatggagaaagtacggccaaaaagctgttaaaaacagcccttttcctaggagttattatcgttgcaccagcacctcatgtaatgtgaaaaagagagtggagagatcttttaccgacccaagcattgtggtcaccacttacgaaggccaacacactcaccccagcccactcatgcctcggccgaatctcgtcggttctactataaattccggcatctccgccggagccgcagcagctttcagtgtgccaatgcaaaggaatactcagtctcactactactaccagcagcagcagcagca

SEQ ID NO: 9667 - DNA, 888 bp, Gossypium hirsutum
  Predicted polypeptide sequence is orthologous to G1944
gtgataggagcagaagctccatcagcttatcaaatggcacctaggaccgaaaatgttagccagattggtgtcggctcaacaacagaggatgtttcaccagttagtgtagggttaactggtagtatagaaaagaaaaagagaggtaggcctaggaaatatggaccagatgggacaatggcgagggcattgtcaccaatgcctatttcctcatccgtcccgcccagcggaggtgagttctcaagtggtggcggaaagcgtgggagaggacgaggtagcgggtaccagattaaacatcagaagggaatggacttggagaatttaggtgaatgggctgctacttctgtcgggtcaagttttacgcctcatgttatcacggtcgatgccggtgaggatgtgacaatgaaggtgatatcattttctcaacaaggaccaagagctatttgcatcctatctgccaatggagtaatttcaaatgttacacttcgtcaacccaattcttctgggggcactcttacgtacgagggtcgctttgagatactttccttgtctggatccttcatgcctacagaaactcaaggaacgagaagtcgatctggtgggatgagtgtatctttggcaagtgctgatggccgtgttgtaggaggaggagttgctgggcttcttatagctgcctgccctgtacaagttgttgtcggcagctttttacctggcaaccagcatgatcaaaaacccaaaaagcagaagatcgagtccataccagctactgttgcaccaaacccgagtattgccgctgcaccagcttcaaatgctgagaaagaggatggcatagatgttgtttcgccgcaacaaaattcgaatgccctgaaacaagcctcaccggtgctacct

SEQ ID NO: 9668 - DNA, 936 bp, Gossypium hirsutum
  Predicted polypeptide sequence is orthologous to G1944
gtccatgtcactaggcaactctgacactaactcacctcatctgccactgggtagcttggtgttatctcaagtcatgaacatggacttggagagaaacctcgataatgcagcaacaggcgagggagccacaataagtaccacagcaacagcagttccaggaccaagtggaggtggggttgattctttaggaaagaaaaggagagggaggccaagaaaatatgatgcagatgggaaccttaggttaccatataaattagcgacgacttctcctactgacttctcctcttccaagagaggtagaggcaggccccctgcttcttccaactgccaccttctagcttctatagttcagttgtttgctagcacagctggaggggactttacgccacatgtggtcacagttaaccctggggaggatgttgcaggcaaaattctttcattttctcaaaagggacctcgtgggatttgtgttctgtcagcaaatggagctgtttccactgtttgtattcgacaacctggttcatctggtggtattttaacatacgagggtcggtttgagatattgtccttaactgggtcatttacagacagtgaccgtggtggtggaaaaagtaaaactggtgggttaagtgtttcattggccggaccagatggtcgtgtaattggcggtggacttgctggttccttggtggctgctagccctatacaagttgtggtaggaagcttcatgccaaacggttacaaattgcataaaaagaagtatcaagctgagcacacggcgacagccgcaaggccaatctcacaagcggaacctgatggtgatctcaagttctgcatgacacccacatccccatttcgaaaggaaagcaatggggaaccaaatcataccacaatggataaacatacaaatgttggatcctctcatgctgttagttg

SEQ ID NO: 9669 - DNA, 837 bp, Gossypium hirsutum
  Predicted polypeptide sequence is orthologous to G1944
gttagagtggtaggatccgattctccatcggactaccacatagctccaaggtccgaaaactcaacccaaaacccgaacccgactcccggatccgttccaccgccgcagccccatgcggcacaaccaggacctccgccgccggtttcagtttcggggatgccagagaagaagaagaggggaaggcctagaaaatatggaccggacggttcagtcactaaagcgctctctccgaaaccgatatcaacatctgcgccagcgccaccttcggttatcgacttctctgccgtgaagagagggaaagtgaaatctccgatatcgttttcaaaggccaagaacgagccggagaatttaggtgaatgggttccatgttctgtcggagctaattttacgccgcatatcatcactgttaatgctggtgaggatgtcacaatgaagattatatcattttcccaacaagggcctcgagctatatgtattctctctgcaaatgggatcatctcaagtgtcactcttcggcaaccagattcttccgggggtacattgacatatgagggtcgttttgagatactgtccttgtctggttcgttcatgcccagtgaaagcggaggaacaagaagcagatctggcgggatgagtgtttcattagcaagtccggatggacgtgtagtaggtggtggagtcgctggactcctagtagctgctggtcccgtgcaggttgtagtaggcagttttctggccgggaaccagcacgaacagaatctgaagaaacagaagcacgactccgtaacaatatcagctgccacaccaatggctgttattcccatttctagtgccgat

SEQ ID NO: 9670 - DNA, 895 bp, Gossypium hirsutum
  Predicted polypeptide sequence is orthologous to G1944
ggcattgtcaccaatgcctatttcctcatctgtcccacccggtacagctgagtttccaagtggaggaaagccagggagagggcgaggcagtgcttaccagattaagcatcataaaggaatggacatagataatttaggtgagttggccggcacttctattggaacaaattttatgccgcatgtcatcactgtcaatcccggcgaggatgtaacaatgaaggtgatatcgttttctcaacaaggaccacgagccatttgcatcctatccgctaacggagtgatttcaaatgttacacttcgtcagcctgattcttccgggggtacgcttacatatgagggtcgttttgagatactgtccttgtccggttccttcatgcctactgaaactcaaggaactaggagtcgatctggagggatgagcgtctcgttggcgagccctgatggacgtgttgtaggtggaggcgtagcaggccttctcatagctgccagtcctgtacaggttgtcataggaagttttgtaccaggcaaccagcacgaccaaaagtccaagaagcagaaaaatgagtccttaccagcaactcttgcaccaaacccggccacagtcgatttacctgcatcgaatgcagaaaaagaggacggcatcggtgtgcaacattcacaacaaaattccaataccctgaaacaaaactttgctactactgctagtttcagaacagaaaattgggccaacatacaggagccaagaaattcagccactgatataaacatttctttgcctgcagtttaattttataacttaacaaatcattcatgtcttaatgtaggataaagtaatttcctgacattcacctaggttttaatttttcagacatgacatagacaatatatgtttttt

SEQ ID NO: 9671 - DNA, 931 bp, Gossypium hirsutum
  Predicted polypeptide sequence is orthologous to G1944
ccatatctgggtcactaggcaactcggacactgactcaccacctgcaccagtgagtaaccttcaagtgttgcctcaggtgatgaatatcaacaacatgagctcggaaacagcgacgacaatgacttcaacagtgattccacgaccaggtggaagaacactaagtgattctttggggaagaaaaagagagggaggccgagaaaatatgatgcagatgggaaccttagggtaccatatcagatagtgacgacgacgatgaattcacctcctggtttcactttatctccttcatctcctactgagttctcatcacacaagagaggtaaaggaaggtccccagggaactggcagcttcttgcttctctaggtgagttgtttgctcacacggccggcggagacttcacggcacatgtggtcaaagttaataccggggaggatgtagcaggaaaagttgtgtcattatcacaaaagggtcctcgtgggatttgtattctatcagcaaatggagctgtttctaatgttacccttcgacaacctggttcctctggtgggattttatcattcgaggggcgttttgagatattgtctctaaccggttcatttacattcactgacaatgggggtgtaaaaagcagaaccggtggtttgagtgtttcattggctggatcggatggtcgagtaataggtggtgggcttgccggtgtactgttggctgctagccctatacaaattgtggtgggaagcttcatgctaaatggctacaaagtgcataaaaggaagccttgccgtgagcagcacacagtggcagcttctgcagtcaccaccgctccttcggccatggccattacagaagaaggaaggccaatcatctcacaagcaaaactagattgtgaaaacaacgtgaaaccaacatctccattccaagtggggag

SEQ ID NO: 9672 - DNA, 927 bp, Gossypium hirsutum
  Predicted polypeptide sequence is orthologous to G1944
gttttagctccaaaatcaattttcaaaacctgtgttagtgccaaaaactaaatcttttgctgagtttcaagttaaaagttgatatctttcaactttgtctgttttgggttcttttttattgttaaaaattagccttgtttttagctggttgagcttaaaatccaaatgcgtttttgataaaatctcagaaagtttttagttttaactatggagtcaagagaagctgttactaatactaatattagtactaatactatcaccaccaccaccaccactactactactaccactgctggcgtaacggtggtaggatccgatgctccatcggactaccacatagctccaaggtctgaaaactcgacccaaaatcctaacccggctcctggatccgctccgccgcagattcctcaacaaccggcggctcaacaagtccctcagcctgttgtggtgccggggatgcccttgaagaagaagaggggaagacctaggaagtatggaccggatggttcagtcactatggcgctctctccaaagcctatatcaacggctgccccacctccagtaatcgatttttcagccgggaagagagcgaaagtgaagtcgccgatatcgtttccgaagactaagtacgagctggagaatttaggtgaatgggttgcatgctctgttggtggtaattttgcgccacatatcatcactgttaatgctggtgaggatgtcacgatgaagattatatcattttcccaacaagggcctcgagctatatgcattctttctgcaaatggagtgatctcaagtgtcactcttcgtcaacctgattcttccggaggtacattgacatatgagggtcgttttgagatactgtccttgtctggttcgttcatgcctaatgacactggaggacagaagcagatcgggtgggatgag

SEQ ID NO: 9673 - DNA, 899 bp, Gossypium hirsutum
  Predicted polypeptide sequence is orthologous to G1950
gttattcctgtattttcatggtatgtcatgaggatgattcgataattggggaatttttggaaggtggatgctggtgattgaaataaataggttaaaaagtcttgaaatttgttgttgatcattgataaagctctcgttttttatcaaaatattgaatttgttgtgataattttgttatttcgggaaggggatagtttgaatccgttctctttttgggggtgttaaagtttgagtttctggacttcgggtaaaccttccgttagggactctgattgggagctgttacggtttatcggaaagtggctacagccacaaccatggggggagttccgactgacaatgtggactttgttgtgaccttggatgcagagagtaggtgttcttcggagtaagccgaaaaactaatagaggaaaacgctatctttgttagttctgcccttcgaatcttcttgttctttaaccttcttctttcccttacttcttcttttatctgtaattttcgcttcaaacatggaaattaatcctccaactaagtcagttgaaattaaagagaaagacctcttcaaagctgcggagaagggcgattcttccatattcaaatccctctcccaagaccaccttaccaagtctgttaaactccggaatgaagacgcccgatctcttctccacgtcgccgtctcctccgcccaccctgaggtggtcaaactactctctgccgccgctgatgaatcagttgtgaatggtatcgatgaagaagggttgggctcccattcactcagccgccagcattggtaatttggaaattatggaaatcctgttgaataaaggagcaaatgttaatgtgaaaaatgatggtggccgcaccgcccttcattatgctgctagcaagggatggttga

SEQ ID NO: 9674 - DNA, 823 bp, Gossypium hirsutum
  Predicted polypeptide sequence is orthologous to G2
aaaaaatgtgggatcttaacgattctcctgatcgttcaagagacgaggaatcggaagggtgttcatcgccggtagacggtgaagaagggaagggtaaacgggttggatccgtttcgaattcgagttcttccgccgtggtgatcgaggatggatcagaggaagaagatgcagcagctttaaagaaacgaaacagtaacatgatttttgggttctcggtgcctgtcgagaccggtggaccagctccggtgactcgtcagttttttccacttgaccaagacccagaaatgagggcagttcccagcggaactgcacaagggttccccatggctcactgggtcggagtcaaattccggcaatcggaaccactcgccgttgctaaatccgttgaagctacgaatcccatgaaaaaaagtagaagaggaccaaggtcaagaagctctcaatatagaggtgttactttctatagaagaaccggcagatgggaatctcatatttgggattgtggaaaacaagtttatttaggtggatttgacacagcacatgccgcagcaagagcatatgatagggcagcaatcaaattccggggagttgaagctgatataaatttcagcattgaagattatgaagaagatttgaaacaaatgagtaacttaacgaaggaagaatttgtgcatgtacttcgtcgacaaagcactggtttccctagaggaagttctaaatatagaggagtaaccttgcataaatgtggaagatgggaagctagaatgggtcaatttttgggcaaaaaatatgtttatttaggcttgtttgataccgagattga

SEQ ID NO: 9675 - DNA, 550 bp, Gossypium hirsutum
  Predicted polypeptide sequence is orthologous to G20
ttaaactgaagataaaattcttaattagaccaattttaatttgattacaaagaccaattcatatctcaactgtaacattaccagataatacacgtggaatgtcttacatgctatacaatatacaccaaaattttcttcgtatatgcttttagaacttgaggaagtattgcaaaagtctcattctaagataaaccggcctgtgtcttataaaaaaagaaatctgcaaaagtaagaattcaagcaaaatatatattcctcccattgcacccgaattactcattcctcaggccgaaagaaggtatatgtcgaactcgtctccgtctttgtaacctcaggattacgagatggtccagtaggaagagcaggaacaagagatgtccaaagcacagggtccaccaaggagtcaattgtattgtagttggtgagaagtggaacagacaagaagggagtcaaagggtacacatttttctgaagagatgataacccaccagtcatccccattgcggctccaagtctgtcacctccagtatcatgatttactgatttttca

SEQ ID NO: 9676 - DNA, 650 bp, Gossypium hirsutum
  Predicted polypeptide sequence is orthologous to G2011
attgaaacccaggatctctttccaaaaccttcttcattatcttaaaaaaacgaaatgaatccagacgaagaaaaacgctctccgaattcccttccaaacctaccccaaacgtcgaccttcccttcctcattaatggaactggaaacgttttcaagtggcgtgcctcagcctttggaaattcttcatgggaacccagtgccgccatttttgtcgaaaacgttcgatttggtggaggacacgtcgttggatccgatcatctcttggggtccgacgggacagagcttcgtggtttgggacccggtcgaattctctaagttcatacttcctcggaatttcaagcacaacaatttctccagctttgttcgtcagctcaatacttatgtgcgtattattgcaatagtacagcctacataaaaaaaaatatcgctgatggcatttggttttgtaacttttgtttctctttctttctttctttgattgtttgtttgtttgcctgtttttgttttccgtatttatttttttaaggcttaatctgtaaactggaacctgtaattgtagaagcccgatttgtacacattggttgtaatattctaattatcgaacttttgtacaaagattttgtaaaaaaaaaaaaaaaaaaaaaaaaaaaa

SEQ ID NO: 9677 - DNA, 877 bp, Gossypium hirsutum
  Predicted polypeptide sequence is orthologous to G2057
gcggccgcgtcgacccaacatgcaagaaaaatgggagatagccaccaccaagctgcaacatcgtcaagattggggataaggcactctggaggggagatcgttgaggtccaaggaggtcacattgttcggtcaactggaaggaaagaccgtcacagcaaagtttgtactgccaaaggtcctcgagaccgacgtgttcgtctctcagctcacaccgccatccagttctacgacgtccaggaccgacttggctacgatcgtcctagcaaagctgtggattggcttatcaaaaaagccaaacctgccattgacgagctagctgaactacctccttggaaccctgaaactttgaatacaaccacttcgatcgctaaaactagtaaccaagaagaccaaaacgcgacaaccgcaaccgacaatgataagccgtatcagttccacaccaaccatagtggaaacctggtggaaaaccttgctgctgggtcgggtactcggagaagaacggctacaataatggggaatgaagttcaaagtcttcagcaacaagaaatgggagataaccccaataataattcgggttttcttccaccttctttagtttctgatgagatagcggatacaattaagtcttttttcccattgggagcctcaagtgagacgccgtcttcttccatacagttccagaattatccgccggatttgttgtcgaggaccagcagccacagtcaagatcttcggctttcacttcaatcttttccggagccgattcttttgcaccaccaccaccaccacgcccaagctgctacagctcaggcacaccacagtgaacctgttttattctctgggtcagcccattagctggtttcgatgggtcttctgc

SEQ ID NO: 9678 - DNA, 732 bp, Gossypium hirsutum
  Predicted polypeptide sequence is orthologous to G2057
caaacatccaagcttaacccaacatgcaagaagaatgggagaaagcaatcaccaagctgcaacatcgtcaagattggggttaaagcatagtggaggcgagatcgttgaggttcaaggaggtcacattgttcggtcaattggaagaaaagaccgtcacagcaaagtttgcaccgctaaaggtcctcgagaccgtcgtgttcgtctctccgctcacaccgccatccagttctacgacgttcaggaccgccttggttacgaccgtcctagcaaagctgtggattggcttatcaaaaaagccaaatccgccattgacgagctcgctgaactacctccttggaacccacaaaccttgaaaacaacgacttcaaccacgaaacaaaataatcaacaagatcaaaacataatcacagcagtagacaatgaaaagcccagaagaacggctacattaatgggaaaccaagttcaaattcttcagcaacaaggaacgggagataacccgaatagtaattcgggttttcttccatcttctttagtttctgatgagattgcagatactatgaagtcttcttttccactgggagcttccagtgaggcaccgtcttcttctattcagtttcagaattatccaccagattttttgtccaaaactagcagccacagtcaagatctgcggctttcgcttcagtcatttccggagccggttcttctccaccaccatcaccaagctgctgc

SEQ ID NO: 9679 - DNA, 912 bp, Gossypium hirsutum
  Predicted polypeptide sequence is orthologous to G2071
atttcatttagaaaactgggttttcttttgaataattaatcgactcatatgtagtatctgatttttttaatttttggggggcgtgattgtgtgttctgatctttcaattatttggcttgttaaatttcttgagcacattggaatgttaggtgttactagcacttgcagaacaaaaaaagaaagagttggtctttactttcccttttgtgtttatgtttttttattgtttttcttagttaaagaattcctgtatagatcttgatttttgggtttttcctctttttttttaacgtgtacttcccaaatatagaaatatgtaaatctttcaaactgcatgggatttattttatctgttttattttcattgaagtagtagttaaggacttttatatagcatagtttttaggatcatttctttgacactgttttatacagattttaatggggactaacatgaactttggaagtaacccaccgccgtcaggtgattgcggcgggaacaaaccgccgggcaataacctgttaactagacagccgtcaatctattctctaacctttgatgagtttcaaagcactatgggtggaataggcaaagattttgggtcaatgaacatggatgaattgttgaggaacatttggagtgctgaagaaattcaaacaatggcgtcttccggtggtgtcctagagggaaatggagggttacaaaggcaaggctctttgactctgccaagaacacttagccagaaaacagttgatgaagtctggaaagatatttcaaaggagtattcattggggaaagacggtattggaggtggaggaggcactaataatatgccacaaaggcagcaaactttaggagagatgactttagaggagtttttggtgagggctggtgtggtaagagaggatacc

SEQ ID NO: 9680 - DNA, 550 bp, Gossypium hirsutum
  misc_feature (85)..(85): n is a, c, g, or t
  misc_feature (467)..(467): n is a, c, g, or t
  Predicted polypeptide sequence is orthologous to G2085
tttttttttttttttttttttaaaggaagaaatcatttctaatcttcctacagacaccatgtaggctgtatttcgcaattctggngttacataatgatcggcaatgaaccatatatacagttgtcaaacgaactcaattattacaacaaagttcgacctgtgccccttaaacatcaagttacatagcactcaccacagcagaaggatcttgttaatcatctttcagcagtgcacagtggagttatccccattagatgaagatacaacatctggagttacagttacagcctctgactcgttagcttcagcatcactctgctcagcagtctttacagttggatccgggattgctactgtacaaacctttgaaaggtctctcaaaacacccttatttgcccacttggagtccaccatgcattgcccaagagtccttggaccagcaggtccacgaaggcactcataggagntttctcttagagctgattccacagctgtggtacattaaacttcttggaatattctccatcttgcccagaaaccctaccatgca

SEQ ID NO: 9681 - DNA, 936 bp, Gossypium hirsutum
  Predicted polypeptide sequence is orthologous to G2085
gcgctttcgatttcattgcctgtaaatgcttcctcaatgtacggacaatctcagccaatgaacattccacctcagatcgccggctccggcgctgacatcgacgacgatgtttcagcctccgtatccgtcgataaccaccacatcgttacttacgaggctccctccctcgacgacggtggtggagtagacgacgtagccaccaatcctttctacgccactgccgccgctacttccgcctctggcttggatgttgttccacgaggcgatggtgccagccaactcactctatcgtttcgtggtcaggtctatgtgtttgatgctattactcctgagaagtttcatgcagtgttgttactgttgggtggatgtgaactgacttcaggcccccatggtgttgaaatgtcatctcagaacctaagggttggaatggactttccgagatctaatcaaccgcacagagcagcgtcgctagacaggtttcgcaagaagagaaaagaacgatgctttgataagaaagttagatatggtgttcgccaggaagttgctcttaggatgcagcgtaataagggtcaatttacatcttccagaaaatctgatggtgattatggcagttgtagtcaggatgatgataacctagcagatactgtttgcacgcactgtggcattagctcaaaggccacccctatgatgcgacgtggcccatctggtccaaggtcactatgcaatgcttgtggacttttctgggcaaacaagggtactttgagagatattcccaagaaaactcatgaacattccccgactccagttgagcagggagaaagcgaaccaaatgactcggattctggaactgctattcctacagaaagcaacgtagtacctttctcaaacggggatgactcggctctaatcggcattgccgagcactaatcatccatg

SEQ ID NO: 9682 - DNA, 532 bp, Gossypium hirsutum
  Predicted polypeptide sequence is orthologous to G21
taccaattaatgatcaagaatcggcagacgtaatggagcgagcagcttgatggtagtgcggtaatcgtgggctcgagctgcatttctgcggtggggtaagtcccgagccatattctcgatttcttttttggttgtcggatttcggacacccatttgccccaactccgcattcgtacaccacggtataccggttgcttcctttccaagtctcctacagctttctttgaacctttaatagctacactgttttttgaagttttcttgtattgtttaggacccgaaacggagaatgagatggaggtggccacggtggtagtggtagagatgacggaacaagaagtaagcgggttattataatgagcatcattctcaatgtcgatatccctttccatgacagatagatagatgcctagttttttgttaaagaaagaaattctaaagttgtaggggcctttatgatttatgattctttcacccatgaattctcatttaaaaatgcatgatatgatatgataaaaaaaaaaaaaaaaaa

SEQ ID NO: 9683 - DNA, 905 bp, Gossypium hirsutum
  Predicted polypeptide sequence is orthologous to G2107
ctcaacaacttcatatacatataaacccctttcatttcacacttcaaattcataaacttatcttttattttacaactttgggtttgattttattctactgggagtgaaagttcaatgtcaagctccttgttcaaatgctaaaagtcaaatatttgtttaattgaaagttgaattcacggttttattccttgttatggattctttgagtttagattatgggtcggtttcgtcaccgatgtcagatagtgggagtggaaatggagcttctcgtccgccgaatttttccgatgaagacgtgatgttagcttcgtgttaccccaagaagcgagcgggaaggaagaaattccgggagactcgacacccggtgttccgaggagttcgccggaggaactccggaaaatgggtttgtgaagtaagggaaccttacaaaaagtcaaggatttggctcgggacttttccgacagaagagatggcggcgcgtgcccacgacgtggcggcgttagctctgagaggaaggttggcttgtttgaacttcgcggactctgcttggagactccctgtaccagcttctaccgatccaaaagacatccagaaagcggcggcggaggcagcggaagttttccgacctgttgattccgccggagatagctcaaagacagctgaaaacacggcggtggagggaactaaagagtcggaagaagtgttttttttggacgaagaagcagtgtttgggagagaaaagtttttggcaaacatggcggcggggatgatgatgtctccgcctcacagtggatatgaaaaagatgaacaagaacttgagtttgtcgatgattgtgtgcagctgtggagctattctatttaaaagtataaatatatcagactcaatagaatttgatcaatccttt

SEQ ID NO: 9684 - DNA, 928 bp, Gossypium hirsutum
  Predicted polypeptide sequence is orthologous to G2107
tccaaatccaaaaccaaaagattcaactcccaaaaccgaacccagacaccataatctcgaaaccgttttgaaaagtactttactgctccttttgctgcttaaaaacccaacacccataacttgttttttactcaattcaatggatattccaagtcaaacgtgtgacgtccccttctccaagtcttattctatgcgtgctgaaagggtagagccatcttcatcttctgaagggggcattggtggccagcgagctgttcactctgacgaggaagtgcttttactagcgaccaacaggcctaagaaacgagcagggaggagggtattcaaggagacgcggcatccggtttttagaggtgttcgaaggaggaataatgataaatgggtatgcgaattgcgggagcctaataaaaagactcgcatttggcttggaacgtatcccacccctgaaatggctgcccgggcacatgatgtagctgcattagcattcagaggcaaggctgcttgccttaacttcgctgactctgtttggaggttacccgtgcctgcttccaacgatgccgccgatatcaggagagccgcagctgaggcagctgaagcatttaggcctcaagtattccaggaactctccggtagcgacgtcaggcagggaagcttcaaggcttccgattgtgaagtttcgagcagtgacgtcaagttggaaaacaagaaaaaaatggcagctgaaggtgaagtttcgacagagaaaattcacttcatggatgaagaagaaatgttctacatgcctaagctgcttgacagcatggctgaagcgcttctactttcaccaccaaggaatcgcgatgaagctgacagtgatatcgatgtgtctttatggagttactcaatctgaagtgtacaaactacaaactactgcaagtgtttgttttgt

SEQ ID NO: 9685 - DNA, 1102 bp, Gossypium hirsutum
  Predicted polypeptide sequence is orthologous to G2107
ggccattacggccggggagaaaaagaaagctcatttagttaatattttcccttgcatttccaaattcggaagttcatacagcaagtgatttcctaaaatacttggatcctaagtacgaatatccttttcttgaaatatactctttttaagtcaaaagctttgtttaactgaaacttaaactgattactgtttgggttttttttttaaatggattttgtagttcaagattatgatatggttgattctgggtcggtttctgaaagtggaactgatcgtccggtgaatttttccgatgaatatgtgatgttagcttcgagttatccaaagaggcccgcgggaaggaagaagttccgggagactcgacacccggtgtaccgtggagttcgccggaggaatcccgggaagtgggtttctgaagtgagggagcctaataagaagtcgaggatttggcttggaactttcccgaaggcggatatggcggcgcgtgctcacgacgtggcagctatagcactgagagggaagtcagcttgtttgaacttcgctgactcagcttggaagcttccggtcccggcttcttccgacccaaaggatatccaaaagacggtggcggaggtggcggagactttcagaacggctgagcattcgagcgggaattctagaaacgatgcaaagagaagtgaaaacacggagatggagaaagggttttacttggacgaagaagcgttgtttgggacacaaagattttgggcaaatatggctgccggtatgatgatgtcacctcctcgttccggtcatgacggaggatgggaggaacatgaagtcgatgattatgtacctttatggagttattctatttaaaagtaaaatttttcagacattttcaagcattcattggaatttttagttcacagaaatcgccaccggcaattgccctttatgttttgtacgtacaacgatttttttggattgtacgggtagtgctgtaagtaaaaagattaatgtgtatatatacgatgtatatatacttcatagcttctccaaacaataaatttatagcttcatatctattttaccatcaaaaaaaaaaaaaaaaaaaaaaaaa

SEQ ID NO: 9686 - DNA, 796 bp, Gossypium hirsutum
  Predicted polypeptide sequence is orthologous to G211
gttttctctctctttcatttgttccaatgtttgagagagagtgaattgagtagcttcatccacaagtgaaaacaataaaaatatatatatacagagagagagagacatgggaagggctccttgttgctctaaagttgggttacacagaggtccatggacacctagagaagacacattgcttgtcaagtacattcaagctcatggcgaaggtcactggcgatccctccctaagaaagccgggctacttaggtgtggaaagagttgcaggctgagatggatgaactatttgagaccggatatcaaaagagggaacataacacccgacgaggaagacctcatcatccgattacattcactcctcggcaaccgttggtctctcatcgccggaaggcttccgggtcgaaccgataacgagattaaaaactattggaacacccatctaagcaaacgtttattaagccaaggaaccgatccgaccacccacaaaaaactaccaccggataacccggttgtcgtccttgtcccgaagaagaaaaggaagaacaaatctacaaaaccaaccgagcaagaaaaacccaaaatccatctcccaaaacccattagatttacatcttcagtgtgtaccactaagtcttcgagccaaggaggtgaaaatggacaagtcctcgtcccatggtccaaatacatcaatgatgatgaaaaccgaactgggtttttatgttataatgacgatcatgatcttatcaacagctcagatttcgagtgccagtctcatcatgatcatgaccatgatcat

SEQ ID NO: 9687 - DNA, 1070 bp, Gossypium hirsutum
  Predicted polypeptide sequence is orthologous to G211
attcacaataaatggtaagcaagtgaagattcaaaatccaaacagccacgacagtacttccaaaacagtgtaagaaaaattaaatgacaaaagaaatagaagctatcgctaatatcaaatcgccgatcatcaaaatagttatctctctaagctaaaaaaaaaaaccatgagaaaccctacgaaaaaagacaacgttggaaccaagacgacgccgtgttgcagcaaagtagggttgaaaagagggccatggacgccggaagaagacgagttattatctaattacatcaacaaagaaggcgaaggacggtggcggactttacctaaacgggctggtcttctccgatgcggaaaaagctgtcgtctccgatggatgaattatctccgaccttctgttaaacgtggccagattgctcccgatgaagaagatctcatcctccgccttcaccgccttttagggaatcggtggtcactaatagctggaagaataccagggcgtacagataacgaaataaagaactactggaatactcacctgagtaagaaattgataagtcaagggatcgatcctcgaacgcacaagcctttaaaccctcaacaactctcaccatcaccaccatcactcaaaccttcaccttcttcatcatcatccatggcgaaaccaaacaatcctccttcccctcttcctgttcatgtcgtcaacgctaacaagcaaaattattatgacgatgggagcaatgaagaccatcaagggatgatcatgaacaatgaccattatcagcaacaacaagatcatgatgatgtgttctcttcttttctgaattcattgataaatgaagatgatgatgcattggtttcgaatttgggactctcacaaggatgggaatctactcccttcgatcaaccaaaatgacccaatagagggtttgatgatgaatgttatttatatagttttttttcaaagtgtgttgattgtatgtttaaatcatgttgttgccaaacttaattcatcaaacctgatggttctttttatgtttgttgtgtttgaaagaaacatatgaatgtattgtttc

SEQ ID NO: 9688 - DNA, 981 bp, Gossypium hirsutum
  Predicted polypeptide sequence is orthologous to G2130
ctcctgttcctttccagtatctcgccttttgattttactctccgccaaagttttagtttcttttttcttctctctctcgaaaacagaatccccgtttttctttatgttaaccacctggaaatgaatccagggagggtgaaatacacagagcgaagaactgttactaataagctactcaaggcatcgagcaagtggtttcccatggagtccaagcccaaagcccctaggatcgtcaggatttctgtcaccgatggcgatgccaccgattcttctagcgatgaaagcgagcaggagagacatcacacagtgaaaaggcatgttagcgaaatcaggatcggagattgttctacattcaattccaacaagccatcaaacaagcaaaacagaccgactaacaataagaccaatcttgtcaatatcagatcaaagaagcaacaaccgcagcagcagcagcagcaatgtttgtctaacggcgtcaagtaccgtggggttcgacaaaggccgtggggaagatgggctgctgagatcagagacccgacaagtcgaaccagggtctggcttggcacttatgatacggctcaagaagctgctttggtttatgacagagccgcgattcgaatcaaaggccctgacgctctcaccaactttataaagcctcctgccagaccctccccacctgagattgaacttgaaatgacttccgggtatgattctggccaagaatctcactcactctgttcaccaacttctgttctgagatttcagtcgaatgaagaaactgaacttcaaaccgagtccaaagatgactcaacaacacaaactgggtggagccctgttaaggaactctctcaatacccaagtaacttattagacgagtttttgttaacagatccagtggttttatatgattacttggattctgataaccctacacccatattttttgatgaactgagtttaccggaagcaagcagcaatttg

SEQ ID NO: 9689 - DNA, 912 bp, Gossypium hirsutum
  Predicted polypeptide sequence is orthologous to G2144
ctaagcttgagctgaccgccctccacgaatctaacccaactttctcgcttcacttctttaacctgttaacactgcaatttgggttgaactaaccaagtggctgctttttattttcctgaattttgaacgtgggtatttttcacacttcccaaattgcctagtcccaccgctctctaatggagtcgaaggcagggacgacggaaaccagatccaacataacggcgtcagacggggaccaagttgcggcactcgaatccctacaatttacagacgaattccaccgtttaatcttggctccgccatctgacaatgcgacttctctcgcggctcttcttgaactcccggcttcacgagcccttgagcttcttcactctccggcttcggctaagcttatcgctgctccggctcccagctttgaagctttaaaaggaaactttctttttccttctaatacctctttgattgatcaagctgcgagatcctctgtgtttgctggaggggttaacaacaccaataacaagagcaacgcgcctgaaacgacgtcgaacaattcaaccttgaatcttgagaaagcagtgaagagtgagccggcggagaccgagtcatctcagccgttggtttctgacccagcggtggagaagcggaatttcaagagaaaggatcgcgaaaagaaggctaaaggttcaacgaagaaaagcaaaactgcggtgaatgatagctcagatggccctgaaaagctgccctatgttcacgttagagctcgccggggagaagcaacggatagccatagcttagcagagagagcaaggagagagaagattaatgcacgaatgaagctactacaggagttggtacctggttgcaataagatttctggtacagctttggtgttggatgaaatcatcaatcatg

SEQ ID NO: 9690 - DNA, 985 bp, Gossypium hirsutum
  Predicted polypeptide sequence is orthologous to G2144
ttaatatctctcaataacaattaacaagttttctattagcttgagctgaccgccattgaagaactaaatcaaagcttgtaaaaaaaatatttgaagttgttaagagttgaaattggggtgaattaaaggtgtgggtgttttttattttaaaagaattgaattgggtttttttcagaatttggattttgggtttgttcttcgtttttctgctatggagtcaaacgcggggacattggagaccagatctaataaaacggcgttggaaagggaggaagtagcggcacttgaatcgctacaatttacagacgaaatccactgtttgatgtcggctccggcgaccgacaatgccagttccttcacggctttgcttgaactccctgctccccaagctgttcagcttattcactctccggattcggctaacctcattgccgctccagctccgaacgttgaagatttcaaaggcgggtttcattttccttctaatggtgggctaattgaacgagcagccaggttctccgtgttcgccggcgaaggtaataacaagagcgactcgcctgaagcgacgtcgaacatttcaagtgcaaatctccagaaggcagtcaagagtgaaccggctgagaccgactcgtctcagccgttaatttccgatccaacggtggagaaccggggtatcaagagaaaagaccgagaaaaggtgaaagggcagacgaagaaaagcaaaacaacggtgaaagagagctccgacgacaccgagaagctgccttacgttcacgttagagctcgccggggacaagcaacggatagccatagcttagctgagagagcaaggagagagaagataatgcacgtatgaagctcctacaggagttggtaccaggatgcaataagatttcgggcacagcgttagttttggatgaatcatcaaccatgtgcagtccctacacgtcaagtggagttcttatcatgagactcgctgcagtga

SEQ ID NO: 9691 - DNA, 801 bp, Gossypium hirsutum
  Predicted polypeptide sequence is orthologous to G2147
ccacgcgtccgggaacaggagactagaggtgaaacaggtcgctcccaggccacaagacggagtcgagcatcagctattcataatctctctgaaaggagacgaagacatagaattaagcaaaagatgaatactcttcagaagctagtgccaaatgcaagtaagacagataaagcttcgatgcttgatgaagtgattgaatacttgaaacaactccaaacacaagtcgaaatgatgagtatgagaaacatggcggcccagatgatgatgcagaagacgcggcggcagcttcaaatgtcggctttagctcggatgggcgtcggaatggggatcggaatacttgacggtaacaactccttggctcccaatccttcaccagtcactgctcccacccacacatttcttcctcctcctcctccgtccttcgtgacaccgccgcctatgattccaacgcgcttcgcggcggctgctcaagcgaattcagatgctagctcacatggctccattccttcgcctgatccgtattgcactttactagctcaatccatgaatatggaactctacaataacaagatggcagcactgtatcgaccacaaattaatcaaactacacagacatcaagcaacccatcgaggtcaaacaatgtagcaaaggattaagatgaagcctaatggtccacccaatttgtgagaagcatatgtatttatgttactcgagcttgaggtatgagtgtaacaatgtgtgcaatacgtgtatgtattttcagacatgcctcactgttttctgatatgtcatagttgaaa

SEQ ID NO: 9692 - DNA, 563 bp, Gossypium hirsutum
  Predicted polypeptide sequence is orthologous to G2156
gtcgacacttaaaaaaaaatcaaaacaaaacaaaacttccttcctttctcattcggctgaaccaaaaaaaagggctcctcattcaatcgtcccttttgcttctctccttggccgatcatgggtttcatcggcgtcccatgcgcctccacctatcgtggctcatggctcgggaacaaaggagacgagaggcgtcccttggtccaaatccatgccgttgaaagggtctccgatggccgaaaccgcgggtaggttcccttccccgacctcaaaaaggtcttcaaggaggtgatgggaccaggtggaggagaggcggtgcaagtggaggcacctagggtttgctgcttgtttttttctgctggtggtttgggctggggtaagttgggtattaatgggcccgggtaaatttgggtacttacaaccaaatttgctccgatcttcttatttgccttcttccagtacatatcattcacttacttataacgcttcctctctccatcaaaacaactctttataattccaagacattgtcctattacttggatgcaaaaaaaaaaaaaaaaaaa

SEQ ID NO: 9693 - DNA, 597 bp, Gossypium hirsutum
  misc_feature (435)..(435): n is a, c, g, or t
  misc_feature (480)..(480): n is a, c, g, or t
  misc_feature (507)..(507): n is a, c, g, or t
  Predicted polypeptide sequence is orthologous to G2226
cttgaaaaagcttacaattttttttatataatttctgttagaaaaaaacccagttcacttttcagttcttggtaccttggctgaccatttttgtttgaattgcaggttaccagggtttagccattgcttttcatttgaagctctcctccccattgtttttaaggtcatatatttattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccaccaccatcatcggattacactgaaaatctctcggaatcattcgatttccaccttaatactcctgaaagttacattgaggaattccggagtatgaccccnacaattcatttcggtgctgttgtatgtagctgcaaacggcctcancacgactgtcaggtgtgtctgactcantttgagccaaaatccgagattaaccacttgtcgtgtggccatctctttcacaaggtgtgtttggaaaaatggttggattattggaatatc

SEQ ID NO: 9694 - DNA, 694 bp, Gossypium hirsutum
  Predicted polypeptide sequence is orthologous to G2226
gaaaagcttacatgtattactttcatgttaaacccagttttcttttccttatgcatcactgatcccatgaaaatttgtcctctttttgtgtcatatatatctgcaagagagtgacatcatttatatccttaactagttcatataatcatttgttcgaataaacttagcttaatcttgatataaaagaatgggtctctcaagtctcccagccccatcagaatgagtgctatgtgtactcttggtaaacacagctttatccatatctatggttaaaggcataattcgatcaatccttcacattatcggtatccatctctcctcgtcctcgtcctcctcctcctcctcgtcatcatcatcatcatcatcatcatcgccatcctcggatcttattgaaatccctgcggtatcattcgacatcagcatcggtaatgctgatagttacattaaagagttccggagcaggattgccatcgacccggtacgatgcggtatgtagcggcagtcaaccggagcatgactgtacagtttgcctgactaggttcgagccagaatcagagattaaccgcttgtcctgcggtcatctgtatcacaaggtatgcttggaaaagtggttgaactattggaatgtcaattgccctctttgcatgaacgctctgctgccagaaaacgaacgggcctacttttgggaagcgtg

SEQ ID NO: 9695 - DNA, 954 bp, Gossypium hirsutum
  Predicted polypeptide sequence is orthologous to G2239
ctcctttcctcaccatgtcgtacaccacccaccatggagtcttctcgcttttcttcttgctcttcctgctcctctccccgccgccgtccttcgcacagaacttcaaccaagacgaagaaaattacgctcgtttcagcccttccatggccgtaatcatcgtcgttttgatcgccgctttgttcttcgtgggtcttttcgccatttatattcggaattgttccgacgtgtacaccaacagacagagcatccgccccgtcgccgggcgttcattgcgcggcacgcgtgggctggacgcgtcggtgatcgaaactttccctatcatggtttactccgaagttaagggtcataagatcggcaagggagctttggagtgcgcggtttgcttgaacgaattcgaagacgacgaaacgctgcgtttgatacccaaatgcgaccatgttttccaccctgaatgtatcgacgcttggttagcttctcataccacttgccccgtttgtagagccaatctcgttcctcaaccaggtgaccccgtgagtcaactcactgcattaaataacactgccgtcgagttagaccttgaggctcagaacaatggcagtaactcagaaccggaagaagaaaggagcataaataacaacgctgttaattgtcaggtagaggctcaagtggcttcggaggttgaagtgaataatttgaatgtaactttaaataggaaccgtacacgtggatcaagatctggccgtccacgtaaactttctttcttgcgatctcactcgaccggacattctttggtccaaccgggggagaatacagatcgattcactttacgattaccagttgatgttcggaaacaattaatgaaccgaaagttgaatcgggcgacaagcttagtgttgcccagggaaaggagttcacgccgagggtaccgagcatcagaagatggagggagtaata

SEQ ID NO: 9696 - DNA, 891 bp, Gossypium hirsutum
  Predicted polypeptide sequence is orthologous to G2239
tggaattatctccttccatttcttcgtcctcttgctcctcatctctccgccaccttccactgcccaagtccaacccaccagcccaaacgacgaacaatactcttacgcgcgtttcagcccttccttggccataatcgtcgtcgttctaattgctgctttgttctttttgggtattttctcgatttacatccggaactgctccgaatccaacgccaatggaagcagcgtcaatcctgttaacggcgaagccggccgttcgcggcgtgggacgcgtggacttgaagcgtcggtgatcgagactttccccaccatgatttactctggagttaaggttcataagatcggtaaaggagctctggagtgcgcagtttgtttgaatgaattcgaagacgacgaaacgctgcgtttaataccgaaatgcgatcacgtttttcaccctgaatgtattgatgcttggttggcttctcatacgacctgccccgtttgtagagctaatctcgcttctcaaccaggtgattctggagtgagtcaacccactgagttgaatgagatcgccaccgagatagacctcgaggctccgaacgacagcagtgactcggaaatggaaggagaagaaaggagaataaacaataataatgtcagcagtgacgtagaaggtggtgttgctctggaggttgaagtagttgacttgaacaaaactttaaataggaatcgtacacgtggatcaatatctagccgtacacgtaaattcttttttccgcgctcccactcaactggccactctttggtccagcccggtgaaacaccgaccgatcaccttacgattgccggctgatgttcgaaaccagttaataaaccggaattgaaccgggcacgagcttggttttgcta

SEQ ID NO: 9697 - DNA, 942 bp, Gossypium hirsutum
  Predicted polypeptide sequence is orthologous to G2239
gttctccaccgccaaacatggaatcgttttcgttcttttcctactccttttcctctctccgcctccctccaccgctcaacctaccgacccgaacaacgaccgttacccttacgcccgtttcaccccttccatggctatcatcgtggttgtcttgatttccgctttgttctttatgggttttttctctatttatcttcggaactgctccgaagccaacgccaacggaagcgtcgtccgccctttcaatggcgaaactgggcgttctcgccgtgggatgcgtgggcttgagccgtctgtgatcgagactttccccaccatggtttactccgaagtgaaagttcataagatcgggaaaggagctttggagtgcgcagtttgcttgaacgagttcgaagatgaggaaacgctgcgtttaatccccaaatgcgaccacgttttccaccctgattgtatcgacgcttggttggcttctcatactacctgccccgtttgtagagctaatctcgctcctcaacccggtgaccctgtgagccaacccgccgagttggataacaccaccaccgagttggacctcgaggctcagaactacgacgatgactcagaactggaagaagaaaggaggataaatcctaataatattaactccgatgcggaggctcaagttgcgccggaagttgaagtaattgacttgaaccgaactttaaataggaaccggacacgtggatcaatatcaagcagaacacgtaagttctttttcctgcgatctcactcaaccgggcactctttggtccaaccaggtgaaaacacagaccggttcactttgcggttaccgggttgatgttcgaaaacagttaataaaccgaaagttaaatcgagcaacgagcttggtgttgcctagggaaagaagctcagacgaggataccgaacggagaagacggtggt

SEQ ID NO: 9698 - DNA, 512 bp, Gossypium hirsutum
  Predicted polypeptide sequence is orthologous to G225, G682
ggcaccagcaatccgctgcggaggctgcattcctgcgtccgttgcccatgacccgatcttacaggatcggggaagcgatcgggcagtggcggaaaaccccgtcggacacggcgcttcaccggggtcggacgcttcgaatgcgtctgcgaagggtgagcacatccaaaccgagcctgacggaccacatgacggcgcgggacccgtcgtcgatcacccgatcccggcgattctaaagaggaatccagtgaagattccaagcttgacttctcagaagatgaggaaaccctcattattagaatgttcaatttggttggagaaaggtggtctttgatagcagggagaatccctggaagaacagctgaggagattcagaagtattgggcttctagattctcttacaataatccaatgcccaatctgagttaggattacatccaagtgtttgggttttgcattgggtgattgtttcagctttggtttgcagcgtatatatatatataaaagcaaatgcc

SEQ ID NO: 9699 - DNA, 557 bp, Gossypium hirsutum
  Predicted polypeptide sequence is orthologous to G225, G682
agtcccttcccttcaatcttcaaaactccattaatggctgactctcaacattcctcttctggtaaaacttatgtcaactctcaagactttagttcagaggaggaaacaaatgaagaatcaaagcttaaattctctgaagatgaggaaacacttataattaggatgtttaatctggttggagagaggtgggctttaattgctggaagaatccccggtagaacagctgaagaaattgaagagtattggaataccaggtattcaacaagtgaatgagaaaaaaaaaaggacatttttaaagaaaggggccaaatttgagggactggatggcaattatgggcaagagagcaatgatgggtatttgttgtagtcaccaaaaaggggtcaagaatatggtataatcggttcaacccgacttagaaaattgagcattgttgtttgatgttttggggttttctcttgttttgatgtacttttactatggggggatgtcttcatggccctatatatacttttaatatcccaaggatgtttctgagcttaaaaaaaaaaaaaaaaaa

SEQ ID NO: 9700 - DNA, 878 bp, Gossypium hirsutum
  Predicted polypeptide sequence is orthologous to G227, G242
gcggccgcctctactttttttttagtggtaaatgtcaatcttaatttaatgcctggagcacaggccatattcattcatgaaacctgacatttgttcaaagttcttttgccctttaaagaaccaaggaaaagaaacaaagatcacccatattaacaccaagacaaatggaaaacctccccccaaactagaccataaaaaacataaaacacattggcttaatcttaattagcctttttctcttttggtcttaatgaaacgctgatgtctcagctgataacatggagctcatatattctctaacctctcttgctatcacatctctcatcacatcccaaaactctgccggcaccctttcctctctcctcctctccgccaccaccaccgcacttctactactaactccactaccaggcggcgctagagtcaacgccgtcaacgcttcctcttctatcatcacttccgtagatcccaatgcacaatgatcgccaccatccattggctgatgagtaacccgtaagatctgttgctgatgttcttgttgctgttgctgttgatgatgatgttgcccttcccttgccctcctcttcaacgtcgagttccaatggtttttcacagcattatcagtccttcccggaagcaatctagcaatggtggcccacctgttaccataccgagcatgagcggccaagatggtatcatcctcagcttgggaaaacggacggtgctcaacattggggctaagctggttacaccatctaagcctgcaagatttccctgatcgaccctttatatatcggcttatcaaagaccagtttctaagcccatatctctccactagtcgagtcaaaatcctatcttcctcagcactccaaggacct

SEQ ID NO: 9701 - DNA, 848 bp, Gossypium hirsutum
  Predicted polypeptide sequence is orthologous to G227, G242
gcggccgcgtcgacgcttcttcgatattttttttcttcacctccattgacaaacaaactgagatctctgtttatatttcgaaactgttagtaacaaagcaatggatcaagatattgatcgtgtgaagggaccttggggacccgaggaggatgagtcattgcgtaagctggttcagctccatggtccgagaaactggtcgttgatatcgaggtcaatccccggccgatcggggaaatcatgcaggctgcggtggtgcaaccagttgtctcctgaagtcgcgcaccgtcctttcacggcggaggaagatgagatcatcatcaaagcccacgccaagttcggcaacaagtgggccaccatagcgagactcctcaacggtcgtacggacaacgcggttaagaaccattggaactcgacgttgaagcgaagacgatcggcggaagatggcgattcggttcaggaatcggagagacggtccagcaagtttccgagatccggaagcatcagcaacccgggaagtccttccggctccgacgtcagcgatttgggattgagcgtagccgaatcgacgccgcactctcgcgtttcgaccgcgcttaccctcggacgttcttggagcgacgagttggtcgagttgaacaacgataactcgtgtacggataaagagtcgggctcagtagcggaaaaagcacgataacgggacgaaaacggcgtcgttgggtacggaactattggccgcaatgcaggagatgattaagaaagaagtgagagattgcatggcggagtttggttttcacaaccaatgctggggttaacgagcgattaattttaaaattagcgaaaaccattaa

SEQ ID NO: 9702 - DNA, 902 bp, Gossypium hirsutum
  Predicted polypeptide sequence is orthologous to G227, G242
ccccgttgtaaccttcccccccctcctccgccgcagcattctcctctgtacagatatgaaattagcttagattaaaatttctttggggggttttggggttttcgtctttgtgatcagttcttttttttccttttaaattttccgatggcttctacgaggaaagatatggatcggatcaaaggtccatggagtccagaagaagatgaagctttacaacgtttagtacaaacgtacggaccaaggaattggactttgataagcaaatcaattccgggtcgatccgggaaatcatgtcggttacgatggtgtaaccagctttcaccggaagttgaacaccggccttttacccccgaagaagatgatactataatccgagcccatgctcgagtcggtaacaaatgggctaccatagctcgtttactcaacggccgtaccgataacgccattaaaaatcactggaactcgacgttaaagcgaaagtgcttgtcgatgaccgaaggttttaacgacgattcccctcagccgcttaaacgatccgccagtctcggaaccggcaatccaagtagtccatcggggtccgatttgagtgactcgagtttaccagctccctcaccggctttcaaaacgggttctttagtccctttgagtcaacatgttgaaacagcttcatcggcaacggacccacctactttactcagcctctcgttacccggttctgactttaccgaacctgtttctccacccggattcaacccgacccaagtgaccacacaggcttcggcaccggtcccagctccggtggagaagcagtttttcagtgccgagttttttgcagtaatgaaagagatgataagaaaagaagtgaggagttacatggcggggattgagcaaaatgagctttg

SEQ ID NO: 9703 - DNA, 939 bp, Gossypium hirsutum
  Predicted polypeptide sequence is orthologous to G227, G242
aaaaaaaacacacacacacacacacacacatccaaagaacccaagtccttccctattgcatgcctttcaatttgatttcatggatgtaacaagcacaccaaatagaaaagaaatggatcggatcaaaggtccatggagccccgaagaagatgacttgctccagcagctggtacagaaacatggccccagaaactggtctttgatcagcaaatcaatccccggccgatccggtaaatcctgtcggctccgatggtgcaatcaactgtcaccgcaagttgagcaccgtgccttcaccccggaagaagacgagaccatcatccgagcacatgccaggttcggtaacaagtgggccaccatagcccgactcctcaacggccgtaccgacaacgccattaaaaaccactggaactccacgctaaaacgtaagtgcttgccggttggggaagagtgtaatttcgttgctaatggagggtatgatggtaatctgggaggagaggaacggcaaccgttgaaaagatcggtgagtgctggtctatacatgagtccagggagcccatcgggatcggatgtgagcgattctagtgttcccgtcttatcatcttcttacgtgtacaagccgatcccaaggaccggcggtgttaacgttgatgtaaatgttacgccagctggagtggaagcggcatcatcttccaacgatccaccgacctcactgagtctgtctttaccgggggtggagtcatgtgaggtggtgtcaacccagccaataacggagtcaactcagaatcggagtgaagaaaggggaggtgggggtgatgggtttcagtgcggagtttatggcggtgatgcaagagatgataagggttgaggtgaggaattacatgacgcagatgcagcaacagcagcagcagcaaacggcgcagttccaggaggagcgggaat

SEQ ID NO: 9704 - DNA, 962 bp, Gossypium hirsutum
  Predicted polypeptide sequence is orthologous to G227, G242
gaaaaagccaaaaacccgatattatatccaaaagaaaccaaaattttatttgcatgcttttaaatttgatttcatggctgtaacaagcacatcaaacagaaaagaaatggatcggatcaaaggtccatggagccccgaagaagatgatttgcttcaaaaactagtccaaaaatatggacctagaaattggtctttgatcagcaaatcgatcccgggtcggtccgggaagtcctgtcggctccgatggtgcaaccaactgtctccgcaagttgagcatcgggccttcacccccgaggaagacgagaccatcatcagagctcatgcccgatttggtaacaagtgggccacaatagcccgactcctcaacggtcgtacggacaacgccattaaaaaccactggaactcaacgctaaaacgtaagtgcttgtcggttggggaagagagtaatttcattacacatggtgggtatgacggtaatttgggaggggaagggaagcaacaaccgttgaaaagatcagttagtgctgggctttacatgagcccggggagcccatctgggtccgatttgagcgattccagcgtccccgttttatcatcttcacacgtgtacaagcccatcccgaggaccggcggagtcagcgttgacgtcaatgttatgccattacctggggtcgaagcggcggcgtcttcttctaacgatccaccgacttcactgagtttgtctttacctggggctgaatcgtatgagttgtcagtttcaaccctcccagttaccgagtctactcagacgaggaacgaagcaaaaaatgatggaaagggaggcgaggtgatggggttcagtgcggagtttatggcggtgatgcaagaaatgataagaatggaggtgagagattacatggttcagatgcaacagcaaaacggtggcgtttcgagagagagggaatggggatgtgtttggatgc

SEQ ID NO: 9705 - DNA, 1606 bp, Gossypium hirsutum
  Predicted polypeptide sequence is orthologous to G229
tttttattcggtacacacttgcttacgaaaatcaagttttaatgctatcgtcccttttgttgctactatccgcaagtcaaactgctaaatttgtttgtttccttctattattttagccaaggatagaccaagttatccgcattttggccctgatttcccatcttgactagctggtggtggcagttacacatagggagatggggagggcgccttgttgcgaaaaagtggggttgaagaaggggagatggacggcggaagaggatgtgttattgaccaagtatattcaagctaacggtgaaggctcctggagatcattacccaagaatgcaggattactgaggtgtgggaagagttgcagactaaggtggattaattacttgagagctgacttgaaaaggggaaactttacttcccaagaggaagaagtcatcattaacttgcatgctactttgggaaataggtggtctttaattgccagttacttaccaggaagaacagacaacgagattaagaactattggaactctcatttgagtagaaaaatccatagctttagaaggccattaactcaaagcatgccagtcatcatggacctcaccaagacggccgtgattgctaagcggaaaggaggtagaactagcgaagggtcgatgaaggaaaacaaaagctgcagtacccagaaagatactggaagttgttcaaataaacctactgaaaacgtttgtgttaatgaagttgagccattcccatccactccattgttagaaaaagaaaccttgtccactacagccattgaagatcgcatggtactggatcaacatggagaagataaggagagaacaacccatgttgtacccagtccttgtcacgacaccgttgttgaaggaatgttgggttcaagcgaggagagagagagcctggtgactgaggaaggaaccatagagaattcaatgcagtgccctagtggcaacgctgagaaagggactggtattttagcaccacatgagagtattgatagcagtgagatagagtggtttaatgatatcctggatagtgaattgctacagccaagtgggcatttgacgtttactgaactaggagaggacaggtggaatgtgaaaacacacacaactgcagctaataacgaggaaatagtgagtaggaactgtagtgcagatagtggtggggtcttgagctcatgtacttcaacaacattttactttgttgatgattgggaaaatgttgttccaagaagtgagctttgggatgagaaggaatacatgtgttcttggctgtgggagccaagcgactatcatgggaaaggagagagacataaagtggatgataatggctttgaggggcacaatcccatgattgctgctaacgtcgcttttctcctaatgctcctccttgttcctcctgctttagtgtctagctacacttccatgtcaatattttatctaggtagacagtgtgaacatgtcctgccgttttttctttttgttttacttttagattttgcttctcttttcaattctgatgctttgttttctttgtaaactgatttgtgatggaaaaaagattgaagaaaacattttcaccgaat

SEQ ID NO: 9706 - DNA, 644 bp, Gossypium hirsutum
  Predicted polypeptide sequence is orthologous to G2290
tgccattgttatcactacatatgaaggtcaacactgtcatcacggtatcgcattccccagaggtggactcatctgccatgaagctgcctttgctggtcaattgacaccgccagtctcacaaatttatcatccaggggtgcagtcacataggcaaatgcctccgagcataacacaatcacagccgcaccaagcacccgttgacgtaggagaaccacatccggagcctgaacccacctcacagctccccacagatgaagggttactcggtgatattgtgcctcctggaatgcgtggcagatgagaaagagaatatggcctgtaattgatgggtataaacataagggcagccaagtcatgcgacacaatacttttctcaagatggaagtgagtcatttacctgaaaaggttcacacagatgattatatcataaattattattatatttacttacacaagctcagctataatgcttgcatgaggtcattaatctcttatggtgcccagattttatctaatctcaacccttcaattctaatctatgcatctgaatattgaaattcctgttggttaggtttaagagattaattactgcagatcatataaaagtagtaacattacttgctattaaaaaaaaaaaaaaaaaa

SEQ ID NO: 9707 - DNA, 581 bp, Gossypium hirsutum
  Predicted polypeptide sequence is orthologous to G2343
ccctaaattcggctttcgagcggccgcccgggcaggtactaccttggatgaagaaggtggtggagaaatgacacttgagagcttaaggagacaacaacaagagttgaatgaatgggttgaatcacaacaatgttcaagctttttgttgtgggataatattattgaaggacaaattggtggtagtgttgaaggaacaacaataccattaccaccttcatcttcatcatcatcaaatatgggaactacactatcttctttcccttcgtctctataaattatcattaatggtgatgatttgtttttctttctttcttttttgcttcttttgttaactttattaattggtcatgagcttgtggaaaatgtgagggaatgttgcatatttaagtatgcaccattttttttctttcttatcggtgtttggagaaatggaaaaggaaagaataaaaagcaatgtaacagctaattagataatttttactcatttctttcggatttttttttatatataaggtattctcggttgatcaaaaaaaaaaaaaaaaaaaaaaaaagtacctcggccgcgaccacgctaagcc

SEQ ID NO: 9708 - DNA, 552 bp, Gossypium hirsutum
  Predicted polypeptide sequence is orthologous to G2343
gcttagcgtggtcgcggccgaggtaccttgcgtgggcggaactaaagtctttcgtatcttcttcttgatccatgaattccaatagtttttaatctcattatctgttcttccaggcaagtgacttgctatatgagcccacctgtttcctacaaccccatggaggctaatgatcaacttctcttcctcaggtgtaaaccttcctcttcttatatcaggccttaaataattaatccatctcagcctacaacttttcccacatctctgaagaccagctttctcagggacttcactccaacatccatagccatgagtggtgatgaacctaatgagcttttcatcttcctcaggggaccaaaggcctctcttaaccttttgttgattgcagcaagaatggtgacccatcctgtataatttaatatggacgacgacgatgatgataaataatatcaactaatcttctgcttacttaattttaattcacaaattaaaagaaaggaaagaaatagctctttgggatttccccgcgtacctgcccggcggccgctcgaagcc

SEQ ID NO: 9709 - DNA, 905 bp, Gossypium hirsutum
  Predicted polypeptide sequence is orthologous to G2371
ggacctctcacttctaccccgccatgttcctatcctccatccacgctgcccgccacttcagccttaaccatgacgacgacgaagagctcgacgaccaaacatccaatctcgacaccctaaaccctaaaccaaatccccctgaaaaccaccagctaggccatgaaacggaacccatgtttgaaaagcccttaacccccagcgatgttggcaagctgaacaggcttgtaatccccaaacaacatgccgagaaatacttcccgctaggcagtgactccagtgataaaggcttgttgctaagtttcgaagacgagtcaggcaagtgttggcgcttccgctactcgtattggaacagcagccaaagctacgtgttaacaaaaggatggagcagatacgtcaaagagaagcaacttgatgctggtgacattattttattccaacgacaccgcacggatggtgatagattgtttatagggtggaggaggcgcggtgcagcagtggtggttgcaccggcggctactgatggcggaaacgccgtgatggagaataatggcggtggtggtgggggtggaaatggaggggtggagtaataggcgattgtatcaaaggtatcctcatcttggacacattcaaggtcttgaggctatttggagtgaacctagaatgccaccagctagacgagtccccaccatccacgcctgctagctcgatggtgtcgagccagggtccaacagcccaccagttttactagttttccctcctacacttgaaactacatggtcaggaatggatatcgtcccgagacatgaagcggatgaaaaagatgagggagggataagatctgaagatgtgacatccaggaattgactttgaatattgaaaccccacttggaacgtcacaattagag

SEQ ID NO: 9710 - DNA, 783 bp, Gossypium hirsutum
  Predicted polypeptide sequence is orthologous to G2394
gccctgcataatttccatccttggtatccaagaggatttttcaccaactagaggagccaccagggaaattataaatgcattgccaacattcaaatttaaatccaagaaaaccggaaatgtaaacgatcaggaaatttcaactagtgaaggtggtgtcctggctgcagggacggcaaaggaacgtgttatatccggggaagatgcagtttgttgtatttgcttggctaaatttgcagacaacgacgagctgagggagctgccatgcctccatgtcttccatgtggagtgtgcagataaatggttaaaaatcaatgcatcttgtcccctatgtaaaactgaaattggtgagagcagcagtacttcaccattagcacaagactcgcattaacagtgcaggcaagacaatcgtcaatggacgaatgaccggtaatgtcttcaatgttttactttgttctactggttcttgcatttaagtttgagtcgaatcaagccgagttgtcacgagtcccccatgcaagagatacaaatatatagttaggctatcatcaaaaaagaaacttgcaatgctatatactaaaaaagattgttccttgaggctaacctctcatggtcatacaaaaatattttgattgctattgctcttttatactatggtatcgcgaaacatgactgtcttgaattttggtgggaacatttcctctaaagtcggatattttgtgggtcaaaaccaatccctcgtatcgcctctcactctcccctacccccttccccctcggtccccct

SEQ ID NO: 9711 - DNA, 550 bp, Gossypium hirsutum
  misc_feature (83)..(83): n is a, c, g, or t
  misc_feature (238)..(238): n is a, c, g, or t
  Predicted polypeptide sequence is orthologous to G2394
tttttttttttttttttttttaaaaaattattatcattttttatttaatataaacaaattggtttacaccaacagttgcaatngggggaacgatactgaaaaaaaaaacatgatcacatgaatgtacgaatatctcaaaatcttttgtgacacaacataaaataatataaatacgattatgatataacaaaatacataaaaatagctatgaatacaagatatgaaggtcgaatgtttngggacattgcttcgtctttcaactgtcatttttccggtatgctgttaatttgaatctccggctgatggcgaagtacagtcactggtgttgccaacctcggttttacaaaggggacaacatgcattgattcttaaccatttatctacacactttacatggaagacatggatgcatggcagctccctcagttcgtcatcgtctgcatatgctgccaagcaaatacaacaaaccgatcttctcccgatatcacgcgttcttttgcagtaccggaagccagaactccacatgaaacgtccggatcatcaacatttc

SEQ ID NO: 9712 - DNA, 550 bp, Gossypium hirsutum
  misc_feature (14)..(14): n is a, c, g, or t
  Predicted polypeptide sequence is orthologous to G2394
aaaaaattatatcntccattattttatttaatataaacaaatttgttaacaccaacagttgcaataaaaaaacgatactgaataaaaaaaacatgcatcacatgaatgtacgaatatctcaaaatatttttgacacaacataaaataatataaatacgatttaatataacaaaatacataaaaactagctatgaatacaagatatgaaggtcgaattgtttaacgacattgcttcgtctttcaactgtcatttttccagtatgctgttaatttgaatctccggttaatggtgaagcactgtcactggtgttgccaacctctgttttacaaaggggacaacatgcattgattctcaaccattatatctacacactttacatggaagacatggatgcatggcagctccctcagttcgtcatatgtctgcatatgctgccaagcaaatacaacaaaccgcatcttctcccgatatcacacgttcttttgcagtaccggaagccagaactccacatgaaacatccggatcatcaacatttacaattttcttaga

SEQ ID NO: 9713 - DNA, 514 bp, Gossypium hirsutum
  Predicted polypeptide sequence is orthologous to G2457
ggttccacaatccgagcatctttgctatgtccgctgcaacttctgcaacactgttcttgcggttgggatcccatgcaaaagattgcttgaaacagtgacagtgaaatgtggtcattgcagtaacctttcttttctcagcaccagacctccactgcaaggtcaatgcctcgatccccaaaccagcctcactctccagagtttctgcggtgatttcaggaaaggtactcagtttccatcgccatcttcatcaacatcgagcgagccatcatcccctaaagcgccatttgttgtaaaacctcccgagaagaaacacaggcttccatctgcttacaatcggtttatgaaggaggaaatacagcgcattaaagcagcaaatcctgagataccccatcgagaagctttcagcgcagctgctaaaaattgggctcggtacatcccaaattctccagcagcatcatccgtttgtggaagtagcagcaatggcttctatgaaaattttgcaggaacaaaatga

SEQ ID NO: 9714 - DNA, 620 bp, Gossypium hirsutum
  Predicted polypeptide sequence is orthologous to G255, G664
ctgagattttagggttaaattagtgaggagagaatgaggaagccttgctgtgataagcaagacacaaataaaggggcatggtctaagcaagaagatgagaagctcatcaattacattcgaattcatggcgaaggttgctggcgtactctccctcaggctgcagggctccttcgatgcggtaaaagttgtaggctgagatggataaattatctaaggcctgaccttaaaagaggcaactttactgaagatgaagaggatcttattatcaagcttcatgcactcttaggcaaccggtggtcgttgatagccggaagactacctggaagaaccgacaacgaggtgaagaattattggaactctcatctaagaaggaagcttataaacatggggatcgatcccaataaccatcgtttgatcactcacaatcatcttcctcgcccacatgatcccaatagtggtgcaagtataatatctcctgcttcaaaagttccagtcaccgataatactaatattcatccaccggagaaatccagaggtgacaatgatcaagtttcggatgctgcaagttccctggaggatcataagctccctgatttgaacctcgatctcaccatcagtgg

SEQ ID NO: 9715 - DNA, 1145 bp, Gossypium hirsutum
  Predicted polypeptide sequence is orthologous to G255, G664
tgcaaacgtaggctactagtgctgctattttccacaagttgaaaaaggtttctttgtgttactgaattatgggaaggtctccttgttgtgagaaagctcatacgaacaaaggtgcgtggactaaagaagaagatgatcgcctcatagcttacatccgagcccatggtgaaggttgctggcgttcactccctaaagctgctggccttctccgctgtggcaaaagttgtagacttcgttggatcaattacttaagacctgatcttaaacgtggcaatttcactgaagaagaagatgagctcattatcaagctgcacagccttcttggtaacaagtggtctcttatagcggggagattaccaggaagaacagataatgagattaagaattactggaacacgcatataagaaggaagctattgagcagaggtattgatccagcaactcacaggccactcaatgaggcttctcaggatgtaacaacaatatctttcagtggtgccaaagaagagaaagagaagattaatactaacagtaataataaccctattggatttatcaccaaagatgaaaagaaaatcccagttcaagaaaggtgtccagacttgaatttggacctcagaattagccctccttattaccagcaaacccaaccagagtcattcaaaactggaggaagaactctttgttttatttgcagcttgggagttaaaaacagcaaagattgcacttgcagcaccatcactactgctgcaggtagcagcagcagcagcagtagccacagcaacagcaacaacagcagtggttatgatttcttaggcttgaaatctggtatcttggaatatagaagtttggaaatgaaataataaagagtgaaaatttggatttttaactatgtagttcaactcccccccccccccgaaaaaaaatattggagagaaatgacaaggagatcattgttattagttttaaaatctctttcatttctctttttttatttctaatttgtatgattattatatcacattatatatgcatatattagtagaatagatgatcattgttgttggtgagtgtttatgcatttattgagttataaaaccttcttcttctttcaaaaaaaaaaaaaaaaaaaaaaaaaaaaaaaa

SEQ ID NO: 9716 - DNA, 810 bp, Gossypium hirsutum
  Predicted polypeptide sequence is orthologous to G2574
gcggccgcgtcgacgtaggtgcaaagatgcgccgaggatatgtcaatcttaattacaacttatgaagggaatcacaatcacccacttccagtttcagcgactgcaatggcttccaccacctcagcagccgcttccatgatgttatctggctcttcaacatctcaaccagggctcaatggattaaacttcagccaccatgataattccacaacaagacagttctatttatccaactcaacctcatcatcattgtccccaacaattactctagacgttacctcttccccctcccattcccctttatcttcatctaattatttcaacagcttccctacaagctttcccagatttcctcgaagtctcaacttttcttcatcagaatccaacattttgcctgcagtttggggcaatggctatcctggttatggtgcagtgccatattatcaaactcagcctggtaactcaatccttggaaacgagtcccaaaaccagatttaccagtctttaccgggtaataatcagcaagggggagcctctcaacagtctttgacagaaaccttaacgaaggtaatcacatcagacccaagcttcagatcagtaatagctgctgcaatttcatctgtggtttgtaacagtgcaaaatctgaagaccaaactgatcaaaaagctcagcattttggtcagaaattgatgcaggccatagtttctcaaaatgagaaaggtcaatcatcatgttcatcaagctacttcaatggattggcatcttcaagttctcaaacaagaagttcattacttcagtcttctttgcct

SEQ ID NO: 9717 - DNA, 766 bp, Gossypium hirsutum
  Predicted polypeptide sequence is orthologous to G26
ccatgaacctttctgcccagccaccacacgttaccgtgaccggtgattggcggtgagcgaagcccgttctaaaccgattaaagccacatatgccaatttcaaccccgaaatcctcacttagacttcgatttagacgaagaagatgaggactccgaaggcgaactctcaatggtaaaccctctatttttttagattcgtcgaatagattcaaaataaagtaaaaaaaaaacaagaataagagcagagacataatctacgaatcacctttggtaaactctttttgaattgatttcttttttcatatatgcgtctgttctctctattttacatcgtttcattcagttttatagccaaaataaataaaataaataaataaaaagaaatccaaatttcattgctgtcatttgttgctatttgctgtccattgcttgtggttgttttcgtttgttagtctgttgcaggtacagctagagggtggcgcgtgtggaggccattatgggggtgaagcgtgaagtcactggtggctgcttgcggcccgagggtagacggggctagggtttgctgcaagcatggtttgggcttagggtttattattcttttgtgtctgcttgtaaaattttgggcttaattttattattgggtattgggttttgtaatgggctaaggggttatagactgttttattgatttttattattttttggttttttgcatttagtttataagtctaaaggcccgggtgaaatggcctattacaatataaatc

SEQ ID NO: 9718 - DNA, 921 bp, Gossypium hirsutum
  Predicted polypeptide sequence is orthologous to G2632
cccgggagtgagaggagtgaactcattaaattcatcttcgatggaatgcactaatgcatcagagtcgaatgatgggcagtcactgtccaatggtgcactaaatgaagaggatgatgttaataaagaaacacaaactactgcatcctctcgggcagttggaactggaggacaagaacatcacaatttgcagcatgttggatctagcatgcctgctgtgcgtgatgaaggcctcacccaacctcccctgcttgagcttgttggtcattcaatcgcatgtgcatcaaatccttatatagatccactttatggaggaatgatggcagcttatggacatcagcctatgggttatcctccgtttgttggaatgcctcatgcaagaatgactttgccgattgaaatggcacaagagcctgtttatgtaaatgccaaacagtaccaaggaattctcaggcgaaggcaggcccgtgccaaagcagaacttgagaagaaggttgttaaatcccgaaagccttatcttcacgaatcaaggcaccagcatgctttacgtagggcgagaggtagtggaggacgttttgcaaagaaaacagataccaatccaggagaagaaaaaggatcaggttcaggtcccacgttatcatcccaatctccaagttcctccggttctgaaccattacaaactgattccaacgaaacctggacctcctccctcacccagcatggcatccaccatgtcaacggcggcagccattatcagaagctaggtggtaacatctccaatcacgccgctttctatccggtgaatggaggacaatcctttcaaagctgatggttgactccagagacgttacagtcatggcatgcattagcgagcggcaatcattcttggctcgtatatggaagggagaagagattgtacgagac

SEQ ID NO: 9719 - DNA, 814 bp, Gossypium hirsutum
  Predicted polypeptide sequence is orthologous to G2632
taaaaacctcttattaaaattttaaacatataaataaagataatttattaagcttgatagatttgtctttctctatgtctctgttatggttgcagagagagagccaaactgaatcaatctctaggcatttgcttctccaattccaatcttctttttctttttcttcttttactaataagtcgtgagaaatgccagcaaaaccagggaatgatgatcagcagatagaccatggggctcaaagtgtgttgcagtcaactgcctactctgaaccctggtggaaaggagttgggactaacccctttgttgaagctgcctcgaagtcgccttctgtagaacaactaaatggttcagtggcaaatggagctgtgcattcacaggctcatggggacttgggcaatgaagatgggagaaacggacaagatcgccaacatctcaaacacgttccttccacaacaccccttactttgggtgaacaccatgaaccaaattcccaaatggaactagttggtcactcgattgtcttgacatcatatccttattcagatcctcagtattgtggaatgctgacttcatatgggccacaaatgatggtgtcaccacatctatatggaatgcatcatgctagaatgcctttgcctcttaaaatggaagaggagcctgtttatgtaaatgcaaagcaatatcatggcattttgaggcgaagacagatacgtgctaaggctgagcttgaaaagaaagccattaaagttagaaagccataccttcatgagtcccggcatctacatgctatgagaagggctaggggttgtggagg

SEQ ID NO: 9720 - DNA, 550 bp, Gossypium hirsutum
  misc_feature (473)..(473): n is a, c, g, or t
  Predicted polypeptide sequence is orthologous to G268
ttttgattttaacttaacaaataaatattttttgactgtatctaaccaatgaaataaaataaattaaaaaacaatgatcctacccctaccctgagaaaacaattttaaaagaaaagttgcatatatatatatagtagaattaagttacaaaggaactgtaaaaaaccataccaggctgcattttggctgaagaaatcagatctctctaagaacctcaatgtgtctgatgtcctcctccatcctcctccggtccaacgactggatgatattaagacacttgtaattgacgacttgtattttatttggaaacaatcatttgcaaggcttgctttagctgtcttcaatttgcggaaggggtgaggttttggctttcgagtctttagttctgttggttcaactgcggagtaggcgcttgtcacataccaagatcctataacttgcatgaggaccctcggatgtatcgcgtagagtangatgccaacccatggcttttgcgatatcttgaagttcatccataacatcaagagaatcgcggatgtatgctcgtcca

SEQ ID NO: 9721 - DNA, 550 bp, Gossypium hirsutum
  Predicted polypeptide sequence is orthologous to G268
gttttttttttttttttaatcgaataatggctttaacttttttacccacactcgtgccagggcacaatcagataaggaatatgattctctaaatacatcattatttaaaaaaaaaaaaactgaacagtcacatggaatctaaataatgctcctactgcctagagaaaaataaaatgcacctacaatgaccgtatatgttacaattacgttagaaaagagttcacctttcaccccaggacatcatccttctctatagcacacagcacaccaattataagagctgaaactcatcagcatccccccgtcccatgacttgcatccttcaatcctcttatctgcagttcaaatttcgatacacaagcttctttctttcgcttgcaaatgactgcgcttgtcgaactatctttccaacttgcattactaaacatcacagataatacttatagttccaatttgttcaaccatgacgcttgtcacatgtcaagatcctgtaacttgcgtgaggaccttcggatgtatcacgtagagttggccgccaacccaagggctt

SEQ ID NO: 9722 - DNA, 782 bp, Gossypium hirsutum
  Predicted polypeptide sequence is orthologous to G268
ttttttttaagacgtaaaggttacattgacactgacaaactttgtaatgtacaattacacttggaatacaacagagaaaaatgaaatcctttagtatatgttcgtccaaatgtagtaataccaatcagtaatatttactacatacatagaacaatagattatatttatattatttggaacgagttgcagctcttactttttagttcagggagttgcagcttctttctatatgtgattttgacgtacttcccgaagttgtgaagcaacatggttttacggatattcatcaaacaagcacatcacatacgtttctcagagatcaaaattttccagctcgcgtgtggaccttcacctgtttcgtgcagcatagccacccatcccattgcagttgctatttcttgaagttcacccataacagagattgaatctcgtatatatacacgtccaccaggtctcagcatgcgatccatctctagcatgatggttgacatattacacctctttttctcaacagagaaaagacctgctgcgtgtaataggtcatatgttctaggataagtatcgaatggttcacaccagtcatgcataactcctataagcccacgatcataaataacagacaaggtgttgaacccactaacaggaacaacattcataacccagcaatcaatctgaagatcatgtaatgctgctgcaaactgtctattatttcattccagtatttcgattcagctctaaagatttcctttctggatatataggcattcatttctatgctttga

SEQ ID NO: 9723 - DNA, 866 bp, Gossypium hirsutum
  Predicted polypeptide sequence is orthologous to G268
cgaagctctctgttagttcaaaattagaaaaagaaaagctctctgcttctctgttgaattttttttcttccatccttcctgagaaaatttacgaataaaaatacttttaaacaaaatgaaaccgactgctccaataactagtactacagcaaccgtcacggcatcttcgacgacgattgaggcccttaaaaccctcaagtttgttaagcttgtagccattgttgtcctctctgtttccctcgttttccttgctactcacttatcctcctcttcttcttccttctcgatcaattactccttacaaactccgcaagcgtcgcctccggtttctccaccaccacctcctcccccttctccgctaccatctcctcctccaccggccgtgcgaagaacggggataatcgacgaaaatggagcaatgtcggacgaattctttgtcggagagtcaggctcgaactctacgactggttttacggagttcagtgatggcgacgaggaaggacgagaacaagaagaggaggaaagaaagagtaagagcgacggtgacgttagggttggggttgagaaatataaggtatgtgataagagtaaagttgattatataccgtgtttggataataagatagcaattaagctgtttagtaagagtgacaaaggggagaaatacgagagacattgtcctggaaaagatgagatgttggattgtgtgattccaaggccggaagggtaccagagatctataccttggcctcagagtcgtgatgaggtttggttcagcaatatgccacatactcgtctagttgcagataaaggtgggcaaaattggatatcaataaagaaagataagttcattttcccaggaggtg

SEQ ID NO: 9724 - DNA, 705 bp, Gossypium hirsutum
  Predicted polypeptide sequence is orthologous to G274
gcggccgccttgactgcagctctcaactctcccaaattgtgggttatgcatgtgatgcctaccatagcagagaaagataccctgggtgtcatatatgagcgaggattaattggcatctatcatgactggtgtgaggctttctccacatacccaaggacgtatgatatcattcatgcacatggtctattcagcttgtacaaggacaaatgtaatttggaagatattctattggagatggaccgaattcttcgtccagaaggtgcggttatattccgtgatgaagttgatgttctaattaaagtgaagaagataacagcaggaatgaggtgggacactaagatggtagaccatgaagatggtcccttggttcctgagaaagtattggttgctgttaagcaatattggaccgttgggggaaatacgacatcggcacagtaaacagcagacggcaacaaacttaaaccatggcatgaactgagtttgtggattatatgagtttgacatgaattgatgaatttccagcctgaaaatttttgccagcaggattgttttggtgtagggaggtgggtcacaggattaggtgaactaaggatcagtctgtgttcatttgtattaatttgtgaacagatagctataaactatgcttccaaagtttaatgatgattgaattaatcttattttttgttttaaggtcgacgcggccgc

SEQ ID NO: 9725 - DNA, 710 bp, Gossypium hirsutum
  Predicted polypeptide sequence is orthologous to G274
gcacgaggctgagcaaaaaaagattgaagagttagctgaacaactttgctgggagaaaaaatatgagaagggagatattgctatttttaggaaaaaagttaatgacaaatcctgccgcaggaattctgccaatatgtgtaaacctaggggttcagatgatgtttggtacaagaaaatggaaacatgcataacccctttccctaaggtaagtagtgcaagtgaagtggcaggaggggaactgaagaagttcccagctaggctttttgctgtccctcctcgtatatccaaaggacttgttgagggggtctcagttgaaacttaccaagaggacaataagctttggaagaagcatgtaaatgcttacaaaaggataaatagattgattggtactgcaagatacagaaacgtgatggacatgaatgctggtcttggaggatttgcagcagctctcgaatcacccaagtcttgggtgatgaatgttgtgcccacaattggcaaggacaccttaggtgtgatctatgagagaggtctaattggaatatatcatgactggtgcgaaggtttctctacgtatccaagaacatatgaccttatgcatgctaatggtgtctttagcttgtatcaagataagtgtagctttgaagacatccttctggaaatggatcgcattttacggcctgaaggagctgtgatattccgggatgatgtcg

SEQ ID NO: 9726 - DNA, 672 bp, Gossypium hirsutum
  Predicted polypeptide sequence is orthologous to G274
ttttttttttttttttagcacgacttgaatctaatctatacttggaatgatgaatatctttgaccatcaaaccatcacgtatgattcaagtttttttaatattttaattatcaataattaatacattttaattatatttgatcatttaaataatattattttacatcacttaaaaaatattatccaatgaattaaaaagataaagagataaatccattccacattaaaaattagtatatatgtaaattactgtataacccgctgtattgccaatctcatccaacatgaattgatcaagtaactttcggcctcaacatagccgaaatgacgagtccaacattcacaaccagctgcaccatattatgatcagccaacaattctagttatcagcctcgtgccgaattcggcacgagggttgagacatatgaagaggacaataacatatggaagaaacatgtcaatgcatataagaaaatcaatagacttattgactctgggaggtatcgtaatattttggatatgaatgctggattgggaggatatgctgcagctctcaactctcccaaattgtgggttatgaatgtgatgactaacaataaagagaaaatatacccggttttaaaatataaccaagaataatggcactaatcagaacggagttagggattccca

SEQ ID NO: 9727 - DNA, 877 bp, Gossypium hirsutum
  Predicted polypeptide sequence is orthologous to G2766
ttctcctttaacttatataatttcccttcctagttcttccatttctccacgctaccaaagccatgtatccatcatcttcgtctcaaaagcccatgggtcaatccggcctcacccgttacggttctgctcccggctcctttctggccaacgccgttgattccgtcatcggagcggaccctaacctcgtcggccactacttctccgccgctgactcctcctctttaacatcagagtcaacttgtaaagtcagctcatccaacgatccgcgagagcctaaatcagctgctgctgctgctcctgctcctcctcatcctcctccgcatcatccccatggatcttaccctgcaccttcttcttcctctctgctcagacaacgcagctcccccgccggtttccttagtcacctcacatcggaaaacggtttttccgttacaatgggcaacagaaattatagctctcaaggcagtggtaatggtggccatggagtgtcaaggttgaagtcccagttgagtttcactaggcaagattctctttctcagatctctgaagtgagtgagaatcttgtggatggtgttagctctaacagtaaccaccaaaatcctgcacattcgtttgctgctgctggctttggaatggattcatgggataatacaaactccattgtgttttctgccccatcaagcaagagggctaaaaatcttgatggcgatatttataactgtttcaatgccttggaaactcagtttagcttgccccaaacgacactcgagatggccacagttgaaaagctgctacatattcctgaagattccgtgccctgcaaatccgagccaagcgtggttgtgccctcacctcgaagcattgctgaagagagaaa

SEQ ID NO: 9728 - DNA, 840 bp, Gossypium hirsutum
  misc_feature (9)..(9): n is a, c, g, or t
  misc_feature (824)..(824): n is a, c, g, or t
  Predicted polypeptide sequence is orthologous to G2791
ccgcgtttnaccccacagttcgatcccacctcctcccacgatgacttcttagaccagatgctctccactctcccttcttgctcctggtccgacctcaagtcaccttgggacccgcctaaatctgatgaaacgccgccttctaatcatgacaataatgttgggtttcactacgacgagattctagcctccaagcttagacaacatcaaatcaacggcggcggcggagggactactgcagctatgaagatgatgatgcaacagcagatgatgttaccgggaagacccatcgccgccgcaggtggaggagggttgactatgccgttgcataacgatatcgttgatgggtcttcgtttaagtcccccaatcaacagggtggggagggttccgtgcaagctctgtacaacggtttcggtgctggatctttgcatgggactaataatcagtcaccgaaccagcctcagccttttcaccatcctcagggaggcaatatgcagacacaaagctttggagcaacagcagggatagttatgaaccaaagtcaggcaagcggatcgacaacgggaggtgcaccggctcaacccaaacaaagagttagggctagaaggggtcaagctactgatccccacagcatcgctgaaagattacgcagagagagaattgcagagagaatgaaagctcttcaagacctggttcccaatgccaataagacagataaagcttcaatgcttgatgagataatcgactatgtcaaattcctccagctccaagtcaaggttctgagtatgagtagattgggcggtgccgctgctgttgctccccttgntgctgatatgccatct

SEQ ID NO: 9729 - DNA, 904 bp, Gossypium hirsutum
  Predicted polypeptide sequence is orthologous to G2791
atctcctccatcatcaaagcaaaaaaataaccctaattatgcagccttgtagtcgtgaaatgcaagcaatgaactctctcttaaacccgacccaacaaatccctctccaagaccttcaaatcaacggtaacagccaccatcatcaacagatccacgtcccatcatcatcgcagttccagtatcccacaccgacttcaacaacccaccatgacgacagcttcttagaacagatactctcctccaccacgtccttcccgtggtccgacgaaacgggtcctcccaaacccgaggataacaataacgccggcttcaactacgatgagatggttctagcttccaagcttcgacagcatcaaatcaacggcggagctgctggtaaccctttttccgctatgaagatgatgttgatgatgcaacaacaacaacagcaacagcagatgatgttagcgggcagacccacggttgcctcctccgccgccggaggcggaatcaccaccaatcatcagggtggagagggttccatgcaagctttgtataatgtttttggagatggatctttgcatggaactatgcaggcgaaaagctttgtgggggctaattcagcaacagagatgacccaaagtcagggaagtcgtccgacggccggagaagcggtgacggcgccggaaaagcctaaacaaagagttagggcaaggaggggtcaagctactgacccccacagtatcgcggaaagactacgtagagttagaattgcagagagaatgaaagctcttcaagaactggttcccaacgccaacaagacagataaagcttcaatgcttgatgagatcatcgactatgtcaaattcctccagctccaagtgaaggttctgagtatgagcagattgggtggtgctgctgctgt

SEQ ID NO: 9730 - DNA, 434 bp, Gossypium hirsutum
  Predicted polypeptide sequence is orthologous to G280
accaaatccgtcagcaccggaaggccacgtgggcgcccccctaagaaggctaagactggtaccaacactgctcctccacctcctccaggcgtgaagcgaggccgcggtcgacctcccaaagtgttaccgtcggtaggttttcagtaaagcagccaacttaaatgaaagagaatggagaaaatggctcataccgtcattgctccacctcccgctttaggtttaatatttttttaaccttaattttttaggtgtggtttagttatcagctaattgacgttttagctgttttttttttcctttttaatttttagttaacttggggtgggggtactgtaatgattttactgtagggcttagactttacttttgttcgactccttgtaatttccatgtaattgttaagacccttttctttaaaaaaaaaaaaaaaaaag

SEQ ID NO: 9731 - DNA, 804 bp, Gossypium hirsutum
  Predicted polypeptide sequence is orthologous to G280
gcggccgcgtcgaccttcctctcactctcttcttcgctttctcttaaataatacgaaagctaaaagaaaaagctctaaatttcaatggcgaccgaagaaattagtcgaactcaaggcctcaatccttctcaacaatcttcttcacttccagactaccctcagatgattctggaagccatagaggcattgaatgagagagagggctccagtatgtcatccatcgccaagcacatcgactccactcactccgatctcccagcgtctcacaccactctcctctcccaccacctcaaccagatgaaacaaatgggtcaaattgttatgttgaacaacaattactcgaaacccgaccccaatgccccacccaagcgtggacgtggacgtccacctaaacccaaggttcctcttccacctggcgtcgtcgtctctcctcccagacctcgtggtcgtccgcctaagccgaaggacttattggctccccccaagcccaaacccgtcagcaccggaaggccgcgtgggcgccccactaagaaggccaagactggtaccgccgccgctcctccacctcctcccggcgtgaagcgaggccgcggtcgacctcccaaagtgttaccgtcggtgggttttcagtaaagtagccaagttaataaacgaaagagaatggagaaaaggactcattccgtcactgctcctaccccagccgcgttaggtttaatatttttttaaccttaattgtttaggtgtggtttagttatctgctaattgacgttttagctttttcggttttttgttgtagttaacttt

SEQ ID NO: 9732 - DNA, 861 bp, Gossypium hirsutum
  Predicted polypeptide sequence is orthologous to G2887
ctcaatctccctcggtgctctctctcgctcgcggctctcttctctacgggctttacattgcacaccaaatgaattttgagctcaattgggaacagccgccttctgtttttggttctgatctggggtttacgaaccgtgggagattgaggtatttttcacaaaagattttcttttggcattggacttggcctgttttttacgcgtcaggttttttgttttgattatacgatttgattctgctgctttacttgaagaagcggaatcacaaattttgttgttcattttctcgtgagccatatttgtttgttattggatactgagactccaagttttggatttttctgatggggaaaaacgcattacccccggggtttcgatttcaccccaccgatgtagaacttgttatgtattatttgaaaagaaaagtattaggccaaaagctcttgttgaatgtgattgctaaagttgatgtttataagtttgctccctgggacttgcctgatatgtcctgtatgaagactggggatcttaaatggtacttctattgtcccatcgagaagaaatatgctagaggggatagggtgaatcgagctactatattcggctactggaaagccacgggaaaggatcggcccgtgaagtacaatgacgaagttgttggaatgatcaaaaccttggtatttcacaaaggtaaagctccacgtggtgaccgaacagactgggttatgcatgagtataggcttgaagaaaaaatattggctgacagagggcctgttcaagatatgtatatgctttatgttgttttcaagaaggatggtctgggcccaagaaatggttcccaatacggagccccattcaagg

SEQ ID NO: 9733 - DNA, 418 bp, Gossypium hirsutum
  Predicted polypeptide sequence is orthologous to G2893
ttttttttttttttttttatttagagataaaaatgaattagtttatcttcacaacttaacaaacattgaattcctcagttgcagtaataacatttggacaaaaactcgaatgacaacaaaaaatctgaacacaaataaacccagaaaatcaactatgaagaaataacatcagaggttccccttcaatggaagttcccatagttctcccatgctccatatcccatctgcaaaaccatcattaacccaattgttgtccgccatgtggcagtcggcagtcataaaatctccaactgctgatgtggatggcaggttgatggtttccatgccgtagcaactactgttatcaacataatagcaatgctttgcaaccgtgttgtactcattgttatcagtgatgccgaatgaacttgtttggtac

SEQ ID NO: 9734 - DNA, 859 bp, Gossypium hirsutum
  Predicted polypeptide sequence is orthologous to G2982
ggtaagtggtagtaaccatattcaaaaccataaccaccatgaaaatggggagaaaaacccaactttgggaggagcttctaggtcgtggggcacgaccgtttccggtcaatccgtttcgactagtggtagtgttggctctccctcgagccggagcgagcaagctatggctacaccagctagtgagaatactttcttaagattgaaccatctcgatattcacggagatgatgctggatctcaaggtgccgttggtaaaaagaagaagagaggtcaacgtgcagttgcaggtgataagagtggcagagggctccgccaatttagcatgaaagtttgtgaaaaggtggaaagcaagggaagaaccacatacaatgaggtggcagatgaacttgtagctgaatttgctgatcctggcaatagtgtagcatcaccagatcagcaacagtatgacgagaaaaacatccgccgaagggtttatgatgctctgaatgttctaatggcaatggatattatatctaaggataaaaaagaaatacagtggaagggacttcctcgtactagtctgagtgatattgaagatttaaagactgaacggcttgggctgagaaataggattgataaaaaggctgcctatttgcatgaattggaggaacagtttgtaggtcttcagaatttgatacaacgaaatgagcaactatacagctcaggcaatgcttccggtgggggagtggctttacctttcatcctggtgcagacacgccctcatgcaactgttgaggtagaaatatcggaagatatgcagctggtgcattttgactttaatagcactccctttgagctccacgatgacaattatgttttg

SEQ ID NO: 9735 - DNA, 958 bp, Gossypium hirsutum
  Predicted polypeptide sequence is orthologous to G2989, G2990
ccttcatctcccccccatttaacaacccaagagagaagagcccatttttccccccgtttctctatcccttttcctttttcattaccaagcttcgtaatttcttgcatattatcaaatatttctcataaaacccatctttaaaacccttttaaaattcatttttagcctttttctttaatttttacctttttttttgcttggtgttaactctagatgttaaagccatggatatagctcttgcaagcaccgcaccaaaatcgccagaggctgagcccgagcctgagccagtgagtgaaacaccaactcggatccaacccaccaagcctgtatctttcaccaacggtgttctcaagcgtcacaagcctcaccaccaccaccaccactaccaagcgccacccatcgtcataacctacaaagaatgtctgaagaaccatgcagccagcttaggcggccatgctttagacggttgcggtgaattcatgccgtcgccaacagccaccccaactgacccaacttccctcaaatgtgctgcttgtgggtgccaccgcaacttccaccgccgcgaaccggatgacccaccacccacaacagctaccccaacaatagaataccagcctcaccaccgccaccatccgccaccaccagcaacggcaggtcaaccaaatcgtagtcctaactcagcttccccacctccgatctcatcatcttactacccttcagctccccacatgcttttagctctttcaggaggtcttacaagctcccatttaccagctggtgggctgacaccaaacactgctaatcttggttccaactcaaagaaaagattcagaactaagttcactcagtaccagaaggataagatgctggagtttgccgagaaaattgggtggaaaatccagaaaagagatgagagatattcaagaattctgccgtgaagttggggttgatagagggg

SEQ ID NO: 9736 - DNA, 948 bp, Gossypium hirsutum
  Predicted polypeptide sequence is orthologous to G2989, G2990
cctagatgttagagccatggaaatagcccctacaagcacccctccactaagcaccacaacacccaaatcacccgacccagagaccgaaacaccagttcggatccatcctgccaagcccaaatcttttactaacggtgttctcaagcgccaccaacctcaccaccactacctccaccatgcgccgcccatagtagtgagctacaaggaatgcctcaagaaccatgcagccactttgggtggacatgctttagacggctgtggtgaattcatgccttccccatcagccaccccatccgacccaacttccctcaagtgtgcagcttgtggttgccaccgcaacttccaccgccgagaatcagatgacccaccacccacaacaacagccaccgctactatagaatatcagcctcaccaccgtcaccatccaccgcctccagcaagtcaagcaccacatcgtagtccaaactcagcttccccaccaccgatctcatcatcttactacccttcagctcctcacatgcttgtagccctttcaggtggtttagctggtgcattagacaacaaccaccatcaaaataactctcatttacaaggcttaggaacccttaccccaaacaccacaaatctgggttcccactcaaagaaaagattcagaacaaagttcactcagtttcagaaagataagatgttggaattcgctgagaaagttgggtggaagattcagaaaagagatgaacaagctatccaagagttttgcagtgaagttggggttgatagaggggttttaaaagtttggatgcataacaataagaacacttttgggaagaaagatcaagccattaatgaaggagaaactgggaataacaacaatactgagaatggactcagccatgaagaccaccatcaccacacaacaacaatggtcagaatctcaaccatcactttgaa

SEQ ID NO: 9737 - DNA, 986 bp, Gossypium hirsutum
  Predicted polypeptide sequence is orthologous to G2998, G2999
tggattttggctggataatgctaaatatcgggaggaatataggggaaagggaaaacaataagatatctaacctagataagcttcttgcatcatcatcatcatcaccgtcatctcttttgataacgtttcaaagttttccgagttaggtgaatagttgaatagtgagcttcattttaggctctttattttgtgtttagtcgataattagttgttaaactatggaagttagaggtgaagaacatgatattaaaacgccagtgcgagatggggatcataatggtgctgcggttctcacttgcactcaaaccctagaccaagttcatcgtccccaaaggcaacagtcacttggccatgttggaagatctccgaacccggatcgaatcgccggcgccagtgttgcacccatttcagtcagttctaacacgaagccattggcgggtgtcgttaggtatcgagagtgtctgaagaaccacgctgccagcatcggcggaaacgtttacgatgggtgcggtgagttcatgcctagtggagaagaaggaacactggaagcgttgaaatgtgcagcctgtgactgccaccgcaacttccaccgcaaagaggttgatggagagacccaacaattcgggggtaggagaagcttgatgcttaaccctcttcagttgcctccaccattgccctctccaaccatgctgcaccaccaccaccatcaccatcaaaagtatacaagtccacccagtgcaatggttacaccaatgaatgtagcgtttgttggcggtggcaccgagtcttcaagcgaggatcttaacatgtatcagtctaatccggagggaatggcggcagcagcacccccatatgttttgtcaaagaagagatttagaacgaaatttacgcaggaacagaaggataagatgttggaattagcggagaaattgggggtggagaatcaataaacaagatgaagatgaagtcgaaaagttttgcgctga

SEQ ID NO: 9738 - DNA, 931 bp, Gossypium hirsutum
  Predicted polypeptide sequence is orthologous to G2998, G2999
accaacctgtctcttgttgggatatatatctgtagttggcttattgggagcacaaacccaaacactgtatccttaaccctaaactccaacccccaaccccaaattcctttccctcgtttctctttgcttctcccttgctaattacagatgtttacaccctgcttagatggtgtggtaaaggcgtaaaagcggtggcctgactctgccgtttcctcatctctttcttaaaactctcgttgaaatttggggtatgggtcgagggattttggcaccataatgctgaatacatgaatatctgaggaggaggaggaggaagagataagggaaaccaaccatatatcctagataagctacgtacttgcatcttctcttttatgaaatgcttcaagttgcacacaaaagcacgggaaaacaaatctattatgagttgaactttgagcttgtttagcttggataaaatatcataaaaaagtttgcttctcttttttgtttttcaaccaactactccttaaattatggaagtgagaggccaagaacatgatattaaaacgccagggtcttcagcctttggtcttcactcgcctggagtagagagaagaaaagatgggaaccataatggtacggccgttctcacgtgcactcaaaccctagatcatgttcatcatctccagaggcagcaatcactcggtcaagggagatccccacatccggatcgagtcgctgccgccactggtgctgcagctgttgcacccatttcagtagttcaaacgcaaagccgtccagcttcgtcagataccgagagtgtctcaagaaccatgccgccagcatcggcagaatgtgtacgatggctgcggcgagttcatgcctagtggtgagatgacactcgagcttgaatgtgctgctgtgactgtcatcgcacttcatcgcagag

SEQ ID NO: 9739 - DNA, 514 bp, Gossypium hirsutum
  Predicted polypeptide sequence is orthologous to G2999
ccatctcttaatttgcctggtttcggtgtgaagtcccagggaagctcagccatgccttccattgatgaactggggttgagccatggtcatggtaatgcaagcgtcggtggcttacaaagtcatggggttggcttgaacgatgggaaccaagagcatttgaagacctttagatgggagttatggtaatactgatcataattcacacagagttaacagctgcaaaatgaactactcagcgtcctcatcagctttccaccatgacaagggattggacaccgtttcttcaagaaccgaaggtacccttgattcatggatttgtcctgcagaatagaaatcattgatcactactaaacttaattaatgtgcagaatattgtcagcactagaagggttatttttctcttctttttctcttttgttcatttcagaaataattaattcacattatatatatgcttaattccgtcagtatacttatattatcctcctctgtcgggattaacacacttgtaaaa

SEQ ID NO: 9740 - DNA, 866 bp, Gossypium hirsutum
  Predicted polypeptide sequence is orthologous to G3
tttttctccttcttatggcttacaagttatagtttccagaaacaaggggaaataaaaaaaaatccattttgttttaggattttggtcttcttttatcttttgggtcatggagctaggtgattgttgtttaacatcaagtccagcaagcggagagaagcgaaagctgcataggacacagcaaaaggagaaaccattcagagggataaggatgaggaagtggggaaagtgggtcgctgaaatcagagaacccaacaagcggtccaggatttggcttggttcttacaccacccctgtagccgccgctcgtgcttatgacacagccgttttctacttgcggggtccttccgccaggctcaacttccctgacctcatattccaagaagacgagcttagggatatctcagccgcttccatacgcaagaaagcaaccgaggtgggggctaaagtcgacgctttacagacctcactccatcatgcttctgcttcatcatcggaatcatcgaaccctactcgagttttccgtaaacctgatttgaacaagtaccctgacagttctgatgaagattgaaaacaatataatagtttaccataacccaaaaacctataactgttcatactcgccactttttttttttccccacttatgtctttttgattctctcatggaatagcaagtgcccaaagaatagaatcaataaaaaaatggattgattctctgtttgataaggttatgaatgttttactttgggaatacaagtttagtttatggcatgtaacttttaacatgaatggatattgatgaaacagggatatatatcgctgagttagtaaatactcctaattccttgaccaaaaaaaaaaaaaaa

SEQ ID NO: 9741 - DNA, 671 bp, Gossypium hirsutum
  Predicted polypeptide sequence is orthologous to G30
aaaaatgcttcaatctttattggtttcatttattctcaaaatcaagaagctcctctaacaatttatcgtccaagcactccaattccagcactattctttcttcatctttcttgcttttcacatgttcaaaggaatacgaagaagaagaagcagcagaagcagatgatgaagaagatgatgatgatgatgatgatgatgatgaaggggtagcggtggggggagagtttactgctgtggatgaaatgatatgttcatctcggaagttgagaatagcggagtgacccctcatagagaaagcagctctgtcataagctcgagcagcctcctctgctgtatcaaaagttcccagccacagccgaggtcctccttgcctcgtcgagtcccgaatctcagctgcgtatttcccccaaggccgcctcctcacacctctatatcgaaggctggactccgcctctcctgctttcttcatcttattttgttccttacgttataaaccctcacttgaagaactacatttgtttttggaattttcgctgccaaggcggtgggcaccagttttcgacgagtttccccgtggtttacaacacaagcgacagagcaattcgtttttacagttcaagttcttgggtcccaagctttatgttaacaccattccagttgatgtaggtatg

SEQ ID NO: 9742 - DNA, 934 bp, Gossypium hirsutum
  Predicted polypeptide sequence is orthologous to G3055
agattatcgtgtttggaacaaccaagaaacctccaccgacacccttctgtccaattccgaccaggcaccgaacaagaaaccaagaaattcccaggatttaaacactaggtccagagccataggcaagatgttcttcaagaccaagctttgttgcaagttcaaagccgggacttgtccttacatttcgaattgcaacttcgctcacagcacagaagagctccgccatccacctcctaactggcaagaaatcgtggccgcacacgaagaagagaaagggatcctgtcggagccgagggaagaatttcaaatcccatctttagggtctaccagtttctcaggagaaacacagaggtcatataaaggaaggcattgcaagaagttctattcggaggaagggtgtccttacggtgataattgcacctttttgcacgacgagcagtccaagaatagagagagtgtagctataagtttgggtcccggagggtacggtggtggtggcgccggcggaggaggaaatggtagtggtggtgggaatggatcaaatgcaaagccgtctaattggaagacaaggatttgtaataagtgggaacttactggttattgcccttttggaaataaatgccattttgctcatggagctgcagaactacaccgatacagagggggccttggtgatgcagaaactaaggatactaatgctaccctgcccgactcgaagcaaggcggaggaatgcctttgagaactccttcagaccccgcggcggcgtcagttccccaacttccggtttcagacgtttaccactcacaaaggacatcgattgtactccaaaggccggggcaaagaactcttcagaaatggaaaggtccagataaaatcagtctaatatatggtgactggatcgatgatattcaataaactcatttctttcgagta

SEQ ID NO: 9743 - DNA, 548 bp, Gossypium hirsutum
  misc_feature (47)..(47): n is a, c, g, or t
  Predicted polypeptide sequence is orthologous to G3067
ccacgcgtccgatggattctctgccaagaaagagctcaaggaaggancttggtgtttttacaacttccacaagtggacgagctttcgagtccattcaaattctcgaagacgatccatctataaggaaagctttaatagtttgcagggtaatagctggacgagttcatagacctttggagaatatacaagaaatggcaggccaaaccgggtttgattcgttggccgggaaagtcggtctatattcgaacatcgaagaactttatctgctcaatcctagagctctacttccttgttttgtggtaatctgcaaaccttagaagacacaagttgtgactttatgaaagttatgtgaatccctttttccttggtagagtttttcttttttggaaagaattctcattcttcttgcaatattcttgttaattgctgatatgttctggtttttcatgcaattatattgcttcttttgtgtttaggaactgtattgtagatgaaagatgtgtggaaaaatttatatttcatcaaccatgattggatatttcaagctt

SEQ ID NO: 9744 - DNA, 956 bp, Gossypium hirsutum
  Predicted polypeptide sequence is orthologous to G3074
aaaaggaaaaagctatattcggatctgcgataggtggaaggtggtgttttttgttagatttttttttcatgtttgaaaggattaggtcaacaatgatttccttctgaaggttttttttttctttgaaagggaaaagatcttgttttggtttactttttttttagtattttaataatttaatgatccaaatctgccaaccaaaccatgaggaagaagcttgatacccgtttcccagctgctcgcattaaaaagattatgcaagccgatgaagatgttgggaagattgcgttagcagtgcctgttttagtttctaaagcattggaattgtttctacaagacctttgtgatcgtacatataagattacccttcagagaggagcaaagaccatgaattcattacatttaaagcattgtgtacagagctataatgtatttgattttctgagggaaattgttagccgggttcctgattatggtcatggtcatggtcatggtcattccgatgctgttgctgctgctgctgatgacgatcgaagtatttcaaggagaaggaaagccgctggagatgaagtccatgacagtgatgaagaatcaaagaggagcagaatatgacaaagaggtatctggtgaacttcaatttattatgccaaagccaaactatgttacttggactcgggtatgagtgtcggatacggacatatatctgacacggcatgatgtgggtcatgtagggaccattggtagagggagaggccggggacgaggtaggggacgtggaaagaggaggtcgaaatgtggaaagagatgctcatcgtgaaatagaaccagaaccctgtgcaactcttcagcaaaacagcaaaagtcatccaacccctggaatgctggtagatgatgggttctgagtccaaggaaccgataaaagagaacacaattgctgaagatgccaccaagctgtt

SEQ ID NO: 9745 - DNA, 861 bp, Gossypium hirsutum
  Predicted polypeptide sequence is orthologous to G3074
cccaaatcatgaggaagaagctcgatacccgtttcccagctgctcgcattaaaaagattatgcaagcagatgaagatgtcgggaagattgcattagcggtgcccgttttagtttcaaaagcattggaattgtttctacaagacctttgtgatcatacgtatgagattactcttcagaggggagcaaagaccatgaattcattgcatttaaagcattgtgtacagagctacaacgtattcgattttctgagggacattgttagtcgggttcctgactatggtcatggccattctgatgctactgctgctgctgctggtactgatgatcgaactatttcgcggagaaggaaagctactggagatgaggtcaatgacagtgatgaagaatcaaagagaagcagaatgcatgatatgggtcatgcaggcaccagtggcagagggagaggccggggacgaggcaggggtcgtggaagaggagctcgaaatgtggaaagagatgctcatcgtgaaatagaaccagaaccctgctcaactcttcagcaaaacaacaaaagtcattcaacctcaggaatggtgatagatgatggttccgagttgaaggaaccggtgaaagagaacacagctgctgaagatgccaatcaagctgttcggaattttgatctgaatgccgaggtagatgagaatgtggatacaaaagcctcagcaactgctgctaaagttgctgcacctgcacccccagtcggtgttgctagtggcgctgctgcaccagcagcgccagctgcagcagctcagccttctacagcagagcctacacagaggccaacatgaagaataccaggctggtctctttcggatatggaca

SEQ ID NO: 9746 - DNA, 550 bp, Gossypium hirsutum
  misc_feature (441)..(441): n is a, c, g, or t
  Predicted polypeptide sequence is orthologous to G309
gatggaatcaataaattgataatttattatatattcaaaaagaaaagaaaagaaaaaacaaatacctgtccaaacttatggttggtggaattggaattgaagtgtccatcttcaactttgggtttccatgccgacaagaaaaacattgggcatcccttgttacctaaaatcaaacactcttcttcctcccccattatttctaacaaactttcatcctcaacgctagattatctttcctctggtttaatggaattcgactaaagccagccattgaaaagagatgttgccattctgtcaaagttgggtgccgcctaattacattattaccttcccatgcctctatgttgcactcgcactcatactcataaaaaaaaaggcccaagtcgcaccaccaatcaacagtcttcaaggaatactgaaatgaatccttgaaacatgtcnagaaattggagtgggtatgattagaataaaagtctagcattatcacaatcgtcggatttatctccttcaatcttactaactctctctccattgctttatgcatctctta

SEQ ID NO: 9747 - DNA, 914 bp, Gossypium hirsutum
  Predicted polypeptide sequence is orthologous to G309
cgataccatccactataacccttccgatctagcctcctgggttgactcgctgctgtccgagtttactcagcctcctacttgtccctccgagttcatcatggatcctgaaaccaatcagacggtggtaagcgacgcatggaccactgccgaacctcatatgccgcaggtgcaccagaatatttcttaccagcaacaaagtttgaataatcagttaacggttgataatcagttaacggttgtaacagcaatggaggaagattccggtatacggttggttcatatgttgatgacgtgtgcggagtgcgttcaacgtggagacttctcattggctacttcatgtctcgaagacatgcaagggttactgacacgtgttaacaccgtctgcggtatcggtaaagttgctggacattttatagatgctttgagccgtcgtattttccaaggaattgggggcggttctatcaacggtggttctgcttatgagaatgagattttgtatcatcatttttacgaagcgtgtccgtacttgaaattcgcacacttcactgctaatcaggcgattctcgaagctttcgacggtcacgattgcgtccacgtggtggatttcaatttgatgcacggcttacaatggccagctttgatacaagcccttgccttacgtcccggtggaccccctttacttcggctcaccggcattggaccaccatcaccagatggccgtgactcgcttcgcgaaatcgggttgcgactcgccgagttggctcgttccgtcaacgttcgtttcgccttccgtggagtcgcggcttccaggcttgaagacgttaagccgtggatgcttcaagtgaatccaaaagaatcggtggcagttaactcaatcatgcagcttcaccgcttactcggggtctgatctaaat

SEQ ID NO: 9748 - DNA, 932 bp, Gossypium hirsutum
  Predicted polypeptide sequence is orthologous to G309
gggagtagtagggaaaaaccaagcaaaaccccccaatccccaatgctcagattcttcacccattcatcttttttctttggtttttgagcatcaccacacaaatccatagatacctcccctccacccccctctcaacccacaattttacacaggagaaatttatcacaatcatgaagcgagaccacaatcatctccaacccaacccagacccctcttctctccgcggcgctccttcaaccggaaaggccaaggtttgggacgaagaatccgcccaacaagactgtgggatggatgagcttttggcggttttgggttacaaggtcaaaacttcagacatggctgaagtggctcaaaagcttgagcagttggaggaggttatgtgtaatgttcaagatgatgggatttctcaccttgcttctgaaactgttcattataatccttccgatctgtcgacttggctcgagagcatgctctctgaacttaaccctccctccacttttgatccttttggcgctgctgggacggcggcggcggcgttggatgattcgtttcttgtccccgctgagtcctcaactttgacgacgttggatttcgacaacatcaatcggaaacatcagaaatctggtcaacaaatctttgaggaagcttcctgctccgattacgatctcaaagccattcctggtaaggctatttattctcaaaaaacccaaccccaaacccacgattcctcatcttcttccacacccaccaacgttaaatctgaaaaacgcttcaaatccacatccgggccgccctcgccctcggatatcttcccccctcctcctcctcccgctgctgcttcctatggaattccgactgcttcaactcgtcccgtggtcctggttgactcgcaagaaaatggaatcccggcttgtccatgctttgatggcatg

SEQ ID NO: 9749 - DNA, 980 bp, Gossypium hirsutum
  Predicted polypeptide sequence is orthologous to G309
cttactcactctgtctctcccaactttgggccatgctagatctgccccttctttcaatatttgaaaaccaagaaactaattttaatttgaatcatgttgcggtacgactccacctcgtcatcagcgggaagtagcagtggcagcttatcatcctcctcctcctcgtccaagccaccgcagcaagatattgatggactactcgccggtgctggttataaagtccggtcgtcggagttacgacaagtagctcaacgactggaacgactcgaaaccgccatgggtaattcgcctgcagatttctctcaacttgcctccgatgctatactctataacccttctgatctggcctgctgggtcgactcgctgctaactgagttcgctgagcctcctcccacttgctcctccgacttcatcgtggatcccgtaaacaatcaaacggtggtaaacagcgcgtggaccaccgccgaacctcatacaccgcaggtgcaccagaatattacttatgacgagcaacagagtttggataatcagttgacggttgtcacggccatggaagaagattcgggtataaggctggtccacatgttgatgacttgtgctgagtgcgtccaaagtggagacctctcattggctacttcattgatcggcgacatgcaagggttactgactcatgtcaacaccgtttgcggtatcggtaaagttgccggacattttatcgacgctttaagccgccgtattttccaaggaatgggcggtggctctgtcaacggtggctcggcttttgagaacgagattttgcatcatcatttttacgaagcttgtccatacttgaaattcgctcacttcacggccaatcaggcgatcctcgaagctttcgacggtcacgattgcgtacacgtggtggatttcaatttgatgcacggcctacaatggccagctttgatacaagccctggctttacgtcctggcggactcctttg

SEQ ID NO: 9750 - DNA, 2041 bp, Gossypium hirsutum
  Predicted polypeptide sequence is orthologous to G309
attttctccactttcttctatattctctcccttttttaacttccaacaaaaaccaaaaaccccaatttaacgcccccaccccttgttttccttttccatgaccaaattctagcaaaaaaaatgaagagagatcatcaagaaatttctgggagtggttcaaatccagctgagagttcatccattaaagggaaattatgggaagaagatccagatgctggtggcatggacgacgagttattagctgttttgggttacaaagttcggtcatcagatatggcggatgtagctcaaaaattggaaatgttggagaaagttatgggtactgctcaagaagatgggatttcacagcttggtgatactgttcattttaatccttcagatctatccggttgggttcaaaatttgttgatcgagttcaacggttcaacaacaacaccagatcccaatttcaacgatgattctgagtacgatcttagagcaataccaggggtcgccgcttacccaccggtgaaatcggatccgggtctagaaataacccggaaacgagctaaaactgagtcctcctcatcatcatcttcaacaactactcgtcctgttgtgttgattgactcacaagaagctggggttcgactcgttcatacattaatggcttgtgctgaagctgttcaacaagataatcttaaactagctgatgcattagtgaaacatattgggttacttgcttcatcacaaactggtgctatgagaaaagttgctacttattttgctgaagctttagctcgaagaatttatagaattttcccaccagattcacttgatccatcatataatgataagttacaaattcccttctatgaaacttgtccttatttgaaatttgctcattttacagccaatcaagccatattggaagctttttcaatggctagtagagttcatgttattgattttgggctaaaacaaggtatgcaatggccagctttaatgcaagcacttgcattaagacccggtggaccaccggcgtttcgattgaccggaattggaccgcctcaaccggataatactgatgcgttgcaacaagtggggtggaagctagctcaattggccgaacgcatcgggatcgaattcgagtttcggggattcgtggctaatagtttagccgatctcgaacccgaaatgctcgatattcgtcctcccgagattgaagtagtagcggtgaacgctgttttcgagcttcatcccttgttagctcgaccgggtgggatcgaaaaagttgtttcctctattaaagcgatgaaacccaagattgtcacggttgttgaacaagaagcgaatcacaacggtccggttttcttagaccgttttactgaagctctccattattattctacccttttcgactcgttggaaggttcaggggtggcgccagcgagtcaagacctggctatgtccgagttatacttaggaagacagatttgtaacgtggttgcttgtgaagggatggaccgagttgaacgacacgagccgctgactcagtggagaactcggatggaaacggccggcgttagccctgttcatttgggttccaatgcttataaacaagctagtatgttgttggccctcttcgccagcggcgatgggtatagagtggaggagaataatgggtgtttaatgcttgggtggcatacaaggccacttatcgcccacctcggcttggcgactcgctggtactgagtcaggtagtgagttaactcaggagctgagttgagaaaaagtaaaaaacctgttgaaaagaataagtggggtctatcttttaactgagttgcagaatgtacgagtgaatgaaaaaaatgagggtaaattaaaaaccagtccaagtgtgtaattctagtttttctttgtctattttttccccactttttagtattgtttttagtttcttttagggtagattttttttttaatggggagcctttgtaattttcaaggttggatctaatgtgaaggcatatctttttattactagaaaaaaaaaaaaaaa

SEQ ID NO: 9751 - DNA, 904 bp, Gossypium hirsutum
  Predicted polypeptide sequence is orthologous to G326
tttaacatttcatcttcttcattgaggctagggtttttcaaacttttaatttagatttgatccaaaaaaagctatggttagtccagtttctgaaggtaaaggagctgtgccgtgtgatttctgcaatgaacaaatagcggttctttactgccgagcagactcggccaagctgtgtttgttttgtgaccagcacgtacactcagcgaatctgctctctcgtaagcacgtacggtctcagatctgtgataattgtagctctgaaccggtttcggttctgtgttcgaccgataatttggtgctttgtcaagactgtgattgggatgcacacggtagttgttcagtgtcggcggcgcacgatcggacattggtggaagggttttctggttgtccgtcggctttggagttggcttcggtttggggatttgatctggaagagaagaaaacgacagatcggaactggaacgtgtgtcatcaggatttgatgatgccggcggtggaatcgtggttgtacgaaactagcttgcaagaaatgatggtgccgtacgagagttttggttgttacggggagacgttgaagaagcagaataccggaagcgggaagtgtaaacaggtaatttataagcagcttgttgagttgatgaaaagagatctcatgtgcggcggcggaggagaaggtgttggagacggtggtggtggcggtggaggtgaagagaatctagcgtcgaacgtcgaacaaaacggcgggtttttgactcaacaagaagttttacagccgttgctggaaccgggaacggaaacgcaaacgcaagctctattcacttctttgcttatgatgcaaacgcaagagagtgagcgcatcgttaatggaggaaatgtggtattaaacggtaatccgaacaatcaa

SEQ ID NO: 9752 - DNA, 507 bp, Gossypium hirsutum
  Predicted polypeptide sequence is orthologous to G351
tttttttttttttttttttttttttttttttttgaatgatcaaaagaaaaaaaaatttaattcagctcaaacaaataaatcaatgaattgccaacagctgactgcaatagggagagttcacaaacaatgaacgcattcactgtacacaacaattcatcaaagatataaatcccagaactaatgaaaaattatatatatattgattgtaaattcaattattccttaaccatcaagacatggggtttcttggtcggcaatggactttccacctcttgttcggcatagatgtgaccaaatcttccatcttcattttcctcacaagcaggcatgtttaggtcaaagtcaaagttgagacggtggctttggctcaacgcgccgccgtctgacaacgtcaccccactcacgctaccgctcttgtaactgctgctgttgttgttgccaccttcgtagtggcagcgtttgtggcctcccaaggcttgtcccgtagggaaagacttgtgctcgtgc

SEQ ID NO: 9753 - DNA, 661 bp, Gossypium hirsutum
  Predicted polypeptide sequence is orthologous to G351
aacttatcaatctttagggggacacaagtccagtcacaggaaatttgttggagctgatgaagactccacaaccaccgctgctgctgaagataaattcaccgcatccacgacggctacaaattcacatgccatgatcagcaaccaaggtggcaagacacacacgtgttccatctgttacaagacgttttcttcaggtcaagccttgggaggacataaaagatgccactacgaagctggcagcaacaataataacagcggtaacgatggtgttaaatcctggagccagagtcaacgtgacttcgacttgaatttacctgctggaccagatgaaacaagtatggacgttcttagacaagataaattttgccgcaacgatgaagaggtcgagagtccgtttaccgacgcttaagcacggaagctgcaaggtttattgaatgttttgtaaaaaatcagatttagattaggtgaatgattggagtggactttgttgttgtttattttagtctttttctttttcaatttaattggcatgttttaacgttatttatttatttacttttttagctctctcttggttttgttgatgtacatgaggattaaggtcattataaaatatttgtttgtttggtattgaaaaaaaaaaaaaaaaaaaaaaaaaaaa

SEQ ID NO: 9754 - DNA, 550 bp, Gossypium hirsutum
  misc_feature (77)..(77): n is a, c, g, or t
  Predicted polypeptide sequence is orthologous to G351
tttacacggaaataaaatattcaatagaagaaaatgaatctaaaataatataattcctacaaaagaattcagtattntgtttagttgacttcaactttaggtggcatccatatcacgagacgtggctttttagcaggatgtgggctttccacttcttcatcgccgccggaaacaaacaattttgacggtgagagttcaggaaaagccggaaggttgaggtctaagccccgctggctggtggaactagtggacgctgatctttcaggtgtcgtaacgcctctagcagtcccagcacagccttcatagtgcaaacgcttgtgaccccccaaggcctgtccggaagggaagcttttatgacagatggaacactggtgggacctgccgcttgggttggaggtggaagtggaagaggtggttgttgaggttgattggtcatcgttaataccagatgaaagcttacggtggctggctttgtggccacccaaagcctggtaagagttgaaggccttgttgcaaactttgcacttgaatctaagttgttgatccgttg

SEQ ID NO: 9755 - DNA, 822 bp, Gossypium hirsutum
  Predicted polypeptide sequence is orthologous to G351
gcggccgcgtcgacttcagtgcttcaatcagatggctttagaagctcttaactccccaacaaacgctgctgctccttttcacttccaagataccaatttacactgcctcgatgccttcaccaagcgtaagcgttccaagcgaccacgcttcgacgatgaccatgttcccaccgaggaagaatacctcgctctctgccttgttatgttagcacgcggcggtgctcctcgaaccacctccactaccttgactcaccaaaaacttggcacctacaagtgcagcgtttgcaacaaggcctttaattcttaccaggctttgggtggccacaaagccagccaccgtaaactttcaggagccaacgatgaccactcaacgccaacgacctcatccgccgttggatcaaacccaagcggtaggtcccacgagtgttcaatctgtcacaaaagcttccctactggccaggccttgggaggccataagcgacgccactatgaaggtggggctgcgaataccggtagcattacatctgaaggagtgagttcaacctcaaccaataccacccaccgggactttgatctgaatataccagctcttcctgcattctcaccggctaatttatttgtttccggcggtgatgaagaagttgaaagcccacaccctagtaagaaaccatgtctcttgatgcaaaaggccacccaaaattgaagtcaactaaattttaggccagattccatttttttttcttttatttttgtacatagcacatggaccattcatcggtctcaatggcagcaagttttttatttttattaattactcaaatg

SEQ ID NO: 9756 - DNA, 795 bp, Gossypium hirsutum
  Predicted polypeptide sequence is orthologous to G351
gcggccgcgtcgacaaaacttccacttttctctattgtttgattatggctttagaagctattaactctccaacctcagccaccgctcctttccgcttcgatgatactaatttacactgccttgaatcctttactaagcgtaagcgttcaaaacgaccacgtctcgaccatgtcactgccgaggaagaatatttagctctgtgtcttatcatgctagcacgcggcggtggccaacgatctccttctccaaccaccatgccagaacccacctcgacggaggagcagaaaccgagttacaagtgcagtgtttgtaacaaggcgtttaactcttaccaggctttgggtggacataaagccagccaccgtaagctttccggtgggaacgacgatcagacgacatcggcgaccgggacagccggtggggttgttaagtcatccggcgggaagtcacacgagtgttccatctgccataaaagcttccctacgggtcaggccttgggaggccataaaagacgccactatgaaggtggggcggggaataataacgccggcgccaccgctaccgctagcagcgtgacggaatctgaaggagtggggtcaaccaacaccaacaccaatacccatatcagtaaccgggatttcgacctcaacatgccggttttactggaattctctccggctaatttctttgtttctgccgccggtgatgatgaagtgcaaagcccacaccctgctaagaagccatgtttatcgataccacccaaaatcgaagtcaacttaacaatttaaaaccctt

SEQ ID NO: 9757 - DNA, 964 bp, Gossypium hirsutum
  Predicted polypeptide sequence is orthologous to G351
gtttatcaacttgggctatacttttctcacttctctccacttgtcacgcaacttccttccccctttaaaaccccatcccctcacttctcagtctccttcaactcacagtttctttccccttgcaaacacttttgctctgcatctctctagcatcccaattcataaccaaaggctccttcgttttttgtgtttactttcggtgttggaatcaatcggatggctttagaagctctcaactctccaactacaaccgctacgcctcctttccactttgaagataccactaacttacactgcctggaatcgttcaccaagcgtaagcgttccaagcgaccgcgtttcgatcatgtgaccaccgaggaagaatacctcgctctctgccttatcacgctagcacgcggcggtgatgccaactccaccaacacttctgttatcccacaccgccatcgttctcctactccaaccgcctcaccaccgcctgcaccagcaccagcaccgacctcaacagtgcaaaatgttagctacaagtgcagcgtttgcaacaagtcctttaactcttaccaggctttgggtggtcacaaagccagccaccgtaagctttcaggcggaaacgatgaccagtcaacgtcgacaaccacctctgccactgccggcggagttatttcatctgctttgaacccaagcggtaaaacccaccagtgttctatctgccacaaaagcttccctactggccaggccttgggaggccacaagcgatgccactatgaaggtggggctgggaatagtgctagcgcaaccgctagcgccagcggcgtgacgacatctgaaggagtgggctctaccaataccatgagccacatcagccagcgaatcgactttgacctgaacctaccggctttgccagaattctcaccggctaacttcttcgtatctggcggtgatgatgaagtggaaagcccacacc

SEQ ID NO: 9758 - DNA, 947 bp, Gossypium hirsutum
  Predicted polypeptide sequence is orthologous to G351
cacagattaaacccctccaaaaaagcttacttttagcactctgtttttgctctcaaactcgaagggactcggaagtattagatatggcgcttgaagctctgacctcgccggcgacgcctttcaccaacaaatacgatgacgtggacaacaattacgtcgagacatggaagaaaggcaagcgttcgaagcgccaacgcggcgactctcctgctgctgttgaacttcaacccaccaccgaagaagagtacctcgctctttgtctcatcatgctcgctcgcggctcttccggtgctgatcgtgatgttattcgtcggtcttcctcttcgtcgtcaccgcctccgccgccgcctgctttgaagttgtcttacaagtgtagtgtttgtgacaaggcgttcccttcttatcaagctttgggcggtcataaagccagccaccgcaaacccctttccgccgacgccgctaccaccaccgccgccgtcaacgtcgataacccatcaacaaccagcaccgccaccaccatcaccagcagcggtaggcttcacgagtgttccatctgccacaagagtttccctacgggccaagccttgggtggtcataaacgctgccactacgaaggtggcaacaacaacaacaaaaataacaacaacagcggtagcgttagcgttagcgttagcggggttacgtcttcggatgggggggcgttgagccacaaccaccgtgcagtcgactttgactttgacctcaacttgccagccttgccggagttcagtcaaatgtacccagatgaagaagaggttcaaagcccattgccgaccaagaaaccacgtctcttgatcgccaagaaagagaaactggattcttcattagcacaagatttagaattaaattgaaaaattcagatcatttgtttttaattttcaatttttttctgggatttgtattttttt

SEQ ID NO: 9759 - DNA, 916 bp, Gossypium hirsutum
  Predicted polypeptide sequence is orthologous to G351
cttgcacttgattgattcgaaggaaattagaagataaatatggcccttgaagctctgaaatctccaacaatggcgactgccccttacagcaacaagtacgaagacatcgacaacaattacttcgatacatggaagaaaggcaagcgttcaaagcgacaacgcgacgacgagtcttcttcttctccgccgccgccaccaccgccgacgaatgaagaagagtaccttgctctttgtctcatcatgctagctcgtggtggttccaccactgaaaacgccgtgacagacggtggaaacgatgaccatcgtctgtcttcttcttcttcagcaccggcaccagcggctttgaagttgtcttacaagtgcagtgtttgtaacaaggctttcccttcttaccaagctctaggtggacataaagccagccaccgtaaatcctccaccgatgctaaacccgataatcagtccatcaccaccagcagtaccaccgccagcggggaagccggcggtaacggtaaagcccataagtgttcgatctgccataagtctttccctacaggccaagctttgggaggtcacaaacgctgtcactacgaaggcggaaacaccaccaccaccaccaccaccaccgccgccatcaccaacaacaagagcagtagcgtcagcttgagtggggtgacggtgtcggacggtggcgcgttgagccaaacccgttgcgtcgactttgactttgacctaaacttgcccgctttgtgcgagttggaaatcaaagatggaagcagattttgtcaaatctatacagagcaagaggttgaaagtccattgccgaccaagaaaccacgttttatgacagcttctttagcacaacattaatttcattagtgtttataggaattaaacatagagtgaattcatttatttt

SEQ ID NO: 9760 - DNA, 760 bp, Gossypium hirsutum
  Predicted polypeptide sequence is orthologous to G354
gcggccgcgtcgaccagatttcaacagcaaaacccaaagtttcatactttacagtgttccaagtattcagtgttttttatacaagttttcagattaatgaagagaggcagagatattgatgcgatggatatggcagattgtttgatgttattatcgagagttggggaaaccgaccgggttgctggtcgtgtctttgcatgcaagacatgtaataaaaagttttcatctttccaagcacttggaggtcacagggcgagtcataagaagccgaagctaacggtaggagacaatgaagggttagcggtttcgcctaagaagccgaagacccacgagtgttcgatatgtgggctggagttcgccattggtcaagctctcggcggtcacatgaggagacatagggctgctctgaatgacgggttggtaactcgggatttgttgccggagatgaataaatcgaccggagatggtagggatccatctatagatttgggtttgacgtcttggggagtggatttggagttgaagctggggaaagtgacaccaactccggttgttcattgttttatataggattaatacatgtgggttcatattattagagcacggtataggtagataggatttgattttaacattctttcgttacttgtatattgtttttggtctattttttactccatttttactacattgttattcatgtcttatttttatgttaagattgataataaaattacagaatataaaaaaattcaattaa

SEQ ID NO: 9761 - DNA, 523 bp, Gossypium hirsutum
  Predicted polypeptide sequence is orthologous to G385
ttttttttttttttttttaagaaaaaagctattcattaattttcaaagataccaaaaacataaaaccagaaaccaaatgtttgccgatggctactgtggactgtgagtcccaataatacttcaaaacacaaaaacataaaagaaaagaaacgatggaagctctcattgtctttttcccccgagaaagtcaatacccgaaccaaactaattctccttgcaaggaacatggaaggtgcgttcttgactttcattattactgttgagctagtcaccattttttgtttgctcggtcaagcgtcattacacatgaccgcagttctgatcctttcaagagtgcatttgattaggctattcacagtagccactgatcccacagagattttcgaattcggagccgaatcaactaagatttggaacgcaagggtaacgagtgacccgccggagccgatttccgtgatctctattcctctgttaggtccttcacagtcgggaagtatcgcgaaaccagaaggtaaaaagcgag

SEQ ID NO: 9762 - DNA, 2616 bp, Gossypium hirsutum
  misc_feature (2600)..(2600): n is a, c, g, or t
  misc_feature (2614)..(2614): n is a, c, g, or t
  Predicted polypeptide sequence is orthologous to G385
gctcaccaaaaattatgccattatctttcatagttcgcccgttttctttttccctctcaaaattgattgactagaataatactactctttcattgctctggtttttttatctccagtttattagcaatgatgataatgagcggtgttgaaatccaaatggttgctcctactgagtaaaagagacccttttttccgctttcatttaaggtgttttcgtaaaggagagacgttatggattgcggaagcggcggcggcggcttaggagcgagtggttccggcggagaccatgattcctccgacctttcacgacggaaaaagccttaccatcgtcacacagctcaccagattcagaggcttgaatcgatgttcaaggaatgtccacacccagacgagaaacaaaggttacagctaagtagggaattgggattagcaccaagacagatcaagttttggtttcaaaataggaggacacaaatgaaggcacaacatgaaagagccgataactctgcacttcgtgctgagaacgataagatccgatgtgaaaacatagccataagagaagcacttaagaatgtgatttgtccttcttgtggtggtcctcctgctaatgaggattcttattttgatgaccagaaaatgagaatggagaatgctcaattaaaggaagagcttgatagagtatccagcattgcagccaagtacatagggagaccaatatcccaactcccaccagtacaacctgttcatatctcttcattagatttcaggatggcgagttttgacggctatggtgtcggcgctggtccttcactcgatctcgatctcctccccggaagttcgtcatcaatgccgaatttaccgttccaaccggtcgttatttcagacattgacaagtccctcatgtctgatatagccgcaaatgcaatggaagaactgcttaggctattacaaaccaatgaaccattgtggattaaatccactaatgatggcaaagatgctcttaatctcgaaagttatgaaagaatcttccctaagcctaataatactcattttaaatctcctaatattagggtcgaagcttctcgagattccggtgttgttattatgaatggcttagctttggttgacatgttcatggattccaacaaatggttggagctatttcccaccattgtgtcaattgccaaaacaatcgaagtgatttcacctgggatgttgggtacacataggtgttctttgcaattgatgtatgaagaactacaggtcttgtctccattagtaccaacacgagaattttatacactccgatattgtcaacaaattgaacaagggttatgggctattgtcaatgtttcatatgatttgccacaatttgcttctcaatgtcgatctcatagactcccttctggttgtttgattcaagacatgcctaatggttactccaaggttacttggttagaacgtgtggagattgaagacaaaaccccgattcatcgattgtatcgagaccttgttcatagtggttcagcatttggagccgaacggtggctcacgacccttcaaaggatgtgcgaatggtttgcttgcttaagggtatcgagcacttcgactcgggatctcggtggagtgattccatctcccgagggcaggagaagcatgatgaagctagctcaaaggatggtaaacaatttctgcacgagcgtcggcacgtcgaatagtcatcggtcgacaacactttccggttcgaatgaagttggtgttcgggtcaccgttcataagagttctgatcccggacaacccaacggtatagttcttagtgcagctactacattttggctccctgttagtccacaaaatgtcttcaatttcttcaaagatgaaagaactagaccacagtgggatgttctatccaacggcaacgcagtccaagaagttgctcatatcgcaaacggatcacatcccggcaactgtatatccgttttacgagcctttaatacaagtcacaacaacatgttaatactacaagagagttgcattgacagttctggttcactggtggtatactgtccagttgatttaccagctattaatgtagcaatgagcggcgaagatccatcttacattccgttacttccgtcaggttttacgataacacccgacggtcatctcgagcaaggtgacggagcatcgacgagttctagtactgggcacggaagatcgtccggtggttcattgattacggtagcgtttcaaatactagtgagcagcttgccatcggcaaaattaaacttggattcggtcacaattgttaataaccttattgctaatactgtacaacaaattaaggctgctttgaattgtcctagttcttgaactgatttgatttgggttatggtgcatgtgtgtgtctagggtttttcttactacaaggcatttttgtttttttttttttttcaatttaatctttggaagagtggttactaatattcgaagaggagtcaataacacaaacgtatatgttatttgtcttttcttaaattttaatcctttgtgttggacctcaacctcgcttgcttggttcgggtatattgacttctatnccattggctttatnct

SEQ ID NO: 9763 - DNA, 962 bp, Gossypium hirsutum
  Predicted polypeptide sequence is orthologous to G4
caacaacccaaacaaacaaacaaaaaaggaatcgcctctacttctactttttacataattctcactttcaattccctcactctgatcaagccgccatgtgtggaggtgctataatctctgattttattgctccggtgcggtcgcgtcggctgacggctgactacttgtggcccgatctgagaaaatcgcaatcgaaaaaggcttccagtaataggtactcgaagccggcgatcgatttcaccgataacttcgaggccgactttcaagacttcaaggatgataaatccgatatcgaagactatgatgttgatgatgttttggctgatgccaagccctttgcgttctctgccgcaaagaaagcatcttctactgtttctcatgctcaagctgagaagtctgcaaaaagaaagaggaagagccaatatcgaggaattcgacagcgtccatggggtaaatgggctgctgagatccgagacccgaggaaaggggttagggtctggctaggaactttcaatactgctgaagaagctgcaagagcttatgattctgaggcacgaagaattcggggtaagaaagcaaaggtgaacttccctgatgagatgccacgcacctctccaaaacgtgtgattaagacaaatgatgagaaaccacttcccatgtcaaatttgagccctgttgaaccaaatatcaaccagaatttcaattgcttgaacaaaccagagcaggtcttttatgataccatgggtttcgttgaagagaaggcaccaatggatccatttgcttatgtggacactgttcctgctgctgttgatgttggattgaaaccctttggccaatctgacaatacccccttgtatttcggctcagaccagggaagtacttcctttgactgttctgacttcggctggggagaacatggtgcaaagactccggaaatatcatctgctcttgaagctactatg

SEQ ID NO: 9764 - DNA, 1538 bp, Gossypium hirsutum
  Predicted polypeptide sequence is orthologous to G4
cggcacgaggagagagagagaactagtctcgtgccgggaaaatttacaattaaaaaaattaattttgccctctaaatttctctaaaaaatctcctaaatcccatactttaaatccaattcgccatgtgtggaggtgcgattatctccgatttcattccgcctgcgcggtcgcgactggtgacggcgaattatttgtggccggatctgaaaaaatccggctctaaaaagcggtcgggtagaaagcactcgaagaagccggcggtcggctttgaagatgacttcgaggctgattttcaggtgtttaaggatgaggattctgatgtcgatgacttcaacgatgatgttgatgatgttttggctgatgttaagtcctttgctttttctgctacaaagaaaccctctcctgctgtttctcatggttcaaactccataaaatctgtggaattcagtggtcaagctgagaaatctgcaaaaagaaagaggaagaaccagtatcgcggaattcgccagcgtccgtggggtaaatgggctgctgagatccgtgatcctaggaaaggggttagggtgtggcttggaacttttaatactgctgaggaagctgcacgagcttatgatgctgaggcactgagaattcggggtaagaaagcaaaggtgaacttccctgatgagactccacgtaccactccaaagcatgctgttaaaatgaattctcagaaacctctttccgggtcaaatttgagttctgttcaatcaagtctcaacccagatttcagttactcgaacaaacttgagcagggctactatgataccgtgggtttcattgaagagaagtcactaatggatcagtttgcatatgcagaccctgttagagctgctgtagatgatgggttaaaaccctttgctgaccctgagaataccgcttcgttttttatctcagatccagggagtaacaactttgacagttccgaccttgtctggggcgaccagggtgccaagactcctgaaatatcatcctctcttgaacctactctagaggtcaacgagtttctggacaacgcaaaccctacgaagaagttgaaactgagcttgaataatgtcatgcctactggaggagacaattcggtaaagagtttatccgatgagctattagctatggacaatcaagtgaactactttcagacaccatttattgacgagaactggaatgtttcgatggatgacttccttaatggagatgcaactcaggttggcggaaacgaaatgggtttttggagctttgatgactttccttccatagatgggggtattttctgaacaaactctccttacttattatccgtttccgtacataaggcatcgtgttagcgagtttcgaccctctggcaactgcttgactattgtttctatcttgatatctctaacaccgaaaaattcaaatttaaatttcgagtgactgttagaacttacaacattgattatgtgtgatttatgatgaaaatttgaaactcctatgaatgtttaaccaaaaaaaaaaaaaa

SEQ ID NO: 9765 - DNA, 1596 bp, Gossypium hirsutum
  Predicted polypeptide sequence is orthologous to G4
aaaaaaccaacccatttatttcactacccaacaacccaaaagataaaaggaatcgtttacttgttcgtagcaatttatcgtcatttcaagctcaattctctgaaaattttgtgctgaacttcttttttctctttgtaccaccatgtgtggaggtgctattatctccgatttcataccgccgtcgcagtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgctacaaagaaacctgcttctgctgtctctcatggttcgaactctgaaaaatccatgcaattcaatggtcaagctgagaaatgtgcgaaaagaaagaggaagaaccagtatcgtggaatccggcagcgcccatggggtaaatgggctgctgagatccgtggcccaaggaaaggggttagggtctggttaggaactttcaatactgctgaagaagctgcgagagcttatgatgctgaggcacggagaattcgtggtaagaaagctaaggtgaacttccctaacgagactccgcgtacctctccaaagcatgcagtcaagacaaattctcagaaaccactttccaagtcaaattcgagccctgttcagccaaatctcaaccagaattacaattacttgaaccagcctgagcaggaatactttgataccatgggtttcgtagaagagaagccatcggtcaatcagttcgcatacgtggaccctgttcctacgtctatagatgctggatttaatcaatcagataatgcccccttgtacttcaattcagaccagggaagtaactcgatcaattgttccgactatggctggggagaacagggtgccaaaactcctgaaatatcatccattctggaagcttctgtagagggtgatgagtttcttgaggatgctaaccctagcaagaagctgaaaccaagttccgacaatgttatgcctgccgaagacaactccgcgaagaccttgtcggacgagctgttggctttggacaaccagatgaaatacttccaaatgccgccatttattgaaggaaactgggacgccactattgatgctttcctcaatggagatgcaacacaggatggtggaaacccgatggatctttggaactttgatgatttccctaccatggcggagggtgttttctgagcgaactttccataataactagtgtttgtaaataaagcaacatgaatttggtcaaaatctgttgtgaagttgaagtaaaaaccaagctatatgcatgcttaagccttgcctgcactgctttcagaggtttttagtatgtaccccttttttatgtgtttttttgtagactttggactaaattttaaatttgagtgactgtataagtaactgtgtctgaatttgtctatgtttgaatactgaaaaacatatgaatgttttaaacccaaaaaaaaaaaaaaaaa

SEQ ID NO: 9766 - DNA, 883 bp, Gossypium hirsutum
  Predicted polypeptide sequence is orthologous to G409
gcggccgccttgacctccagcaagcaactttttgtgtctttttactcgccggaaagttttagacacaaaaatattacacacatacacgaagtttaagatatagaaagacaagtttgtataaagaaaatggagtctggccgtctttttttcaatccctccactacccaccgcaacatgttgcttctcgggaacactgaacccatctttcgaggggcaagaacaatggttagcatggaggaaaacccaaagaagcgactgttcttcagctcgccggaggatttgtacgacgaagagtactacgacgagcagttgcccgagaaaaagcgtcgccttacgtcggagcaggtgtatctgctagagaagagctttgaggcagagaacaagctggagccggagaggaagagccagttggccaagaagttaggactgcaaccaaggcaggtggcggtatggttccagaaccgccgtgcaaggtggaagacaaagcagcttgaaagggactatgacctcctcaaatcttcctttgattcccttcagtccaattatgacactattctcaaagaaaatgagaagctcaaatctgaggtagcttccttgactgaaaaactacaagccaaagatgtggcaacagaagcaatagcaggtgaaaaggatgaagggttagcagctgagatggcctccgccctccaattcagtatgaaggtggaggaccgtcttagtagcggcagtgtcggaagcgcggtggtggatgaggatgccccacagctggtggacagcggcaattcctactttccaagcgatgaatactccagaggcattggccctttcgatggggttcagtcggaagatgaggatggcagtgataattgcgggagttacttct

SEQ ID NO: 9767 - DNA, 494 bp, Gossypium hirsutum
  Predicted polypeptide sequence is orthologous to G428
tttgggagtcatattagcagcttgaagttggaattctctaagaagaagaagaaagggaaactaccaagagaagcacgacaaacattgctcgagtggtggaatgttcactacaaatggccataccctacggaggcagataagctagcattggcggaatcaacggggctagaccagaaacaaatcaataactggtttataaatcaaagaaagcggcactggaaaccatcggagagcatgcaattcgcggttatggataatctgtcggggcaattcttttcagaggactgagggcgggggcaactaccgactggcttgctttctcataaatgtatatgccacatcattaattaattatatggttttgttttgcatatgccttctatgccatgatgtatattctgaatgcaaaatgtattataggacttaaaactcagatttgaatctctccctcccgtcgacttggaatatttggataaaaaaaaaaaaaaaaaaaa

SEQ ID NO: 9768 - DNA, 728 bp, Gossypium hirsutum
  Predicted polypeptide sequence is orthologous to G450
tttttttttttttttcttttttttttttttttttttttttttttttttttttttttttttttttttttttttttttttttttaaaagcaaatagaaaacacggatttggataaatagtcaaaggcttatgacatccacatatatataaatatatatagtagcaaacttccatcttatgctttcagtagttactgtgacattgaatcgtctaggtacggtttttgcacttctccatagccctcggagctaggccgatagcctctgtactcttcatgatcctcaatctcttaaacgagtccccggccataatggccgaattcccgggtaccaacacaatggcgcgcttcccgagaaaaaaaaaaaaagctcgtccagatctcggagcttggcgtaatcagggtcatagctgtatccggtgtgaaattgttgtccgctcacaatggctagagtactttccatatttggcgcctcgttatcatccaaaatacgccaggaatattccaacgagataacccggttaaatccttcaccgggggaactggtcaaaaataccctccggaaacttcggggaaagcgaaacctgtgaagtaacgcgaacatagctgaaatacaaaagggccccaaaacatgggcaacctggccaacagctccgtgaacaggtacgccacaattcacacaagacagaaaaatggacccacgcgccacaagagacaccaaaaaaggctcac

SEQ ID NO: 9769 - DNA, 769 bp, Gossypium hirsutum
  misc_feature (769)..(769): n is a, c, g, or t
  Predicted polypeptide sequence is orthologous to G450
tgtttcgccccacgcgtccgcactctcctctatttcttaacaaacatcaactccagagatcgccaaacatgctaggaactgagcatgatttgaacttcaaagagaccgagctgtgtctcggcctgcctggtggaagtggtggaggaggaggagctgccgccgccggtggtggtggtggtggtaaaaatgaagtggaaagttccccaaagaccaccgggaaaagaggctactccgagactgttgatttgaagcttaatcttcagtctaaagaaggttgcatggatctgaatcagaacctagaaaatggttcaaaagaaaagaatcatctcactgcaaaaccaccagccaaggcacaagtattgggttggccaccagttcgatcttataggaagaacattatggctaaccagaagaacaacagtgacgaaattagtgacagagctagcagtggcagtgggggtgcagcgtttgtgaaggtttgcatggatggtgcaccatatttgcgtaaagtagatttgaagatgtacaacagctaccaaaagttatccgatgccttggctaagatgttcagttccttcaccatggggagttatggatgtgaaggaatgatagacttcatgaatgagagcaagttgatggatcttctcaacagttctgattatgtgccaacctatgaagataaggatggcgactggatgctcgtgggcgatgtcccatgggagaatgttgttgaatcgtgtaaacgtttgcgcattatgaaaggatcagn

SEQ ID NO: 9770 - DNA, 785 bp, Gossypium hirsutum
  misc_feature (639)..(639): n is a, c, g, or t
  Predicted polypeptide sequence is orthologous to G450
tacctttttcgcaagccacgcgtccgaaccttcctatattcctattcctattcttatcatcactctctcaatcctttgcttattacaacaaaacctttttcttctttatttttcacctttcagttcaaatcatcaaacccagaaagcgtggctacaacaaactgcaaaaaaaggaaacaattagagaaagaagctatggaagttggcttaaagatgacgatgaaaggaggcggaggagatcatgttggaggttgcgacaaagagaagatggggtttgaagagactgagctgaggctagggttgcctggtggtggtggtggtggtggtgacggtgaagttgtgaggaaaagaggcttctctgaaactgttgatttgaagcttaacctttcctccaagcaagacacctctgggatcgatcccaatgatgagaaagtgaaaggcttgcaccaggagaagaatcttctcctttctgccattgatgctgctaagcctcctgccaaagcgcaagttgtgggatggccaccggtccgatcattccgaaagaacatgttagccaccaccacacagaagagcagcagcgaggagagcggcgagaaagcggcgctggtgaaggtgagcatggacggtgcaccttacctncgtaaggtggacttgaggatgtacacaagttaccaccaactctccgatgctttagccaaaaggttcagttcttttactatcggaaattgtggatctcaaggaattaaggattttcatgatgagaagtagctgatggatctccttaa

SEQ ID NO: 9771 - DNA, 795 bp, Gossypium hirsutum
  Predicted polypeptide sequence is orthologous to G450
cgtcgctcttagccttttactcttttactttactccttgtagtactctcgacaatataacccccccccccccaaccctttttttttcctttaattcaaagccacaaagccaactcaaaacccacaaaagccaaagcctaggtacacagaaactacaaaaagaaatagagaaagaaggtatggaagtaggggtgaagatggggatgaaaggaggaggagatgaagtgggaggtaaggagaaggagaaaatggggtatgaagagacagagctgaggctagggttgcctggtgatggtgaggttgtaaggaagagagacttctcccacactgttgatttgaagcttaaccttatttccacctctccaactgatgacaaggacaaaaatattgtcccttctcaccttgatcctgctaagcctccacctgccaaggctcaagttgtgggatggccaccggtccggtcattccgaaagaacatgttagccacccaaaagagcagcgccagcgaggacagtggtgagaaggccgcctttgtgaaggttagcatggacggcgcaccctatctccggaaagtggacctgaggatgtacaaaacttaccaacaactctccgatgctctagctaaaatgttcagttctttcactattggaaattgtggaagccaagggttattgaaggatttcatgaatgagagtaagctaatggatctgcttaatggctctgattatgttccaacctatgaagacaaagatggtgattggatgcttgttggtgatgtcccttgggagatgtttat

SEQ ID NO: 9772 - DNA, 880 bp, Gossypium hirsutum
  Predicted polypeptide sequence is orthologous to G450
catatattcccccctcctacttgcaatttctctagcaaatacactatcaagagagagagaaaagagagatattttgtgacgaaaaaaaaaaaaaggaaaaggactaaagttggatggttgtagggttttgcacgtaaaagctcgtgtttaatcatcataatgactagcattatgggcacagaggatgataagtatagcacgattaacttcgaagagacggagttgcgtttagggttgcccggcgccaatggaaacgacggtgaaactaccaaaaacaacggaaaacgagggttctcagagaccgttaatttgaagcttaacctttcatcaaaggagactgtagccgaggattccgacaagatgaaggagaagagctcaactgaccctgcaaagccacctgccaaggcacaagtggtgggatggccaccagtcaggtcattccggaagaacatcatggccgtccaaaaagccagttccgaggaggaaggtggcagcaagaaggccggaaacagtgcagccgccattactaccaccacggctgcggcgtttgttaaggtcagcatggacggtgcaccttatctacgcaaagtggacttgaaactatacaagagttaccaacaactctctgatgccttgagcaaaatgttcagctccttcactattggtaactgtgggtctcatggaatgaaagatttcatgaatgagagcaaattgatagaccttttgaatggttctgagtatgttcctacttatgaagacaaagatggagattggatgcttgttggagatgttccatgggagatgtttgttgattcgtgcaacgcttacgaattatgaaaggatctgaggcaattggacttgcaccagagcagtagagagt

SEQ ID NO: 9773 - DNA, 1020 bp, Gossypium hirsutum
  Predicted polypeptide sequence is orthologous to G450
ggtgttggtccaataatttagtgcaaaaaccatcttcttttttctgctttctcgtatagcagcctgttttgagaaacttttttttgaggaaattagaaaatgtcatcggagaacgggaaaaggttgctggaaactgatgccggcggcttgaattttgaggctaccgagctgactttagggttacctggagagcctagagtaacatcggacggtggagctaagttgggcagtaaacgtggattttcggaaaccgttgatcttaagttgggtgacaacaatcaagaggttaagctgggtcactccctccaagaagctgccaagtctcccgtttcaaagacacaagtggtgggttggccgccggtgagaggctttgcaaagagaggaaagaagagttgcaaatatgtaaaagtggcggtggacggtgctccatatttaaggaaagttgatctcgagatatacaatagttatcagcagctgttaacctcccttgaagacatgttttcatgtttcaccataagaaactatttgaacgagaagaaaatagaccaagtgaatggaattgagtatatgcctacatatgaagataaggacggagattggatgttggtgggagatgttccatggcaaatgttcgttgaatcttgcaaacgcttaaggttaatgaaaagttcagaggcagtaggattaggtctaaagacggctcccaaatattcaagcacaaattaaagaaaaagaagcctttttaattcaagcatccaagaaagaaatcataaagaattgtacagaggctttttgctttgtttgaactatttttacctgacgggcagggtttttgactaagatatagactgccaaattgcaagaaacataaaataaataagctgtaattgtagtgcattgatgttgtgggcttttttctccacattacttaaagttaatcatctcttcttcctttttcaaaaaaaaaaaaaaaaaaaaaaaaaaaaaaaaaaaaaaaaaaaaaaaaaaaaaaaaaaaaaa

SEQ ID NO: 9774 - DNA, 476 bp, Gossypium hirsutum
  Predicted polypeptide sequence is orthologous to G451
ttttttttttttttttttttttacccatataagttttaattgtacatacatagataaacagctgatatacagtacaaattttgtttctttgttttaacatttcataatcaaaactttgggataatccacatctatttgctgaatttcttcaatcatttctttgcttacaaatttgcactttgaacccttcatattatctggatttctttaataagtccttcaagaactttcccagtccattgaatctctgagatgactatctattgaagccaaaaaaatatccttcgagaacccaagctgatgatacctctccgtgaaggagacatcaatggagatcttcagtgtttttcatgttcttaggcaaagtgttttttttctcatacaccacaacctaatcctctagcttctgatcctttcatgatccttaatctcttacatgatgtgatgaacattctgtaacaaaaaaaaaacgtaag

SEQ ID NO: 9775 - DNA, 860 bp, Gossypium hirsutum
  Predicted polypeptide sequence is orthologous to G451
gtacaattggattggatcttaactattctttaatatcgtgcctttttgtttttgtgctataaaacaagtatagatatttgacatgcatagaggaggctaaaaaggccagccatgttgtcaaatctttgagaaatttttctctagcaaatagccccctcactttccaggaagaccaaattgatcttccttgtagaatttggattatccaaagccaaagaaaactttccttcttgttaaataatttggtggctcatacacagcccaaccctctagcttctgatcctttcatgattctcagcctcttgcaggaggaaatgaacatctcccagggaacatctccaacaagcatccagtcaccatctttgtcttcataagtaggagcatagtcagatccattgtagccttccctctttgagtatgcaccaatggtgagcttgaacatattttccaaagctttgaggagttgaggatagcgcccataaaccttgagatcaatctttctgagataaggagctccatcaacgcttactttcacatacatccccatcccttcaacttcatttctcttggaactttgtaagcaatttttcctgtttgatcggattggtggccatcctacaacttgttccttggcaggagggggactgtcttgatcatcactcccagacattgtaatgctagaattgctctcagaactcgatacctcagaaatctcaggtacagttcttttattatttctgatactgggatttgtttttctttggggctcatcatcaccacaaccagggcatcccaatcttggctcagttgccatgagattgagatcattctcgtaattcactctcctttccattgctata

SEQ ID NO: 9776 - DNA, 479 bp, Gossypium hirsutum
  Predicted polypeptide sequence is orthologous to G451
gcacgaggctcagagagggaaggctacaatggatctaactatgctccaacatatgaagacagagatggtgactggatgcttgttggagatgttccctgggaaatgttcatctcctcttgcaagaggctgagaatcatgaaagggtcagaagccagggggttggggtgcgtatgagacgcccaaaaaaagaacaaacaaggagattttctttggcttggataatccaaattccacaaggaagatgaagcctgctcttcctgagaagtgagaggtgccatttgctagaggaaaaattcagagactgcatccttttcaatccaaccatggctggctttcagcctccattatttcaaatacatgtacttctttataaatagcatataccacaaaaccaaaaggcagaaaaacaatgtagaaatacttgagagacccaactgtacaaaggaaatactatttgctttaaaaaaaaaaaaaaaaaa

SEQ ID NO: 9777 - DNA, 554 bp, Gossypium hirsutum
  Predicted polypeptide sequence is orthologous to G468
cctttaaaattcggcttagcgtggtcgcggccgaggtacccctggatgtatacagtatttccttctctttctggttatttaaaccaaaggtggtggcttttgttcttcggtcttagttcccacatctcagaaaatgagaagggcaattagttattgttcatcttctatagggagcagcaaccactttgattcctcaagcactgctactgctgcttcttcctcctcgcagagggaccataacaccgatcttagccttggtcgtagcatttcaacctctcctctttatgcaaggaagcaaagatcgccaataaagccgctgctaaggctggagcttgccgaacaagatgagtgcaacagcgctactttttatgtcaaggtttacatggaaggaattcctattggtagaaaagtagacctgttggatcgccggagttactgtgacctgataaaaactcttgaacatatgtttaatacaaacctcatatggggctgaggctgaggtgaatggtgatcatttcgaggaatatcatgtacctgcccgggcggccgctcga

SEQ ID NO: 9778 - DNA, 373 bp, Gossypium hirsutum
  Predicted polypeptide sequence is orthologous to G468
cctttaattcggcttcgagcggccgcccgggcaggtactcccttttgaagacaaggaaggggattggatgatggttggtgatgttccttcgcagatgttcttgtcggttgtcaggagattgaagataagtagatccaatgccgaactttgataaacaacattgtttttcttttcttttctttttcgtggagtgaaaatcaataggagatcgcgtacgcagaaaatatatggtcagatatgtttagggttttttctcaaaaaaatgtaccatggacatactagaatgattgagcaacacgcaccagtcttgtctttcggctgcaactcttttattggtgatcgattgtgatgttttaacttaaaaaaaaaaaaa

SEQ ID NO: 9779 - DNA, 549 bp, Gossypium hirsutum
  Predicted polypeptide sequence is orthologous to G468
catctcagaaaatgagaagggcaattagttattgttcatcttctatagggagcagcaaccactttgattcctcaagcactgctactgctgcttcttcctcttcgcagagggaccataacaccgatcttagccttggtcttagcatttcaacctctcctctttatgcaaggaagcaaagatcgccaataaagccgctgctaatgctggagcttgccgaacaaaataattgcaaaagtgtaatttttaatgtcaaagttaccttggaaggaattcctatgggtagaaaattagacctgtgggctcgccggagttagtgagacctgataaaaactcttgaacatatgtttaatacaaaccatcatctgggctgaggctgaggtgaatggagattatttcgaggaatatcatgtactaacatatgaagacaaggaacgggattggatgatggttggtgatgttccttggcagatgttcttgtcagttgtgaggagattgaagataagtagatcaagtgctgaactttgataaaaaaattgtttttcttttcta

SEQ ID NO: 9780 - DNA, 941 bp, Gossypium hirsutum
  Predicted polypeptide sequence is orthologous to G489, G714
cccatttagggttccaatttatgaacaaaatcaactgatccaaagctaaacaacgagcagcagcataagtttgtggttatggatcagcaaggccatgggcagacttcggccatgggcatagttggtagtgcagcggcagttccttatggtataaccggctatcaagcgaatcaaatgatgggaacctcgactcctggatcagtcggttcagtccaaccccctactcagcctgctggcccctctgcttcatcggcccagctggcacaacagcaactagcttatcagcatatccaccaacaacaacagcagcaattgcaacaacaactccagcgcttttgggcgaatcagtatcaagaaattgagcaggctacggattttaaaaaccatagcttaccgttggccaggattaagaagatcatgaaggcagatgaggatgttaggatgatatcagctgaagctccggtcgtgtttgctagggcctgtgaaatgttcattctcgagttgacactgaggtcgtggaatcacaccgaggaaaacaagaggaggacccttcagaagaatgacatcggagcagcaataacaaggaccgatatattcgattttctggttgatatcgtcccgagagaggatataaaagatgaggttctcgcatctgttccgagagttgaaggatcggctgatggtcttccttactattacatgccgcctcaacttgctccccaggctggtgctccgggtatgactgtaggtaagccgggtgatggatcccaccttttatggccaaaagtctggccctcatgccggtcagccggtatggccgccacagcagcagcagcaaccgcctccggattcataaatgtgatcttaatgtctacttaagagcttaaaggacagtgcaagtgaattaatcatcatatccgtagtatattaatatgtgattg

SEQ ID NO: 9781 - DNA, 906 bp, Gossypium hirsutum
  Predicted polypeptide sequence is orthologous to G519
cattaaattgttttacacctcacacacgttcaataacgacattcaaaaccgatcctagaccacacaattattcctttcccatttaggaaaatattcctccttatcattaaaaataaatgctgaatttaaaactgtgattatttttaatatttcagttaaattgatttttatttttcgtttatgcagttggacgattgggtgctttgccggatttataacaagaaaggcgccatcgagaaacagccaccgcaaggaagcattggcaaaagctctgctgtgacggagattgaagacaagaagccggatatagcgacacttggcgtggacacgcgccatctgcccccgcctcctacggggttagttaacgattacgtgtacttcgacacgtcggagtcggttcctagactccacacggactcaagctgttcggagcacgtggtgtcaccggagttcacgtgcgaggttcaaagcgagccgcaatggaaggactggggaagtgcgaccaacaccaccaccaccaatgcccttgacttcccttataattacatggatgccactgttgataacgggtttcctgcccatttccagagtaataatcagctgtccccgctccaggacatgttcatgtacctgcagaagccattttagacggggaaaaaataaaataaaaaggggttatattgttggaagtcaaaacggtgatggtgaactgcgtttcaggggttacacgagactgaaagtctatgagtgtaactgagaagggttgcgcatagattaaataacgaattgaaaaattgaaattgataatattgcagtaaggtagggggagctgttggatttttgcagatgggaatggatggacggtggaagttggatcttatgcaatctagaaaagtagagattaga

SEQ ID NO: 9782 - DNA, 981 bp, Gossypium hirsutum
  Predicted polypeptide sequence is orthologous to G519
agaccacccggtaccaacagccaacaacacaaagaaggcatatttacagcttttttaaagaggagcttaagaaagttaagtctaaaaaggaagaagagtttaaagagttcagagaatgaagggagagttagagttgccacctggtttcagattccatcctacagatgacgaattggtgaatcattatttgtgtaggaaatgtgcttctcagcctatttctgtgcccatcattgctgagattgatctttacaagtttgatccatggcagcttccagatatggcgttgtatggtgaaaaagagtggtatttcttttctccaagggatcgaaaatacccaaatgggtgtcggccgaacagggcggctggaaccggatattggaaagcgaccggagccgataagcctatcggaaagcccaaggcactgggcataaaaaaagcactcgttttctacgctggtaaagccccacgcggtgtcaaaaccaactggattatgcacgagtatcgcctcgccaatgttgataggtccgccggcaagagaagcaacaacttgaggcttgatgattgggtgttatgtcgaatatacaacaagaaaggaagcatagagaaacattttccgagtgaacaaaaatcgttaagttacccagaaatggaagatgagaaactgggcatcataatgaatggtcaaaacatgcaacaaccgtggtcggtgatggcgatgaagaacgatgcaatacaaacggatggttcggagtcgagttggtcggagcacgtgccgtcaccggaaatcacgtgggagaaagaagtgaaaagtgaagggagatggaatgagcttgatttcgggttggatttcatagatgaagacccgtttgccagtcaagttgattaccaaatggagcagctgtcaccgttgcagacatgttcatgtatctacccagacattttaagccaatgtagaccaaaatcctacaattgtggggtcca

SEQ ID NO: 9783 - DNA, 894 bp, Gossypium hirsutum
  Predicted polypeptide sequence is orthologous to G519
gagaggaaaaaaaaaaggggtcaggtatacctgaaaggttaaaaacgtcagaaaaaaaaatgactgcaacggagttacagttacggttacccgctggctttcggttccatccaacggatgaggaactggtgatgcactatctctgccgtaaatgtgcgtctcagtctatcgccgtccctattatcgccgaactcgatctttacaaatacgatccttgggatcttcctgatttggcgttgtacggtgagaaagagtggtatttcttttcaccgagagacaggaaatatccgaacggttcaaggccgaaccgtgcggccgggtctgggtactggaaggcaaccggagctgataagccgattgggcaaccgaaaccggtcggtattaaaaaggctttggtgttttactccgggaaagctccgaaaggagagaaaactaattggattatgcatgagtatcgattagccgacgtggaccggtcggttcgcaagaagaacagcctaaggttggacgattgggtgctgtgccggatttacaataagaaaggttgcatcgaaaaacaacctccgcgaggaagcgttacgaaaaaagctagcgtgacggagattgaggagagtaagccggataatgggacactaggcgtggaggcgtgtgaatttccgccggcagcgacggcggtgggtaacgattacgtatatttcgactcgtcggagtcggtcccgagggttcacacggactcgagctgttcggaacatgcggtgtctcgggaattcatgactgaggttcaaagcgttcccaaatggaaggaagaattgggaatggccaacaataatgccctggatttcgcttataattacttggataccaatatggatatcggatttgcttcacagatgc

SEQ ID NO: 9784 - DNA, 869 bp, Gossypium hirsutum
  Predicted polypeptide sequence is orthologous to G559
gtcgttgacaacgactgctccaaattctggtccatcggctgcggtgagtatgggagcagggacggcaacgtccggtgaggaaaatgcgagtgttggtgttgggtcttctgagaagcctagaattaggcaccaacatagccagtcgatggatgggtcgacaagtattaagcccgaaatgctcctctctggttcggatgaggttacgcctgctgattctaagaaagcaatgtccgctgctaagcttgctgagcttgctcttattgatcccaagcgtgctaagaggatctgggcgaataggcagtctgctgcgaggtcaaaggaaagaaagatgcggtatatagctgagcttgaacggaaaatacagacattgcaaacagaagcaacgtcgcttgctgctcagctgactctactacagagagactccagtggtatgagtgctgaaaatagtgagttgaaactgcggttacaaacaatggagcaacaggtttacttgcaagattcattgaacgatgcactgaaagaagaaatccaacatctgaaggtgctgactgcccaacctatgccaaatggtggaccaatgatgaactttgcatcttttggagctagtcagcaatacatcccaaataatcatgctatgcaggctcttctaacggcccagcagttccagcaactacagattcaattgcaaaagcatcagcatcagttcccaccgcatcaactgcatcaacttcagcagcaacttcagctgcaacaagagctccaacagcaagcaggggagatgagagttagaggatccatgccttcccccaaccgaagagatggtccatcttcatcagatgtcagctcaacggcatcaaatgattgaggag

SEQ ID NO: 9785 - DNA, 840 bp, Gossypium hirsutum
  Predicted polypeptide sequence is orthologous to G562
gtggatgttgtcttccctttggcactccctctcttttttcttctcccacaccctcctcctcctcctgcatctctctcttattctccgcgaattttaaaagaaaagaattcccgatatttttcagtgaagaagataatgcagtctttttgacgaatatttcttttcaaattctcttctctacttctcttttccctaattgaagataatctaatattgatttgtattattgttttccagccaagagaaggaagaatctcgggtttcagattttaagttgacagagagaggtgaaccaacttctataaaaggtttcacctttggtgctttgaccatgggaaacaacgaggaagggaagtcttctaagtctgacaaatcatcttcaccagtgccaacggatcagaacaatattcatgtctatcctgattgggctgctatgcaggcatattatggtcctcatgtcaatatgccaccgtattacagttcagctgtggcatcaggccatgctcctcccccctatatgtggggtccaacacagcctatgatgccatcctatggagcaccttatgcagcaatctactctcatgggggagtttatgcacatcccgcagttcctctggcatcacacagtcttggtgttccatcatcaccggcagctgcaggtcctgtggagacacctacgaagtcccctggaaatactgaacaaggtttaatgaagaagctgaaaggatttgatggtcttgcaatatcaataggcaatggtactgctgagaatgctgaaggaagagctaaacctagaccatcccacagtgtggagactgcagttcagctgatggtagtgat

SEQ ID NO: 9786 - DNA, 884 bp, Gossypium hirsutum
  misc_feature (879)..(879): n is a, c, g, or t
  Predicted polypeptide sequence is orthologous to G562
tctttctccgtctctgcgaatttgaaaaaagaaatcctaaaattttctctttgtttttcagtgaagataatgcggtctttttgagtattttgttttacaatatctctttctgctccttttttttcccaattgagagttattaatttcacgctgtaaagctgctgagagaagggaggtttctagatttggattttcgagttgactgagagacgtgaaggacattctagaaaataggttttccgctttagtgcttggtaatgggaaacaacgatgaaggaaagtctaagtctgacaagtcatcttcaccagtgccaacggatcaggccaatattcatgtctatcccgattgggctgctatgcaggcatactatggtcctcgagtcactatgccgccatattacaactcagctgtggcctctggccatgctcctcccccttatatgtggggtcctccacagcctatgatgccaccttatggggcaccttatgcaacaatctactcacatgggggagtttatgcccatcctgcagttcctataactgcagcccctgtggaagctcctactaagtcatcaggaactacagaacgagggtccaacaagaagatgaaagggtttgatggcctgctatgtcatacgcactgcgtcctgccacacatgatgaggtggaggtgaactttactgtccaaatgttgagatgacgtccatgcgggttgatggatacactggcacgccagtggcgaccaacaggggaacaagcgttcgatgttaatggagcatgagcagaagggaacaacccaacagagagtgtcagacacggaggaaccgtatctctcggtgtatcctacgagaactctggacatacacacaaggaagagangagac

SEQ ID NO: 9787 - DNA, 992 bp, Gossypium hirsutum
  Predicted polypeptide sequence is orthologous to G567
aatggtagaacgacaagaaaaacaagaccaaacgcaaattgcaaatcgccgaggaaagaagatttcactgaaaacgatgaatagcgtgttctcagttgacgatttctccgaccctttttgggtggcttctgctacaggcgctgcggcggggatgagccgaagccaatcggagtgggcgttagagaagtttctagaagaattttctggtgctggtgcggcgatccaggggtcacgtgcgggtgagaatgtgattggtacgtctttggcggcacctcaagcgccggtttcgaaatctgaaaatggtgacggggatggtggcgcggtggaggtaaaaaagcctaataatcttaatcctccgccgtccgattcgacaccgacggtaccgattgacgcggatgagtaccgcgcgatccttaagaacaagctccatcaagcctgcgctgctgttgctctctctcgtgcgtcggctgtgaaggcagaaggttcgtctgcgcaagctgaaaatcaagcgcttcagtcgggatcctatgttcaaggttcctcaaagacacaggaacagggtgaacctgatgctggtatttcggctgtttcaactacacaaaaaaaatcagggacacaaatgaggcaagccacaagtgggtcatcaagagaagattcagatgatggtgaacttgaaggagatactgaaaccaccgaaaacatggatccggctgatgcaaagcgtgctaggagaatgcggtcaaatcgagaatcagccagacgctctagaagaagaaagcaagcacaaatgaatgaacttgaaacacagttggtcaattaagagctgagcattcctcattacttaagcgtctaactgacatgaatcacaagtatgatgaagctgccgttgacaatagaattctgacgctgatattgagacattaagagcaaagtaagcaagccatcatccttgtccaagttgcattttcttatcctggtagagttactctgca

SEQ ID NO: 9788 - DNA, 952 bp, Gossypium hirsutum
  Predicted polypeptide sequence is orthologous to G567
tctcagttgacgatttctcggactccttttgggcggctccgccggggatgagccgaagccaatcggagtgggcttttgacaattttattgaagagttttctggttcgggcggggcgatcccagtgtcgcgttcgggcgagagtgtgatcggtccatccttggcggaacctcggccgtccgtttcgaaatctgaagaagccgatggtgaaggtgacgtggtggagatcaaaagacctggtaatcagaatcataacagtccgccgtccgatctggcaccgacgttctcgattgactcggatgagtaccgcgcgatcctcaaggacaagctccatcaagcctgcgcagctgttgctctctctcgcatcatctgtgaaggcagaagttttctctgcgcaagctgaagatcaagcgcttcaatcgagatcccaagttcaaggttcctcaaaggctcaaggacagggtgaactagatgctacacctagtgaagtcttggctatgtctactacacagacaaaatcaaaggtacaaatgaggcaaacaacaagtgtgtcatcaggagaagattcagatgatgatgaacttagagatactgaaactactgataacatggatccggctgatgcaaaacgtgcaaggagaatgcggtcaaatcgagaatcagctagacgctcaaggagaagaaagcaagcacatatgaatgaacttgaaacgcaggttggccaactaagagttgaacattctacattactcaagagtctcactgacacgaatcacaagtatgatgaagctgctgtggacaatcgaattctgaaggctgatattgaaacattaagagcaaaggtaaaccatcagcatcagttcgtcatcatcaccattgcctaagttgccttttcttactttggtccagttattcttcagttagtttggcttatggttcctgctgaaagttcaa

SEQ ID NO: 9789 - DNA, 851 bp, Gossypium hirsutum
  misc_feature (41)..(41): n is a, c, g, or t
  Predicted polypeptide sequence is orthologous to G568
gcggccgcctctactttttttttgctaaaagtgaataacanatgaatctcgttttaataaatggtaggtcaactatatatttacaattcaacagaaaagaatggatgtgattcttgcatgaatgatccaaaatacaaataaaatatctctcgaaaaaaaatgttacaattattctacacttgtatacagtctacaacaaggcaataattatagttgttctaagagagaaatagaattcagtctttcttgaaatgccataaatgagaccatggaagggtcgctttgatgcattaagtagaaagaagatatgtgattagagggtatcaacgaactacttctcccaacttcaaaacctcagtgcaccctccctcgcttccgggaagtggcagattccagttctattcccatctccagttctctctctatccaggcttcactgtctacctcgtcatctctaactttcgttcgcttcaaatttgcagccctatcgcatctcctcctcttaaagatctctcgaatccggtcggcgtcgctcttactgaaagtattacaaattgatacaatcttaatacttgggtttagatgatgagattcctctgttcttagctcacaatcgccttcagcattgtcgacaacagtacttgcaccactatcactggtttgacttggtaaactttcttttgcacttgcttgcttgttgtcacaggcaacggatgaaacaatattcaaactttggttctggtcagattcctctgttcttggctgacccgtaccactgccatcctcaacaccaccacttgcgccatcatcacttgttcgatgtgggaaaactctttcacacaatcttggct

SEQ ID NO: 9790 - DNA, 1005 bp, Gossypium hirsutum
  Predicted polypeptide sequence is orthologous to G591, G793
aaaaaaggaagaggaaagccaaaactccaaactttctattttgcttttatattatatttttttttggttcaattcagtttcgccatttcctttgcatgtagatgctctttggttagtctctaacgccgctacttggactcactttccgctgctatctttttttcggctttctcatggctaataacaccaacgaggcccccgccgccgatgatttcctcgagcaaatcctcggcctccctaactttgcgccctctgaaacgggcttagctggatccgacgctggattggctgcaaccgctcctggagctggagctccaatgtttttgcagctcagctccggtgatggcgccgctcatatcggcggaatcggcggcggtggaggcggtgcgtttcatgggcaggttttccccttgggcttgagcttggagcaagggaaaggcgggtttttgaaacccgaggaagcttccggtagtgggaagcggtttcggaacggggtcgttgatgaccgggcttcttctgtaaaaaatgttttccatggccaacctatgcaagcaactgtttctgcagcaccacatccaccgacaatgcgtccaagggtgcgcgctagacgaggacaggccacggatcctcacagcattgctgaacggttgcgcagggagagaattactgaaagaatcagggcattgcaggaacttgttcctagtgtcaacaagactgatagggcagtcatgcttgatgaaattgtagattatgtcaagttcctgaggctccaagttaaggttttgagcatgagtaggttgggcggagctggtgcagtggcaccgcttgtaacagacattccactatcatcagtagagtatgaaagcggtgagggtggaagaagccagccagcatgggagaagtggtcaaatgatggcacagagcaacagtagctagctgatggagaaacgttggagctgccatgcatcctccaatcaaagtctctttgcattatgcctatctcac

SEQ ID NO: 9791 - DNA, 920 bp, Gossypium hirsutum
  Predicted polypeptide sequence is orthologous to G591, G793
ttgaaaaaaaaaattccctcttttcctttctgttactttcacagagctgaaagtacagaacagaaaagaaaccccaaacctcaaaattttctctttctcacgttgatagaaggatttaagctagaacggcaaagatatgaaataatatcgtgttttttgtctataaatattttgttgggttttcaattcttttttcgccatttcttttgcatgttgatgatctttggtggctttaactcggtacttggactcacttccgctactacttcttcgggtttcacatggctaataaccccaacgaggcttccgctgatgatttcctcgagcaaatcctcggattccctaacttcgcgccttctgagacgggtttggcgggacccgacggtggactgacaggaacaactgctggtgccggaacgccaatgtttctacagctcagctctggtgatggagccagtcatctcggcggaatcggcggcggtggaggcggcgcgtttcccggacaggtttttccgttggggttgagcttagaccaagggaaaagcggcgggttcttgaagccggaggaaggttctggtggtagcagcaggcggtttcgcgatgaagtcgttgatggcagggcttcctcagttaaaaacgttttccatggttcaccaatgccggctaccgttgctccatcaccgcatccaccaacaatgcgtccaagggtgcgggctagacgaggacaggccacggacccgcatagcattgctgaacggttgcggagggaaagaattgccgaaagaatccgagcattacaggaacttgttcctagtgttaacaagactgatagagcggtcatgcttgatgaaattgtagattatgtcaagttcctgaggctccaagttacgttttgagtatgagtagtagcggggcggggc

SEQ ID NO: 9792 - DNA, 1004 bp, Gossypium hirsutum
  Predicted polypeptide sequence is orthologous to G591, G793
gtttctctttcagaaaaaggaaagttcaagctaagctaaaactctgaactttccccttctcagtctcctcagggacggagaaagattaaacgaaaggaaaagaaaaagacttcttctttttttccctaaaagaaaagttgatctttttttgtttggttcgattctctttagccatttcctttttgcatgtagatgctctttggtagccttaactcgccacttcgactcacttcaatccatggctaataaccccaacgagtcccccgctgatgatttcctcgagcaaatcctcggactctcccactttgcgcctactgagactggcttagcggggcccgacggtagattgtctggaaacgccacgacggctggagcgccaatgcttctgcagctcagctccggcggtggcaccggacacatcggcgctataggcggcggtggaggcggtgcgtttcacggacaggtttttccattgggattgagcttggagcaaggaaaaggtgggtttttgaagcccgaggaagcatccggtagcagcaagcgcttccgcaacgaggtcgttgatggcagagctttttctgttaaaaacgttttccatggacaaccagtgccagctactgttgctgctggaccacatccaccagcaatgcatccgagggtgagggctagacgaggacaggccacagatccacatagcattgctgagcggttgcgcagggagagaattgccgaaagaatccgggcattgcaggaacttgttcctagtgttaacaagactgatagagcagccatgcttgatgaaattgtagattatgtgaagttcctgaggctccaagttaacgtcttgagcatgagtaggttgggcgcagctggtgcagtggcaccactcgtaacggacctcccactatcgtcagttgagatgaagtggtgagggaggagagccaccagcctgggagaaatggtcaatgatggcacagagagacagtagctagctgatgggagga

SEQ ID NO: 9793 - DNA, 792 bp, Gossypium hirsutum
  Predicted polypeptide sequence is orthologous to G634
gcaaaagattactggccagaccatacaattacccactaccgcaactgttattgtacccgcacctgcaccaccaccaccacctccaccgacacaaccgaccgtctccgttgttccaccagaggtccctattgctccaccatcgcatcaaacaccgtcattaacacaacaaaagcaacaagaacaacaacagacgcatatatctcaccatcaaccaccaccaccacaacagcagccacaagttgttcaacagcagcagcagcttcacaatatggaacttgtgaggcatcaacaacagcccattactacagaaatagtaatggcaatcccggaacaacaggtcccaccacaagagattagtgggagtgggagcttggtggagccagcctcgtctagatggcctaaagctgaagttcttacacttataaacctgaggagtgggcttgaatccaggtaccaagaagctgggcctaaaggtcctctttgggaagaaatctctgctggtatgtccaggttgggttacaagcgaagcgccaaacgatgtaaggaaaagtgggagaacatcaacaagtacttcaaaaaggtcaaagaaagcaacaaaaaacgtcccgaagatgccaaaacttgtccctattttcaccagctcgatgccctttaccgtaagaaaatacttggtggtgggactagcagtggcagctttagtgaccataatagacccgatgaagaaacgtcacggcagcatcatgaccccacactaagcacggcagcaccgcaaccatcccaaaacgaaccgga

SEQ ID NO: 9794 - DNA, 622 bp, Gossypium hirsutum
  misc_feature (281)..(281): n is a, c, g, or t
  misc_feature (369)..(369): n is a, c, g, or t
  misc_feature (424)..(424): n is a, c, g, or t
  Predicted polypeptide sequence is orthologous to G653
ccttcttcaacaccaatctcctctctctctctctctctctctattttgtttgataaatacccagaaaaccccttcagtcttctagctctcaatttctttttattttttaccttcttatttcatagatccagggtgctcttcttcttagttcacattggcatagataaaggaccgtacggtcagatctaagccgtattctagcgatgtcgtttaccggtactcagcagaaatgcaaggcttgtcagaagaccgtttatcctgtcgaacttttgtcggctgtngggatcccttaccataagtcttgcttcaaatgcagtcattgcaaagggacactaaagttgggtaattactcctcgatgaaggtgtcgnttattgcaagcctcatttcagcaactattcaagagtcgggggaattcaacagatnttcagtcactgccaagtcagctgagagttaactccgagctgcaagatcacctacaagctgcagcatgttttcgggacacaagaaatgcgctactgtgaaaactgttatcactcagaggtacgtggaggcgtcgacacagtatgttcaatgcttatgtgctgccatactcataattgcgactgaagcatgatgaactcc

SEQ ID NO: 9795 - DNA, 848 bp, Gossypium hirsutum
  Predicted polypeptide sequence is orthologous to G653
catagatccaggccttcttcttcttcttcttcttctatcaaagttaatataggcaaatataagagaagaaatcgaattaaagtctatctgtggaactagataaagaacagtacgatttgttttgatccaaagcacattcgagccatgtcgtttattggtacccaacagaaatgcaaggcttgtgagaagactgtttatccagttgaacttttgtctgcagatggagttccttaccataaatcttgctccaagtgcagtcattgcaaagggacactaaagttggctaattactcctcaatggaaggtgttctttactgcaagcctcatttcgagcaactcttcaaggagacgggtaacttcaacaaggatttccaattgtctgcaaaggcagctgagaagttaactcccgagatgacgagatcaccaagcaaagctgccagcatgttttctgggacagtcgaaaaatgtgctacttgtggcaaaactgcatatccacttgagaaggtaacagtagaaggacagtcttacctcaaatcatgtttcaagtgctctcatggtggctgctctttgagtccatcaaattatgcagcacttgaaggcattttgtactgcaaacatcacttttcccagctcttcaaggagaaaggaagctacaatcatcttatcaaatccgcatcaatcaagcgtgccgctgcatccgttcctgaagcttgaatacctatttcatgttcttcgtctattcccatgtttgccggtgcgttttcgtattgatttcttggatttatgctcgggaggggaactggaaagaaagaactcgggtttctctccgtttgtttgaggctttggta

SEQ ID NO: 9796 - DNA, 713 bp, Gossypium hirsutum
  Predicted polypeptide sequence is orthologous to G653
ataattctcattatctatttcttctctaattccttagaacacccttttgactcttttacagggttgtgaactttctctttaatttgatttcatttttttgttaatcttatttcatagatccaatacttccttctttcaaagtattaaacaacaaaatattgaattgaagctctagatctaaagcatatattggagccatgtcttttattggtacccaacaaaaatgcaaggcgtgcgaaaagactgtttacccagtggaacttgtatcagtagatggggttcctttccataaatcttgcttcaaatgcagccattgcaaagggacattaaagtggggtaattattcatcaatggaaggtgttctttattgcaagcctcatttcgagcagctattcaaggaggcgggtaactacaacaagaattttcagtcacctgccaagtcagccgagaagttaactcaactgacaagatcgcctagcaaagcggctggcatgttttccgggacacaagacaaatgtgctacctgtgggaaaactgcttatccactcgagaaggtcacagtggaaggtcaatcttaccacaaatcatgtttcaagtgctctcatggtggttgacctataagccttcaaattttgcagcacttgagggcattttgtattgtaagcatcacttttccaagcttttccaacagaaaggaagttacaacctttgac

SEQ ID NO: 9797 - DNA, 1290 bp, Gossypium hirsutum
  Predicted polypeptide sequence is orthologous to G666
gaaaacttgctgtcatctttttgactctttggggagggagttggaacttggataccacccttttttcctctttttaagtcagcatcctcactgtcttacactttgatttctatatatgtaatgctgcaacatcaaatcctttgtcttactcttagactcgtcttaaagctcccaccaacataaactaaaccctaaaaacacaagaaatcaactgcagttttgataatgggaagacaaccttgttgtgacaaagttggtgtcaagaaagggccatggactcctgaagaagatctcatcttggtgtcttatattcaacaacatggtcctgggaattggagggctgttcccaccaaaacaggtttgcttagatgtagtaagagttgcaggcttaggtgggctaattacttaaggcctgggattagaaggggtaacttcacagaaaatgaagagaaaatgataatccaccttcaagccctcttaggcaacagatgggctgcaatagcatcttacctccctgaaagaacagacaatgacattaaaaattattggaacactcatttgaagaggaagctgaagaagctacaaggcaatgaaagttcttctagatacgggtttccatcatcatcatcgtcataccagatttgtagaggtcagtgggagagaaagttgcagacagatatccatatggctaaaaaggatttatctgacgcattatcacctgagaaatcaagtgacttagttgaaatgaaaccctttaatgaccacacatcttatccaaaaccaagtggatatgcttcaagcactgaaaacatagctaagttgttgaaagggtggatgagaaataatccatggaaaatggctgattctgcagattatagtgaagaagggactgttccaatgaaggaagacaagaacagcaaggaaatggcagaggcatttcaatcacatttagggtttgaatctttagattcttcactttctgatatctcaccatctatgtcacctgagacaagcctttcacaatatgaaagtaagccacacctcaatgctcaaagccaactttcactgcttgagaaatggctttttgatgaaggcaaggattaccaactttgtgacattacattagaccaaaatcttcattttttctaaaaggtagaggggaaagttctttgttttaagggcttctttggggtacttttcatcttggattataagtttttctaggttgaggtttcctagagtgaaacaaattcaatgtataaatttaacattattgttgcaaaaaaaaaa

SEQ ID NO: 9798 - DNA, 669 bp, Gossypium hirsutum
  Predicted polypeptide sequence is orthologous to G675
ggtaaaagtcataaaatgaccccagaaaccctttaatccttttatacccctgggataccagaaaccccttttggaaccctggaaaaccctgaaaccaaaccctaggggcttatgtgcaaaattagcccacttttgggttaaagtgcaaaaaccaagccaaataagtattttaagtcaattggttcacaaatatgtggacttgaaagccaaaccctaagttttggacttaaatgcaaaatggacctcatttgagttctatactaagtctgaaatttagtgttgaaggctccactttggggctttgtaactttcaaagcatagggtttttgccctaggtcaccacatcaaggttgaagaccaatcataggagaacaactttgtttaagggttcaagccatgatcctatgagaaatttggagaaaaacccaatcaaagtttgactgtcaggctagtttcattctgaaattcagaacttcagtgaaaccgagctagttttggacttggatttaaacatgatccaatgcaagtttgggtatgattcccataacaactttgtagatggcatattgctctacaaatttgctgcatagtgtggatcacgttgccatagaaaatcgggagagaatgaagctccattatgctctgtcagtccgctctgaatggggtgtt

SEQ ID NO: 9799 - DNA, 944 bp, Gossypium hirsutum
  Predicted polypeptide sequence is orthologous to G707
tcagtttggcccttgttgaaaccttgatggactcgaatcgttggtcggagatgtttccatgtatgattgccagaacatcaacgactgatgtgatatctagtggtgtgggaggaaccaggaacggtgcacttcaactgatgcatgctgagctccaagtcctttctcctttggttccagttcgcgaggttaatttcctaaggttctgcaagcaacacgcagaaggggtttgggctgtggtcgatgtgtccattgagaccatccgagaaacttcgggtgcaccctcatttgtgaactgcaggaggcttccttctggctgtgttgtgcaagatatgcccaatggctactccaaggtgacatgggtggaacatgcagaatatgaggagagccaagttcaccaactctaccacccattgctaagatcggggatggccttcggtgcccaacgctgggtggccaccctacagcgccaatgcgaatgccttgctatccttatgtcctcctctgttcccactagggatcatacagggataactgcaagtgggagacgaagcatgctaaagctagcccaacgaatgacggataatttctgtgctggggtgtgtgcctccacggttcataaatggaacaagctgaacgtagggaacgtggatgaggacgttagggtaatgacccgaaagagcgttgacgaccccggtgagccaccgggcatcgtgttgagcgcggctacttcagtttggttgccagtgtcacctcaaagactgtttgatttcctgcgtgatgaacggctgagaagcgagtgggacatcttgtccaacggtggtcccatgcaagagatggcccacatcgccaaggccaagatcacggcaactgcgtctccctctctccgtgccagcgccatgaacgcaaaccagagcagcatgctgatactgcacgagacatgcatc

SEQ ID NO: 9800 - DNA, 971 bp, Gossypium hirsutum
  Predicted polypeptide sequence is orthologous to G707
ctcgaatcgttgggcagagatgtttcattgtatgattgctagaacatcaacaactgatgtgatatctaatggcatgggaggaaccagaaatggtgcacttcaacttatgaatgctgagcttcaaattctttcacctttagttcctgttcgtgaagtaagtttcttaaggttctgtaaacaacatgctgaaggtgtttgggctgtcgttgatgtgtccattgatactatcaaagaaagtactacatttgttacctgtaggagacttccttctggttgtgttgttcaagatatgcctaatggttactccaaggttatatgcgttgaacatgctgaatatgatgagagccaagttcatcaactataccggcctttactaagttccggcatgggcttcggtgcccaacggtgggtggcgacccttcaacggcaatgcgaatgccttgccatactcatgtcctccaccgttcccactagagaccacaccgctataactgcaagtgggagacggagcatgttgaagctagctcaacggatgacagataacttctgtgccggggtttgtgcatcgacggttcataaatggaacaagcctaatgctgggaatgtagacgaagacgttagggttatgactaggaaaagcattgacgaccccggcgaaccgccagggatcgtactaagtgccgccacttcggtttggttgccggtgtcaccacaacggctttttgatttcctacgcgacgaacggttgaggagtgagtgggatatattgtcgaatggcggacctatgcaagagatggcacacattgccaaaggccaagatcatggcaattgcgtttccctcctgcgtgccagtgccatgaacgcaaatcagagcagcatgctgatattgcacgaaacatgcatagacgcagcacgtcgcttgtagtgtacgcgccagttgatattccagccatgcacgttgtcatgaacgg

SEQ ID NO: 9801 - DNA, 3023 bp, Gossypium hirsutum
  Predicted polypeptide sequence is orthologous to G707
aaagacatgtcaattgggttttctttttaacgctttgatactgtgaatgtgaaagagaagaaagctttttccttgggttttgtgttttgattatggtttttccatgacatctttttgacttctcttttagttttttttataataaaatatatcgttgatgtccttttcaagcaattggtcaaacatgcagttacaaagattagggtttttcatatttatcagtctttccatggcgttttcagggatttttccagtctgggtttaggcaaaaggatttggtttttcttttttctttatcccctaaaaggtgtgacctttttttccctttaataaaccctgagaatagtgtgttgagtgagtcttgcatgggcgttgacaatagaacagcctttcttcattctaaaagaatggctagtcatggtgagctgaggctgattggagaaaactatgatcctggttttattgggatgatgaaggaagatgatggttatgggagtagtgatgattttgaaggtgcgttaggtaatgatcaagatactgctgataatggaagaccacctaagaagaagaagaaattccataggcacaatccacatcaaatacatgagcttgaatctttcttcaaagagtgtcctcaccctgatgaaaaacaaagaagggaacttagtaggaggctagccctagagagcaagcaaataaaattttggtttcaaaacaggagaacccaaatgaagactcaattggagcgccatgaaaatgtatttcttaaacaagaaaacgacaagcttcgagccgagaatgatttgttgaggcaggccatagctagtgccatatgcaacaattgtggggttcccgcagtgcctgatgaaatctcttatgaacctagccagcttatgatcgaaaattctcgattaaaagacgaactgaaccgggcacgtgctttaacaaacaagttcttgggcaggcatttgtcctcctcctccgccaaccctagtccttctccttctcagggcttaaattccaatgtggaggttgtagtaagaagaactggtttttgtggattgaacaatggaagcatttctttgcctatgggatttgagtttggtcatggggctacgatgccattaatgaacccttcttttgcgtatgaaatgccatatgacaagtcagccttggtggatgttgcattagcagctatggatgaattaattaagatggcacagatgggtaatcccctttggatcaaaggctttggtgatgggatggaaaccttaaatctagaggagtataagaggactttctcctctttcattggcatgaaaccaagtggattcacaactgaggctactagggaaactgccatggttccccttcgcggcttggccctcgttgatacactaatggatgcgaatcgttgggcagaaatgtttccctgcatgatttcaagagcagtaaccattgatgtgctatcaagtggtaaaggtgtaaccagagacaatgcattgcaattgatggaagctgaatttcaagttctttcacctttggttcctattcgtcaagttcaattcatccggttctgcaagcagcattccgacagtgtgtgggccatcgttgatgtttctattaatctgagcaatgctgcaaatgcactgatgtttgcaaattgcaggaggcttccttctggatgtgttatccaagatatggacaacaagtactccaaggttacatgggttgaacactcggaatatgatgagagcacagtccaccatctctttcgccccttactcagttctggttttggctttggtgcacaaaggtggattgccactctccgaagacagtacagcagcttggcacaactaatgtcccctgacatccacggtgaagacattaatacagtggggaagaaaagcatgttaaagcttgcacagcgcatggcatacaacttcagtgctggaattggtgcttcaagtgtgaataaatgggacaaacttaatgttggtaatgtgggtgaagatgtaagggtgatgactcggaagaatgtaaatgatcctggtgagcctctagggattgttttgagtgctgctacttctgtttggatgccgataacacagcaaacgctgtttggtttcttgaggaacgaacggatgcgtaatcaatgggacattttgtctagtggtagaccaatgcaggcgatgttcagtgtcgccaagggtccaggacaaggcaactgtgtctctatccttcgtggtgctgcagttaacggcagtgacaccaacatgctaattttacgagaaacatggagcgatgcttgtggtgcattgatagtgtatgcacctgttgacgcctcatcaatcagagtggtgatgaatggtggtgattcatcgcatgtggcactgttaccatcaggatttgcaattcttcctggcgtccaaactgatggaccttcaatgcaacctgacatcgatgagaatactagtgatggatgcatacttacagtggggtttcagattttggtgaacagcgttccgactgccaagctaacagtggaatctgttgaaactgttaaccatctcctaacctgcacagttgagaaaatcaaagctgccctttcggtaacacagctgggatctgttgagtaaaagtcacagctaaaagtttattaaataagtacagaatggaaagaaaatggaggggtttcaagtcaagaacgaaccgcttgtggagaagcaatgcttcatattcatgcttggttttgggcgttcggggattattattctggttcgggcattgacttggtggacctgtgagattctcagctcttcatttctcagttggcgaactttttttttgtttgtttgtttaatttagtcagtcatgtttaaaagacaaaatatagatacagcaagcctcgtctttttacttgttcttaaacataaagttaccattaaagtttgtattatttacatgcttaccacaagtgaattagttaaccgtaataaatttctaaaacaggttcattt

SEQ ID NO: 9802 - DNA, 870 bp, Gossypium hirsutum
  Predicted polypeptide sequence is orthologous to G732
gcggccgcgtcgaccgcaggacccatctcgttcaatctttctcagttgtcttcctctactggttctatgttttttcataaatgacatgcttattttttttactatatatatatatataattatctgttgctagtataggtgtccagtcgcctttgaggttagattatcctgaaatattagtaatttatatttgaagttttagcagtgagtttggtgtaaaaatattaacatggcctcgtccagtggaaactccaattcctcaagctcctcgcagcttcagaactctgggtctgaagaggacctgcaccagcagaacatgatggaccaaagaaaaagaaagagaaaggaatcaaacagggaatcggcaagaagatccaggatgaggaaacagcagcacttggatgaattagtggcccaagtggctcagctcagcaaagataacaaccaaatcctgaacagcatcaacttcaccacccaccactatctcaacattcaggctgagaactcagttctgagggctcagatgatggaactgagtcaaagactcgactatctgaatcaaatcctcagttatctcaacaccatgagcgccagtgagttggtgtacgaaactgatcagtgctttgaaacaagtacttgtgaccacggtttcaccaaccctttcaatctaccttaccttaaccaacccatcatggcctctccagacatgttccagtactactgatccataataatcctcaccatcatcatccctcatttactgataaaacgagggtattaatattattgttatggttaattaatttaatgaaatattagtgttattggcagctataggtctaggaagatgatgtaaagggatgatgattg

SEQ ID NO: 9803 - DNA, 692 bp, Gossypium hirsutum
  Predicted polypeptide sequence is orthologous to G732
cccccttatagagtttagtcaatttctgctctcttcctgtttttcattttcccttgtagagctaacgttctgctggtttcggttcactaattttttcagctgtgtttctttcaaatcgttttgatatgtttttcaaatcgttttgagattcatgtctccagttgtgagtgaaatcctccgatcggggtttatgataaattcctcactcagacgcaggacccatcttgttcaatctttctcagttgtcttcctccactggttctatgtttttcataaataaattctctgtaattgcttgactttcatttcctttacataataaacccaatatataagaaaacgttgcattagctacacgtagttagtatctgggtcctgtcgtcgtctttctatcagtgattttagtgtacatacatcaacatggcatcgtccagtgggaattccaattcttcaggttcgactctgcttcagatttcaggctccgaagaggatctgcatcagttgatggaagaaaggaaaagaaagaggatggaatcaaacagggaatcagcaagaagatccaggatgagaaaacagaagtatctggatgatttaatggctcaactcacactcctaaggaaagataataatcaaatcttaacaagcatcaatttcatcacccatcattacttcaacattgaagctgagaactc

SEQ ID NO: 9804 - DNA, 255 bp, Gossypium hirsutum
  Predicted polypeptide sequence is orthologous to G881
gtggatactacgctggacctcaacatcaatcctttccatcaccggaacaaagctctgaggaccgaatctgagggagaaatggctgactctgatgtgaagctacccttcaaacaagagaatgcagttttggtggaggaattgaatcggattaaagctgagaacaagaagctaactgagatgttaacagttttgggtcactgctacaacgatttgcagaacaagttcatggaattagtgaccattaactctgaaaat

SEQ ID NO: 9805 - DNA, 863 bp, Gossypium hirsutum
  Predicted polypeptide sequence is orthologous to G881
gcggccgcgctcgacaaaacctttcactctctcttcctcatcgtttcttcagagcttcagctccatcgcctgcctctttgcttcttcttttcttgttctatagtgtaatttcggtgatggaatcggcttgggtggatacgactctcgacctcaacatcaatccttcccataataccatcaaagttctgaagagagaatccagtggaaaactggctgattctgatgtgaaagtaccagttaaacaagagaccggagctttgttggaggaattgaaccggattagcgctgagaacaagaagctaactgagatgctaacagttttatgcgagcgctacagctctttgcagaaccaatacatggaattggtgagcaggaactcgggaagtgatgcaacagctgcaacatcaaaaaagagaaaagccgagtgtgaggattatgccaccatgattggattcagtggaaaagctgagagcagctgcagtgatgaagactcgtgcaaaaagcctaaggactgcatcaaagcaaaaatttcaagggcttacgtgcgcacaaatccttctgataacagcctgattgtgagagatggatatcaatggagaaaatatggtcaaaaggttacaagagataatccctctccgagggcatacttcaagtgctccttcgccccaagttgtcccgtcaagaaaaaggtgcaaagaagtgctgaagatccatcaatcttggttgctacttatgaaggagagcacaaccatgaacaacactctccaccagcattatcatcattaagccccaacagtggtaccagtaaccctcgttcagctcctgtttcttctttctcttctgccccccgccaatcttcacct

SEQ ID NO: 9806 - DNA, 793 bp, Gossypium hirsutum
  misc_feature (785)..(785): n is a, c, g, or t
  Predicted polypeptide sequence is orthologous to G881
gcttggtaccgagctcggatccactagtaacggccgccagtgtgctggaattcgccctttcgagcggccgcccgggcaggtacacatacacaccttaacctaatgctttaaagaaatgttattttagtttgttggtggtttagggtgctcagtaatggagctgagcgacagcatgcggctaaagctagagtgaagctaggatcttttgctaaggatgctgcaacatggtcttccattgatctcttgttgttataatcgtcatcgttgccgatgccgcagctgttttcgcttgaaagattgagatcaagagcgatggcggatcgtaacgggttatcaagaactgaattgggaaaaccggagatggatgtcgtggcggagctggtgggggaagacaaagattgtcctattgaaggattaacttcatggttgagtcgtccttcgtatgttgccatcaagaaattcttgtcttccatgcatcgctgaaccttctttttgacagggcatgcgggagccattgaacacctaaaataagctcggggaaaaggattatgtttagtaactttctggccatatttcctccattgaaatccatctttaactatatggctctagtgcctagggtcagtttccacaaaaacttgtgaggaatttgctgctaactgaagttgaggtattagaatatttttgtgggagtgctgatcttcgcacatatcacatcgcgttaagcctaggcagatatgtgtacctcggccgcgaccacgcttagggcgaattctgcagatatncatcacat

SEQ ID NO: 9807 - DNA, 410 bp, Gossypium hirsutum
  Predicted polypeptide sequence is orthologous to G896
cgcaatgcgttccaacattcgtcatgtgccttagagcggatttgttacctctcttctcacaatgctcttaacaggcggcagcctcggtggcagatcaagaccggagccacagttaacagccaccgagccatttgatgtgtataataaacctttttccttgtaattggtaaacatgtgcgcggcatgcttttcattcttttgacgaagcctaagcccgagctttgtacagtttttgagggacaaaaagaaaaaggaaataaattcatcttctatttatcataaataattttattatttaggcgaatgttgatgcgactgacactgacatgaatgtgttggacacggttattggacataaatcttttaaagaaaataaagagcacggttaattttaaagtcgacgcggccgc

SEQ ID NO: 9808 - DNA, 949 bp, Gossypium hirsutum
  Predicted polypeptide sequence is orthologous to G896
ctttcaacatcatcaacacccatgttaatgcaggtcaactgttctaattgccacgcgccactgcacctcccgccggctgcaaactccatatgctgcgtcctctgccaagctatcaccctcatagctgaccctcgctccctacccctacctcttccctcttcctcccaccaacaacaacctcttccatctccttacaaccacgcgccgcccggtcccccaccgcaggctcatggccgcaagcgcgctgttatttgcggcgtgtcttacaaaaacacccagtatgaacttaatggttgtattaacgatgccaactgcatgaagttcttgttggtgaatcgcttcatgtttcccgagtcctccattattatgcttacggaagaagaaactgatccttacaagcgtccaacgaaacgcaacataagaatggcattgcgttggcttgtccaaggttgtcagcctggagattccttagtgttccactactctggtcatggctcgcagcaaaaggacgacaatggagatgaggtggacggatacgacgagaccctttgtccattggacttcgagtctcagggaacgatcatagatgatgaaatcaatgcaaccatcgtcaggcctctaccttgcggtgttaagcttcacgcaatcattgacgcttgccatagtggcaccgtattagatttaccatacctctgtaaaatggacaggaaggggagatacgtctgggaggatcaccgtcctcggagcggaatgtggaaaggaacaaatggtggggaagtcatttccttcagtggctgtgccgatgatcaaacctccgcagacacttcagccttatctaagattacttccaccggtgcaatgacttactccttcatccaagctattgaatatgggcatgcgaccacttacggtaacatgctaaacgcaatgcgttccaacattcgtcatg

SEQ ID NO: 9809 - DNA, 933 bp, Gossypium hirsutum
  Predicted polypeptide sequence is orthologous to G896
gaataatgtatccgccgccagggccaggaggcatgtactacaattacccgccgcctatgctggtcaactgctccggctgccacacccctttgcagcttccgcaaggtgcccgatccatccgttgtgccatctgtaaagccgttaccaacatcgctgaccctcgatccctccctcccgcgtcccaatcacctgctccttccacccacgcgcttccttctccctccccttacaatcatgctcctcccggggcacctccccacgcccacggtcgaaaaagggcggtggtctgtgggatttcgtatagatactcgaggcatgagctcaaaggttgcatcaatgacgccaagtgcatgcgttaccttctcgtcaacaagtttaagtttcccgaggattccattcttatgctcacagaagaagaaactgatccctacaggcttccaacgaagcataatataaggatggcattattttggttagtacaaggttgtcaacctggtgattctctgttatttcactattccggtcatggttcacggcaacgaaattacactggtgatgaagttgacggctacgatgagactctttgccctttggattttgaaactcaagggatgattgttgatgacgagatcaatgcaactattgttcgacctctacctcatggtgttaggcttcatgcgattattgatgcttgccatagtggaactgtattggatttaccattcctttgtagaatgaatagggctggacagtatgtatgggaggaccatcgtcctgcatcacgtttgtggaagggaacaagtggtggagaagtgatctcctttagtggttgtgatgatgatcaaacctctgctgatacatctgccctatcaaggattacatctaccggtgccatgacattctgcttaatccaagccatcgaaagggggcatg

SEQ ID NO: 9810 - DNA, 843 bp, Gossypium hirsutum
  Predicted polypeptide sequence is orthologous to G904
cttcctttacccccccaaatacaattctgttccttacacgtcatcctcctccacttgtgatacagtaaggaccaagaacccatcaatggcgtcgccgccacctttgttatacggagttattggaggtcctgtggcctcctcggaaaataatagcagtgaacgctcccattcttcttcttcttcaattgagagtgcaaagccgagtattataataatcattttgatcctttctataaccttgcttgtttctgtttctctttgtctcctcttgcgtcatctcaaccgccgttgcttgcgtcacctctctcgttcctctacctccactattgtcgcctccgctgccagccaccgtgtcagtcccgaacaatcaccgacggctttgttgcttgattctcttcctctttttactttctcttccattactcgccgccgctccaacggtgattcaacggtttccggagattgtgccgtttgtttgtcgaaatttgaacagcaggatcagctcaggcttctccctatctgttgtcacgcatttcacgcccagtgcattgatacttggcttacttcaaatcagacttgtcctctatgccgctctcctctcttcgcttccgagtccgatctcatgaagtcgttgcttcagtcttctaacgcagccgcaccgatcggaagtggcggaagcgatagtttccggcttgagatcggttctgtaagtctccggcaaccaggctcagaatcaggtgagcaaagaacgtcgtattccattggctcttttgattatatcgtcgaggaagaatcagaggtgactaggaatcaaactcatcagagaaacgtctccgataaaga

SEQ ID NO: 9811 - DNA, 675 bp, Gossypium hirsutum
  Predicted polypeptide sequence is orthologous to G921
tttttttttttttttttttttttttttagctaagcagcgtgccgccgttcatatttgcaccaaagcatatacaaagtacaaaagtgtttgatattcactccattatctatcttctctctttttcaccaaaaaaaaaaaattaccatagtgttttagtttgtttttgaagttcacgggggtgatggtttagggtgttcagttttgatggagcgagcaaccgctgcagctaaagctagagtgaagttaggatcttttgttaaggatgcaacatagtcttcgatcttcttcttcttattatttccgtcgtcgttactggtgctataatcatgcataaagcttggaaggtttctgtggttttgtaagtcggagcctgaaagagtgagatcaagggtgatgggtggtggaaaagggttatccagaggtggaaaaggaatgcttctcgtcccggaaaatatcgccgagctgcatgatgctaacattgattttccggcagctgtggaatcaacatcatggttgtgttgtccttcgtatgttgccacaacaatagatttgtcctccacgcatcgctgaaccttctttttgacagggcattccggagccataaagcacttaaaataagctcgaggcgagggattatcttttgtaactttctggccatattttctccattgaaat

SEQ ID NO: 9812 - DNA, 556 bp, Gossypium hirsutum
  Predicted polypeptide sequence is orthologous to G921
ttttttttttttttgcgttaaaacgtattttcttttatttataagttaggaagggaatgtgaatttacagaccaatttattcaaaaacaaaaacaaaatgaaaagaatatttacatgaagctgatgcttgaacagatttcctgtcctattctgtttttaaattgtgtgtttccccaattcttctgcaatgtcgtatttacaacattctaagttcataacaattactacttatagttgacaaaatcatagaaacaactctttgtccgccggtatattttcccagcaagacagatataaatcctaaaatagaaacgagaaaaaaaaaactctaaattgatcttatattttgagatattaattccatcccattttttttattcaactggactttgctgaaacattcttcctgaaatggcagctgccaatgctgctgtgaattttgggtctttcgtcaaagaagtagccatctgttccaccaaatattgtctgacttgcggtgaatccatttttggcagaccggagctgcagattctagctacatcactaccactgggct

SEQ ID NO: 9813 - DNA, 949 bp, Gossypium hirsutum
  Predicted polypeptide sequence is orthologous to G921
atgaatatattagatctggatctttgcttaaagattgaaaaaaaagctatgaattcttcttcgtcttcatgggttgattcgttggatcttaatgcttcttcaacaaagtcccttcaacttgaaactcctgtaagtcatcccaataccagcaacagcttaattgtatttggaaggaaactttcagtcaaagaagagagtggtgctttaatggaggaactgaaccgtgtaaatgcagaaaataagaagctaactgagatgttaaaagcaatgtgtgagagctataatgcattgcaaagccagttagtggatttgatgaacaagaatactgagaaagaacttagtcctacaaagaaaagaaaatcagaaaccagcaacaacaacaatgggaatatcattgggaattcagagagtagttcaactgatgaagaagaatcatgtaagaaacctagagaagaaatcatcaaagccaaaatttcaagagcttatgtcaggactgaactatctgataccagccttgtggtaaaggatggatatcaatggaggaaatatgggcaaaaagtcaccagggataatccctgtccaagagcttatttcaagtgttcttttgcaccaagttgccctgttaaaaagaaggtgcaaagaagtgttgatgatcaatcagttctagttgcaacatatgaaggtgaacataatcatcttcccccttctcaaatcgaggcaacatcgggttcgagccgccttggttcggtccctgttggttcgaccccagttaagtcatccggtccaaccattactctagacctcaccaattcaatcaagtcaagtgatgaagctagaaactcaaagccaaaactagattcaccagaagctacgcaatatttggtggaacatatggcatcttctttaactaaagaccctaatttcactgcagcactggcagctgctattt

SEQ ID NO: 9814 - DNA, 961 bp, Gossypium hirsutum
  Predicted polypeptide sequence is orthologous to G921
cagtaatggaaccagcttgggtggatactactttggatctcaacatcaacccttgttttcgcaccaacaaagctatgaaacgagaatttgagggagatgtggctgagtcggcaccagttaaatatgagagtggagtgttggtggaggaattgaatcgggtcagcgccgagaacaagaagctaactgagatgctaacagttctatgcgaacagtattactctttgcagcaccaattcatggaattggtcaacaagaaccctgaaattgaaactactgctgctgcaacaacatcatcatcaaagaagagaaaagctgagtgggaggattatggtgccaacatgattggatttagtgggaacactgagaccagctctagtgatgatggctcacctaaaactcccaaggactgcattaaacctaaggtttctagggttcaagtccgcacaaatccttctgataatagcctgatagtaagggatggatatcaatggcgaaaatatggtcaaaaagtcacaagagataacccctgtcccagagcatacttcaagtgctcttttgccccaagttgtccggtcaagaaaaaggtgcaaagaagtgctgaagacccatcgatcttggtggcaacatatgaaggagagcacaaccaccatgagcaccaccgttctccacctgctgaaatatcattaaactccaacaacaacacccctagttccaacactggttcgggtcctgtttcatctgccccaaccaaagctttagcttccactgtaacactagagctgcttcaaccagctggtttgggcggcgatgaaaccgaaagggcagccctacaaatcgacgcaccagcaatccaacagatttagtcatcaaatggcggcttcttgagcagagacccatttcacggcagccctgctgcagcattcaggagagctgtgtagacggaaatagatgaaagtggtga

SEQ ID NO: 9815 - DNA, 372 bp, Gossypium hirsutum
  Predicted polypeptide sequence is orthologous to G927
gcttagcgtggtcgcggccgaggtactctacaagctgggagagtcactgaacaaggactgaacaaagggaatcctgctcacttcactatattccctggtgatggcaaatgttcaggggatggacaaaaatctccgaccgtcatatctctgcaatcagttccatcagaacagcattctcgctttgaactaggatgtggtcagccgcccatggtctgtgcaaaatatccttacatggatcaatgctatggagttttctcaacttatggacctccagtttcgggtcgtgttatgctgccattaaacatagcatcagaggatggaccgatatatgtaaatgccaagcagtacctgcccgggcggccgctcgaaagc

SEQ ID NO: 9816 - DNA, 344 bp, Gossypium hirsutum
  Predicted polypeptide sequence is orthologous to G937
accttgttttgggtggtggtcatgcatgaatgtgtcaagatcagtttggagaatcctcgaaagggagcagttcgcagtcgggtgcccttaagggcctctccagttagccacaaacaccggagggacctccactacatggtgtgagagcatggaagatgatgaagatgcaaaatccgagtgctatagttggaaaagccatgttcaaaaacccataaaaaacaatatatagagtttacccaccatgaattttgcagataaaaaaaaaaaagaaagaatgtattatgaggaaatcatttatctggagaaattttcatttctgaaaaaaaaaaaaaaaaaaaaaaaaa

SEQ ID NO: 9817 - DNA, 609 bp, Gossypium hirsutum
  Predicted polypeptide sequence is orthologous to G938
ggtgttgaagatgagccgaacttcgatgtgcaagagcgcaaacccaggactatcagttctaatatggtcatggagagaatgagggctatccaacaaccaccttattcgattaagggggaagttgttggtaatttggatttcacgcgaaagaggaaaccatccaatgatttaaacatggttgaacaaaaaatctacacttgtgagttcctccagtgcccttacagtgaatttcgtttgggttttcatgataggactgccagggacaatcatcaattgacttgtccatatagaaattcctctgcacagtttggtggttcgaatttcagtgttaatgaagtaaaaccagttattttccctcggcaattcggacaatccaagccagctgcaccgcaggttacatctgtctcaacaccctttgatctatccggacttggagttccagaagacgggcagaaaacgatcggcgaactcatgtcagtatatgataacaacattcaaggcaacaagaacatgaatcctagtaacaatcttgttaccaaaggtcaaaacgttcttcagccgaaaatacaacatcagcaagatgaattcttccgcggtcaaggagtcatt

SEQ ID NO: 9818 - DNA, 898 bp, Gossypium hirsutum
  Predicted polypeptide sequence is orthologous to G938
caacaggggaagcaagctaaagcagccaccccccttcccctttttctccaattattatctttattcatccattattctctctctgtgtctatgcttttgttcttctcatagtcttcttagtgttgcctaaatggcgtctttgagcttctttttcccttctggttaatggagtcctttggttattggatgatttgaggttatatcagttctaagttgtaacagatactagtagaaactcaaagcttcagtttgatttcggagatttcctcgagtttcggatttgttctgagtcctgtattggaacgatgatgatgtttgaggagatggggatttgtggggatatggatttctttggtgcttctttcggggaaaaggatgtgacggctgcttcacaggtcgaaatggatgcactagttgatgacgattatagtgatgaagaggtcgatgttgatgaacttgagaggagggtgtggagggacaaaatgcgattgaaacggcttaaagatcagagtaagggaaaggacggggttgatacagccaaacaacgccagtcgcaagaacaagcaaggaggaagaagatgtcgagggcgcaagatgggatattgaagtacatgttgaagatgatggaagtgtgtaaggctcaaggttttgtatatgggattattccggaaaagggaaagccggtaactggggcatcagacaaccttcgagaatggtggaaggataaagtgaggtttgatcgtaatggtcctgctgctattgcgaagtaccaggcggataattcgattcccgggaacaatgatgggtgtaacttgatcggtcctacaccgcacactttacaagaacttcaagatacaactcttggttctcttttatctgcactgatgcaacactgcga

SEQ ID NO: 9819 - DNA, 843 bp, Gossypium hirsutum
  Predicted polypeptide sequence is orthologous to G938
ccctctctctctctctctctctctctctctctctctctctgtctgaaaatcttctgtttgttgctgaatttacttctttcagctttttggaataaacccaaactgtgggtttttcctggcttatcttggaacaatgatgatgtttgatgatatgggaatttgtggggatatggatttcttcagtgctccttttggggaaaaagatgcggccacggcaacgttggcggctttgcgtactgaaccagaggccacagtggaagatgattatagtgatgaagagattgatgtggatgaacttgagagaaggatgtggagggacaaaatgcgtctcaaacgacttaaagaacagaacaagagcaaggatggggtcgatattgtgaaacagagacagtctcaagaacaggcgaggaaaaagaagatgtcgagggcgcaagatgggatattgaagtacatgttgaagatgatggaagtgtgcaaggctcaaggttttgtttacggaataatcccggagaaaggaaagccggtaactggggcatctgataatcttcgggaatggtggaaggataaagtcaggtttgatcgtaatggtcctgccgctattgccaagtaccaggctaataattcgattcccggcaacaatgatgggtgtaacccaattggtccaataccacacaccttgcaagaacttcaagatacaacgctcggttcccttttgtctgcactgatgcagcattgtgatcctcctcagaggcggtttcctttagagaaaggtgttcacccaccgtggtggcctactggtaacgaggaatggtggccgcatctcggattgcctaaagatcaagg

SEQ ID NO: 9820 - DNA, 943 bp, Gossypium hirsutum
  Predicted polypeptide sequence is orthologous to G938
caaggttttgtttacgggattattccggaaaagggaaagccggtaactggagcatctgacaatcttcgagaatggtggaaggataaagtccggtttgatcgtaatggtcctgctgctattgctaagtaccaggctgataatttgattcctggcaagaatgatggctgtaacaacattgggccaacgccacacaccttacaagaactccaagatacaactcttggttctcttttgtctgcactgatgcaacattgtgatccccctcagaggcggtttcctttggagaaaggtgttcccccaccatggtggcctactggcaacgaggaatggtggccacaactgggattgcccaaagatcaaggtcctcctccttataagaaacctcatgacttgaagaaggcatggaaagtgggggttctcacggcagtaatcaagcatatgtctcctgatattgccaagattcgcaagcttgtaaggcagtctaagtgcttgcaggacaagatgacagcaaaggagagtgcaacttggctcgctatcattaaccaggaggaggccttggcacgagagctttaccctgattcctgcccacctttgtcctcaggtggaggaagtgggtcttttgttataaatgactgcaatgagtatgatgttgaaggggctgaagatgagccaaactttgatgtacaagagctcaaacccgggcatctcaatacatctaatttcagcatggatacaatgagggctgtccaacaacaatcgtatcctattaagggagttgtcaataatttggatttcatgcgaaagaggaagccatccgatgatttgaacatgatggaacacaagatctacacttgtgagtcctccagtgcccttatagtgactccgcctgggtttcgtgacagactgccaggacatcatcattacttgtctttcagaactcttc

SEQ ID NO: 9821 - DNA, 519 bp, Gossypium hirsutum
  Predicted polypeptide sequence is orthologous to G938
tttcttcagatgctccacttgtgggaaaaagatgtggcagcctcacaaattgaaccagaggcgagggtggaggatgattatagtgatgaagaaattgatgtggatgaacttgagaggaggatatggagggacaaaatgcgtctcaaacggcttaaagagcagaataagtgcaaggaggggattgatattgctaaacagcgcctgtcacaagaacaggcgaggagaaagatgtgggggttctcacggcagaataagtgcaaggaggggattgatattgctaaacagcgccgatcacaagaacaggcgaggagaaagaagatgtgggggttcacacggctgtgatcaagcatatatgctcgttttctttagttttggaatgggtcagaagatttctttctgaccattttcaaattttttgatgttgtaaaactatataacatatggattatgatgtagaatttaattttaaccttttcttaatataagataattatgtttatgtaaaaaacaaaaaaaaaa

SEQ ID NO: 9822 - DNA, 647 bp, Gossypium hirsutum
  Predicted polypeptide sequence is orthologous to G976
ttttttttttttttttttaagagataactttaaacttggaatataaataataaaataaatatgaaaaataaaacaaatagaatgatgtataccactgagtctaacctaatccaaatcatatactatggatttaaaagtaatatgaggttgatgtaaatcctaaccttgtatgactagttggttaattggtatactttttctactattttttttaacagaaactggaaaaatgaagcgaaaacaaagaaaatagaaaaaaacacaacatagcaaaagcaggcttataatttagtaatgtccccataaatcaatgttaaaggtggaagctacgttatcgtcgcaatcataaacttgtgcctgcaaagcagcaggtgaagagaggagcaaaccttcagccatgctatcgattaagcctggcatgttaaacaatgcctcctcgtccatgaaaccataattccactcattatcattaatgttggtggtctccaagctccaactacgatccaacatcgagccataatctaaaacgctcttttcttcgtcgttctcagtggaaactgaggttgatgatgagcatcccactggttgaggatcaatatccgttgaagttactggtttaaaagcctcggcagcggcaaacgcagcga

SEQ ID NO: 9823 - DNA, 876 bp, Gossypium hirsutum
  Predicted polypeptide sequence is orthologous to G976
cacaaacatgactgaatctgattcttcttcaaccaatgtgcccccaaaagaccagccgccaccaccaactgttcccatccctgacgctccgccgcaagagcagtcgccgaaaccatcatctactccattgatctcatcgaaagaaggcgtaagtgggaattccacatcgagaaagttgccggcggtttatcgaggagtaagaagcaggagtgggaaatgggtgtcggaaatacgtgagccgcgtaaaacgacgcgtatatggctagggacataccctacacctgaaatggcagccaccgcgtatgacgtggctgctcttgccctaaaaggtcccgacgcggaactgaactttccggatatggttcattcgtatccgaaagtgggttctacatcggcaactgatattcgtgccgccgctgctagtgccgccgcttctagactactacccaaggctgtaaccaacactgggtcatcatcaaaaaacgaggacaccacatcgactactgctatggagattacatgttcaggtcaagaatttatcgacgaggaagagcttttaaactttcccaatttgatggtggatatggcagggggaatgctagtaagccctccaaactggataaactcaccaccttctgatgattcaccagataattcagatgtagatacactatggacttacacttaaaatagaaaaattcactgtaaaagtgatgaatgagagagagtatacagtacaatgaaatgtagaagaagaagaagcatggtttaaaaactagggtctagatgcttctgatgattcagtaatatgaaatgcagaaggtactgtcatttgtcctctttttttaactctgtctcttctggtttttatctctt

SEQ ID NO: 9824 - DNA, 452 bp, Gossypium hirsutum
  Predicted polypeptide sequence is orthologous to G993
ttttttttttaaagagctaaacatgaatcaataaatataaaaacagaagaaattgacagttatttcatatttttttcttggacgaaatgtattacacctaatttcagctttcttcagcctttttgtcttgtaatatacaattcaacttttacaacttgctactacagcccctccatgtccccccctccccttttctttttcttcctacaccgtcttttaacattcacaaagctccaaaaacaacaaaagaaggggaaaaaaaaaagaaaaaaaaagggaaattaattaggtgatgttacaaagcatcaattaccctttgtttcttgctgcactctaattctaaaagctccatttctctagtccttttcccattacatcctccagctagaccaacattttcactgccaggcattttaaatatgttgaccccaaatagcctgaccatttgaacc

SEQ ID NO: 9825 - DNA, 843 bp, Gossypium raimondii
  Predicted polypeptide sequence is orthologous to G1006, G22, G28
gataaaaaaacatccccaaacacaaaatttgaacattttgagattagatttttagaggaaaaaaaataggttgactgttttgttttggctatggagatgtattcaagtgcaaacgactccgatttggctatgctggactcaattcggcaatacttactcagcgattcatcggaccttcgactcactgcttccactgattttacctcggctccccccatgttttgcaggagctcaagctttagccgtttgaacccttgtttcactgaaacctggggtgatctcccgctcaaagaagacgattccgaggacatgcttgtttacggactcttacgagatgctctaactgtcggttgggcaccgtccgataactctacgacgaatttaacgccgatcaagccggaaccgcaagaatttttaccgcagacatcgttggaaaaagtggatatggtgacggagaggacggttcctgcggtggtgccggccaaagggaagcattacagaggcgttaggcaaaggccgtgggggaagttcgcagctgagattagggacccggctaaaaatggcgctcgggtttggttaggtacttttgagacggctgaggatgcggctttagcttatgatagagcagcttataggatgcgtggctcaagagctttgttgaattttcctctgagggtgaactctggggagcctgatccagtcagagtaacgtcaaagagatcgtcgccggagccgtcttcgtcttcgtcttctggctccgaaaatgcgtcaccaaaaaggaggagaaaggtggctggctcagctccggcagtggttcacgctgggttagacatgggtgctgga

SEQ ID NO: 9826 - DNA, 892 bp, Gossypium raimondii
  misc_feature (879)..(879): n is a, c, g, or t
  Predicted polypeptide sequence is orthologous to G1136
cgtttacttcaggtgtaattttaccttcatctggtgtggtgaaatcaagtgggggtgccggggattcagatcactctgatcttgaagcttccgttgttaaggaggccgatagtagtcgagtcgtagagcctgaaaagaggcctcgaaaacgggggagaaaaccggctaacggaagagaagagcctctaaatcatgttgaagcagagcgtcaaagaagggagaagcttaaccagaagttctacgccctgcgtgcggtggttcctaacgtgtcgaagatggataaagcatcgctcttgggtgatgctatttcatatattaacgagctcaagtcgaagctacaaagtgcagattcggagaaagaggagatgcagagccaattagaggcattgaagaaaaatttgtcaagtaaagctccaccaccacatgatcaagacctcaagatttcaaatcacactggcgataaattgatagatttggagattgaggtgaagattattggatgggatgcaatgattcaaatccaatgcagtaaaaagaaccatccagcagcaaagctaatggctgccttgaaggaattagacctggatgtgcaccacgctagtgtatcagtagtgaaagacttgatgatccaacaagccaatgtgaagatggggagccggtttttcacgcaggagcaattaaaatcagccctaacaaccaaacttggagatgcaagatagagagtattgagcagagcttgattgaaagatcattgttgaaaatggctgcagggttctgggatattttaaggctcctggtagcacgagctctgtaaaataatgttctattttggtcttattagtgtttagtgtagttaataatagtttgagaggtgatgtntatgaatctggag

SEQ ID NO: 9827 - DNA, 869 bp, Gossypium raimondii
  Predicted polypeptide sequence is orthologous to G1146
cttggtattgtttccagtgctgcttgaccaatatgtatttagaatgagcaaacaatatttggccaatgtggcattgaaaattaatgtcaaggttgggggaagaaatactgttcttgttgatgcaatatcacgaaggatacctcttgtcagtgaccgtccgactataatttttggtgctgatgttacccatcctcaccctggggaggattcaagcccttctattgcagctgttgttgcctctcaagattggccagaggttacaaagtatgctggcctggtttgtgctcaagctcatcgacaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctgttatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacagtttacagctgatgcattacagtcccttacaaataacctttgctatacatatgcaaggtgcacacgatcagtgtcaattgttccccctgcgtactacgcacatcttgctgcatt

SEQ ID NO: 9828 - DNA, 832 bp, Gossypium raimondii
  Predicted polypeptide sequence is orthologous to G1146
ggaatacagttcttgttgatccgatatcaccatgaatacctctagtcagtgaccgcccgactataatttttggtgctgatgttacccatccgcaccctggggaggattcaagcccttctattgcagctgttgttgcctcccaagattggcccgagattacgaagtatgctggtttggtttgtgctcaagctcatcgccaggagctcatccaagatttattcaagacatggcaggatccagtaagggggactgtttctggtggcatgattaaggagctcctaatatctttccgaagagcaactggacataagccacagcgcatcatattctacagggatggtgtcagtgaaggccagttttatcaagtgttgttgtatgaactagatgctattcgtaaggcatgtgcttctttggagccaaattatcagcctcctgttacctttgttgtagtacaaaagcgacaccacacaaggttgtttgctaacaaccataatgatcgcaatgctgttgacaagagtgggaatattttgcctggcacagtggtggactccaaaatctgtcatcccacggagtttgacttctacttatgtagccatgctgggattcagggtacaagccgtccagctcattatcatgtgctatgggatgagaacaagtttacagctgatgctttgcagtctcttacaaataacctttgctatacatatgcaaggtgcacgtgatctgtgtctatcgttccccctgcatactatgctcatcttgctgcattccgagctcgtttttacatggaaccagagacttcagacagtgggatcatgataagtggccctgc

SEQ ID NO: 9829 - DNA, 770 bp, Gossypium raimondii
  Predicted polypeptide sequence is orthologous to G1198, G1806, G558
ggagaatccaatccggctgatggtagtccaaagactgacatctctacagatgcagacactgatgaaaaaagtcagaggtttgatagaggaaaatctagtattgttgcggtttctgattctagtgacagatcaaagagtaatttggatcaaaagacacttcgtagactagctcaaaatcgtgaagctgcaagaaaaagcagattgagaaagaaagcatatgtgcaacaactagagagtagtcgtttaaagttgacacaattggagcaggagcttcagcgggcacggcagcagggtatcttcatatcaagctctggagatcaaagccattcgatgggtggaaacggtgccatggcatttgatgtagaatatgcacgatggttggaagagcaaaaccgacaaattaatgagctgagaacggcagttgaagagcaatgcagctaaggctgatgttttccatttgttgtcaggcatgtggaaaacacctgccgagaggtgtttcttatggcttggtggtttccgttcatctgagcttctaaagcttcttgtaaatcaattggagcctttgaccgagcaacagttggtggggataggtaacttgcagcaatcctcccaacaggctgaagacgcattatcccaagggatggaggcattgcagcaatctctggctgaaacattgtcgactggatctttaagctcttctggatcatctgggaatgtggcgaactacatgggtcaaatggccatggccatgggggagctcgggactcttg

SEQ ID NO: 9830 - DNA, 846 bp, Gossypium raimondii
  Predicted polypeptide sequence is orthologous to G1198, G1806, G558
cgggagaattggggagattccaatatggcagatggcagccctaggactgatacgtcaacagacgacactgaagagaagaatcaaaggtttggaagaggtcaaacaaatgctatcgtggcttccgattctagtgacagatcaaaagataaaacagaccagaagacattgcgtaggctagctcaaaatcgggaggctgcaagaaaaagccggttaaggaagaaggcgtatgtgcaacagctagagagtagccgactgaaactgactcaactcgagcaggaactgcagcgagctcgtcagcagggtatattcatttcaagcacgggagatcaatctcattcgatgagtggaaatggtgccttggcatttgacgttgaatattcacggtggctagaggagcacaataagcatataaatgagttgagggctgcagtcaattcacatgctggtgacgccgaacttcgcactattgtcgacagcgtcacagctcattttgatgacattttccgtttgaaaggtattgctgcaaaagctgatgttttccatatcttatcgggaatgtggaaaacaccagcagagcggtgttttctgtggataggtggcttccgttcatccgagctccttaagcttcttgcaagtcagttggagcctctaactgagcaacagtttatgggtatccaaaacttgcagcaatcatcccagcaggccgaagatgctttgtcacaagggatggaagcattacaacaatctttggccgagacattggccaatggctcacctgctccctcgggaccatctgggaatgtggcaaattatatgggccaaatggctatggccatggggaagcta

SEQ ID NO: 9831 - DNA, 897 bp, Gossypium raimondii
  Predicted polypeptide sequence is orthologous to G1272
tcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcatatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttct

SEQ ID NO: 9832 - DNA, 897 bp, Gossypium raimondii
  Predicted polypeptide sequence is orthologous to G1364, G481, G482, G485
cttctagggcttttccctactctttaaatctctccaaaatccccactacgagctaacaataccctcttactcctactatacatatatattcaacttcaactgctctttttcactgtaaaagctctatatcacaataccttattgaactttgagaattgaaggcgatggtggactcagacactgagtcgggaggaggtccaaacaacgcatccaacgcagatctttcttccccgaaagagcaagacaggttcttgccaatcgctaacgttagcaggatcatgaaaaaggctttgcccgccaacgccaagatttccaaggaagctaaagagaccgtccaggaatgcgtgtcggagttcatcagtttcatcaccggggaagcctccgataagtgtcaaaaggagaagcggaagaccatcaacggtgacgatctgctgtgggccatgactaccttaggtttcgaagattacgtcgagcctttgaaggtttacttgcagaggtttagggagatggaaggggagaagaccgccgtagcacgtgataaagacgcgcctcttgctggaggcgtcggtgctgctgctgctgctggttctagtgggatgtatgggatgatggtacaccagcagcatcaaggccatgtgtatggttctggtgggtttcatcagatgggccggggcccaaggtagagtttcttcatcactcacacgtgtatggttgttattaatttgataaaagaaaatctggtttggtttcggttcggcatacttggttgggccggggataaggccttgctaatttattattgggacacgtgcacggttgtgatagcttgtatgtttgaggagaaaggtagtgtctgctttcactttttcacacccttgatttgagggtttagtacta

SEQ ID NO: 9833 - DNA, 901 bp, Gossypium raimondii
  Predicted polypeptide sequence is orthologous to G137, G145
caaaaaaaaaaaaaaaaacaggtgaaatccctttttcttttggtctcaaaacaattcaaaagggaaagattgttggttttagggtttgggttctcattgatttttagtgaaaaaattataaaaaaaaaattatgggaagaggtagggttgaacttaagaggattgaaaacaagatcaacaggcaagtcacttttgcaaagagaagaaatggtcttttgaagaaagcttatgagctttctgttctttgtgatgctgaagttgctctcatcatcttctccaatagaggaaagttgtacgaattttgcagcagctcaagcatgatcaaaacattggagaggtaccaaaaatgcaactatggagctcctgagccaaacgtgtcatctagggaggctgctttggaattaagcagtcgacaggaatatttgaagcttaaagcacgttacgatgccttacaaaggtcccaaaggaatttactaggagaagatttgggacctttgagcagcaaagagctcgagtcacttgagaaacaacttgattcatcattgaagctaatcagatcaacacggacccaatacatgcttgatcagctcaatgatctccaaagaaaggaacatcttcttaatgaagccaataagaccctaaaacaaaggttggtggaagggtaccaagtaaactcgttacaattgaatccaaatgcaacggaagacgtcggctatggccgtcaacaggttcatcatcagcctcatggcgatgccttcttccatccactggactgtgagccaactttacaaatcggatatcagcatgatccaatgtcagtggtgactgcagggcccagtgtgaataattatatgacaggttggttaccatagcatatatatctctatatatctatataaag

SEQ ID NO: 9834 - DNA, 829 bp, Gossypium raimondii
  Predicted polypeptide sequence is orthologous to G140, G146
gagaagtaaataaaaaaacccttctctttctttttccgcctttaattatcatacttgcctttttcttttcttttcctttcaagttaggaagcatggtgtaccccaatgaatcccttgaagactttccccagaagaaaatggggagaggaaagatcgagatcaagcggatcgaaaacacgacgaaccgccaagttaccttttgtaagaggcgcaatggtttgctcaaaaaggcttatgagctatcagttctttgtgatgctgaggttgctttgattgtcttctccaaccgtggtcgactctatgagtatgccaacaatagtgttaaagcaacaattgaaaggtacaaaaaggcttctgattcctccaacactgggtcagttgctgaagttaatgctcagttctatcagcaagaagctgacaaactccgaaatcaaatccggaatttgcagaatataaacaggcacatgctgggggagtccgtagggggattgcctatgaaagagcttaagagcttggagagtcgtttagaaaaaggaattaacagaatccgttccaaaaagaatgagctgttgtttgctgaaatagagtatatgcagaaaaaggaaattgacttgcataacaataaccaacttcttcgagccaagatagctgaaaacgagaggaagcagcagagcatgaatttgatgcccggaggttcaagtaataacttcgaggacatacattctcagccatatgactctcggaactacttccaagttgatgccttacaacccgccgccaattattacaaccctcagcagcagcaagaccagatagttcttcaactagt

SEQ ID NO: 9835 - DNA, 904 bp, Gossypium raimondii
  Predicted polypeptide sequence is orthologous to G1419, G43
gccatcttctgaagaaacattagccttggaactcattccagaacatcttcttactgactttgcttccatggattcttttcttgccagtcttcatcatatagtggaagccccacaattctctcaaatccatagccccaatcagatgaaacagtctactctaagccaacgccgtccttctataaacgtcgccattcccgcaccgaaagtgaacgtaagcgacgagcagaggcattacaggggtgttaggagacgaccttggggtaaatttgcagctgaaattagagacccccacagaaaaggtgcgagggtttggctgggaacctttgataccgccattgaagctgctaaagcttatgatgaagctgcgtttaagcttcgtggaagtaaagctatattgaattttcctcttgaagctggaaaatcaagttcagcccactctgaattaactaaagcttgtataaaaaggaaaagagaggaggaagaagaagaagggagagtggagagtaaagtagtgaaaagagagaaggaggaaaacgcggtgaaggagacgggaagtgtgacgccgggagtatgtttaacgccgtcaaattggacggggttttgggatagtgaagatatgaagggaatattcagtatccctcccttatctccgttatctccgtttgggtattcagggcttgcggttatgtgaaacgcttttggtgggttttggacgccgttaactaaaatcaggaatggttggctgacgtggctagttcaattatccgaagatagaaatttgttcaatcattagtgtacatactctacattgcggcccaagccttttgttttactataacattctatttcttcttttattttttttttagtgaatgataatttttaagtgattaatgttatttac

SEQ ID NO: 9836 - DNA, 844 bp, Gossypium raimondii
  Predicted polypeptide sequence is orthologous to G1419, G43
ttccccttttttagtctccaacttccatttttcttgtcggtgttgatatcataaataccaaaatggcacgttctgaagaaacatcagcccagttagaacttatcaggcaacatctctttactgattttgcttccatggaaactccaccacccttctatcaactctcaaattccgagtcatctcatgtttatagcccgacccggttaaaacaatcgagtctcagccaacgtcgtccttctattaacgttatgatcccacccacaagttttaacataggcccaaacccggttccagattcggctgcggtggcggttgaatcatacgagaaaagtcattatagaggtgtcagaagacgaccatgggggaagtttgcggctgaaattagagaccctaacaagaaaggggcaagggtttggcttggaacatttgacaccgccatagaagcggcaaaagcatatgatagagctgcctttaagctacgcggtagcaaagctatactgaattttcctcatgaagctggaaaatcaaatttctcagagtcagggaaaaggaggagaaatgaagaggaaggagaaggagaaaagagagtgagcctgttggagtccaaagcagggagaagagaggaggaggtaacggtggcagaatgtggaacgccgtcgaatcagacggggatcggggataatgaagatataaatgaaatattcggcggcccactcttatcacccttatcatcgtttccatggttcgggtattccaggcttgaggttatgtaaaagcttagcaaggaatgtggctgtgtttactttttaagtgtttagtaatgagtaaggatgggatgcctaaa

SEQ ID NO: 9837 - DNA, 781 bp, Gossypium raimondii
  Predicted polypeptide sequence is orthologous to G1451
gtgactcagtcctttttatttggaatgagaagaatcagttgttgctgggtatccggagagcaaatcgtcctcagactgttatgccatcttctgttttatcaagtgacagcatgcacattggtcttcttgctgcagccgctcatgcggctgcaaccaatagccgttttactatcttttataacccaagggccagtccttcagagtttgtcattcctctcgccaagtatgttaaagcagtctattacacccgggtttctgtaggcatgcggtttagaatgctgtttgagacagaagagtcaagtgtccgccgatatatgggtacgataactggcattagtgacttagatcctggtcgctggccaaattcgcattggcgctctgttaaggttggctgggatgaatccactgcaggagagaagcagccaagggtgtccttgtgggagattgaaccattaacaaccttccctatgtattcatcacccttccccctgcgattgaaacgaccatggccatctgcgctaccctctttccatgctttcaaagatggtgatatgaacatcaattcccaaatgatgtggcttcaaggtgggattggagatcaaggacttcagtctttaaacttccaaggttttggagttgcaccctggatgcagccaaggcttgatacttcttcaatacaaggtgtccaacctgatctttaccaagcaatggctgctgctgcatttcaggaaatgaggactgttgattcatccaaattaggctctcagtctctcttgcaatt

SEQ ID NO: 9838 - DNA, 815 bp, Gossypium raimondii
  misc_feature (17)..(17): n is a, c, g, or t
  Predicted polypeptide sequence is orthologous to G1480
acttcaaaccctccacnggttgactcctaacataatatttttttatttccattgctttgatttgattcgcgattatgggaatcgaaataagcggcggcacgatcattccaggaggttggggggccgccgccatggctgtcgcggctaagacatgcgacgcatgtaaatcatcggcggcagctatcttttgtcgtactgattgggtctttttatgcttgaattgtgattccaatttccattccggtcacgaaagggtgtctatgtgtgaagtttgcgaacaagctccggcggctgtcacttgtaaagccgacgcggcggctctctgtgtcacttgcgacgccgatatccattcagcgaacccactggctcgccgtcacgaacgtgtacccatcgaacctttctacgactccgctgattccatcgtcaaatcttccccttttagcttccttgtgccgacgacggatcataatggtactaattgtaaacaagaaattgaatctaacaaaggggatttttttttcacagaaatggatcggtttatcgatttcgggtacccgaattcatctcaacatcttcatgatgccgccatggatagcgttgttccagttcaaactccaaaaccagtcattccactgatcaacgatggaagctgtttcgatactttcagctatcaaactcaatcatctctcagtcatagcgtttcatcatcgtcgcttgaagtaggaacagttccagatgggaattaccacgcgacacaagtgggtggttcaatcgatcgagaagctagggttttaaggtaccaagagaagagaaag

SEQ ID NO: 9839 - DNA, 866 bp, Gossypium raimondii
  Predicted polypeptide sequence is orthologous to G1480
gaaaaggagaaagacagtagatttgtttaaccccagcaactcgttgaaatggcgtccaagttgtgtgactcatgcaaatcagcgacggccactctgttctgccgtcctgactcggcttttctttgccccaactgcgactccaaaatccatgccgccaacaagctagcctcccgtcacgctcgggtcttggtctgtgaagtttgcgaacaagcaccggctcacgtcacctgcaaggctgacgcagccgctctttgcgtcacttgtgaccgtgacatccactcctctaaccctctcgctcgccggcacgagcgggttcctttggctcccttttacgattccgtcaagcccaacacagcgtttaacttcctggacgaccgttacttatccgacgtcgatggagacgctgacagcagcagggaagaagcggaggcagcttcgtggttgcttcctaaccctaaccacaaagcacatgaaagcccggacgtgaacacggggcagtacgtgtttcccgagatggatccgtatctagatctggattacggtcatgtggatccgaaaattgaaacccaggaccaggagcagaacagttctggaactgatggagtggtccctgtccaaagcaacaccgtccaagctccgatggtcaacgatcactgtttcgacatggagttcactacaccaaaagccttgccttatggctacaactacaactgtaactacaaccctcactgtcttagccacagtgtatcatcttcttctctggatgttggggtagttccagatggcggtagtacgattacggacatatcagtcccgtgcgcgaaagtgacggagacgactcatcaggcggtgcaactctcatcggc

SEQ ID NO: 9840 - DNA, 833 bp, Gossypium raimondii
  Predicted polypeptide sequence is orthologous to G15
ctccacagtttatttagggtggttatgacatggaggagaaagctgcaagagcatatgatctagctgcactcaagtattggggaccctccactcacatcaatttcccattggagaattaccaaaaagaacttgaagaaatgaagaacatgacaagacaagagtatgttgctcacttgagaaggaaaagcagtggattttcaaggggagcttcaatgtacagaggagtgacaagacatcatcaacatggaagatggcaggctcggatacgaagagttgcagggaacaaagacctttatcttggaacatttagcactcaagaggaagcagctgaggcttatgacatagcagctatcaagttccgaggggcgaatgcagtgactaactttgacataacaaggtacgatgtggaaagaatcatggctagcaatacccttcttgctggagaattcgctaggcgaaacaaagatgtcggacctggtggtaatgacaaccttttaactggtaacaccaatgctgaaaccaacattaacatatcaccaaagaacaatggaggtcaaccagactggaaaatgatcctttatcagtcatctgaacagcaacagcccaacatcattgagaattttaaggctcaggctttctcattggcaccagaaaccatggttggccacagagaggtggatgattccagcaagatagggactactcacttctccaatgcttcttcattggtgactagtttgagcagctcaagagaaggtagcccagagagaagcagtttacctatggcgtttgcaatgcctcctccaccatcatcctagttgatcactacttca

SEQ ID NO: 9841 - DNA, 868 bp, Gossypium raimondii
  Predicted polypeptide sequence is orthologous to G1535
ttttgagggatgaacgccgccgagctcagccgtttgtgctatcaaatgggaatgccttacatgaagtggctccttttgctaatggttcccatcctggaaattgcatttcactccttagaatcaacgtttccagcaactcatcacaacacgtagacctaatgctacaagagagctgcaccaacaaatccggcagcctcgtcgtgtactcaaccgtagacgtcgattccgttcagctggcgatgagcggcgaggacccgtcgtgtatcccattgcttccgttaggcttttttataaccccaatggaactggtgaatgatggtgggtgtaaggacgaagcaaatgggcataatattacagcagggagtttactcaccgttggacttcaagttctagccagcacaataccatcggcaaagatcaatctgtcgagcattgcagccattaacaatcatttatgcaccaccgttcaacaaatcagtagtgctttgagtagcaattgcatcgggtcttgcaatgaaggtgacaatggtaaagaaaaatagggtgttggtgattcgtgaattacccataacatccttaattttgttaactaattgaggaagttattggtaattgtactgaaaatcgtgcactgggatttgtagtaattttaatgtggtaaataaagagtgtaatgatgatggagggttaaatttgaaaacttgggggggtataggtgaagtcaagagcgcaccaattgtgaccctttgcttttaatggtaaaggccaccaattagcaagggtgggtggttcgggtattgacttcagctttcttgccctttttttggtaatttttatatatagttataataaacctaagtatttgact

SEQ ID NO: 9842 - DNA, 883 bp, Gossypium raimondii
  Predicted polypeptide sequence is orthologous to G1646, G715
tttttatttttattttggaaaataataatcatataacaaagccagcgcaaaatgcaatggccgctgtaccttatcccatccatatctgacccttaaaaatatccaccgccgccaccaccaccacgatcaccaccgccacatccccatctcccgccatttggtcaccagccaatggacagtaaccagcaaactcaatccaccccatacccacctcagcctcccacatccgccattacccctccttcatccgccacagcaaccgcgcctcctttccaccacctccttcaacaacaacagcaacagctccaaatgttttggtcataccaacgccaagaaatcgagcaagttaacgattttaagaaccaccaactcccattagctcgcattaagaagataatgaaagccgacgaagacgtccgtatgatctccgccgaggctcccattctcttcgccaaagcttgtgagcttttcattttggaactcactatccgttcttggcttcacgccgaggaaaacaagcgacggacacttcagaaaaacgacatcgctgcggctattacgaggaccgacattttcgatttcttggtagatattgtgcctagggatgagatcaaggatgaaactggtttggctccgatggttggggctaccgccagtggggtaccttacttttatccccctatgggtcaacctgctgctggtggtcctggtgggatgatgattggccggcctgccgtcgatcccaccggaggtatttacggtcagccaccttctcaggcttggcagagtgtttggcagacggcgggaactgatgatggctcgtatggaagtggagttaccggtggtcaagggaatcttgacggtcaaggctaacctaaaatca

SEQ ID NO: 9843 - DNA, 843 bp, Gossypium raimondii
  Predicted polypeptide sequence is orthologous to G1646, G715
catctgccgttgattcttcatccaatcgcttgaggacaagcaagcccagtcctcctcttaccctcctcctcctcccactacttctattacgcctcctcctccttcctcctccgccgccatcgccgccactccgcctgctcctttccaccacctcctccagcagcagcagcaacagctccaaatgttctggtcttaccagcgccaagaaatcgagcaagtcaacgacttcaagaaccatcagcttcctcttgctcgcatcaaaaagatcatgaaagccgacgaagatgtccgtatgatctccgctgaagcccctattctcttcgccaaagcctgcgagcttttcattctggagcttaccatccgttcctggcttcacgccgaggagaacaagcgacggacgcttcagaaaaacgacatcgcggcggctattactaggaccgacattttcgatttcttggtggatattgtgcccagggacgagatcaaggatgaggccgttctgggtgggatggtgggtaccaccgccagtggggtgccatatttttatcctcccatgggtcagcctgctggcgctcctgctggacctggcgggatgatgattggaaggcccgccgtcgatacaaccggtggtatttatgctcagcctccttctcaggcttggcagagtgtttggcagacggcgggggctgacgatgggtcgtatgccagtggaggtagcggcggtcaggggaatcttgacggacaaggctaagcaattcattgggtcaatttgggtgctcgatggcatggcaaatggcgtgatgcactggggtattgcactaagaaatttgggttgcttatgat

SEQ ID NO: 9844 - DNA, 846 bp, Gossypium raimondii
  Predicted polypeptide sequence is orthologous to G1850
tctgaactttctagaatttaacaatcagacttctcatctctggtgaacgaaacaaacaccttctttaaggaattattaattatcgtctttgatggctccgccgccggtggagcaaaacggagatgcaacgacgggaacggcggaatcacaaaggtctattccgacaccgttcttgactaaaacgtatcaattggttgatgatcacacgattgacgacgtgatttcgtggaacgacgacggatctacttttatcgtttggaatcccatggtgttcgctcgtgatttgcttcctaaatatttcaagcataacaatttctctagttttgttcgtcaactcaatacttatggatttagaaaagtggtgcccgatcgatgggaattctctaacgattattttcgacgaggtgaaaagcgacttttgtgcgaaatccagcgacggaagatctcgtcgccaacagcagcagctgttacggtggctccggtgacggttgcggctattccaatggcgaagcctattatatcaccgtcgaattctggagacgagcaatctccagtcatttcatcggcctcatcgccttcaaggctgaaccaagcaggaaccgttatggccgagctcatgaaagaaaacgaaaaattgaggaaagagaacgtgcagcttaacaaacaattatcagagatgaagagcttgtgcaataatatattcagtttgatgtcgaattacgcaagttctcagtcggagaacatttctcccgtgcacaaaccgctagatttcttgccggcgaagcggttatcatggggagaatcagtcgaagaagaaacgagtccgaggttattcggcgttccaat

SEQ ID NO: 9845 - DNA, 879 bp, Gossypium raimondii
  Predicted polypeptide sequence is orthologous to G19
gtagagctttggttctctgtccgctgcttctttcttcccttggtacttcattatttttcctttcacttcctttttgtgaaaaaacattgaaacccttttcaagacgcaatagaagatgtgtggaggtgcaatcatttccgatttcattgccgtgaaacgcggtcggaagttaaccgccgaggatctttggtctgaacttgacacattctccgacctgttgggtctggattacggaaatggaaaagaccctttctctcagttcgacaacaccaaggccggttccaaagccaagaaccttgaaaaagtgacaaacgagtcgactcagaagacaagccgggggagagagaaagaagggaagactcagcgaactcgaaagaacatttacagaggaatcaggcaaaggccatgggggaaatgggcggctgagataagagatcctcacaaaggtgtccgagtctggctcggtacatacaacacggctgaagaagcggctcgagcctacgatgaagccgccaagcgcatccgcggggacaaagccaagctcaacttccctcaaactccacgcctaactcagcctcctgctaagaaaaggtgtatgatggctcctgagttgactccaccgagttctgaaaccaagagctcaccaaccccacaaccttttatgggttttggttacgagaatggagtttacaggccgagtgaagcaatggaaagcgagatggagctgaaggagcaaatctcgagtctggagtccttcctgggtttggagcctgatgagatgacaactgagttgagtggaagcgctgagcctgagtcagtgaacctttggatgcttgatgaccttgtgacacatcatcaacaacagcctcagctctttta

SEQ ID NO: 9846 - DNA, 760 bp, Gossypium raimondii
  Predicted polypeptide sequence is orthologous to G2
caagatcttcagcttcgttctttaatcctcttctactctatacttacttttttagcttagctgattaactctctcataggcttttccttttttttttttttttttggtctttcagcttttccttggaaaatcactggctttgatggtcattttttaatatttaatttcagcttttatgatagttttttttcttcgtttaaagtagattatgatcatttttttttgagaattttctgctttgaaaatatatagtatcttcgcgatttttagtagctgaaaaagtttgtgaagtgaaaaaaaaatgtgggatcttaacgattctcctgatcgttcaagaggcgaggaatcggaagggtgttcatcgccggtagacggcgaaaaagggaaggggaaacgggttggatccgtttccaattcgagttcttccgccgtggtgatcgaggatggatcagaggaagaagatgcagcagctttaaagaaacgaaacagtaacatgatttttgggttctcggtgcctgtcgagagcggtggaccagctccggtgactcgtcagttttttccacttgaccaagacccagaaatgagggcagttcccaccggaactgcacaagggttccctatggctcactgggtcggagtcaaattccggcaatcggaaccactcgccgttgctaaatccgttgaagctacaaatcccatgaaaaaaagcagaagaggaccaaggtcaagaagctctcaatatagaggtgttactttctat

SEQ ID NO: 9847 - DNA, 630 bp, Gossypium raimondii
  Predicted polypeptide sequence is orthologous to G2
tttaggcttgtttgacaccgagattgcgcttctagggcttatgacagagctgcaattaagtgcaatggcaaagatgctgtcactaactttgatcccagcatatacgacaatgagcttattaattctggtaaaacttcagaaaatgctggagatcacaaccttgacttgagcttggggaattcaaacccaaaccaaaacagtgctaaacctaatgctgataggcaaagtggtacgagttatcagcagcatagtctcccacttgaagcaactgattggcaatgtcggggatttaggtctatgcaggaatctcgtagaattgatgaagctggccatggatatagtgaggaagaaacaatgcagttgttgagccaaactcacattcactctccagctgtctcagttaagtgtaatgaaatgcaaagatatggacagttgaggagacctggaggcaacagtaacatatttcacattgttcctcaacacattaatccatcaccttatcagattcatattccaagaagcagcaatggagggcgaattgggagtgatctttcattatcaactagtgatcaacagtggcaatcaggtcctcaccaccagttgttttggaattctgcagcatcatcagga

SEQ ID NO: 9848 - DNA, 755 bp, Gossypium raimondii
  Predicted polypeptide sequence is orthologous to G2057
agggaacagtagcatcaacataaacattgcaaacaaatgtccagtaacataaaaaacacatgacaagttctgcaagaagagaagccatagctgagttttaagagctcagtcaaaaaaatagtcaaagtacaacacaatgaactgatagaaactaatggaaccggggattgaataacctgaaatcaacccagatttcttcttcccacggcataggccattgatttgaagtgaccaaaatcttccctcaaactggtgttgaatcgagcagcatctcctcatttacttcactgtcaacgatcaaactggtcctgttagaggggaaagactatggcttttctccattttattggatcaatggtgagagtcagaggaagcagaggacagcttatttgcgatgctgtcttgatcctcttgtgcgccctggaaccgtgctggaacgcgaaatccagagaatacacctgatgtggtgaattcaatgccagataaagcaggttggtgatggatattttgtgggatttgatgatgatgatgatggtattcgtcggttgttggaattggctggtctatccaagcacgaaccaagggcgtgttactggactgaaggggtcccctctgaaagaaaaactggccgttttggccaaaagctggtgatagtggcggtgctgatagattgccaaagagaaatcctcccattccaccgccaccgccactaccagtatcagcagcagcagcaccattattccaggccaccaatc

SEQ ID NO: 9849 - DNA, 903 bp, Gossypium raimondii
  Predicted polypeptide sequence is orthologous to G2057
gttcgtctctcggctccaccgccatccagttctacgacgtacaggaccgtctcggatacgaccgtcctagcaaagctgtggattggctaataaaaaaagccaaatccgccattgacgagctcgccgagcttcctccatggaacccattggatgcaacgatttcaaccaagaaacccaataaccaagaagacctaaacacatcaacagcaacaaacaatgaatttcacatcgaaaaccttgctgctgggtctggttctcaatgcgttcagcagcacgaaatgggagataacttgaataataattcgggttttcttccagcttctttagtttctgatgagattgctgatactatgaagtctttttttccattgggagcttctagtgagacgccgccgtcttcttcattacaatttcaggattacccgccggacttgttgtcaaggacgagcagccatagtcaagatctgcggctttcgcttcagtcatttccggagccaattcttttgcatcaccatgaacaccatgctgctgctacagctcaggcgcaccatagtgaatctgttctattctctggaaccaccccattagccggtttcgatgggtctaatgctggatgggagcaccaccagcagcagcaaccggtggagattgggaggtttcagagattgtttgcttggaatagcagtggtggtgatgctggtggtggcaatggcggtggatttatctttggcactccatcgcaacagtcattgccactgacttttggccaaaacagccagtttttttctcagaggggaccccttcagtccagtaacacacccttggttcgtgcttggatagaccagccaattgatgaacaccatcatcatcatcaaatcccacaaaacatccatcaacaagctg

SEQ ID NO: 9850 - DNA, 839 bp, Gossypium raimondii
  Predicted polypeptide sequence is orthologous to G2057
cagcattagaacaaactaggttcccatctcagtagtaactctaggaaacagtagcaaacattgattggtaacatgaaaaacatgacaagtccaacaagaaaaagaaaccattgttaagctctaagagctcactcaaatataaatttaagctacaacacaatcaactgatagaaactaaacaaaccggggattgaaaaacctgaaatccacccagatttcttcttcccacggtataggccattgattcaaagttgaccaaaatcttccctcgaactagtctttgattcttggatccatcatagtatagttatcttctcatccagttcacagtcaacaatcaactagtgctgatagaggggaaagactttggccttttctccgatttactcgatcaatggtgagaatcagatgaagcagaggacagcttattggcaatgctgtcgtgctcatcttcttcgccctgaattcgtgctggaacgcgaaacccagagaatacaccaggcgtggtgaatccaatgccagataaagcagtgtgatgatggatgttttctgggatttgatggtggtgatgttgttgatgatgatggtgttggtgttggtcggttgtggaaattggctggtctatccaagcacgaaccaagggcgtgttactggactgaaggggtcccctctgagaaaacaattggctgttttggccaaaagccggcggcagtgactgcggtggaggagtgccaaagataaatcctcctcctacaccgctactggccgcagcaccaccgccaccgctactatcagcagcagcaccgctattattcaggcaaacaatctctggaaccttc

SEQ ID NO: 9851 - DNA, 794 bp, Gossypium raimondii
  Predicted polypeptide sequence is orthologous to G2144
cgttttactcattcttctaagcttgaccttaccgccctccacgaatctaacccaactttctcgcttcacttctttaacctgttaacactgcaatttgggttgaactaaccaagtggctgctttttattttcctgaattttgaacgtgggtattttcacacttcccaaattgcctagtccccccgccctctaatggagtcgaaggcagggacgacggaaaccagatccaacataacggcgtcggacggggaccaagttgcggcactcgaatccctacaatttacagacgaattccaccgtttaatcttggctccgccatctgacaatgcgacttctctcacggctcttcttgaactcccggcttcacgagcccttgagcttcttcactctccggcttcggctaagcttatcgctgcttcggcttctagctttgaagctttaaaaggaaactttctttttccctctaataccactttgattgatcaagctgcgaggtcctctgtgtttgctggaggggttaacaacaccaataacaagagcaacgcgcctgaaacgacgtcgaacaatgcaaccttgaatcttgagaaagcagtgaagagtgagccggcggagaccgagtcatgtcagccgttggtttctgacccagcggtggagaagcggaatttcaagagaaaggatcgcgaaaagaaggctaaaggttcaacgaagaaaagcaaaactgcggcgaatgatagctcagatggccctgaaaagcttccctatgttcacgttagagctcgccggggagaagcaacg

SEQ ID NO: 9852 - DNA, 887 bp, Gossypium raimondii
  Predicted polypeptide sequence is orthologous to G2144
aagattgcagtatatgaatactcatgccatttaagtcagctcaagtcatgcggataagaggaaaagatcgtaatcggatgataatctacttcattccatggatttcagtgtcagattggaacatatggaaactgaagcttcgtttatacatgagcagctgcatcatgaatctagtagatcttacaggttttctaacagcgaagagaagattgaaaatgaggcatatggaaagaggcagcactatgaacatgattctgacctagctgatcgcctaactacagctgagaatgaggtcatttcaccatcatcatcaaaggttgttgatgatatggtcttcaacaagtatcttacagaagctagtggtcttcttaaagaagccaaagagtgtatgaagggaagacatgatgaagagcgtgtagaagtcatcttgaataggtctgcctcattactctcacaagccatctcaatgaagcccatgagcctattggctgtaggccagttaggcaatacatatcttcttcacggagaattgaaactacatgtcagtcgtgagttgaggactctttttactaaaaatgatcccataactcgtgagaggccgcaaggaagagtagttaacagactagatcaattttcatgcagagataaaattatttccctcttagttagtgcttgtgaggagtgtgaagatctccttgtgagagctgggcaaaaatatcagctggcattatcaattgatggagatgatgtgagatccctatataattggggtcttgctctgtcttttcgtgcgcagttgattgcagatataggaccagaggctgcgtatgatgctgataaactattcttggctgcaatcgataaatttgatgtcatgatgactaggg

SEQ ID NO: 9853 - DNA, 898 bp, Gossypium raimondii
  Predicted polypeptide sequence is orthologous to G2144
gggatcttgaatcgctacaatttaccgacgaaatccactgtttgatgtcggctccggcgaccgacaatgccagttccttcacggctttgcttgaactccctgctccccaagctgttcagcttattcactctccggattcggctaagctcattgccgctccagctccgaacgttgaagatttcaaaggcgggtttcatttcccttctaatggtgggctaattgaacgagcagccaggttctccgtgttcgccggcgaaggtaataacaagagcgactcgcctgaagcgacgtcgaacatttcaagtgcaaatctccagaaggcagtcaagagtgaaccggctgagaccgactcgtctcagccgttaatttccgatccaacggtggagaaccggggtatcaagagaaaagaccgagaaaaggtgaaagggcagacgaagaaaagcaaaacaacggtgaaagagagctccgacgacaccgagaagctgccttacgttcacgttagagctcgccggggacaagcaacggatagccatagcttagctgagagagcaaggagagagaagattaatgcacgtatgaagctcctacaggagttggtaccaggatgcaataagatttcgggcacagcgttagttttggatgaaatcatcaaccatgtgcagtccctacaacgtcaagtggagttcttatcaatgagactcgctgcagtgaacccaagagttgatttcaactttgatagtgtattcacggcagaaagtggattttttatggacagtaacttttctggcatggttatgcctatgatgtggcccgagattcaactttcagcaacctgtttgggggagagaagaagtctgcaataattacttaactccggagaacttgcttttaagctatg

SEQ ID NO: 9854 - DNA, 852 bp, Gossypium raimondii
  Predicted polypeptide sequence is orthologous to G2226
gtaaatgtttcatctttctagtccttttgagctttttttactttatggaatataagtggtgtataactctttttctttttttaagaagcctatcttatttcttggccataaactattaacaagatgccatttaaaaaagaaaaaaaaccatctttatcaatgttccactgatatcacatccaccagttgaattgcaggttaccagggtttagccattgtttttcatttgaagctctcctccccattgtttttaaggtcatatatttattatatattatcagcacaaaaagaaaaaaatgggtctctcaagtcttccatctccatcagaaggagtgttatgtatactcttggtaaacacagctttatctatatctatagttaaaggcataatccgatcgatccttcacgttgtcggtgtccatctcccaccaccatcatcggattacactgaaaatctctcggaatcattcgatttccaccttaatactcctgaaagttacatcgaggaattccggagtaggaccccaacaattcatttcggtgctgttttatgtagctgcaaacggcctcagcacgactgtcaggtttgtctgactcagtttgagccaaaatccgagattaaccacttgtcgtgtggccatctctttcacaaggtgtgtttggaaaaatggttggattattggaatattacatgccctctttgcaggactcccttgttgcctgaagaagaagcttcttgcttttggtaagaagattattaccaagtatattattatgcagagttgaggaattcccgtgtacagcgcggtatataaaaatatactgttatctttatcgagtgttgtcgttacc

SEQ ID NO: 9855 - DNA, 880 bp, Gossypium raimondii
  Predicted polypeptide sequence is orthologous to G2239
gaaaacgaccgttacccttacgcccgcttttcccttccatggccatcatcgtggttgtcttgatttccgctttgttctttatgggttttttctctatttatcttcggaactgctccgaagccaacgccaacggaagcgtcgtccgccctttcaatggcgaaactgggcgttctcgccgtgggatgcgtgggcttgagccgtctgtgatcgagacttttcccaccatggtttactccgaagtgaaagttcataagatcgggaaaggagctttggagtgcgcagtttgcttgaacgagttcgaagatgaggaaacgctgcgtttaatccccaaatgcgaccacgttttccaccctgattgtatcgacgcttggttggcttctcatactacctgccccgtttgtagagctaatctcgctcctcaacccggtgaccctctgagccaacccgccgagttggataacaccaccaccgagttggacctcgaggctcagaaccacgacgatgactcagaactggaagaagaaaggaggataaatcctaataatattaactccgatgcggaggctcaagttgcaccggaagttgaagtaattgacttgaaccgaactttaaataggaaccggacacgcggatcaatatcaagccgaacacgtaagttctttttcctgcgatctcacacaaccggacactctttggtccaaccaggtgaaaacacagaccggttcactttgcgattaccggttgatgttcgaaaacagttaataaaccgaaagttaaatcgagcaacgagcttggtgttgcctagggaaagaagctcacggcgaggataccgaacccggagaagacggtggggggagtagtagaggaaagctttttcgat

SEQ ID NO: 9856 - DNA, 854 bp, Gossypium raimondii
  Predicted polypeptide sequence is orthologous to G227, G242
ctattgcatgcctttaaatttgatttcactgtatgtaacaagcacaccggatagaaaagaaatggatcggatcaaaggtccatggagccccgaagaagatgagttgctccagcagctggtacagaaacatggccccagaaactggtctttgatcagcaaatcaatccccggccgatccggtaaatcctgtcggctccgatggtgcaatcaactgtcaccgcaagttgagcaccgtgccttcaccccggaagaagacgagaccatcatccgagcacatgccaggttcggtaacaagtgggccaccatagcccgactcctcaacggccgtaccgacaacgccattaaaaaccactggaactccacgctaaaacgtaagtgcttgccggttggggaagagtgtaatttcgttgctaatggagggtatgatggtaatctgggaggagaggaacggcaaccgttgaaaagatcggtgagtgctggtctatacatgagtccagggagcccatcgggatcggatgtgagcgattctagtgttcccgtcttatcgtcttctcacgtgtacaagccgatcccaaggaccggcggtgttaacgttgatgtaaatgttacgccagctggagtggaagcggcatcatcttccaacgatccaccgacctcactgagtctgtctttaccgggggtggagtcatgcgaggtggtgtcaacccagccaataaccgagtcaactcagaatcggagtgaagaaaggggaggtggggtgatggggttcagtgtggagtttatggcggtgatgcaagagatgataagggttgaggtgaggaattacatgacccagatgcagcaacagcagcagc

SEQ ID NO: 9857 - DNA, 850 bp, Gossypium raimondii
  Predicted polypeptide sequence is orthologous to G2604
ctcagactctttctacccccatcgttcccctttgtgtctcacagttgaactgtatgggagaaagcttgctgctctctggttctagacagtgaactattgaaaggagagtttagctctgtctgattttacaatgccagttccccttgcgccatatcccacacctccagcaccctacactcctcctgctgccaatgggtatggctttggcattaagatacacaggttgttatggatgtaaagtaccaatattacaagtctagtttggcttctaaaaagcttggcctcatcaacaaattggtcaaagacaggagaatttatgaattaagtcattaacctttctgcatctacaaaagttactgtatttctactctcttttttttttttttttaccttccattgacaactgatctagtggccaaacctatgctaaccaggtgctcaaagccaacttgtgtgttccggttgtcgaaatttattgctctatccagttggagcaacctctgtgtgttgtgctgtttgcaatgcagtaacagcagtgccgcctcccggcacagaaatggcacagttgtttgcggaggctgtcataccttattaatgtacatccgcggagcaacaagcgttcaatgttcgtgttgtcacactgtcaatctggccttggaagcaaatcaggtggcacatgtaaattgtgggaactgcaggatgttactaatgtaccagtatggagcgagatccgtaaaatgtgcagtttgcaattttgtgacatcagttgggggctcagctagtgctgctgaacagaagttcaacagctgagactatattagaccccaagtcaaatattaaaagcaacaag

SEQ ID NO: 9858 - DNA, 898 bp, Gossypium raimondii
  misc_feature (869)..(869): n is a, c, g, or t
  Predicted polypeptide sequence is orthologous to G2632
gttatggttgcagagagagccaaactgcaatcaatctctaggcatttgcttctccaattccaatcttctttttctttttctttttttactaataagtcgtgagaaatgccagcaaaaccagggaatgatgatcagcagatagaccatggggctcaaagtgtgttgcagtcaactgcctactctgaaccctggtggaaaggagttgggactaacccctttggtgaagctgcctcgaagtcgccttctgtagaacaactaaatggttcagtggcaaatggagctgtgcattcacaggctcatggggacttgggcaatgaagatgggataaacagacaagatcgccaacatctcaaacacgttccttccacaacaccccttactttgggtgaacaccatgaaccaaattcccaaatggaactagttggtcactcgattgtcttgacatcatatccttattcagatcctcagtatggtggaatgctgacttcatatgggccacaaatgatggtttcaccacatctatatggaatgcatcatgctagaatgcctttgcctcttcaaatggaagaggagcctgtttatgtaaatgcaaagcaatatcatggcattttgaggcgaagacagatacgtgctaaggctgagcttgaaaagaaagccattaaaattagaaagccataccttcatgagtcccggcatctacatgctatgagaagggctaggggttgtggaggtcgttttcttaatacaaagaagcagggtgatgatgttaccagccccacttcacaaaagggcatgaattcagatgaaaacatttcaaccaaatcatctatcttgtctgggtctgagtgcgtatccgcaaatggtgctgngaatatgaattccttctatagtcagcaag

SEQ ID NO: 9859 - DNA, 814 bp, Gossypium raimondii
  misc_feature (774)..(774): n is a, c, g, or t
  Predicted polypeptide sequence is orthologous to G274
cgggatatgcgattggttactatttttaaaaaatggcattgaaaccgaattcaccggatggtagaacaaggagttggcttcagatatttatcgtttttggattatgttgttttttctacatattaggagcatggcaacgaagtggtttcggcaaaggggatagcatagctttagagataaccaaacacggcgccgattgtaacatcatcccgtcgttgaacttcgaaacccatcacgccggcgaagtggggaacgtcggtgaatctgaaaagatcaagtcttttcagccctgccctcctcgttacgttgattacacgccttgccaagatcaaaagcgtgccatgactttccccagggacaacatgatctatcgggagaggcattgtcccagggaggaagagaagttgcattgtcttgtcccggcacctacaggatacgtgaccccgtttccttggcctaagagtagggactatgtgccttatgctaatgctccctataaggccttgacggtagagaaggctattcagaactggatccaatatgagggtaatgtattcaggttccctggtggaggaacgcagttcccacaaggcgcggataagtatattgatcagcttgctgctgtgatcccgattacgaacgggactgtaaggactgcacttgataccggttgtggggttgcgagttggggggcatacttgtggagtagaaacgtccttaccatgtcgtttgcaccaagagattcacatgaagcacaggttcagtttgcccttngaagaggtgttcctgctgttattggtgttcttgggaccat

SEQ ID NO: 9860 - DNA, 896 bp, Gossypium raimondii
  Predicted polypeptide sequence is orthologous to G274
gttctttctttcttcctttcttctggcgtactttgggttcccactctaatcatggtatccaagcacaatccatcgggcaacaaaaaacggagcccactatctatatttgctgttattggtttgtgttgtttcttctacattctgggagcatggcagcgaagtggttttggcaaaggagatagcatagcattggaagtaacaaagcaggcagactgcagtatcttcacaaatttgaactttgaaacacatcacaacgatgtagagattgttgagccttccaaaccaaaagctcaggtgtttaagccgtgtgatgtaaaatacactgattacaccccttgccaagagcaagaccgagccatgaagtttcccagggataacatgatttaccgggaaagacactgtccccccgaagaagaaaaactacactgtctcattccagcacccaaagggtatatgacaccatttgaatggccaaagagtcgtgactatgtccattatgctaatgttcctcacaaaagcctaacagttgagaaggctgtccagaactgggtacagttcaaaggaaatgtgttcaaatttccaggaggaggaacaatgttccctcaaggtgcagatgcgtatattgatgagcttgcctctgtcatcccgatagcagacggttctgtcagaacagcattggatactggttgtggagttgcaagttggggtgcctacatgctgaagagaaatgttctggctatgtcttttgcacctcgggacaatcatgaagcacaggttcagtttgcactggagcgaggtgtgcctgctgtaattggtgttcttggatcccattaatctccatatccatcaagagcatttgatatggctcagtgttctcgatgcctaataccatggac

SEQ ID NO: 9861 - DNA, 654 bp, Gossypium raimondii
  Predicted polypeptide sequence is orthologous to G274
gaagaaaaataaacttgtttattggcattcatcactatgctttcttggatcttgacataattatttgggcagctacccaaataatggaaaaaaacactatttcctcccaaaatcacactcaggattacaagctaacataattgggtatattctctacatagtgaataacacaatggagcaacttaagtatctttttgagggttgttgatcggaactcttcagtccctctgtctgaaccaacttcaccatcagttcgagattttaacctttgctttttagttttaccttgaaatacttgacctgttgatgttggtttattcagcactggatggactgtttcctttgataacaccaacccagtactgtttaactgcaactaaaattttctctggcacaaggggaccatcctcgtgatcattcatcttggggtcccatctcatgcctccagcaattttcctaaccttgtttaggacatcgacatcatcccggaatatcacagccccttcaggccgtaaaatgcgatccatttccagaaggatgtcttcaaagctacacttatcttgatacaagctaaagacaccattagcatgaataagggcatatgttcttggatacgtaaagaaaccttcgcaccagtcatgatatattccaatt

SEQ ID NO: 9862 - DNA, 769 bp, Gossypium raimondii
  Predicted polypeptide sequence is orthologous to G2982
aactaacattcgttaaaaaaaaaacattaaaaaacctaacatgtaatccctaaactcaaaatatgggtatgtggacctgtcgattgaaaattccaccttcattcccccatacccaatattacacttctcaaaagcctaacaacaaaaactaaacccttacacaaataaaatttccctcttttccacaaccttccttcaaacctctccaagccttgaaaccccctctggctccaattttccacaataaaaacctcctctttcctcacttccaaagtgattttcttttttattttttttatttgaagtcatagaaacaaacagatagaaataatatattattttgggttggaagctactattactgattatcctcattaacatttcttgatgtcaagcacccatttttcattaaggtatggtaagtggtagtaaccatattcaaaaccataaccaccatgaaaatggggagaaaaacccaactttgggaggagcttctaggtcgtggggcacgaccgtttccggtcaatccgtttcgactagtggtagtgttggctctccctcgagccggagcgagcaagctatggctacaccagctagtgagaatactttcttaagattgaaccatctcgatattcacggagatgatgctggatctcaaggtgccgttggtaaaaagaagaagagaggtcaacgtgcagttgcaggtgataagagtggcagagggctccgccaatttagcatgaaagtttgtgaaaaggtggaaagcaag

SEQ ID NO: 9863 - DNA, 870 bp, Gossypium raimondii
  Predicted polypeptide sequence is orthologous to G2998, G2999
gtatccttaaccctaaactccaaccccccacctccaaattcctttccctcgtttctctttgcttctccctcgctaattacagatgtttacaccctgcttagatggtgtggtaatggcgtaaaagcggtggcctgactctgccgtttcctcatctctttcttaaaactctcgttgaaatttggggtatgggtcgagggattttggcaccataatgctgaatacatgaatatctgaggaggaggaggaggaagagataagggaaaccaaccatatatcctagataagctacgtacttgcatcttctcttttatgaaatgcttcaagttgcacacaaaagcacgggaaaacaaatctattattagttgaactttgagcttgtttagcttggataaaatatcataaaaaagtttgcttcttttttttgtttttcaaccaactactccttaaattatggaagtgagaggccaagaacatgatattaaaacgccagggtcttcagcctttggtcttcactcgcctggagtagagagaagaaaagatgggaaccataatggtacggccgttctcacttgcactcaaaccctagatcatgttcatcatctccagaggcagcaatcactcggtcaagggagatccccacatccggatcgagtcgctgccgccactggtgctgcagctgttgctcccatttcagttggttcaaacgcaaagccgtccaacttcgtcagataccgagagtgtctcaagaaccatgccgccagcatcggcgggaatgtgtacgatggctgcggcgagttcatgcctagtggtgaagaaggaacactcgaggccttgaaatgtgctgcctgtgactgtcatcgcaactttcat

SEQ ID NO: 9864 - DNA, 863 bp, Gossypium raimondii
  Predicted polypeptide sequence is orthologous to G309
ggtatgcaatgggcgcagctttaatgccagtacttgcattaagacacggtggaccaccggcgtttcgaccgaccggaattggaccgcctcaaccggataatactgatgcgttgcaacaagtggggtggaagctagctcaattggccgaacgcatcgggatcgaattcgagtttcggggattcgtggctaatagtttagccgatctcgaacccgaaatgctcgatattcgtcctcccgagattgaagtagtagcggtgaacgctgttttcgagcttcatcccttgttagctcgaccgggtgggatcgaaaaagttgtttcctctattaaagcgatgaaacccaagattgtcacggttgttgaacaagaagcgaatcacaacggtccggttttcttagaccgttttactgaagctctccattattattctacccttttcgactcgttggaaggttcaggggtggcgccaccgagtcaagacctggctatgtccgagttatacttaggaagacagatttgtaacgtggttgcttgtgaagggatggaccgagttgaacgacacgagccattgactcagtggagaactcggatggaaacggccgggtttagccctgttcatttgggttccaatgcttataaacaagctagtatgttgttggccctcttcgccagcggcgatgggtatagagtggaggagaataatgggtgtttaatgcttgggtggcatacaaggccacttatcgccacctcggcttggcgactcgctggtactgagtcaggtagtgagttaactcaggagctgagttgagaaaaagtaaaaaacctgttgaaaagaataagtggggtctatcttttaactgagttg

SEQ ID NO: 9865 - DNA, 873 bp, Gossypium raimondii
  Predicted polypeptide sequence is orthologous to G4
caatcaccaaaagaaaaatttgcaattaagccataattaattttgccctctaaatttctctaaaaaatctcctaaatcccatactttaaatccaattcgccatgtgtggaggtgcgattatctccgatttcattccgcctgcgcggtcgcgactggtgacggcgaattatttgtggccggatctgaaaaaatccggctctaaaaagcggtcgggtagaaagcactcgaagaagccggcggtcggctttgaagatgacttcgaggctgattttcaggtgtttaaggatgaggattctgatgtcgatgacttcgatgatgatgttgatgatgttttggctgatgttaagtcctttgctttctctgctacagagaaaccctctcctgctgtttctcatggttcaaactccataaaatctgtggaattcaatggtcaagctgagaaatctgcaaaaagaaagaggaagaaccagtatcgcggaattcgccagcgtccatggggtaaatgggctgctgagatccgtgatccaaggaaaggggttagggtgtggcttggaacttttaataccgctgaggaagctgcacgagcttatgatgctgaggcacttagaattcggggtaagaaagcaaaggtgaacttccctgatgagactccacgtacctctccaaagaatgctgctaaaatgaattcccagaaacctctttctgggtcaaatttgagttctgttcaatcaagtctcaacccagatttcagttactcaaacaaacatgagcagggctattatgataccatgggtttcatagaagagaagtcactaatggatcagtttgcatatgcagaccctgttagagctgctgtagatgatgggttaaaac

SEQ ID NO: 9866 - DNA, 825 bp, Gossypium raimondii
  misc_feature (796)..(796): n is a, c, g, or t
  Predicted polypeptide sequence is orthologous to G4
ttctaactctgtaaaatctgtggaattcacacctcaagctgagaagtctgcaaaaagaaagaggaagagccaatatcgaggaattcgacagcgtccatggggtaaatgggctgctgagatccgagacccgaggaaaggggttagggtctggctaggaactttcaatactgctgaagaagctgcaagagcttatgattctgaggcacgaagaattcggggtaagaaagcaaaggtgaacttccctgatgagatgccacgcacctctccaaaacgtgtgattaagacaaatgatgagaaaccacttcccatgtcaaatttgagccctgttgaaccaaatatcaaccagaatttcaattgcttgaacaaaccagagcaggtcttttatgataccatgggtttcgttgaagagaaggcaccaatggatccatttgcttatgtggacactgttcctgctgctgttgatgttggattgaaaccctttggccaatctgacaatacccccttgtatttcagctcagaccagggaagtacttccttcgactgttctgacttcggctggggagaacatggtgcaaagactccggaaatatcatctgctcttgaagctactatggagggtgatgattttctggtggatgcaaaccctaagaagaagctgaaaccaagctctgagaatgttatgcctattgaggacaattcagcagagagtttgtctgatgagctactggctttgggcgatcagatgaagtacccatttcttgagggcaactgggatgccacccttgatgcgttactncatggagatgcaagtcagtatggtggagc

SEQ ID NO: 9867 - DNA, 795 bp, Gossypium raimondii
  Predicted polypeptide sequence is orthologous to G4
gaaacaaatagcagagtttaaaacattcatatgtttttcagtattcaaacataaacaaattcagacacaattacttatacagtcactcaaatttaaaatttagtccaaagtctacaaaaaaacacataaaaaaggggtacatactaaaaacctctgaaagcagtgcaggcaaggcttaagcatgcatatagcttggtttttacttcaacttcacaacagattttgaccaaattctaacatgttgctttatttacaaacactagttattatggaaagttcgctcagaaaacaccctcctccatggtagggaaatcatcaaagttccaaagatccatcgggtttccaccatcctgtgttgcatctccattgaggaaagcatcaatagtggcgtcccagtttccttcaataaatggcggcatttggaagtatttcatctggttgtccaaagccaacagctcgtccgacaaggtcttcgcggagttgtcttcggcaggcataacattgtcggaacttggtttcagcttcttgctagggttagcatcctcaagaaactcatcaccctctacagaagcttcaagaatggatgatatttcaggagttttggcaccctgttctccccagccatagtcggaacaattgatggagttacttccctggtctgaattgaagtacaagggggcattatctgattgattaaatccagcatctatagacataggaacagggtccacgtatgcaaactgattgaccgatggcttctcttctacgaaacccatggtatcaaagtattcctgc

SEQ ID NO: 9868 - DNA, 690 bp, Gossypium raimondii
  Predicted polypeptide sequence is orthologous to G409
gattggtattttttttttattacttaattcataattattagtacaagaagtaataatacacaaacaacatcctatatttatttatgtatgtatgtaacatatagatgtgtaacttaataagccgaaaaccagaaagcatgatcttcaacatgaaatccataactacaagaacttgcagggggggcggagtaatcattgtcttccaattttgggaaaatgtaaaaagatggttgaaacaaagccttactcaagttatcttcctcatcttgggatgtatcaaactgatctggttcgaatggataaaatgaatgagggctgtctgaatcaacaggcttttgggggggttcttgacacactgggttcacatccgataactctgagttgttcttttctttcataaccaacttatcagtaagctgaagaacctcctgtttaagtttatctttctctttgaggagattaccataatcatctttgagggtattaaagctagcttggaaagtgtcatagtctttttcaagctgcttagtcttccatcgagcacggcggttttgaaaccaaatggcaacttgacggggttgtaacccaagttctttagctagttgagttttcctttcaggttcaagtttgttttcaacctccaaacttttctctagaaactggacttggtcaacagtgagtcgtcttttc

SEQ ID NO: 9869 - DNA, 697 bp, Gossypium raimondii
  Predicted polypeptide sequence is orthologous to G409
ctttttttaaaacccaaacaacatcatatatttatttatggatggatggaacatataaatgggtaacttaataagccgaaaaccaaaaagcatgatcttcaacatgaaatccataactacaaaaacttgcagggggggcggagtaatcattgtcttccaattttgggaaaatgtaaaaaaatggttgaaacaaagccttactcaagttatcttcctcatcttgggatgtatcaaactgatctggttcgaatggataaaatgaatgagggctgtctgaatcaacaggcttttgggggggttcttgacacactgggttcacatccaaaaactctgagttgttcttttctttcataaccaacttatcagtaagctgaaaaaccccctgtttaagtttatctttccctttgaggaaattaccataatcatctttgagggtattaaagctagcttggaaaggggcatagtctttttcaagctgcttagtcttccatcgagcacgggggttttgaaaccaaatggcaacttgacggggttgtaacccaagttctttagctagttgagttttcctttcagggtcaagtttgttttcaacctccaaacttttctctaaaaactggacttggtcaacagggagtcgtcttttcttcccggggtgatgaaaatactcatcaagatcttcctctccattctcttcttc

SEQ ID NO: 9870 - DNA, 858 bp, Gossypium raimondii
  Predicted polypeptide sequence is orthologous to G450
caacgttatcatatattcccccctcctacttcctatttctctagcaaatacactatcaagagagagagaaaagagagacattttgtgacgaaaaaaaaaaaaaaaggaaaaggactaaagttggatggttgtagggttttgcacgtaaaagctcgtgtttaatcatcataatgactagcattatgggcacagaggatgataagtatagcacgattaacttcgaagagacggagttgcgtttagggttgcccggcgccaacggaaacgacggtgaaactaccaaaaacaacggaaaacgagggttctcggagaccgttaatttgaagcttaacctttcatcaaaggagactgtagccgaggattccgagaagatgaaggagaagagctcaactgaccctgcaaagccacctgccaaggcacaagtggtgggatggccaccagtcaggtcattccggaagaacatcatggccgtccaaaaagccagttccgaggaggaaggtggcagcaagaaggccggaaacagtgcagccgccactactaccaccacggctgcggcgtttgttaaggtcagcatggacggtgcaccttatctacgcaaagtggacttgaaactatacaagagttaccaacaactctctgatgccttgagcaaaatgttcagctccttcactattggtaactgtgggtctcatggaatgaaagatttcatgaatgagagcaaattgatagaccttttgaatggttctgagtatgttcctacttatgaagacaaagatggagattggatgcttgttggagatgttccatgggagatgtttgttgattcgtgcaaacgcttacgaattatgaagggatctg

SEQ ID NO: 9871 - DNA, 856 bp, Gossypium raimondii
  Predicted polypeptide sequence is orthologous to G450
ctaaaccttcctatattcctattcctcttcttatcatcactctctcaatcctttgcttattacaacaaaacctttttcttctttatttttcacctttcagttcaaatcatcaaacccagaaagcgtggctacaacaaactgcaaaaaaaaggaaacaattagagaaagaagctatggaagttggcttaaagatgacgatgaaaggaggcggaggagatcatgttggaggttgcgacaaagagaagatggggtttgaagagactgagctgaggctagggttgcctggtggtggtggtggtggtggtgacggtgaagttgtgaggaaaagaggcttctctgaaactgttgatttgaagcttaacctttcctccaagcaagacacctctgggatcgatcccaatgatgagaaagtgaaaggcttgcaccaggagaagaatcttctcctttctgccattgatcctgctaagcctcctgccaaagcgcaagttgtgggatggccaccggtccgatcattccgaaagaacatgttagccgccaccacacagaagagcagcagcgaggagagcggcgagaaggcggcgctggtgaaggtgagcatggacggtgcgccttacctccgtaaggtggacttgaggatgtacacaagttaccaccaactctccgatgctttagccaaaatgttcagttcttttactatcggaaattgtggatctcaaggaattaaggatttcatgaatgagagtaagctgatggatctccttaatggctctgattatgttcctacctatgaggacaaggatggtgactggatgcttgttggtgacgtcccttgggagatgttcgtcgaatcatgcaa

SEQ ID NO: 9872 - DNA, 865 bp, Gossypium raimondii
  Predicted polypeptide sequence is orthologous to G519
cgcgtagaataccaaagaagtttgtagcaattaacaccgagagcgagtgtgaaaaagctcaaaaactacgtttattaccttcaaggtgaaaagttcaaaaaatgacagcatcggagttacagctgccacctggattccgattccatccaaccgacgaagagcttgtgatgcactatctttgccggaaatgtgcatcgcagtccatcgccgtgccgattatcgctgaaatcgatctttacaaatacgatccttgggaccttccagatttggcgttgtacggagagaaagaatggtattttttctccccgagggataggaaatatccgaacggttcacggcctaaccgggcagctggttctgggtactggaaggcaaccggagctgacaaaccgattgggcagccgaagccggtcgggattaagaaggctttggtgttttacgctgggaaggcacctaaaggagagaaaaccaattggattatgcacgagtatcggttagctgacgtggaccgatcggctcgcaagaagaacagtttaaggttggacgattgggtgctttgccggatttataacaagaaaggcgccatcgagaaacagccaccgcaaggaagcattggcaaaagctctgccgtgacggagatcgaagacaagaagccggatatagcgacacttggcgtggacacgcgccagctgcccccgcctcctacggggctagttaacgattacgtgtactttgacacgtcggagtcggtgccgagactccacacggactcaagctgttcggagcacgtggtgtcaccggagttcacgtgcgaggttcaaagcgagccgcaatggaaggactgggggaagtgccaccaacacca

SEQ ID NO: 9873 - DNA, 853 bp, Gossypium raimondii
  Predicted polypeptide sequence is orthologous to G653
ctcctctctctctctctctctctattttgtttgataaatacccagaaaaccctttcagtcttctagctctcaatttctttttcttttttaccttcttatttcatagatccagggtgctcttcttcttagttcacattggcatagataaaggactgtacggtcagatctaagccgtattctagcaatgtcgtttaccggtactcagcagaaatgcaaggcttgtgagaagactgtttatccggtcgaacttttgtcggctgatgggatcccttaccataagtcttgcttcaaatgcagtcattgcaaagggacactaaagttgggtaattactcctcgatggaaggtgtcgtttattgcaagcctcatttcgagcaactgttcaaggagtcggggaatttcaacaagaatttccagtcacgtatgtatttttttttcctctcggtggatggaatcctttatttggtttcttgatagttttcgtgtttcgttggtttttaatttgccttcggttttgttttcggcagctgcaaggtcagctgagaagttaactcctgagctggtaaaatctcccttgcaaacaccggatgtgtttgatgtttcgattaattgggaaaaattcgttatagtgtgtcataatgtttttgctaactcctaatagctcgtgttaatttcagacaagatcacctagcaaagccgccagcatgttttccgggacacaagaaaaatgtgctacttgtggcaaaactgcttatccactcgagaaggtagcttttgagatccattaaatcattagatgagaaatctatatattttctgcaattgccggactccaattttctggttatctatatg

SEQ ID NO: 9874 - DNA, 848 bp, Gossypium raimondii
  Predicted polypeptide sequence is orthologous to G707
gatcgtactaagcgccgccacttcggtttcgttgccggtgtcaccgcaacggcttttcgatttcctacgcgacgaacggttgaggagcgagtgggacatattgtcaaatggcggacctatgcaagagatggcacacattgccaaaggccaagatcatggcaattgcgtttccctcctgcgtgccagtgccatgaacgcaaatcagagcagcatgttgatattgcaggaaacatgcatagacgcagcagggtcgcttgtagtgtacgcgccagttgatattccagccatgcacgttgtcatgaacggtggtgattccgcttacgtcgcacttttaccttcgggattcgccattgtcccggacggtcctgggtctcatggacctatctctaacggacatgttaacggaaacaccggcggagggtcgtcgagagtcggtggatcgcttctcacggtagcttttcaaatattggtaaacagtttaccaacggctaaactgaccgtcgaatcggttgaaacggttaataatctgatttcgtgtactgtccaaaagatcaaagctgcccttcaatgcgaaagttgatgactcagtgagttgggtaattttagttattaatataggttttggttgtggttaaagagtgcgactcagtaagttgggacgagtgggggtattgagtcaagaacgaaccgcgcgtggagaattattgtatggtgatgatcaaagggacaagggtggtggttcgggtattgactcaagtcgaccctttgagttggctcgccgggaccagaaaagaaagtcaaaactcaaactgcgtcgtatttggtgtactaatccaatttctctttcc

SEQ ID NO: 9875 - DNA, 884 bp, Gossypium raimondii
  Predicted polypeptide sequence is orthologous to G8
ctttgttcttatgttgatgtgcagacgaattgtatctgagtaaggaagaattcgtgcacgttcttcgtcggcagagtgctgtgttttcgagggaagctcgaaatatctaggagtaacgttgcacaaatgcggcaggtgggaagcacggatggggcggttcctaggcaaaaggtgagatacttgttcctaggcaaaaggtgagatacttgtttaaggaaatttaaatttttgcagtcaacatgctgtcatttaggagtatggatgtaaaatgatttgagtgcctcttggtgttgaactgagaatcggtttttcttgaacggattctcagtgggattgttgtttggttttttctccttggatgggaaaaagaaaaaaaaaaatttctaagatgcctatttcaaagaggaaaaataattggggatggtgtttcatggtggggattacgatgcttgcgtgcaggtatatttatcttgggctattcgacagtaaagtagaagcagcaaggtcctagtgatcatgaattactctacctgatactgaatttattaccctgaattctcaacctcaatagggttccatccaacacttgtctaccttttgattttttctggaaatcagggcttatgacagggcagctatcaaaagtaatggacgggaggcagtcaccaactttgagctgagtacatatgaaggggagatggtctttgataccaggaacaaaggcaatagtcacaaccttgatctgaacctggggatatctccgcctgttagcgatggtcccaaggaaaaggaaaatgcggggcatctccaaatgaataacggagagagttttaagggtaacttttgaatcgattattttgaatttacttgtatgtttcatcaca

SEQ ID NO: 9876 - DNA, 888 bp, Gossypium raimondii
  Predicted polypeptide sequence is orthologous to G896
gttcgaatcgatggcacgaagagaacgatccattggttgtgggagtaacatgttggtttcacccgaggcacgagtcgttcgttgttcccagtgccacacccttaccaaccttgtcccaatcaatgctcgaccaggccgaaccaggtataatgggctgccgagaatgcatgaaaacccatacgggaacggcccaagtccgcaacatccacaatatccacaaccgcgaccatccttatctccagttccgatttacgggagaaaacgagcacttctttgtggtgtgaattaccatggaaagagttataaactcaaaggaagtatcaatgatgtcaagagtatgaagtaccttcttgtggagacattaggatttcccaatgattccattttaatgctcacagaaaatgaaagggagccttcaaagatcccgacaaaacagaatatccgaaaggctttgaaatggctggtctatggatgccaaccgggggactcgttggtgttccatttctctggtcacggcactcgacaaaaagattacaaccatgacgaagtcgacggatttgatgaagcattgtgccctcttgatcacgaaaccgaagggaacataatcgacgacgaaatcaacgacaccatcgtaaaaccgttgactcgaggaaccacactgcacgcgatcatcgatgcctgctacagtggaacagtcctcgatctccctttcgtttgcaggatgaacaaggaagggcgttatgcgtgggaagatcaaagaaatcccttatttaacaagcgtacaagtggaggattagccttttgttttagtgcttgtgatgatcatcaaacctctgctgataccactgctttcacaggaaccaatgtgagaaccggcgcgatgacata

SEQ ID NO: 9877 - DNA, 857 bp, Gossypium raimondii
  misc_feature (58)..(58): n is a, c, g, or t
  Predicted polypeptide sequence is orthologous to G896
caggcccaacgctaattccacctccttcttttcttcttcttcatcattagaaattccncttttttccccaaataattttttttaggaattaacctttgagattttgaataatgtatccgccgccagggccaggaggcatgtactacaattacccgccgcctatgctggtcaactgctccggctgccacacccctttgcagcttccgcaaggtgcccgatccatccgttgtgccatctgtaaagccgttaccaacatcgctgaccctcgatccctccctcccgcgtcccaaccacctgctccttccacccacgcgcctccttctccctccccttacaatcatgctcctcccggggcacctccccacgcccacggtcgaaaaagggcggtggtctgtgggatttcgtatagatactcgaggcatgagctcaaaggttgcatcaatgacgccaagtgcatgcgttaccttctcgtcaacaagtttaagtttcccgaggattccattcttatgctcacagaagaagaaactgatccctacaggcttccaacgaagcataatataaggatggcattattttggttagtacaaggttgtcaacctggtgattctctgttatttcactattccggtcatggttcacggcaacgaaattacactggtgatgaagttgacggctacgatgagactctttgccctttggattttgaaactcaagggatgattgttgatgacgagatcaatgcaactattgttcgacctctacctcatggtgttaggcttcatgcgattattgatgcttgccatagtggaactgtattggatttaccattcctttgtagaatgaataggactggacag

SEQ ID NO: 9878 - DNA, 853 bp, Gossypium raimondii
  Predicted polypeptide sequence is orthologous to G938
gagattgatgtggatgaacttgagagaacgatgtggagggacaaaatgcgtctcaaacgacttaaagaacagaacaagagcaaggatggggtcgatattgtgaaacagagacagtctcaagaacaggcgaggaaaaagaagatgtcgagggcacaagatgggatattgaagtacatgttgaagatgatggaagtgtgcaaggctcaaggttttgtttacggaataatcccggagaaaggaaagccggtaactggggcatctgataatcttcgggaatggtggaaggataaagtcaggtttgatcgtaatggtcctgccgctattgccaagtaccaggctaataattcgattcccggcaacaatgatgggtgtaacccgattggtccaacaccacacaccttgcaagaacttcaagatacaacgctcggttcccttttgtctgcactgatgcagcattgtgatcctcctcagaggcggtttcctttagagaaaggtgttcacccaccgtggtggcctactggtaacgaggaatggtggccgcatctcggattgcctaaagatcaaggccctcccccttataagaaacctcatgacttgaaaaaggcttggaaagtcggggttctcacagcagtaatcaagcacatgtctcccgatatagccaagattcgcaagcttgtaaggcagtctaagtgcttgcaggacaagatgactgcaaaggaaagtgcaacatggcttgctatcatcaaccaggaggagaccttggctcgagagctttaccccgagtcctgcccagctttgtcctccgggggaggaagtggatctttggttataaatgactgcagtgagtatgatg

SEQ ID NO: 9879 - DNA, 858 bp, Gossypium raimondii
  Predicted polypeptide sequence is orthologous to G938
caaagtcaggtttgatcgtaatggtccttctgctattgcaaagtaccaggcagataattcgattcctggcaagaatgatggctgtaactcgattggcccaactccacacaccttgcaagaacttcaagatacaactcttggttctcttttgtctgcactgatgcaacactgtgatcctcctcaaaggcgattccctttagagaaaggcgttcccccaccatggtggcctactggaaatgaagaatggtggccacaactaggattgcccgaagatcaaggccctcctccctataagaaacctcatgacttgaagaaggcttggaaagtgggggttctcacagctgtgatcaagcatatatctcctgatattgccaagattcgcaagcttgtaaggcagtccaagtgcttacaggacaaaatgacagcaaaggagagttcaacttggcttgccatcattaaccaggaggaagccttggcccgagaactttaccctgattcctgcccacctttgtcctcaggtggtggaaatgtatctttggttataaatgactgcagtgagtatgatgttgaaggtgttgaggatgagccgaacttcgatgtgcaagagcgcaaacccaggactatcagttctaatttggtcatggagagaatgagggctatccaacaaccaccttattcgactaagggggaagttgtcagtaatttggatttcacgcgaaagaggaaaccatccaatgatttaaacatggttgaacaaaaaatctacacttgtgaattcctccagtgcccttacagtgaatttcgtttgggttttcatgataggactgccagggacaatcatcaattgacttgtccata

SEQ ID NO: 9880 - DNA, 863 bp, Gossypium raimondii
  misc_feature (12)..(12): n is a, c, g, or t
  Predicted polypeptide sequence is orthologous to G993
ctcttttcttcncaccttttgaaagacaaacatttaaaaaccaaccttgttcaactactgcatcctctgcctatatctttttcctgtttgtacaacccaaaagaaagaaaaaaacaaatggatggaggctgcatagccatagatgaaagcacaaccagtgattccatgtccatatccatatcctctcttttacctcccgttaccaaatatcccgactctctctgccgagttggaagtggaaccagcgtgattgtggaatctaaagctgaatctaaaaagcttccttcttccaagtacaaaggcgttgttcctcaacccaatggccgatggggtgctcagatatacgagaaacaccagcgtgtctggcttggaactttcaatgaagaagatgaggccgccaaagcctatgacatagcggctcaaaggtttcggggtcctgatgccgtcactaactttaaacacctccaagaaactgaggaagatggcatcgaaatggccttcctcaatacacattccaaggctgaaatcgttgacatgttgcgtaagcatacttacaatgatgagcttgagcagagtagaacaaggagatgctatggcttcgacgggaatgggaaacgtgtggtaggaaacgaggctgtgtttggctcttttggtgccgaagtgaaagcgcgtgaccagcttttcgaaaaagctgtgaccccaagcgatgtggggaagttgaaccgactagttatacctaagcagcatgcggagaagtacttcccattgcaaagtggaggtgcttcttccaaaggagttcttttgaacttggaagacgtgactggtaaagtttggaggtttaaatattcctactggaatagtag

SEQ ID NO: 9881 - DNA, 575 bp, Malus x domestica
  Predicted polypeptide sequence is orthologous to G1006, G22, G28
cttctcaattccacacacacacacacactctctctctcttcttttttgttagcctagtcatccaaattaaggacaaagctaacaagcaaagatggaagaacaacctcagcactacacaagctgctgctcattgacggtgaacaatattagcagtccatgtatgatgccgtgcttaacgcaacaatggggagatttacccttccaagtcgacaattccgaggacatgatcgtctacaactccgttcatgatgctcttagcctgggatggtctcccgaccacactttacccttccaagtcgacgattgggatgacatgatcgactacaactcccttcacgacgctcttagccccggatggtctaccgaccactcctgggaatgtgtgaaacccgaacagacgtatgatcttgatcatgtttttggacaaagtcatgatcagctgccacctgatgtttgcactcaatgtgaaccccacgattgtaatgttcccattaatggaaacgaaccctgaccaaccctagtactgccacctgatactgatattgctacgatggatcatgacgatcgtgatcaaa

SEQ ID NO: 9882 - DNA, 666 bp, Malus x domestica
  Predicted polypeptide sequence is orthologous to G1033
ctcgatggaccggatgacttcccacaaatatctctctactttttatgtctttggtttcttagcttgaacttgctttagccacactactctctctctctctctctcctttcccctgttgcgttcgcttctctccaaaaccaagagaaatcagtctgttgagaatgaaggcttccaaaggcaaaggacctgtgaggaaggacaagaaagaagtattaaagcctgtcgaggacgtaaaggtgggaaaacgaaaggcggcgattgaggctgacaagagccgccgaaaacttgccaagaacgcaaaattgggcaagaaggaccccaataaaccaaagagacctgcgagcgctttctttgtttttctagaagagttcaggacggtttacaagaaagagcatccgaatgtgaaagctgtgtcagctgtggggaaagctggtggagaaaagtggaaatctatgtcacccgcggagaaagctccatatgaagctaaagcagcaaaaaggaaaacggagtatgaaaaacttatgaaagcttacaacaacaaagaggatgagacggaggatgacgaggaagaagttgctgaaaagtcaaaacccattgcgaaggttgttgaagaagaagagagtgccgaggaagacgatgaagaagatgatgacgacgatgaagatg

SEQ ID NO: 9883 - DNA, 631 bp, Malus x domestica
  Predicted polypeptide sequence is orthologous to G1033
caaaaacaagggcgtagtttactctctctctccgcgtcttcgtcttgttctcgaaaaccctaggtaaccttgcgcctccgccgctctgactcggtccgaatcgagcagtttttgaccgtttccgaacgattctcgccggttcccaccgatttttgaccttttttgtgtggttgcaggttcgccatgggtaaagccagggctgctgcccccaaacgcgatacgaagttgaagagcaagagtgccggagcgagcaagaagccggcgaagaaagccggaaaggatccgaacaagccgaagaggcctgcgagtgccttcttcgttttcatggaggacttcagagagaagtacaagaaggagcatccaaacaacaagtcggttgctgccgtcggtaaagctggtggcgataaatggaaatcgttgtcagatgccgagaaagctccctatcaagccaaggcagacaagaggaaggtagaatataacaagaacattcaggcatacaacaagcaattagctgatggaaataatgaagctgatgaagaagagtctgacaagtccaagtctgaggtaaatgacgatgatgaagacgaggacgagagcggcgaggaggaagacgatgatgagtagagagtag

SEQ ID NO: 9884 - DNA, 681 bp, Malus x domestica
  Predicted polypeptide sequence is orthologous to G1033
aaaaacaaaggcgtatttgctctttctctctctgcgtcttcgtcttatttccttctcgaaaaccctaggttcgccatggggaaagccagagcagctgctcccaaacgcgatacgaagttgaagagtaagagtaccggagcgagcaagaagccggcgaagaaagccggaaaggatccgaacaagccgaagaggcctgcgagtgccttcttcgtcttcatggaggagttcagagagaagtacaagaaggatcatccaaacaacaagtcggttgctgctgtcggtaaggctggcggtgagaaatggaaatcgttgtcagatgctgagaaagctccttatcaagccaaggcagataagaggaaggttgagtataacaagaacattcaggcatacaacaagcaattagctgaaggacctaatgaagctgacgaagaagagtctgacaagtccaagtctgaggtaaatgatgatgatgatgaggatgaggacgagagcggcgaggaggaagacgacgatgagtagagcaacgggaattgaatggagggggagaagcgatatgtgtagggttgcttagaagataattcaaaggcctgcctgcaccttttcttcactatgggataagttgctggctctctaccttttgttttaggggttagtttttaggaaaacacaaaacaaaatcgg

SEQ ID NO: 9885 - DNA, 572 bp, Malus x domestica
  Predicted polypeptide sequence is orthologous to G1033
acaaccaagggcaaattttacacacgcacaccgcaccaaaacaaagcaaacgacccaaaggcatatctctctcattattctccatctctgtctctgcgtcgtcgccttatcctctcccttcaccaaaggtttagctgaatatggggaaatcaagagctgctgctcccaaaaaagccgatgcaaagttgaagaccaaaagcgctggcgcgagcaagaaggcagcgaaggatccgaacaagcctaagaggcctgcaagcgccttcttcgttttcatggaggatttcagagtgaaatacaagaaggatcatcctaataacaaatccgtcgccgctgtcggtaaagctggtggtgataaatggaaatcgctttcagaggctgagaaagctccctacgttgccaaggcagagaaaaggaagaccgagtacaccaagaccatgaatgcgtacaacaagcgcatagctgagggaggcaatggagcggaggacgaagagtctgataagtccaagtccgaggtgcaaaacgaagacgaagatgatgacgagagcggagaggaagaagatgatgatgagtaa

SEQ ID NO: 9886 - DNA, 476 bp, Malus x domestica
  Predicted polypeptide sequence is orthologous to G1033
gaaggtagaatataacaagaacattcaggcatacaacaagcaattagctgatggaaataatgaagctgatgaagaagagtctgacaagtccaagtctgaggtaaatgacgatgatgaagacgaggacgagagcggcgaggaggaagacgatgatgagtagagagtaggggaatcgaaatggaaggggagaggcaatgtctgtagggttgcttagaggataattgaaaggtctgcctgcactttgtcttcaccatggataagttgctggctctctacttttgtttttagggattagatttaggaaaaacacaaacgaaaatcggattaagtttgaagattgtctgctcccctcgattcccatatcgttgtctttgtacttaatgatcctccttatgttcaatgaatttcagtttgctttcgtaacataatgctttcgttagtttcttattatgcaaaaaaaaaaaaaaaaaatcggt

SEQ ID NO: 9887 - DNA, 484 bp, Malus x domestica
  Predicted polypeptide sequence is orthologous to G1033
gttgccaaggcagagaaaaggaagaccgagtacaccaagacaatgaatgcgtacaacaagcgcatagctgagggaggcaacggagcggaggacgaagagtctgataagtccaagtccgaggtgcaaaacgaagacgaagatgatgacgagagcggagaggaagaagatgatgatgagtaaagaaggaaagccggaaatcgaatgaaggagaggagcaattcgtggttagggttattggttagaacatatcgaatgacctgcattttctgattaaagctttgtgtctgatgataagatagctacatttttaggattagggaaggaaagggaaaaacacaaggggttatgtttcgggactcatccacctgattccccatatcgtttctgtacttaatgatcgtttttatgttcaaattacttctgttttgctctaattagtatcccttttattaaaaaaaaaaaaaaaaaaaaaaaaaaaaaaaaa

SEQ ID NO: 9888 - DNA, 490 bp, Malus x domestica
  Predicted polypeptide sequence is orthologous to G1033
ttatctctctcattgttctctctctcgccttatcctctcccttcacacaaaggtttagctgaactaggggaaatcaagagctgctgctcccaaaaaagccgatgcgaagttgaagaccaaaagctctggcgcgagcaagaaggctgcaaaggatccgaacaagcctaagaggcctgcgagtgccttcttcgttttcatggaggatttcagagtgaaattcaagaaggatcatcctaataacaaatctgtggccgctgtcggtaaagctggtggtgataaatggaaatcactttcagaggccgagaaagctccctacattgccaaggcagaaaagaggaaggctgagtacaccaagaccatgaatgcttacaacaagcgcatagctgagggaggtaacggagcggatgatgaagagtccgataagtccaagtctgaggtgcaaaacgaggatgaagatgatgacgagagtggagaggaagaagatgatgac

SEQ ID NO: 9889 - DNA, 751 bp, Malus x domestica
  Predicted polypeptide sequence is orthologous to G1048
ctccacctccgctcttagtccacctttagcctttaggattatcattagattagatatttcaactgcttctttgtttatggaattggacgctgatgttggatttctggatgaaatcgattgggatctttggttagacgacgcctctatttccaatggattggatcatgtctttcagttgccaaatccacccgtcacggcgaccggttcaacgccgctgccgccgtcatcatccacttcgccatcttcaacggtggaggagcctgagcctccttcgaacccatccccggatttgctcggcgcgatcgagaccattttgatgaaagacgactactacgaccaatttttggcagatgcactcgtcaactcgccgctcaccgatgacgccgacgacgatcctatctccaagaaaaggagaaggcagttgagaaacaaggatgcggccgtgagatcaagggagaggagaaagatgtatgtgaaggatctggagattaagagcaagtattttgaagctgaatgcaggagactgggcaatttgctccagtgctgctacgccgagaatcatgctttacgcttgagtttgcagatgaacaatgcatatcgacaaggacatggtggtttggcctcaaagcaggagtctgctgtgctctttttggaactcctgctgttgggttccctgctttggtgcctggacatcatgtgcctccttgctctgcctcgaactctatgaccctgctgctacatcccctgaaaa

SEQ ID NO: 9890 - DNA, 598 bp, Malus x domestica
  Predicted polypeptide sequence is orthologous to G1048
cgttgctgtcgagtccacctttagcctttaggattatcattagattagatatttcaactgcttctttgtttatggaattggacgctgatgttggatttctggatgaaatcgattgggatctttggttagacgacgcctctatttccaatggattggatcatgtctttcagttgccaaatccacccgtcacggcgaccggttcaacgccgctgccgccgtcatcatccacttcgccatcttcaacggtggaggagcctgagcctccttcgaacccatccccggatttgctcggcgcgatcgagaccattttgatgaaagacgacgatttcgacgccaacaaggttcctttggcggaatcgggacccgctaacaacgactactacgaccaatttttggcagatgcactcgtcaactcgccttccactgacggtgattccagcgctttccccgattccgacaaagacaaattcgaccgctcgccgctcaccgatgacgccgacgacgatcctatctccaagaaaaggagaaggcagttgagaaacaaggatgcggccgtgagatcaagggagaggagaaagatgtatgtgaaggatctgga

SEQ ID NO: 9891 - DNA, 585 bp, Malus x domestica
  Predicted polypeptide sequence is orthologous to G1062
gtcgatgatctgagtttcgatggttcgggtttgaactatgattcggatgagtttactgagaacactaaggttgatgacggtgccaagaatggtgggaacagctcgaatgcaaatagcacggttaccggtggaggagggggtcataaggggaagaagaaagggttgcctgccaagaatctgatggctgagaggcgccgccggaagaagctcaatgataggctgtacatgctgagatccgttgttccgaagattagcaaaatggacagggcctcaatccttggggatgcaattgagtacttgaaggaacttctgcagaggatcaacaacctccacaatgaactggagtcaatccctcctggatctgcattgacacctaccggaaatactttccaccctttgacacccactccggctactctgccaaatcgtatcaaggaagaactttgccccagctcattacctagcccaaatggccaagctgcaagggttgaagttaggctgccagaaagacgagcagttaacatccacatgttctgcggccgaaggccaggtctcttgctctcaaccatgaaaactttggataac

SEQ ID NO: 9892 - DNA, 572 bp, Malus x domestica
  misc_feature (451)..(451): n is a, c, g, or t
  Predicted polypeptide sequence is orthologous to G1076
aaggaaaagagaggaagaagatgaagaacaacaacaaagaggttcagaaaagaaaaataaataaaaattaaacatgagaagtggtactaggtagaaccaacaagaccaaattaagttgcaaaacatgggcgtgatgttaacgatgatagctagtccaggaaatttgctaaccttttatctccaacaaagctcatctcatccagtatgcacttaacctcccacaacgcacgcagaagcagcttcgaatctaaattgattaaggttctaaaagtaaacatcgatgatgatcccacagaaaatcagaatagtggacgaccccctgagttatttccatttccagcccacccatcgattggcaactgaacattctgcatattcaatggcaaattgaagaatggaagccccgaggacgggtcaggaaaagggttgtttccaacactaccaccaccgncgccgccaccacttcccccggatccctgtgggacctgtacttgcaactgttcctcttcatccaaaggcagcctctcataagcaacattagtaaacgatgaggcgatcacaataacgggccc

SEQ ID NO: 9893 - DNA, 662 bp, Malus x domestica
  Predicted polypeptide sequence is orthologous to G1076
ctctctcctcctccttgcacctctctctcctcaactcgtacccttccctttctctgcacttgatcccctttgttttctattcgttctagggtttgaaattatggggctctcctttctccaaaacccataaaatattgaatcttgctatattaaaatttttacatatattttactatatttttcttgttttctgttctctttagctctctgtgtatggctggcttagacttgggttcagcatctcggtttgttcatcagcagctccaactccctgatctccacctccaaagaccgccggactccgaagatgaccacaccacccccaaccgcaacaatcttttctcctctgaccaccaccaaaatgatgttgataatgacaatcctcatcatcaagggtttgacctggtgaccccaaatcctggttcgggtgattccggcggccgacgctccagaggtcggcccccagggtctagaaacaagcccaaacccccagtgatcataactcgtgagagcgcaaacaccctaagagcacatattttggaggtcagcagtggctgtgatgtgtttgattccgtcggcacttatgcgaggaaaaggcagcgagggatttgtgttttgagtgggagtggtatggtgaccaacgtgagcttgcgtcaaccgtc

SEQ ID NO: 9894 - DNA, 622 bp, Malus x domestica
  Predicted polypeptide sequence is orthologous to G1078
caccagaggagtgtgagttttataggaaaattcattgctcacttccttgcatgggcgatgtgggactcgcccaatgggggaaaaaatcaaaatttcggccgaaattttacacccactttaaacggccataactttgtcaaaactcaacgaaatcaagcaagacaaaaacgaaagttgtagccctcgaagagatgaagagaatggtacctcacacgatgtctgaatcgtagtggtttggccggaaaatgcctcgaaaatcactgaggtcgctgaggtcgtcggaaactgggtaagattcaaatgagtataactttttcaatacgcaacgaaattgagtgaaacaaaacgaaaagttgtagccctcgaagagacaaagagaatggtacctcacacgatgtctgaatcgtagtggtttggccggacaattcctcgaaagtcactgaggtcgctgaggtcgtcggaaactgggtaagattcaaatgaatataactttttcaatacgcaacgaaattgagtgaaacaaaaaggaaagttgtagccctcgaagaaacgaagagaatggtacctcacacgacgtctgactcgttgtggtttggccggaaattgcctcgaaatctactga

SEQ ID NO: 9895 - DNA, 628 bp, Malus x domestica
  Predicted polypeptide sequence is orthologous to G1136
ctctggatctttggtgtggctgactggaagccatgagcttcaattctacaactgcgaaagagcaaaagaagcacaaatgcatgggattcaaaccctagtctgcatcccaacccccaccggagttctcgagctgggctcttcagatttgatccgagaaaataggaacctggttcagcaaaccgaatccttattcggctcggatgtcgtttggggccaacccgaccctggaaccagatcccccatcgatataatcaaccgaaacttctccttcgccgacattggcatcatcgccggcgtaggggaagaagacgacaaaaaggaagttgccttggacataacggcgatgaagaagaagtgcggaaaagcatgtccggatcttgtccagttgtcgaatttgaatagccttaacccggaacattcggattcggagtttccgaaacggacgccgaaaaagcgagggcgaaaaccggggctggggagagacacaccgttgaaccatgtggaagcggagaggcagcggcgggagaagctcaaccaccggttctacgccctgcgagcggtggtgccgaacgtgtcgagaatggacaaggcgtcgctgctgtccgatgccgtttcgtacatcaacgag

SEQ ID NO: 9896 - DNA, 418 bp, Malus x domestica
  Predicted polypeptide sequence is orthologous to G1136
cgagttcagtgtccggactgcgattaccctaatgctagattgatgaatgcactcaaagacctggagttacaagtttatcatgcaagcatatcaagtgttaaagggttgatgcttcaagatgttgtagcgagagtgcctcagggtttcacaagtgaggaggccctgagaattgctattataaatagatggtacaactagaagttacaattcaataattagtttcccttgctaatgaggaatgattttgggtattggtgacgaactcattcttttttccttgttatagttgtaactcaaaattgaagatgtgtccgccaagttttaggagggaaatatgcgtaaattagttatgtattggattgttttccaagtccctaaatgttggttcttcttgcaaaaaaaaaaaaaaaaaatgctg

SEQ ID NO: 9897 - DNA, 649 bp, Malus x domestica
  Predicted polypeptide sequence is orthologous to G1136
agattctacgcgctccgagcagtagtcccaaacgtatcgaaaatggacaaagcgtcgctgctcggagacgccatatcctacatcaacgagctcaaggtgaagctgcagacggtagagacggataaagaggagttgcagaagcaattggagtcgatgaacaaggacttgcccagcaaagattcgaggtcgtcgggttcgaccgtgtcagagcacgaaatgaaagggtctagcagtaaattgttagacatggacattgacgtgaagataatcggaagggacgccatgattcgaattcagtgttgcaagaagaaccacccggccgcgaggctaatggcggctctcaaggagctcgacttggaagtacaccacgccagcgtttctgtagtcaacgatttgatgatccaacaagccaccgtgaaagcgggtagccggatttacacgcaggatcagctccggttagctctacattccaaagttggcgatgcccgccagatttgacagtccatccggtaacattatcctatgcgatccgatccgatccgatccaattggtggtttagagcgatgggacattttaaggctcccagaaatgcagagagctctgctctgtagtctgtaatatagttattctacgacgtcgtacgtcgtc

SEQ ID NO: 9898 - DNA, 403 bp, Malus x domestica
  Predicted polypeptide sequence is orthologous to G1146
aattttttggccacgtatcacaaatgtggtagccacgtcagtatttaacgcattaattgatggaaaaagctaacggatgtattatattgaaataaaatagtacttgaggtatgaaagtgaaatgttttaaagatgttgtatagggttgtaatagacctcaaacttgaggggttactatgtaatttacccaataaaaaatcatacctagacctctctcccctccgcctcattcctccccaccaaatgcctccgtgtctgtaaccacagatggactaattttctacgttaaataaaatttacaaacaaaaattaacaaatttttaattgataaatgaaatttttttagtttgaacaaaggatcttttttatgctgagagtgtgagagtaaactatgctttacaat

SEQ ID NO: 9899 - DNA, 682 bp, Malus x domestica
  Predicted polypeptide sequence is orthologous to G1146
gatttgtttctcgagtgactctgtgagttaattgcttgctactgctcctgctgctgctgctcagtgagtttaaatggctggttggctgttgtggaattagtgtttaaatcttttggaaattgagtgaaaaaaactagaagggaagtaaagcattgtgtttctgtgcaatctggcgaaagcttcatcgttttgaacgaatgcttctgcaaacatgcctataagaaagaaagagagctcggagcaacaccttgtgatcaaaccccacttgcagaacccagtgaacccagttcagaaggcaccgaaaactgcccaaaatggcaaaggtccaccaccccaggaatcccaaaaagccaaaccccataaccaaacttcacccccaacaaaaaacagaggaagaagaaggggcagaggtggtcggaagtctgatcaaggcgatgtttgtatgaggcctagttcgcggcactgcacggtggctcatctgcctgcctcaccaagcttgggtggtgctgcttctgtagcgaatgctccaaatgggtatggcggcaacttagtttccatggatatggggtttccgacttcaagcaagtcattgagctttgctcctcggcctggttatggacaagttgggatcaagtgtgttgtgaaggccaaccatttctttgcagagttaccagagaacgac

SEQ ID NO: 9900 - DNA, 672 bp, Malus x domestica
  Predicted polypeptide sequence is orthologous to G1146
aagttgcatcgaaaaagatcaacaaagatgtcattaagcagctcgtaaaactttacaaggagtcccacctgggcaagagaatcccagcttatgatggcatgaaaagtatttatacagcagggcccttaccatttgcctcgaaagagtttgtggtaaagttggccgagagagagggttcggctgttgctgctcgttcatttttgagggaccaagagttcaaggtcactctcaagttggctagcaaacccgacctgcatcagctgcaacagtttctacgaagccaacaacatgagtcgcctcaaggcgtacttcaagttctggatgttgttcttagggccacaacttctgaaaagtacactgttgttgggaggtctttttttgacgttgagcttgggcagaaaggtgattttgttgagggtctggaatactggagaggcttttaccagagtctaaggatgactcagtttgggcttgcactcaatatagttgctgaatacagtgaaagagcattcgaattatgaattgatacggacgaatcgattcggtggtaattttggtggtttaagattgtacttttcaaaagtcggcaaaatcagaggattaagatcatacctttgaaattttttgttttgaactggggaggagaacgcagagctgctctctgctgttctt

SEQ ID NO: 9901 - DNA, 596 bp, Malus x domestica
  Predicted polypeptide sequence is orthologous to G1146
ttcggagctgatgtgactcaccctgaaaatggagaagattccagtccccaattgctgctgtcgtagcttcccaggactggcccgaagtgaccaagtatgctggattagtttgtgctcaagctcacagacaagaactcatacaagatttgtataaaacatggcaagaccctgttcgtggcacggtcagtggcggcatgatccgggatcttctggtttcctttaggaaagcaacaggacagaagccactaaggattatattttacagggatggcgtaagtgaaggtcaattttatcaagtcttactatacgagctcgatgcaatccggaaggcatgcgcttctctggaaccaaactatcaaccaccagtgactttcattgtagttcaaaaacggcatcacacacgaatatttgctaataaccatagggacaggagcagcgtagacaagagtgggaacatattacctggcaccgtggttgatactaagatttgtcatccaaccgaacatgatttttatctctgcagtcatgctggtattcaggggacaagtcgcccagctcactaccatgttctctgggatgagaataactttactgct

SEQ ID NO: 9902 - DNA, 419 bp, Malus x domestica
  Predicted polypeptide sequence is orthologous to G1146
ggaatcaggaaaaaacaatttcagaaaaccaatgttcgaatcccactcatgttcgtaccaatggaaactgagcgagtgcaccttggacacctgataaacatacgattacaaagttagaaaacattaagttctcttcaaattggcgtcgtacaagtgcaaaagccagagtaaaaattgaaattaatgtctgcttacgtgtagcataggttgttcgttagcatctgcaatgcatctggggttgttctcatcatacaggacactatgatgattgcaccccatattttgtaaaagaaatgtcacctttttatgtatattattgtgctcttcaattatgtaaattgtaaagcctattctaacttgttttatgcaactattttcgtaaaattttgtaattataaaaaaaaaaaaaaaaaatgcgt

SEQ ID NO: 9903 - DNA, 598 bp, Malus x domestica
  Predicted polypeptide sequence is orthologous to G1146
cacgaggcattgagtttgtcaatgagctgctcaaccgagacatttcatctagaccattgtctgatgctgatcgtgtgaagataaagaaggctctgcgaggaataaaggttgaagttacgcaccgtggaaatatgcgcagaaaatatcgcatatctggtttgacatcgcaggcaacaagagaactgaccttcccactcgatcagcaaaatactatgaaatcagttgttgagtactttcatgaaacctatggcttcatcattaagcatacccagctgccttgcctacaagtgggaaatcaacaaaggtcaaattatttgcccatggaggtttgtaaaattgttgagggtcagaggtactcccggaggctgaatgagagacagattactgctttgcttaaagtgacctgtcagcgtccttacgaaagggaacatgacattatgcagacagttcgtcaaaatgcttaccacgaagatccttatgctcaggagtttgggattaaaatcagcgagaatctcactttggttgaagctcgcatccttcctgcgcccaggcttaaatatcatgatacaggcagagaaaaggattgcctgcctcgagg

SEQ ID NO: 9904 - DNA, 660 bp, Malus x domestica
  Predicted polypeptide sequence is orthologous to G1146
tacgagggtttttcattagttcccttgtaatatatccacctcaaaatattctggttcttaactttgaaccaaaatccatttccttcacaagacttgtttcataagcccccataggacacaaaacttacaaccaaaaccatcgcggatgagatgagcgatttaaacgtccgtcttccagacgataaccaaaatataagattaaagtcttgtgcaacttttagttcatacgaccttgacgaaacacaactactagaaaccgccgccagcgacaaaacggacctctacaaaacactagtcgaaaccaatgccaccaaagaccaaacggagctcaagactgattcagcagtagaacataacttctttcacattttcttttatctcaggtagggcacggaaccgcacaccaccagaacccccagctgtagatccggtagtagaacctccatctgagtactcgccttcaatgtagtatcttgcacggaaggcagccaagtgagcatagtaagcagcctcgtgccgaattcggcacgaggtctctctctaaaacttcatctctctctctctctctctctctccccctaaatctgccgatctactctgcgccgaaaccctagaaccgaaaatgcgtgagatccttcacatccagggaggccaatgcgg

SEQ ID NO: 9905 - DNA, 713 bp, Malus x domestica
  Predicted polypeptide sequence is orthologous to G1146
cgaattccgttgctgtcgacgaaacatgttttcagaatgagtaaacaatacttggcaaatgttgctttgaagataaatgtgaaggttggcggaaggaacacagtgcttgttgatgcactgtcaagacgtattcctttagtcagtgaccgtcctactataatttttggtgctgatgttacccatcctcatcctggggaggattcaagcccctcaattgcagctgttgtggcctcacaagactggccagaaatcaccaagtacgctggcttggtctgtgcgcaagctcatcgccaggagcttatccaagatctcttcaaaacttggcaggatcctcagaggggcactgtaactggtggaatgattaaggaactgctaatttcgttccgtagagcaacaggacagaagccacagcgcatcatattttacagggacggtgtcagcgaggggcagttctaccaagttctactatacgagcttgatgcgattcgtaaggcttgtgcttccttggagccaaactatcagccacctgtgacttttgttgtggttcagaaacgtcaccacacaaggctgtttgccaacaatcatagtgaccgtaatgcagttgacaggagtggaaatatcttacctggcacggttgtggactccaaaatctgtcatcccacagagtttgacttttacctctgcagccatgctgggattcagggtacaagccg

SEQ ID NO: 9906 - DNA, 455 bp, Malus x domestica
  Predicted polypeptide sequence is orthologous to G1150
atcgcccaccctctgctttttattctaacacaggaagcaacagaagcatcatcgtcatcctcagcaagaagagattaaagagtcaaacacctcaacccttgttcagttccttcccaattttctctctctacaactttctctctctaaaatccatctctttcctcgtggaatcgcaaactttcagagccgcgcctctttgcaatcccaaatctttttcattaatttattacggttttgtccccaagtcttcgctttttttttttattttttattttatacccattgccataaaaaaccctagcctcactcgctgcccgaaaccccaattcgcgaagttcctctcccgtctggaaattggtattttgttcaaaaccctagctttgttttctgctgcaatttatggtgattttggtgttagaatcgatgatttggaatgcgaatttgttgcagtacca

SEQ ID NO: 9907 - DNA, 535 bp, Malus x domestica
  Predicted polypeptide sequence is orthologous to G1198, G1806, G558
attgccccactggttctgataatgtcgcggactacatgggccaaatggcaattgctatgggaaagctggccacacttgagaatttccttcaccaggctgaccttttgagacagcaaactctgcaacaattgcatcggattctgaccactcgccaagcagctcgtgcccttcttgtcatcagtgactacttctctcgcctccgagcactcagttctttatggcaagcgcgtcctagggactaatgttgttcactatcagctcgaccgccccaccttaggacctacaaaaaagttaggtatttccccccttattagtaaaccagctctagtgctgagaccatgaagatggttaaccatcaaaattgcagattcgggcttttcggacccccttttttttttccttatgatgcttttcgaaacgtcgaggattaggaaaggtcgactggtgattacctagcatgtaattaaggtaaaagaatatgtcctctttagcataaatggatggatgtatactcaaaaaaaaaaaaaaaaaatcg

SEQ ID NO: 9908 - DNA, 489 bp, Malus x domestica
  Predicted polypeptide sequence is orthologous to G1198, G1806, G558
gctcaccaatcttgaaggcttcgttcgccaggctgataatttgagacaacaaacccttcatcagttacgtcggatattgacagttcgtcaggcagcgagatgctttcttgtaatcggagagtactatggacgattaagagcacttagttctctttgggcatgtcgaccgcgagagaccatgataaacgatgataactcgtgccaaacgacaacagacctgcaaatggtacaaccttcacagaatcatttctcatccttttgatcaaaccccattagccagcagagagctactttttagaagaagtccttgatccattattgccggtgctggatgcttctagcttgattaagctactttagaagagataggacatactaattttttctttcttattttctattttctactttttatgtcttcatgtaactacgttatcttgtaaatgcaattcaatattttctgtgcaaaaaaaaaaaaaaaaaatgcgt

SEQ ID NO: 9909 - DNA, 703 bp, Malus x domestica
  Predicted polypeptide sequence is orthologous to G1198, G1806, G558
cacgaggggattggtggcttccgctcatctgagctccttaagcttctggtgaatcaattggaaccattaacggagcagcaactggtgggtatttacaacctgcagcaatcatcccagcaggctgaagatgctctgtcacaagggatggaggcattgcagcagtccctggctgagaccttggccagtggctcacctgcgccatcagggtcatcggggaatgttgcaaactatatgggtcaaatggccatggccatgggaaagctaggaactcttgaaggtttcctccaccaggctgataatcttcgacaacaaactttacaacaaatgcatcgtatactgactactcgacaatcagctcgtgcgcttctcgcaataaatgattatttttcgcgtcttcgagccctcagttctctttggcttgccaggcctagggagtgacatgcattagattcctctccctgaagttcatccttaaagctagctagtcccggaacataaattagcaccatgaagccgagggccatacgatatatatgatggactttagccgtttggacatcaatatccttcaagggtgtgattaaggtgcgtgaagtcagattaacgttcatagtcaccatcaaagttgtcggttgttgtcacgcatgtttgcgtagatgtattctatgttcagaactgtagtatgaataatctgacgatgtta

SEQ ID NO: 9910 - DNA, 605 bp, Malus x domestica
  misc_feature (506)..(506): n is a, c, g, or t
  misc_feature (524)..(524): n is a, c, g, or t
  Predicted polypeptide sequence is orthologous to G1246
agagaggagccgtggtggtccctcccggaccgcctggatcccacgagtgaatagaaagttggatctacattggatctcacctgaatcgccccatctatcctcctgagtagaagtttggtttcaaaccccggttcgaacaggagaagtacgccatgctaatgtgccttggatgatccacatctcagggtcaggcgctgatgagcacattgaactatccatgtggctgagagccctcacagcccaggcacaacgacgcaattatcaggggcgcgctctaccactgagctaatagcccgccgtgcgggcctcccgctgggggcccgctatgccaaaagcgagagaaaccccatccctctctttccttttttacgcccccacgtcgccacacgggagggacatggggacgtaaaaaaggggatcctatcaacttgttccgacctaggataataagctcatgagcttaagtcttacttcaccgtcgagaaacgaaagaagacttccatctncaagtttaactcagacgnagctcgcttctttttgggtgtgaagcagtgtcaaaccaaaatacccaacaagcattagctcttcctgaaaaggaggtgatc

SEQ ID NO: 9911 - DNA, 670 bp, Malus x domestica
  Predicted polypeptide sequence is orthologous to G1272
gagatgttgttcctttgcatgtggaagcagataacattcctgaacctgttaagaaaaaacctgctcgggtccctattgctaggcgtggccttggaaccaagggaacaaaaatacccttggtcacaaatcacttcaaagtgaatgttactaatattgagggttacttgcttccattatagtgtttctgtcgcttatgaagatgggcgtccgcttgacggcaagggtgctggaagaagaataattgaaagggtgcatgagacataccactcggagttaggtggaaaggactttgcctatgatggggagaagagcctgtttactgttggatcccttccgcgcaacaaacttgaattcgccgttgttttggaggatgtgccatcaagcaggaacaatggaaactgtgaacctgatggtcctgggagtccaaatgagagtgaccgaaagagattacggcgtccaaatcgctccaaaacatttaatgtggagatcagctatgctgcaaaaattcccatgaaagcaattggagatgctcttcgtggtcaagaatcagagaattctcaagaagctttgagagtcctggatatcatattaagacagcatgcatcgaagcaaggatgcctcctagttcgccaatcattcttccataatgatccaaaaaatttgcggatgt

SEQ ID NO: 9912 - DNA, 681 bp, Malus x domestica
  Predicted polypeptide sequence is orthologous to G1272
tgctaggcgtggccaaggaaccaagggaacaaaaatacctttggtcacaaatcacttcaaagtgaacgttactaatattgagggttacttcttccattatagtgtttctgttgcttatgaagatggccgtccccttgatggaaagggtgctggaagaagaataattgaaagggtgcatgagacctatcagtctgagttaggtggaaaggactttgcctatgatggagagaagagcctgtttactgtgggttccctaccacgcaacaaacttgaatttgccgtagttttggaggatgtgccatcaagcaggaacaatggaaccagtgaacctgatggtcctgggagtccaaatgagagtgaccgaaagagattacggcgtccaaatcgctccaaaacattcaatgtggagattagctatgctgcaaaaattcccatgaaagcaattggagatgctctgcgtgggcaagaatcggagaattctcaagaagctttgagagttctggatatcatactaagacaacatgcatcgaagcaaggatgcctcctagttcgccagtcattcttccataacgatccaaaaaattttgcggatgttggaagcggtgttcttggatgtagaggattccattcaagttttaggaccacccaaggtggcttgtctttgaatattgatgtatcgac

SEQ ID NO: 9913 - DNA, 702 bp, Malus x domestica
  Predicted polypeptide sequence is orthologous to G1272
ctttactcaagtggaaggccgtgttcttccagccccaaagcttaaagtgggtaacggagatgatttcttccctcgaaatgggcgctggaatttcaacaacaagacacttgtgaagccaactaagatagaaaagtgggctgttgtcaacttctccgcacgctgtgatctaaaagcccttgtccgcgatctaatcaaatgtggtgatatgaaaggaattaaaatcgaggctccatttgatgtgtttgaagagaatccccagtctaggcgtgccccacctttggttagagttgagaggatgtttgaggatatacagtccaaacttcctggacaaccacagtttcttctctgtttgctgccggagaggaaaaattctgctttatatggtccatggaagcggaagaatcttgctgagtatggtattgtgacacagtgcattgctcccacgagggtcaatgatcaataccttacaaatgtcctgttaaaaatcaatgcaaagcttggtggtttaaattcattgttggcagttgaatattctccttctatccctgtggtttccaaggctcccactatcatccttgggatggatgtgtcccatggttcacctgggcagtctgatgtaccttcaattgccgcggtggtcagctccaggcagtggcccctgatatctcgctacagggcatctgttcgaacacaatcccacaa

SEQ ID NO: 9914 - DNA, 400 bp, Malus x domestica
  Predicted polypeptide sequence is orthologous to G1273
cctaattctggactcgtaaagaatctaatgaatgaagatgacttgagcgcctcatatgcaattgattctctggtatgaatattttcttgattactatatattatgatttgttgccaatattctttatcttcttctattcgatttttaactggttcttagggaaaaattgttttagtgtagagcggttagtaaatctttatcattgtagttgtattatttttttcaaaaaatgtaaaggcagagcaagatgaacagattggctctgtactgcctgcccaggtggaatacagaaaatgataggcatgcaaaagttgtgtcaaacttcctttattccaaaacgctctcaatatcacatagcattctgccacttgacatttaacagtaaaaaaattatttggac
